United States Patent 8,781,750 (CELL-TYPE-SPECIFIC PATTERNS OF GENE EXPRESSION) - sequence listing, part 40

SEQ ID NO: 37660 - DNA, 13933 bp, Homo sapiens
ggggcgaagccgaggaagagcgttttggggacgggggctggtgaggctcacgttggagggcttcgcgtctgcttcggagaccgtaagggtgagtgaactagcgcactctccgcagcgggcgggatcccggcgcctctcctgtgggctggaggcttgggctcaagatgagaggcaggagtagtctgggggcgcgggctgggcccccaggccgtctcgggacgcttaaccggctaggagcacggcctgtctcccggggcggaagcctgtgccccaccgggggctctggagccagacggggccgactgggcagatctccgcccccttccctggtccctaggggcccgaggatcggcctgtgggaccagctgtgtcgggtggacactgctcctggcccggcccaaaagcagcgggccggaagccttactctccctctgctccttgttccctctctcggggagaccacaggtcctgtcgggcccggcgggggaagctgatctcctgttgtattccctctctgggcatggccatccacccgggtgcccaagccagaattgggcatcattctcacttgcttcactcctttacccacccacatcgaatcccttgcaaagttgtcttggatacgttcattctccagtcccatccccctgccctacctagttcaggccaccttttcttctctggactacctcggtgtcttcctgatgatccctgcatctcttcttcatcctctgtagtttgttctatacagagaggctacagccatggtcttaaaacagaaatctgatcatgtgaccagaagcgtccccccattcccttatcaccctttggtggattctcattgctcttccaagctcttgaacggggcttgcaaagcccttcatgacctgtcttcctttaactttagattcatttgtctcgactgtactgtgtcttcaaccatactgaatcttttttggttcttagatcagaacaagttccttctgggcttacatgttccttcagtatgttcgctatgtctgaggcactgtcctttggttgaaataatccttcttatcctttatgtgttatttcaggtgtcagttggggatttcgtggtaccccatgggtgtctgcctgccggtctctcttttctaccaggttgtaatctgtgtgagaggagtttgtcgaggtcatagtactatcttcagtaccttgtgctgttagtacggtcattaaatgtataaatgcagcatgggtgctccttgggctccctagatgaacaaatagatcaagttattaatattaaatgcctgctttttcagaaccaattctcaaccctcagtccgtgtagaggtttctttagcttaggaagttggttattttcttgccttcattccaggaccatgacaggggtaagtgacaaagtactggtcagtttttctttggcattggctgtgggtacaggatgtctggatgttggtgagtttggctgctttgggtttgaattcttaaccaagggccccttgagggagaagctgctactagctgctggcaggaaggctggccccaaacttagtgctgataggactgatgacacaccaggaagaaagggttgggccaggtcaaaccactggaagcctccaaaggaagttccagcttaggctagatccgctgtgggatagggaacaatacacctaggtgccaagactcacttccctgattcagcgatgagccaggtcagctcagcagagatcagtaaggtaaatgagagccagaggagagagggtcctgactctcagagagggaggaaaagagaaaaatggaaaaggagaacaacctgtgatcgtatgttcaggtcaaatgagtgtgagaggctacagactgaggtcggatgagagagcaattggtcttggctggaagaatcctgaggtgacatttgaacctgtcctggaaggaagttggagatggacagatggaaccagtaggagcggaggctgtggtacaggaagaggctggcagagcaggaggggagcactgtgacagccaaggcactgggaggcgcactgctcctgatggtccagcactgccctcccaggactgaggctgcgccttgtgagggctgtctcaaggtatgggttgtgccctgaagtccctttgcagaaatttctcctccgttgggtttttcttcagcctggcctttataatttcctaaagaaggccagtgagctggggcttatcttcaggctgttagcccatggccttgagctaagtagttagagcatggatgatgcaacctgttatttgggtagagggagttgcttatgctttctcttgactgtcagcagtttaatttgttaggtggcagttagattccctgttttctatctttccctccctcgcctgccttctttcctttcttcctctctctctctctctttttctaattagagagggagtctcaccatgttgtccaggctggtcttgaactcctgggctcaagtgattcacttgcctcagcctctcaaagtattgagattacaggcataagccaccatgcccagcccgattccctgttttcagtgtaccacttggaggaattttttttctttatgtttatcgatttggcttttgttgcattccaatgattagaaacctgcaacagcaaaccaaaatgagacaagttcaaaatcagtgattcttggcctttatcccacctcccttaaagaagggatattttggactcatagttactacatgattaatcacttggttgctttttggtgttatctaaatagaatttcccccacccccaacacacacacaccaaattgatatactaagcatccaatcacatagttggaggaaatggtgccatgagttccatgatagatatctccaaaagaaaagtttcatcttcagttacagtgacattaaaaattggcagcatatctgcaaaggtggtaatccccccagctccccaaggaccatggcacacaggctaagaaccagcagcttctgttccaggcactgtgcctgatactgggaatgtggattcagtccaagtcctcttaaagcccatccagcaaggggcactgacaagtaatcaggcagtttttcaagaattcattcacacacaagaaaacaaaagaaaaaaaagaattaatttgcagctgtcatcagctgtggacgggagccttctgaagggaagcacttgggagcctgcaggacgaatacctacaccagacttggaattgaaaagacctcactggagaaagagacatttgatgtaaatgagtctgaaaggcttgggaggagcttgattcccttctctgatccttcctgtcccagaactctaagatgtgtggtcagaacaagttgttctgctatggcctaggcagtcactgctaggagtaacctgaaaccttgttttgtggtaccaggtacagtggcagtggccttgtcagggtctggacacgtttaaaaaatttttttgagacagtctcactctcttgcccaggctggagtgcagtggtgtgatcttggctcactgcaatctctgcctcccgggttcaagcaattcttgtgcctcagcctcccaaatagctgggattacaggtgcacgccaccatgcccagcaaatttttttttgtatttttagtagagacgcattttgccacattggccaggctggtctcaaactcctgacctcaagtgatccacttgcctcggcctcccgaagtgttgggatcatagatgtgagccactgtccctggccaaggtctgggcacttttatttggtaaaattggaagtgtagtttctgactgtttctgaattattttgtggagataagaattaaccggaaactccttttgtatccgatccatatagtattgggacaaaattatgggatagattacattgaatacatattcataaaaaatggtagcagatctcggctcactgcaggctccacctccgggttcatgccattctcctgccgcagcctcccaagtagctgggactacaggtgcccgccaccacgcctggctaatttttatttttgtatttttagtagaaacgggatttcaccgtgttagccagggtggtctcgatctcctgacctcgtgatctgcccgcctcggcctcccaaagtgctgggattacaggcacgagccaccatgccggctgaaaatcacaattctaatctcatgtctcaagataatctttgttattagtttgtgtaggaaatacacatttttattttacaaaagtgtattattctttattgcttttttgcagcctgttctttttcattcaatatatattgagcattctttcctattaagtatgacatattgcttttttttttttttaaactacagatataaaaggtctgaggtggccgggcacggtggctcatgcctgtaaccccagcactttgggaggccgaggcgggtggatcacctgaggtctggagttcgagatcagcctggccaagatggtgaaaccctgtctctactaaaaacacaaaaattagctggacgtggtgacatgcacctgtaatcccagctactcgggaggctgaggcaggagaattgcttgaacctgggaagcggaggttgcagtgagccaagattgcgccactgcactccagcctggcgaaagaacaagactctgtctcaaaaaaataaaaattaaaaaataaaaggtctgagacagattgcattttgatgtcactgtttagaagtagactagattctaggtgctttttagcaccctggaagtttcttcctttttttggtggtggaggacagggtctcactctgttacccaggctggagtgtacttcagccttgaactcctgggctcaagcaatcttcctatctcagcctcctgagtggctgggactataggggtgcactgctacgctcagctaattttttattttttgtagagatgggggtctgactgtgttgtctaggctgatctcaaactcctggcctcaagtgatcctcctgcctcagcctcccaaagtgctgggattacaggtatgaaccaccatgcctggcctatcctggaagttagacatcccagtgactattgtcccctttaaggagggggccatgggaagcaatactggtaatgggaaaaacggatttgggaaatttttctaagtgttgtagggtggcatactcacactttcagggttctgccctgagagccttttaggatgggtaagagggactataacacctctacctctcagccccaggcacaaagacagctacagcttctgagctgagccctgtgtgtagcatgtaaaggggatgaccagtgccttatggtttgtctttaccactgctggtttggggctgtggactacaattgacctgttagaaatccctggccttgttatctagcagaatctgttttgcctgttgggaagtgagtgttcggtcaggtcttttgtttttgtatgtaggtcacctggctgtccttcaccttcctttttgaggtcagtctgtcagccctaggacagaccaagactttccattgaatcaacaattattaaaggcctgcctgacccttggcgggtaatactggtggggttaaagttctccctgccctccaagagcttgctctgtagctgactgtcatcttattgaccacaattccaagtgtggccaaaccctgggagttcctgatggcatcctgatttctctgtaacttttctttccagtgcccgctcactgtagttacttgccactgttaccacccaggaggtacagaaccttgtccgctgccgcagaccttgatctgacccgccttaccactcccttggctaccatgctcctgcctctagtcttgcttttgccacttcatgccttccccactgtgctgccagatgagtcattctgaaaccaagctctgatctcacctcccattcatgaattgtaagtgactctcctgtctttctctgcaggagatgtcaagccctggcctagtgtgcaaagccctgtccagtacagcctgtctaggccttggagccacctctgtcctgtctgcttcctaccctctaggctgcagcccagctgaactacttgtagtttctttcccgcttgtgggcacctgccactctgctcccaccattcctgtggtccttcagtccctgcatatctgtccaggcccagctgaagtgtcaccagctctatcagccttctctgattttcctccactcggaggagatttcttcccctgaactcctagagggttttcgctttctctgataatctgatataacttgctggctgcctttcctggtgctcttgatagaaaatatttctttcaggggaccataacttctgggaggcaagaataatcttccagtcccttcaagctttcacgtgttgcttggcactctgcaggcacttcaggaaacctcgtgagccttcccctgccatttgagtgacttggagtgcccagggtcatcccacagtctcaaagcagagctggcattgggccgtgtttgacaagctctcttcctaaccttactgcttcatcaggtttcccaggatcataccatgtcaagccctgaacgaaacctttgctctgatgctctgccttcctcttctgtgtttcccatctcacagatattgatgaccatgagatccctgctcagaacccccttcctgtgtggcctgctctgggccttttgtgccccaggcgccagggctgaggagcctgcagccagcttctcccaacccggcagcatgggcctggataagaacacagtgcacgaccaagagtacgtattcagcccgggctgtggtccagtggcctccccatcatctgcagctgagccagcggcaagggcatgctcagtcctcctttccttcttcctgtttctatggctccttgacattcttcaaggatgattcttattccttattgccacctataagtcaggtattcttttttcatcattgtatcacaggtggaagatctttaggcccaaatggggcacattacttgtctgaatccggtctctcctttttttcaccacagacagacacacacacatacaaatagacacacaggtacacatacacagtcatagtagcagaatccagaaaatagctaaggtttcttgactataacaagaccttttttaaatcaacacattcaaacattgaatcatttgttgcagcttttgtcttgggccagttagcctcacgcattatactcggttatcctttgtttttaaggctgggtgcagtggctcacacctgtaatcccagtgctttgggaggctgaggcaggtggattacttgagcccaggaattcgagaccagcctaggcaatatagggaaaacctgtctctactaaaaaattgcaaaaaattagctggatgtggcagtacatgcctatggtcccagctacttggggggctgaagtgggagaatcaactgagcttgggaagttgaggctacaatgagccaagatcacgctcctgcactccagcctgggtggcagagtgagaccctgtctcaaaaaaaaaaaaaagttttaaaggacatatttttaaattgatggcctgaaaatgttataacaaaattctaataataaagaggaaagaataccctaatcctgccagcataacagatggtctatttgacttttcctgctcctctcaaggccttgtctatctctgtgtaatccttgagtgtggtctgccactgctggtgtttgtttttctgagctggaggaagtttaagatcttgaacttttcagagtccttaagatttcagcatgatcccagtatctgtcaattggcctgaacctgactgttgatttttaggcatatcatggagcatctagaaggtgtcatcaacaaaccagaggcggagatgtcgccacaagaattgcagctccattacttcaaaatgcatgattatgatggcaataatttgcttgatggcttagaactctccacagccatcactcatgtccataaggaggtaggtctggcagtggcttgggggactgtatcacagaaaggcttccctttgttaatttggtccccagtcttgttgacttgtgttgtccttatgtgccaagagtgctgcttctccactgggcatgatggctcgcatctgtaatcccagcactttgggaggccaaagtggaaggatcacttgagccaggagttcaagaccagccttggcaatatagtgagaccctgtctctacaaaacaaacaaaacaaaaattaaaaaattagccaggcctggtagtgcatgcccgtagttctacgtactcaggaggctaaggtgggaggattgcttgagtccaggatgtcgaggctatagtgagccataatcatgccaccgcacttcagcctgggcaacagagtgaggccttgtctcaaaaagagaaaaaaagaaaagaaaaaaaaaggtgctgctgcttctttctcttctgtgttctgcctctttctgtccaacgatccttcccgcaaaggataacttgctgaggcagaagtcccagggctgggcatttgtatctttaagtgctacaggcatttctgttacacaccagagtatgagaatcagtgcctaaaagacagaccgtattcaaactgcagagcaagggagaagttgtttaatggtgaattgacaccaagggattcagggacgtggcagtaattgagggcttgtgtgatactgtatggtgctccaaagtttctgaagccctttcaagtaggttagagatctcgttggatctttgcaacatcttgagtaggcagtggcaggcattgttaatacttccattttcagtggtgcatgcctgtagtcccagctactcatgatgctgaagtaggaggatcacttgaacctgagaggttgaggctgtggcaagctgcgatgttgccactgaattccagcctgggcaatagagcgagatcctgtctcagaaaacaaaaaacaaacaaaaccctcccattttctaggtgaagacactgaaatcaagatcttgtgccaggctaagcacagtggctcatgcctattatcccagcactttgggaggttgaggcaggaggatcgcttgagcccaggagttcaagaccaacctgggcagcatggtgatatcccgtctctacaaaaattagctggacatagtgatgcttgcctgtaatcccagctgctggggtgacggggtgggagggtagtggggaggaacacctgagcctgggaggtcgaggctgcagtgagctgtgatcgtgctactggactccagcctgggtgacagagtcagaccctgtctcaaaaaaaaaaaaaaaaaaaaaaaaaaaatcctcgtgcctccacatttaatgtcattccccttctgccacactgccctctatagagaggaagcaaggcaaagttagccaggtgagtgggattacattcgctgctaggagtgcaggtgaggtttgaaggcagcagggagcatgaatgattttgcacaggagaatggcattgtttagggaagatccttggttgtgggagacagactgaaggacatgaggagagactagtgttaggcggaggaattaggggtcagcagtcctggcagatgaggatagtggtggtgacaggagagggaatggtgaatgtgggagatgtggcaaaggaagaaccagccaaggatgtgaacagcctcagcccactaaccctgctcttggagcatgggaaatactttctcctcaaagatcataacaggttctgctcatcggcagtgccttcttcctcttgttttgatgccaacttgttgtccaattcgtcactgtttctattttatcaggcaaatttgtgcacagagctgaccctcaggaggactggcacttttccaattaaagaagaatgagccataatgaaacaaataagcaaaagcctattttgaagggccttcttttaactggcaaatgtaatttctaaactggattatgataaattgactcaataatacatattctctctctatatatctagattcctagaagtagccccatactccattgaaagtttttggacacatatgagcgtggatattttgttgttttgtttttccttttttttttttttttttttaataaacagtgccatgaaagaacatggatattttggacgttagttaagcacttcttccggtaaaatgcgcaactcatcattgtctaatttgtattttgtaggaagggagtgaacaggcaccactaatgagtgaagatgaactgattaacataatagatggtgttttgagagatgatgacaagaacaatgatggatacattgactatgctgaatttgcaaaatcactgcagtagatgttatttggccatctcctggttatatacaaatgtgacccgtgataatgtgattgaacactttagtaatgcaaaataactcatttccaactactgctgcagcattttggtaaaaacctgtagcgattcgttacactggggtgagaagagataagagaaatgaaagagaagagaaatgggacatctaatagtccctaagtgctattaaataccttattggacaagggcttgcttcaagcatctgtattagtctgtattaatgctgctgataaagacgtacccgagactgggaagaaaaagaggtttacttggacttacagttccacatggctggggaggcctcagaatcatggcgggaggtgaaaggcacttcttacatggcagcaagagaaaatgaggaagaagcaaaagtggaaacccctgataagccatcagatcttgtgaaacttattcactatcacaagaatagcatgggaaagactggcccccatgattcaattacctccccttgggtctctcccacaacacgtgggaattctggtagatacaatttcaagttgagatttgggtggggacatagccaaaccatatcattctacccctggcccctccaaatctcatgtcctcactattcaaaaccaatcatgccttcctaacagtcccccaaagtcttaactcttttcagcattaacgcaaaaatccacagtccaaagtctcatctgagacaaggcaagtcccttccacctatgagcctgtaaaatcaaaagcaagctagttacttcctagataccaacaggggtacaggtattgattaaagacggctgttccaaatgggagaaattggccaaaataaaggggttacagggcccatgcaagtccgaaatccagcagggctgtcaaattttaaagttccagaataatctcctttgactccaggtctcacatccaggtcatactgatgcaagaagtgggttcccatggtcttgggcagctctgcccctgtggctttgtagggtacagcctccctcctggctgctttcacggctgttgttcagtgcctgcggcttttccaggtgcacggtgcaagctgttggtggatctaccattctggggtctggaggacggtggccctcttctcacagctccactaggcagtgccccagtagggactctgtgtgggggctcccacaccacatttcccttctgcactgccctagcagaggttctctcccctgccgctgagagggcctctcccctgcagcaaacgtttgcctgggcattgaggcatttccatacatcttctgaaaactaggcggaggtttccaaatctcaattcttgacttctgtgcacctgcaggcttaacagcacatagaagctgccaaggcttggggcttccactctgaagccacagcccgagctgtatgttggcccctttcagccatggctggagtggctgggacacaagacaccaagtccctaggctgcacacacatgtcaggggctgccctgacatggcctggagacattttccccatggtgttggggattaacattaggctccttgctacttatgcaaatttctgcagctggcttgaatttctccccagaaaatgggtttttcttttctattgcatagtcaggctgcaaatttccaaacttttatgctttgcttcccttatttataagggaatgcctttaaaagcacccaagtcacctgttgaacactttgctgcttagaaatttcttccgctagttaacctaaatcatctctctcaagttcaaagttccacaaatccctatggaaggggcaaaatgctgccagtctctttgctaaaacataacaagagtcacctttactccagttcccaacaagttcctcatcttcatctgaggccacctcagcctggactttgttgtccatattgctatcagcatttggggcaaagccattcaacaagtctgtaggaagttccaaactttcccacattttcctgttttcttctgagccctccaaactgttccagcctctgcctgttacccagttccaaagtcacttccacattttgggtatttcttcagcaggtcccaatctactggtaccaatttactgtattagtccgttttcacgctgctgataaagacatacccgagactgggaagaaaaagtggtttaattggacttaaagttccacatggctggggaggcctcagaatcatggtgggaggcaaaagacacttcttacattgtggcaagaaaaaatgaggaagaagcaaaagcagaaacccctgataaactgatcagatctcatgagacttattcactgtcacgagaatagcacgggaaagactggcccccatgattcaattacctccccctgggtctgtcccacaacacgtgggaattctgggagatacaattcaagttgagatttgtggggggacacaaccaaaccatatcagcatcctttcaagaatattagataattggagctgagtactcaggaacttgactgtagtagaatactgctagtttcttaattttaattcacatcacctgaaaagtaaaacaacaggctttgccaagtggatgcttttcagtaacagtgaagtggagtgaataccaaatgtttgccctggtggttcctatctcttcaggcaaacatggtcagtattctgtaaagttcccctggcctaaatgattacttgctctgggcaagtggatatttattaggctatttcaaagccacagcataagaatgtcagcctagccacagagtctgagattctgagttcagcctagccacagagtctaagattctgtatcctctgacattttggaaatgatacactactggcttaagtgatgactctttcagattttcagtattttatacaactactgccacatccttatactttattgcttttctgtcttcttcaacctgggagagaccctgaatttgagtgtgttctctaatcaatagtggtttagctttcttttctatttcactcgtttctagggttttttatttgcagtttaggaactattaggaatgtcaggactttatcagcaggggtaaaactaccacctggcctagcctaagtaggaagtgaaaagataattcaccaaacaatgattaatcagatagaagttctagtcaagagggatattgttgaagttacctcttttagcctagatacatggattcttttcaaatcaggaaagattagaaaaggaacccaaaaaaccctttaacagtgtgaatctttatagtatttgaaaatgagaagaagcagcagattgtaatttggtttattggatgtgatggacgttctgtaatagaaaacctgaaacgatgattgaatgggaaaaagagactacaaaatttgtcgtaggatgtatacagacttattttctttattacagtattataagaaaacatatgtatttgtaaaaatggtttcctgtgtcaagtatttgtgcagtcagagctgacttgtaaactattcttgtaatagctcattattttgaaagatttatatatgatgaattctggatatatgaccaataaaactgatgaagc

SEQ ID NO: 37661 - DNA, 60615 bp, Homo sapiens; identical to SEQ ID NO: 37447

SEQ ID NO: 37662 - DNA, 385670 bp, Homo sapiens
cggcggccaggaaatgccgcagatgcgccgcgcagcatccccggtgaaggcagcgcgccggtcctcccgcaccgctgccgcggcctcggcccggcccgaagcacgcgcctcgtgcagggccagcagagcggtcagcgcggccgcagagggtccgggcgcccgccggcccccgcccgccctcgccgcacgccccgctcctccgcttggcgtggcgctgctcgtcgccgcccctgggctcgctgagatttgccgctgctgaaacccgagagggactcgggctcccggagccgggcggcccaccatcggcctgcccggaggcctgggcgtttcctttgccggccctggcgccggcagccccctgcgcccccgctctgcgtcttcggcttccgtgcttctccccagcgtgctgctccttcctcttttccagttcccaaggctgtgtcttgctgactgcgatactgtccgggggttacgagggggagaggggaatttgtcagtcatcgcttagataaacttcggcatggcgggttacctctcccctgctgcttacctgtacgtggaggagcaggagtatctccaggcctacgaggatgtcctggagaggtacaaaggtatgtggtccctgccctggggctgcggagcttggcactgatcagagaggcaaccgctgcctttccttaatcagagccaccactccttgggcacgagtaaacaggtgtctggaccagtcttgggaatggaccaggtctttttgcacgggatttagtacccccagcgcagggaggatggtggggtgggcgacagtccggagacgcccttagatgagcggtagagaggggggaagggggttgtttccaagaagcacattgcgttttctctcccttgtaaaagctcttaagcactacgcgtaatcataattcttcctgggagggtggataccgattattctctatgggattactaaggcattgctgctgctgcttggctagggtattggttagccctgtagaaaaggttcagcatcactagatcattttccttaaaatgatctttcttatttgataaagtttgtgactatatacttactctgatatattgtaaaaattattttatagcgtgatggataaaagactttagtgagtttgttgtaaatttaaatgtaaagaatgtattttgagatttttttctgcccatcctttatgttcaggaaattctatgccaatctgatatttatgttttagtataatgtttacttggacttcatagttgaatataatgatgaaatacaaattgcagctgtccattttttaagtgtttttgtgtctggaaatgtatttttaagtgtgtgtataccatctttttattgtggctcccaaaacactccgaactcaagagcagctcacagaggtttaaagtatttatagtgaatagtgacccatttcataggtaggattcagatggttttatatcttttgaatatttgctttgggtttggtaactcaatgtcagtaatttcagtggtattatatggttaatgatgcatgtagtttttctattagtagaaagtagaaataaaaaaaaattgaactaaacaataaaattccaaagccccaaaaagcccaaatacactcacaattgttttctctctttgtaggatatgttttataaccgaaattcttgcaatccttgtagaattttgtaaacagtacaatgagaattcctttgtgccaagactcttattgtgtataatactgccactgagcaagtgcagtgatattttaggctaaagcacatttgtgacatttgtgtgtgtgtgtgtgtgtatgtgggtgggtgggtaatatactcatgtttacctgcatcactccattttaaagtaaggtttgtaattagttgtttccagagctttgaaaaggagaaatattgcaatatagaccaacaaaccttattgaagaaatacatctgtgctctatacagtcagaaataaaaaaatctgaaagttctaaagtagatacattttatacttttgaaaaaaattatagctgaatgaatttttgtcacatgaagttttacttaagtgacacgtgggtgatttcaggtgactgaaaacgagtgcttatttgactttgtctaaaagaagtaggcattgtttaaaagcttgtctttgcctttggaaataaaaggaaattaaagatctgaaggccagtgtacaacaatcagtattgcccttaaacagatacattttcaaacatattgttcagacgtcactgaaaaaatgatgggagttttcctcatttttacttaaggtttttaaaatgcttagttcatcaatttgtacttgggctttatagctgtgctatgtttcatttagtcatggaaaggaaagtaagagtattgggcagtgtattccatgaaaagctggagacctggaaaactcattgtttcccgatgtgttttgaagccagttatgatttcccatcagtatccagtatgatgacttcactacactgcttattatcctggtgacttgctgtggggactgatctaatcagaaaagaattgtaggctttgaatagggagtgtcagttcactaaacgttcagagtacggttgctcactttctgaaatcatgcattgttcaaaacattttatgttctcatttaaacttaaagggaagtcattttgattttatttctgacagagttccttggttacagaatgagtttgcattcatctagaatattatcaggttgccaagttatcatatgcctcagctgttgagtagtgtaagtggtggagtcagctggaaccaattcaaaatctgcctgttgtcagaaatgtagaattgtaataatctataatgttaggaattatgagcattagatttagaagtcgagagttttgttaggtctagtcttcagacagccttgagaggagttcaaatcagactctgtagaaaaacaagaaaagtggagagtgagcgctaattatttatggtgtagtcagtctattcttgtatcttgttttggtccattacttctgagcaaaaataggcaactgtttgctgaattagaataacacagaaagagctatttgctacaaagaagggtgcagtgttctgattcatattcgagtcctgttacttgtaaaatatattcatggaatattcagggacatctgattaaaaaaacatatttcttcagctgataccaaacttcggctgaataaaggcatttatttttgagtaaaacataattctttattattgtttaggctagaaattgtctacatcagaatggctttcttttatatctatagtaaattatccagtgtatataccgtgtaatacaaaacattcttagtagcttagcttaaaagatacagtagtatcttattttttttcttaagtgtaaggaaactaacccatatgctgttattataaatgattaattagttctcatcttatgaaattctgctttttgagtttatcattggaatatttgttttcccaacacattgttactttgtagtatgatgttaagtgagaaaatgagataatgtgaattcaatacatttcattctataccttatagatgtaattttaaaatgttacattattttgttccaccaaaagggttatttttctattgatctggaagtaaatccgttgtacctagacaaccgtaatgaaagtgttgcatttatcattctctatgaaagctgcatggaatggtcgttttggttacttacctgtaatatcactaaccccactccaccccctcaccccctgcaaactgctgtttaggcaataggcaaagttttctctgttttttacaaataccttgtataattgctttagtttcttctctcattagggctataaaatctgcttatgtgcatggtgacaaaaggaacgaagattaccataattttcattttcagttcgggtttattgcctttattgataggtgattagtaaaaattctgtcattttactctgtaaatcggctctgacactcccttgaattgaaaattggagtatacaggtttcagggaatttctctgcagcatgtaatgatctagctcagtggttttcatttggcttccaggattctgaaaaaacttgatttcaaatttcttctgctcatgctctgttcataggttaatagttatataataaatgaactttaactgtgctgcatcatgataatattatagctagtcataatagtataagtctgggatttttgttttcttttaaaagtgaaacaggttgaatttgctgagtgttagttaagattatgtttgactgtttgtaacagaaaacaaatgatactgcttagccaaataggtgttttctttttcttaggtactgagaagtcctaaataggcaaaactgggttgtagggtacccccatttgccagtagggactcagactcctctatttctgtgtggctatttatagtgtatcttgtggttgttttgtgatcacaagatggctgctcctcttccagcccttatatctccattccaggggacagctgttccaggggccatctctatctgcaggtagactaggaaatgtagatttttaagccggcttcatttagtgccctgaacaaaattgaagttttgtttgtaaagaataaggaaagaatggcaactggttttgcaatcagcagtgtctggcacatggagggcaaagtgtgctaaaattgggaacttaaaatttggatacatattaacaatcatcacacaatatatttgacttcactaaagtttgaagaagatctgagagcaccatgaggtttcttagtattttcaaaatgacgcatttgaatgttttatgttacaacatgggtttgaaaagtcattctcaccaaataattacgattaaattgtgtttattgcctcacacaataaggagtgtatatgagttcagaaatgtgggaaattattaggtattgttagtgaatttaattttaaacttctactgatgctcttttcagtttcttttgttcttagagagttatctcaacatttatttagcccagagactttaaaaagaaggcttatgctttttaaaacttctaggttttttttttgttgttgtttgtttgttttgtatttgaacaatttggagatgcttgttttctggctcaataactttttaggtaatcagtgtaaggacaggtggtgaaaacaatttattgtcttactgctatcttgtagtctgacaaagaagtgcttgtatttctgccgttgggtcatatgtgcctcaggatcctggctctgtggggagctggaatatttgaccaaagcatcttcatgcaattggagattatgaaaatatctgaagctatagaggtgataacaagatggaatatctaggctgtcatgttcatttctgttttagttccacaactgagtataaaagtgcacaagaacacacccaaatcatgtgacctggtggactaattgggaagaaaagatgatttgtagtttcgaatgtttgttatttcatattaactaaacacagatgcttctgtttcatggaagtctctctataatggctttgaataaaaaacaggaaagacttctgtgtccatttcttagctcttaatatttcagggattacattctacctatgtccaaggaggaatttcaggtaattatttgctgaagtatgtcattgtttcagtaagtgatcaaatgagaccccttcttattcattttttttttctgcttgtcctttaatgcaattttgtttgcttttgttttctgacttgcttcatctctcccaaaagaagaagcaaataattctgcttaggctggggaaaagctttgtatttggggtcaaatgggatttcaccctgtgagaaggtgaaaagtaccagggaggaaaactccaagaggagaaactagcatgactgttccatttcattgacataattgccaaaatcattttgatcgttggctgaagtgcaccgcaggtttcagggaaaggattggttagaatttgtaggaagatggatatggatgaatgatggagggttatgctgtaccagattgaaagcaatcttgagtgcctattctttaggcagtgagggtgaccctttatgatccccagcaggaagttagatagatattagaaagagcactctggcagcagcgcggaggactgagtggaagggaagactcaggcagggaaacaggttaggtgggtactgtaaaattatagtggttggaatggaaggctgattcaagagaaatttcagaaattgtcaggatggccgattagttggttctgcatgtggggacaggaggcgggtgcagcaacttttgttgttgaagttatgtccaaaaaagtttgaaatgtttcctttttaagtttttaaaaaacttgtagtatgtatttattagaaaaggtgtttttaaaacatttttattattaatcacagttagacctttcttggtagttaaatggaacgaaagctattttgcttgaccttggaaatacagcaagtagtgtgccctagaaaactggaatgctctatttaatgtagagcgctttaagtaataccttatcagtctgtttgttgtgaatcctctgagcatgattagtagcatcttagagcagtggatctattttccataagcaaataaaataattgaattcatatccttttaaaaggtaaatatatatggtgaaaaaactttcaatatatttcaataatttttaatatttgtttttatttcaaaaatcttaattttttctttgtttattttctttttttctttctttttttttttttgagatggagtctctctctgtggcccaggcgggagtgcagtggcgcaatcttggctcactgcaagctccgcctcccgggttcacgccattctcctgcctcagcctcccgagtagctgggactacaggcgcccgccatcacgcccggctaatttttttgtatttttagtagagacggggtttcaccgtgttagccaggatggtctcgatctcctgacctcgtgatccgcccgcctcggcctcccaaagtgctgggattacaagcgtgagccaccgcgcccggcccctttgtttattttctacataaacttcagcaaatatgtagagttagtttggtttggtgtataaaaagttaagtggttttatgttcatttaagttctcggctaccctacaatttgagcattaagccttaaattttaatttaaaattgcaaaacagtaactaccatttatatgtcaacctactcatatgcctggcatgatgctgggtattgcatatgaaatacatatatgttatgtatatatgtaagtttaaagagtcgcatagctatagtggtagaaatggcatttgaacatcaaatgtatatttggcctaaactatatatttttagtgtcattatattgactgggagatactgcagaaatagttatgaaaatatatttattaagattctgattttgattaatactacaactttctcagatatgttaaatgcatgaaattaaagttaatagtttatacatttatagatattacttttattcaaatattagattttggaagtcaaactgttgtgtcttagttgtattatcaattctaatgattagttataaaaagacaataaaattttaacatgagcatttccagtgtgtatttgggtcgagaagattttgaaaagaactgtttttgtaaatgttaccaatgaatgtgactgctttgatacatgcctgaaatgtttcctggaaagaattgtcaaagagcgttgacaaagtcttgattttactctagtgggtgaaaatatttcccagtgaaccctggtattaaagatattatacaaacatactattgttctagtgcccctgtattcagtgctatggttttccatgctgggcatgccagtgtaatgatgtattttcttgattttggtgtgaaatactactacttgtctagtgaggtagatagacactgggttaataaaggcgggataaaatagggcatatggaatattctgagcagtagagattatgtaggtagtcaatgaattaggtagatctaagaactcaagtactgtggctcttcctacaccagtagtcttttaaaaaatgcacacattattttttagagcagttttaggtttatagcaaaattgagcagaaactacatagttcccatatactccctcttcctcccccatagtttctcatatttatatcggtactggtgtggtacatttgttggaattgatgaaccaatattgataaattgattcatcaattacgtagttgattacaagattaatagtttacattagggtttcctttgttgtacagttctatataggttttgacaaatgcataatatcatgtgtctattattgtaatatcatacagaagagtttcactgctcccaaatcctctgtgtttgacctatttgttcctctccagctccagaacccctgacaaccactgatcgttttgctctctctatattttatgtttttacagaatgtcatatagttggaatcctgcagtatatagacttttctgactagcttcttttacttagcaatatgcatttaaagttcctccatgtcttttcatagcttgatagctcatctctttttattgctaagttcattgtctggaagtaccaagtttacttatccattcaccgactgaaggacatcttggttgctcctaagggttgacagttatgaatacaactgctctaaacagttgagtgcagatttttgtgtggacatgttttcaagtcatttgtgtaaaggagtatgattgctagattgtatggtacgtttagctttgtgagaaacttgtctaacttgacttccaaagtgggtgtactgtttttcatttccaccagcaatgaatgagagttcctgttgctacacatcctatcagcatttggtattgtcactgttttgtattttagcctttcagataggtgcgtggtggtatttcattgttttaatttgcagttccctaaatgacatatcatgtaaatatctttttttttttggagttggagtctcgcactgtcactcaggctggagtgcagaggcacgatcttggctcactgcaacctctgcctcctgggtttaagtgattcccctgcctcagcctcctgagtagctgggattacaggcatccgccaccacgcctggctaatttttgtatttttagtagagatggagtttcaccatattggttaggctggtttcaaactcctgaccttgtgatctgcccgccttggcctcccaaagtgctgggattacaggcatgagccaccgcacctggctggtatctttttatatgcttgtcatctgtgtatttcctttcgtgaggtgtctgttcagatcttttgcccgctttttaagcattttttattttgagacatggtctcactctgtcacccagactggatgcagtgataaaatcataactcactgtaaccatgaacttgtgtctcagcagctcctcctgcctcagcctcccaagtatctgggactacaggcatgtgccaccatgttgggctaatatttttatgttatatagagacagggtcttgctatgttgcccaggctggtcttgaattcctgggctctagtgatcctcctgccttggctttctaaagtgctgggatttacaggtatgagccatcatgtctggcccttttgcccactttaaatttttttttttttattgttgagttttggagttttttgtatattttggataccagtcctttatcagatatgttttgcaaatgatcagtaacctttttataccattacctccttttgacacctttgagccactgcatattatagctattatttaaataaataaggacctgattatttccttttatatggtcatagcattcttaagtactattttgttttagctatgtgtgttatttattgtatctgcttcatagagttgtatgtggtgactctgagttcagcaatctgacagtttgctttggtgtatctaatatgctgttgtagctgcaattcaggtatccagttggttggcagctatgatgctttataacacttgagtctaaaattagtcgaactgttctattttaagcatacactgaaattagtagtccatgtcctgtaaaacatgtgaaagttaaaaactcttaggatattgaattacttcttttaaaatgtaatcagaagtagagttggaaagtttgtaagtaagaaagtagttagtgagaaagttttgttatggtaatttgattatggcctggatgtagtgctatatgtatacagtatccacaaacacagtttcacactgttgcctcttagagttaagacagtgctttcacgtaaatgattacatgtgattttaaaaacatgagttgagttacagcaagattatttgctttttttctgttaacatattttagaagagtcgtagttcctaaatgtttagaattctggaacactattgactgcctttgctagaaaaaagagagtgattaaaggagtacttggttgttcgtcttgcgatcttgtgataaccttatttgtgtaacagaaactagataatgttgaaaataagtcagggcatggtagctcatgcctgtaatctcagcactttggaaggccaaggcaggtggatctcctgaggtcagtagttcgagaccagcctggccaacatgtgaaaccccatctttactaaaaatacaaaaattagctggatgtggtggtggacacctgtaatcccagctactcaggaggctgcggcaggagaatcacttgaacctgggaggccgaggttgcagtgagctgagatcatgccattgcactccagcctgggcgataagagcaaaactctgtctcaaaaacaaaaaaagaatattgaaaatacttagtagataaaaagcggagtgattcaaattaagagtttgattttgcatataatatgaattttatacctcttgaagcaatagtttgtgctatagaggcatttttttttttttgcagtgttatttgactatctctgcattagtctgttttcatactgctgataaagacataccagagactgggcaatttacaaaataaagaggttggacttacagttcctacagttccacatggctggggaagcctcacaatcatggtggaaggcaaggaagggcaaggaggggcaagtcacgtcttacatggatggcagcagacaaagagaaagaacttgtgcaggggaactcctgtttttaaaaccatcagaatctcgtgagacttactagaactagtaagttctagttactagtactcacaagaacaacatggaaaagacttgcccccatgattcgattacctcccactgggtccctcccacaacacctggaaattcaggatgggatttggccaaaatatgtcagtgtcctttaaacaatctcagaagctctaacaatttaactactatagataatgtgtagtctttatactttttctttgaacctttttggaaggtctaaagcaggactgaaggattctaaattacagaaagcaagatgcaaggatgctttagttttcttgtggaaaaagacctgtacttatatatccctttccatttagaaaactatatagaaatttaaatttgtgcttcagtagaagtaaaatactgtaaatggaatgaaatacttttataattagcattttttgaaagcattcaagcagcattgttcccaacctttctcatatttctagtcagaaattaattgatcatatgcttcaagtgaacacattaccatctagtatattctctattccctcatacccatcgtattttgtactcagtctttccctggaaaaactgggaagagatgaaggatttagaaccgggagaagcagatcttcaccagtttggaacatgtggtttaattccaaatacttattgatcctatacattaaaatatgctaaggaatcagggcctacagaaggaagaggaacacaggtttgtagcctctcaaagagcagagtttggtgacgaaagtggaccagctacactcattatatgtgagtgctacacaagaggagtgatacgagcatccaggggtttcacaagcagggctggcatttgaaggaaggcagaatttcagtgggagctggggaagggagaggctttgtgttatgtgtgggtggatggtgcagacagagatttttcttggttttaccatgtcatttggacaatctgaccttgcatttcaccttttgcattctaggaaaagtattatcacaaaattgaattactactttaatataaacaagatagattttgcttatacataaccggtgttgagttgaagattttatcctccatttttaagaactctgctttatcatacatatgttatgaaacctgagggtttagtactgagaaataagttttagccatggctcagcaaatgtaaagattggatgtgacactcttaatatggtgtaggaaactctcaattagattgatgatcataataattttagcactttatacttttttttacatatatgatacaatttgattcttataacaattctctgagatgggtaacataagtgccagtgcccttattttataggcaaggaaatcaggcttccatgattgcattgactaggtggtggactggggctagaattctggtcttctgatagccagtctagagaacaccatactgtaggtaattgtggctcatccttatatgcagtcaaagttatcattaataatgtggactataggtaatatatgtggtgagaagtaatagtctctgtttaagtaaacagcagttgaatattgctgttgttctggaattacagtccatagttaggaagaagtatggcttaccttttgtttaatgtggttttgggctaccacgtccataaactttggtgaaaagttctgttgctgactgtagaggatttagttacttgagggaaaaactccattattatctcttgctttcgttgttaattgaagtggctcttaaaattagagggttgtacatttagacagaaaaactatcctgttgactaaagatgtaatttctgtagtactcagtgacaaaggaggaaccatgtaagtacttggggaaaatatggaaagaaaacttatgacatatacttggtaacatttttggaaaataaagaagtggacaaaagtagacaaaatgagtaaaaatctgtaattcaattacctatatacgttaattttatgacatatgtccttttccatttcttttttctccataatatataacatttaaaaattgggactactgcgtgtacagttccatatcctgcagatgcacttaatatatcacagcattttttaatgccatgaaatatcatttcaaaccattttcatgacaatgcacaatgtgtggtaaacagtctgatgaaacatttaagcagttttgtatcctgacagtttttggttaatattattacattggtatttttccatgtaattacaagcttcagaaacacagtttttcaagataagaaagaagtcatatgggtgacataaaccaattagcaattaaatatttataagatagtgcctagttcatgattaagtagattcttgagttatatatccaattaagaaattctaatcactatgaattttagaaattcaacaataaaggaagcaactactagtactgaggagacctgattttcattcctaactcatgctaagtagctagttttggatggcttatacatgaaaatgaatgattgccaaggttctttatcatcctgttatacctgccttaattaattacttcattatttatttatttcttgagtgtttcttgtgtgccagcaactattttagattcttggggtgctagacataaaaaaattaatggtcttttatatttttaaaaagagttttgaatgtatcacttcatactgatatgatctggttacttttgacatcattttctgacatactttccattgtttatggcatacatctcatttattattttggaaatgatcaccacattcatggttttaattttttgtagaaactactattgattccatttgaaaacccttttaaaatgccttccagccttttgatatagtttgcaatcatttattgcatttgtatttcattacttgtgctaggcttcaagactgtattatttattaatggtattcaatcaaggagtactttggggcattagatttatctgtaacattgccaagtcaaactttggaagaaactcacacttttaaaagtgtttttactctcattacatgtattaatgatatgtaaactttaagtgtgtgcaaatggcctcttttgagaagttttaaagttacctattttgtcactatgtgttgttcttgcatgtctaggtcagtatttcttttgtgtttggctaagtgatcaccatatacatgcagttttcaggaaaggcctaaatgttgtcccctccaaggctcctttttccatttccagttaatggaagatttttttcatagtacttttaattccactttagcagtgaacttgaacaagctatttctggttggccatttctttctccaagatttttaaaccagtgttctgagtcttgggggaactacagcttcaagactagggactgtggtcttcagctttgaagtggcttcattctgggggattagtgaagctttctagatttgtttttcccttctcttattctacccttcccctcctccccattaacagaactataggataatatagggtacagaactatagaactactcttgggtagttctgtttgtaaccctgattctgctctcccacctgcccagcctttgagaattaccattgcctgtagggaaaagatgtaaacattgagtatgctgattttcacttatttcattttatcctcaagaaaactaaagtccagaaaaggagggtcagtaaaggaaaaagcaagctctaaactaaggtctcctgattattagttcttcacattgctcagtctcctttgtttcttactggtgtatagaagctgctttcactggctatatccaagttaatgaaaagtaagggcaagaatctagaagaaatgagtggaaaaagtgaagcaatagcaaagacagaagtagtgatatcagtgttattctttacatgcaataagaggaatgctgaggtttcagtgttaccattgatgtttctgtattttagggccttgcattatgttggtgatagtacattgcatgcagcaggctatcagtgttctggggctttaagaaatatattcagactaatataaatcggcattataacatggaactaaaatatttcccaccttgaagagttggatgaaaatttggctgctgctcttggattagtgtgttgctctctggctgtttcctagttaactataagatccaggctccggggaggcagatctaggccactgaccacctcagccatcacccctccccatggcctgcattttgagagtatgctggatctggatccttcccatgtgctctggatcaggagtgaataaaggagaatgtgatgctacatgcatcagttctaacacagctagagagtaggagcatcagtggaaggcatgaaaggtttgatttgatctcacctcaaatgggcatatggtgggtctctgtgtatgtgtgtgggggtggggtacaaagaaggaaaagtacagtgaaaaagggaaagggaatgtatctcctgctgtttctgagagtttgggagacagaagcttttagatgaatggtagcccaactccgtttcttatcatttgggtctccacacatatattttacattccccccaactcttccgcccctgcttagttctatttcttctggctgtcctggtgtcctcagttccctctatgctaacagcaggtaaatgcatggttgggaaggatgtgatttggaaagtgtgattctaatataaacatgcctacagtttattaaatatactttttatagctccaccgttctatattcaatttttattctagattgactacaaaatgtcaatatatgttttacattgataatattgttgctattgttttacctttttttttttttttttttttgagacggagtctcactctgttgcccaggctggagtgcagtggcacgatctcaggtgactgcaacctccgccttctgggttcaagtgattctcagcttcctgagtagctgggattgcaggcacacaccaccacgcctggcttatttttgtatttttagtagagacggggtttcaccatgttggtcaggctggtctcaaactcttgacctggtgatccacccgcctcggcctcccaaagtgctgggattacaggcgagagccaccgcgcccggccctgttttaccattttttaaattaaaaatgtagttgtacattagcctggatgacctaacctttacttaaacagcatttttaagagaaaatgtgttataagttggtcgtttggaactgacaagtgaatttctatagcacaggccattagttaatcggagatacatttttgacagtgggcaagcctaagagagatttaaaggattttttaaaaaactaggagtagtttttttaaagttagaaactacttttcttgttacagtcttctaaaagcacttattataacatccagcactggcaagaacatggggaaacagtgctctcgtgcactgcttttgagaatgtgacttgttactgtctttggagaaaggatgctgctgaagacacatctactccttgacccagcagtatttcagaatctttcctgtgggtagaatttaagtgcaaagatatttatcgtgacattgtttgtaatagcagaatactggaaacatcctgaatgaccaggaatagggaatagttgaataaattttgatattcaaatgttaagcaactaataagtaatatgaattaaatctctaaatattgacttctaatatctctgccatgtagtttaaaggaaaattaaaaggcacatgattatgtgtttggctttcttgtaaaaaaagaaaaaaattctatatgcaaacagagagagctatgaaaatagagaaaccaaacttaagagtggttagctctcaagaacaagttttcttttcatctctgaatttgacattttaaaacatatttattacttctataataaatataaataccaccacaaataaagtagaaagtttaaaataataaaattattaaatattttcatgcatataaaatattgccagtttttgagaaaagcttcttccatgtgattctgacaggtataatttataagcaacattgtgggtattaagtgacattgacttaatagaccatctggtactttcataaacaatttatagacttattgtttgtgtggtcatttatggctgaggtgggccattatggccctagctattattttcagtgtctgatttgatcatacacttgcaggctgtctttctaggcaaagtacagtgggatgagaagacactgccttgcataattcagacatgtgtaatattggtccctaagaagggccatcctaagccaaaggatccgtttgttttgtttcttatctaactttacttttttcattcatttatttaataaattatatatagtgttattgagtgccatgacatatacaaagatgaaaaaagatgatgttgctttcctttaggagatctcagtctgttggggaaaaccagcatggtttgtcacaggacaattaaggtgctgtatatgcagtacaaatgaagtactctaagagccactttcttaaaccctttacctggtgagcccagtgtgttctgtacccattatcttgtttcacagttttaattatctgacagtagggatcaagaagttttagtcctatatagtacaacttctttttctgcgaattgtaatagaaattaaccccacagttgtcaggaaatacctgatactaagagatgatatggaaatagtagggagattagagaaaagcaagttgcatatttgtttataaaaacagaagatagaatacttttgatatttgcaaaagcaagttagaaaactacagaaattttttttttttttttttttttttagtatttattgatcattcttgggtgtttcccagagagggggatttggcagggtcataggacaatagtggagggaaggtcagcagataaacaagtgaacaaaggtctctggttttcctaggcagaggaccctgcggccttctgcagtgtttgtgtccctgggtacttgagattagggagtggtgatgactcttaacgagcatgctgccttcaagcatctgtttaacaaagcacatcttgcaccgcccttaatccatttaaccctgagtggacacagcacatgtttcagagagcacagggttgggggtaaggtcacagatcaacaggatcccaaggcagaagaatttttcttagtacagaacaaaatgaaaagtctcccatgtctacttctttctacacagacacggcaaccatccgatttctcaatcttttccccacctttccgccctttctattccacaaaaccgccattgtcatcatggcccgttctcaatgagctgttgggtacacctcccagaccaggtggtggccgggcagaggggctcctcacttcccagtaggggcggccgggcagaggcacccctcacctcccggacggggcggctggccgggcggggggctgacccccccacctccctcccggacggggtggctgcggggcggagacgctcctcacttctcagacggggcggctgccggacggaggggctcctcacttctcagacggggcagctgccgggcggagggactcctcacttctcagacggggtggttgccaggcagagggtctcctcacttctcagatggggcggctgggcacagacgctcctcacctcccagacggggtcgcggccggtcagaggcgctcctcacatcccagacggggcagcggggcagaggcgcttcccacatctcagacgatgggcggccgggcagagacgctcctcatttcctagatgggatggtggccgggcagagacgctcctcactttccagactgggcagccagggagagggtctcctcacatcccagacgatgggcagccaggcagagacgctcctcacttcccagacggggtggcagccgggcagaggctgcaatctcggctctttgggaggccaaggcaggcggctgggaggtggttgtagcgagccgagatcacgccactgcattccagcctgggtaccattgagcactgagtgaacgagactccgtctgcaatcccggcacctcgagaggccgaggctggcggatcactcgcggttaggagctggagaccagcccggccaacaaagcgaaaccctgtctccaccaaaaaaatacgaaaaccagtcaggcgtggcggcgcgcgcctgcaatcgcaggcactcggcaggctgaggcaggagaatcaggcagggaggttgcagtgagccgagatggcagcagtacagtccagcttcgactcggcatcagagggagaccgtggaaagagagggagagggagaccgtggggagaggcagaggcagaggcagaggatattttttatgtaagtctttttaatacttctgctgcttatcatggtgcttggcatattgtaaatactcaataattattttttctaaaaaggttgaatgaatttctactgcaggttttgggcttttaagattttctgaattcagtttcttaaccaagctaactctagataatagttccagtcaagtacactaccttcactaattttctcccagcaatttaaaaactgccaagcagatgaagtttgaagtaagttttgtaattttcaagaattatacaggccaggtgtggtggctcacccctgtaatcccagcactttggaaggccgaggtgggcggatcacaaggtcaagagatcgagaccatcctggccaacatgttgaaaccccgtctctaataaaaatacaaaaatgagctgggtgtggtggcgtgcacctgtagtcccagctactagggaggctgaggcaggagaattgcttgaatccgggaggcggagattgcagtgagctgagattgcggcactgcactccagcctgccaatagagcgagactctgtctcaaaaaaaacaaaaaaaaattatacacatttccttatttcatgctacataatttctttacgtggaagataggcaaaatgaactgttgccatagtgaaggacaaaattctagagagaaaagatgcaatttagataaaagtaacatagtgctggaacatgtggaacaaaaatactgaggggaggctcagaataggagtgtgcctttagacaacaatggcaaaattcacggacagacttacttagaaatttgttgggaactcagagaatagtgttgtcccagggtgttctttgtttactttagagatagtgtaggctcaccacctgtaatcccagcactttgggaggtcgaggcaggtggatcacttgaggccaggagttggacaccagcctggccaacgtggtgaaatcatgtctctactaaaaatacaaaaaaaattagccaggcttggtagcgggcacctgtagtcccagctactcgggaggctgaggcaggaggattctccttgaacacgggattcggaggttgcagtgagccaagattgcgccactgcactccagcctgggtgacagaacgagactccttctcaaaaaaaaaataaataaataaaataaaataaaaataaataaataatagtgtagctttttttttaaagtggctgtatatagttctagaacctctaaatataaaaggtctagaggtatactgctagggtcagcacatatatagcaacttcaggtaacaggaaatttaatgttacctattctatcattttaatgatttatttgaggatctgggaaatttttgttgctgtgaacttttactttttacttcagaggcaatactcttgattctgcctactcctttctgatggttcttcacctggcttcatacagtttctttacacacatatacatggtactcaggtaagaatgcaaccccttgcagatctctgggatttgcttttgtgcagtctcttttggttctctgctctgcaaattctagttgtcttgacctcctcagatgaactgtctcttcacctgagggagaactgctgcctccccctgcgtcccatcccctccctggtttcttcttcctgtaccatatcctggaaactctccaggcagtaagctgagggtaatagtaggactcaccttgtctatttctcttttctcagagatgacactcccctgtgctgcgtgttgtttattgccccaaaactgtgatttcataaatttgtgtctgtatatttagttatttacagtggagaataaatcccgtctctgtcagtatcatgctcagaggtagaatgtcctccttttctctttaaataaaattcacatgtacataaaatttgcatgaattttctttagaattagatagactatagaaatgttgtgggcttataatccgcaaagtctttaatatactctctatccacatctctcttaataaacgtggataaagtgcatattaaagactttgatgaaagtctttgatggaagacttggatggaagctctggactgagcttggtgatggtatagcagggaaaaaagtctagtctgagttcatgtatttgcctttgtgttaagctaaccctaaaaatattaaagttgggtcatagctggataattaagacatgataggtcagatttctatattttcctactaatgtgaatgttcctatgtgatatttaaatttggatcagtttagtaaaactgttttcatagggcagtcagagaggaaagattctttttgtagtgacagtacatttattctgaatgataatagggcagaatcataatgccaagattgtataatttagctcctgcattttatttctgagaagaattaggttcagagatattcagctcatagaactagttagtactagagttggagctggagcccagttattctcatttctggtttaatgctttttccacttaatcatgctgcccagagaaagtccttgtactctttaagcccccagacatatgcagtatacttctacctcctggtcctgaacacatagggtgagtcttgagggcccagccagcttgcttccttgcaagcttcattctgtgctgtgtaaacattgccacgaatttgacatgaatcgaagtacttagctgatccctttgaacacattatttatgccatgtattgcactagatcccaacagaagacatgcagtgagtaattggagtacctgaccattattttgaaagttaatatttgtgtttcagctagagtgactgtgggcctgtttgatattgacttgagttgctaagtaatgtcagaaggtcaaaacaattttaagagatgtgtggactgtatctgatgacagtttggcacttagcttttatctccttaaggtggcctccatattgaagcatggcagattagccgtgttattttaaaagaatactgaatctgttgggccttggcagtttggaaaggcaaggcctctgtctggtgtaattgtaggcaaaggtatgtggtcctttagggacacatttttgaaagggaacctcagcttggcagtcaagtttgtatacacagcaacgtatagggagaagaagtaaagataactaacatttagatttgtcatccttttttttttctgtgaaaaagaaactaaaagtaaaagaaattagagataacttgtaataatcactataataataggcagtaatgtactggtaagtatttggcaaccagctatttggggaaaaactcttgattttatagcagtttttcattttctggtgtgaatacttttactatggctgatttcgggtgaccaagttgatgtcactgcgtgcagagttgggaagagatatgcagtagcatatctatatcatacaatatttccactatacagatggactagatgtaaacaaactcgtgtaaagataatagcaaatgtaaagaaattagttaagtgatgagttttgaatatttattatctttgttgttggtgtaatttatttaattgaaggctgatgtaatttaatttttaatgaaggctttgcttaacaattggctaacacaattgtgaaaattcaacagtccactctcaagttgttatgagttggctctagcatactactgaaaacaggtaacacttacagaacatgtacactgccttccaagcatagtataagtgttttctgtgaattatgtcatcctcaaagcaatgacttgaactaggtacttaaagtatccttattttgcagttgctatagttgaatcacatagtggttaaataacttacctgaagttacggtttgaaaacggcagagctgggattctaaaccaggccatctgtttctagagcctatgctcttaaccagcttgccatactgcctgttgaggttacagatattcttgaatgtgaggcagtagtagctatgataaattttaagtaaattactcatggttcagaattattttatgacttgtttcaataattgtttggattttatttgagttttatttatgacgaaatgttactatccttaatatatgaatgcttatataaatcaacaagaaaagctattctctcttcagtaggaaaacagaccacagacttcaataggcagttcataagaaaagaactaacaatggccagtaaacattgaaggcaaggacagtgtccattttgttcattgcaacattaacccaacccttgcagagtgcctctataaatgttattgtagtacctgttaattttttatacattttaataaagtacataaatatttcctgtccttttgcttatactaagctattttctaatgttgcctttaaataattgaatttttaaagaaagtgtttctgattatatagttagagacattttgttattaaaactccctaagttcaaacaaggatgaagaggcctaataaattacttttttcctaattataactaatcaatgtatgccgttgtatataatttcactaagtaaaatggaggttcttaaacttaagagacctactgaaattatgagaaatctctgtgtaatttctagaagctttaagttacaagtagtgatattttaatgcattgagctattttatctacaaaccttgttgaggaacagtgtaccctggaagttcagagactgatgtttttcctttgcggcttttcccagtttgccatctctttctcctctctggtagatgttttagccgtgtcagagctcaaatatacttctgatggatgttgtgaattattttgagaaataataaaatgtatcagaacaatatttctggtgctgacagctcctttttggagtttaggaatttgaaatttctgaaatggcttaaaggaagtgttttagttgcattactagacttgtcatccttggtatagataagcccttgctgtagtattttttttctgaagatggaaaagtcagtaagggtaaaggtgggaaaaatggacaaacattgattgaatgatgatccagggtcagacccagtgctaagtgtatacatgcgttattcatcaaagtaaaagctttcttattcagcaattcggaaaaagcagttggcgggggtggtaggaaaccagttcctatggaaagtatgcagttcactaaaaggtaatagtattgctctgtgacattgtttacatatcagagtactttgaaacctttgggatcagaacccttttctgtgttccagaaacatcccaaataaagttggccagaatattaagtttttggctgaagttatattactctgaattttatgttgatcagcatatatctgactgacaatgcagtgtgtcttatacttactaaaaaggaaaatcaattattatttattatgtttagttcatttgggagatgacacactcttcaaatcattggagctatgaaggatggagcatgaggtggagtaaaaggggtgtttactatggaaaaggttaatgattgttgctccatttggtctgtcatatgacttctcatgccatcacagatcaatgtattataataaaagatacaaacagtatgcattacccatgttatatatacacccatgtttcctttgctgagcctccaggaggcagaaacctttccttctgaaccttagttccccccctgctttccctccttcccttcatgataacagtggtccttgtttttttaaaaaaattggcatttttccctagaaggaaattgtattagtttcctattgttgctataacaaataatcacaaacttagtagctgaaacaacacaaatttattaccttacacttctggaggtcattagttcaaaatggaccttacaggtatcagcaaaattgtgttccttctggacattgttggggaacattcatttccttgcattttcaggtttctagagacgggcttcattccttggctcatggctatgtcacttccaccactgcttcatcttcccatcttctgtcactctgattccccacctccctcttttgataacccttttgattacattgagtccacctggataatccaggctagtctccccatcacaagatccttaacttaatcgtatttgcaaagtcccatttgccacttagggtaacatattcatgggttctgagattaggatgtgcacatctttggggaactattattctgcttgccacagaaatttttagaactttaaggtaaaataccaggtagcacaaccattcctgtattggtttatcataatggagaccagggatggtgtctgcaacctttagagaaatcatcatgatttcctttaacacataaaaatatgatttcataaaaaatgaagtatgacaaacttggctaattatgtactgttttgaatacaaaggggagaaatactcaaaggaaatatgacttgatattttgccatagagttttgtaataaaatgctaaggctattgaaacaaaacaaacaaaagaaaactttttttccccacagtatcccatcaaaagttttattttcataaattgctttccaaacatccaacctgcatatctaatgaccatcttttgtcttcttcatctgaaaagtaagataaagtcatatggcccttagattcttttagaaagcctatgttattttcttagttgatttaagtcgtgaagttgcttttattaatagaactatttctattcttgttcatttaagaaaattataatattagatcagtaaggttacctgaagagacactagaaagggagatgccagagtgaaaagtagtagtccttgttagtttttttataagtatttttagtcctctctttttccctcctcattaaaaaaaaaatttaatttactttgtgtgtgtgtgtgtgtgtgtttaagtggcttaaagctacacccatttatctcactatttccatgggtcaagagtctgggcattccttggtaggtgagttctttgaccagggtttcacagaggctgcatttgtagttggtttttggaacattgtgaaattataatctagcagagactataaagatcttcaggagagaattttaaacataaatatgaacattattgctaacaagctgtactttatatatggtaggaatattctgaagagcatagaaaaagcaaaaaaaaaaaaatcagcctatttaaaatagctttctccttctacttagaatatatttacgaacataggaaatttgaaattaagggaaacatagaccaacccgactgcgaactttgaggcttgttgagtgtctcctgctaactactgccacctcagtcctgcacgcgataggggattcctatggtattgtttatttcatagataaggcttgttaataaactgccaggatgcttataatgagcaacgagaacaatcacaaaagagtgctgttgctatgcagttgaaccataggcctataataatacattagggacaaagataagtgtgcttacacatgccacagcttttgggtgctcttctaaatctctttattggctgaatctgcatgaagtggatgaagcctcttctgtgtgcagaagagggcatattaaaggggctgtagaaacaggtctcactattctcctcagagtatcgaagtactttttgcattagtttggcgctacaggaagcgaaaaaaatatcaggtaagcagtttgtcaaggttcttaaattttcatcagctgattaaaccctgtgactttgggtttacctcatgttattgaaccgacttcagtaaagggggatataaaattggaattaagtcagcaggaagttttaggggagagattgtgatattaatgagattgagggagtactcctttcagggtgtttatttttctaccctaaagttgcccctttgatcagagatgctttgtacggacatttatggctagaaccctaaaatctcacggagagtggaggaagaaagaaaagtagataaattactcaatcttactttttttcagagtcagggaatgagaccatgatctttcatcattttgttatcagatacccaaattgtatgaaatcatctttgtgtcctgaatgccttatgtctatttagatgctagcaaatatttgctaatagtagattaaaacacattttatttaatagtcttgcagtgttttttttcatttaatataattgatattgtttgggtaattattggctaaaatatttaaattagagtgggaaaccagatgtttacaatattttataatctactttcagggtcagctgtgcttgtttaactttagttgcactcctggtgtcctctgaaatggctcaagctctgaacttaggggaggcagaggtgctgggacttgggcttcagaggcatcttccatatctctttgtgaggatcatctttaaagggcatgtgcacagacctttcacccagttctaaaagcagagtatttctgtgatttaaaaattgcttgaattggtcataatcctttttggaaaaagatgacaaactcaagctagataaatacagtgcttaattaatttgctcagtgtagatatgatatactaaagctgtcctgccctataaaaataaagtggttataaatgcctcaaatttaaaatttgtgtttatacgtataccttggtgtgacaggcaactatgaataaaagaaaaacaagtcttatatatactgcacattataggaagctgtgtgcattggccttatttatagctccattttctattcataccctattctcctccctacttttccctttcaggctaatgtttctgtaaaactttctgcttgccagatactgttctaaatgctttatatatgttaaattaatctgcatagtgcagtaaacattataatttttattttatggatgaggaaatgggtgcacagagaggataagcgacttgcccacggccacaccgggattatagcgagtggcagagcggtgattctaacctcggctgtgtggctctgcagcctttgccccctcatgtctcacctacactgtgctgtctctgccaccgtcctgcctctcatttatcttgctgtaattttgtaagtgacttcaaatcatttttggaacatggtgggagtaccactgaacaaacagataaaagctttcagtgtatattttgcctctctttttgttcaataatattttgattcagcaattaaactttaaatatatcattagttatttttgacgaagtatacctctagagttacctttggagtcttctgccaaacatcttaagagtagagagttcattttcatttttcagggtttgcttttaatagttctgtggcgtggtgcaattaggcttttcttttctgaaagcacagctgtaacttgctgtgacaaatgctgttgaaggaaactgctgcattgtgaacagagtggaaaaagagatgcctcaaattaagtgttttctttggtctgtcatagacttattaggaggttaaatcctgctctgcaggactgttagtggcaggtgctatttctgtcaccaggacggtctctgctaatttttaatgcagcgacatccccaaatagaagcattctgtcattctctcagtccttccatttgtggaaggattttgatcaaagagtgtttttgctttttatttatttagtgagcaatagcatcatatttcatacaaaaataccttgtgtaatggtaaaagtaaaacttaacaaagtgaaatagtttgttttctttgctcattttccacatacatgaattttgtattttaaaaatgaagtaatttagaaatatgccttcattatgcgaacctatatttgtttatataataaataataatgtgtagttttgtctatatattgagaccatcacaattactgctttcttgtttttattttctctttgagaatcaatgtatttttgagttagtaatacaaaaagcatgtatagacttagtaatttctttacatgagtaatgaaagatacagatttttattttatttgactacatggtaacttttttttcctcatgcttaaaataagatagatctgttttaatacctacaaggttcttaatgattaaagttttaatctcttggggcatgtaatcttggattccaaagaacagcatcataatgaaactctagtataatggattagaaaaatttccacagaaggaatagacctgtaaaaacaaatagcaaaatattaaggagcaaccacaaaaacaccatctcatttttgaattttcatttcccctcctttgctatagcaattatccattaagaactgtttttctgaaattcggctggcttaaaagaatgtttttctgaaaagcgtatctcaaatttatatttcaattgcttgttaaatagtaggaaactagttttattatttatacgtgttttatttgtattgtaaaggaataactgttggtaggtaaaagaactggaatattttaaatatttctttgtagtttctttaggcaaatttgtatttcttaagaaatagcataagaattaagtatattaacatcgaattttaaaaagtatttgcttcgtaagtggacattttattttatttttttttttattattattatactttaagttttagggtacatgtgcacaatgtgcaggttagttacatatgtgtacatgtgccatgctggtgtgctgcacccattaactcgtcatttagcattaggtatatctcctaatgctatccctcccccctccccccaccccacaacagtccccagagtgtgatgttccccttcctgtgtccatgtgttctcattgttcaattcccacctatgagtgagaacatgtggtgtttggttttttgttcttgagatagtttactgagaatgatgatttccaatttcatccacgtccctacaaaggacatgaactcatccttttttatggctgcatagtattccatggtgtatgtgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgcggaatcaccacactgacttccacaatggttgaacaagtttacagtcccactaacagtgtaaaagtgttcctatttctcgttaagtggacattttaaattaaatgagaatatttgcatctagggttgtaatatggtagtatattgtgaggtttgatattcaagactgttttattccagtgttttatggcagaatttgagattttcaataatgtcccacatttaagacatttgtctactttatttagcacacatgtttcagaatattaaaagctgttttattggcaagtaaatcttagtttagatctctcatttgaaatatttcatcccttataagatttacctcagaatgttttctcctcctatagaatacagtttatgtttcaggtttactctttttagatgtttttctgaaaaattttattttagatttattagtaaattttcatcttaattagaatgagttatgacctgattaagacatttctttcacttctgtctttttttagccagtagaaaaacatttgagtttatttttaagggagtgatttcagtttcaaacaaacaacaagaaaagcctgatataaaattaagtaagctgtttaaaaaacatgctatccatgttacagaactgtgaagaatttttgtcagatttatatcagttgccatagaatattttcttttttcttttcttttcttttcttttcttttcttttcttttcttttttttttttgagtcagagtctctttctgttgcccaggctggagtgcagtggtgtgatctcagttcactgcaatctccaccttctgggttcaagcagttctcatgcctcagcctcctgagtagctgggactacaggtgtgctccactacgcctggctaatttttttttttcgtatttttagtagagatggggtttcaccatattggccaggctggtctcaaactcctggcctcaagtgatctacctgccttggcctcccaaagtgctgggattacaggtgtgaaccactgtgcctggcctgcttttgtcttatcaaggaacttatatttctaatcactttatctattaataaagaagtgagtgctttctcttgttttcaaagtggtcttgacattgatatatcagattgtggttggtgaaaatgagaaagacctttggcaggtcaccttgtgtttaccaggcaaatgggaaaataaggctgacacagtttcatcatcagctggtagttaactttaagctttgtttttttcttctccattttaaatgaaagatagtatccaatttacaaatggatttgcttcacagtttctttttaaatgggcttaaatggatctcataatagcacatttccttaacatgttctgttaggaaaccaaggcataatattgatgatgctatagcatcctgacgttttacttcattccattcagaaaatccagagctgggtccatggcccatttccttctggtagcagggggagaggacctggcttttctctggatccctccctggtgtcagctgagagactttcctggcttactcctttctctactgtcagggacccagtacttcctgcttcgtctctcaggttggggctgggaacatgctccccatcctaccttttttttttttttttttttttttttttgagacagggtcttgctctgtcgcctaggctggagtgcagtggcacaatcacaggtcactgcagcctctaccttccaggctcaagtgatcctcccacctcagcctcccaagtagctgggactacaggtgcatgccaccatgcctggctaaattttgtagtttttgtagagatggggggtctcactatgttgcccaggctggtcttgaactcctgggctcaaacgatcctcctgcctctgcctcccaaagtgctgggatttcaagcaagagtcaccatacccagcttcccattctacttttttctcccaggttttttgctggtcagaactccttgaaaacctgaggtgttccagcctgaaaggaggctgtatcttgttcttcttaatgaagatgacatgatgtagcaggaggaataaaacacatttggagtcaggatacctggagttaccctgatactgccttttttttttttccctgtgagaccctgagcaaatcatttgccttttaattttggtaggggtggtgggtgtttagtgtatgtggtgtgtagtttgcattatgttacatctgatgtccctcactgctttaacattacataccacatatttcagaagaggatttgcaaatatgatcacatatttcagaaggggatttgcaaattattaggttcttaaaaggtaggaacataagatttttaacatagaatttatgaacttttacacatggttgaacaagaaactccttagaattcagatgtttatacttgggtatgttatgaataactgacatagtctcagtgtattactataaaatgctgccatttctggaaggggtggtatcatgttgtgtgtagatataatacatatatttttaagagatgggagtcttgctctatcacccaagctggaatgcagtggcacagtcatagctcactgcagctttgaactcctgggctcaagcgatcttttcatctcagccttccaagtagctggaacgtgccaccatgcctggctaattttttatagaggtggggtcttgctatgttgtccaagctggtctcgaacttctggcttcaagcagtccttctgccttggcctcccaaagtgctgggattacaggtgtgagccactttacctggcccataaatatattataactaaaatttgctctttaactgtttactgaaagtacgggttgtcatccttttattttctataggccaacacgtttagtgctactaggagacaaaaataataaagtaatactgataggtaaaaatgctatatttaaaattcctaaaaatttgcatatcaaaatttaagttgttcatataatttcttaggggaaaatgaagcagaaagaagtttatttaaaagttatacccttgtgattgaaaatctgtctaaaatatatcagtttcttttcttgttctagttcaaggtggtaaacataattaagctttattgagtatcttgccacagaatgaatcatgaatggttacgtttactatgattttatcaatgatctatgtggaaggtgggagattaaattaaatgtgtgcaggcatcagccaaaaatttattaaatattttaatgctttacattttttctttcaggtagaactatgagagatagtatattgcaggctctaatttctttggtttctaatgtttgactatataagaatataatcatcataagatggcaatattcattattaaatttaatttatgctaccactcaaatggttaggttgtgaaataagattgtttaatagtgtttgaaagatttgtatacccctgagactctagctagcaccctgactgatgccctgacagaaaaagatgattggagcattcagaagttatgcctcactcggggaggggcagttgagatttgttccctgataccagacccattccttgaatactttgtgactgatgagattgactttggagtgggagacagagaaagaatttggggtgcggtagtatcttggaggcttaagggagagcaccaagaagcagatcacagggcagaagagggatgagtgcctttcaagagaaggtggggaggtttgagaggagtgagtcaatagtgtagagtcctcacacaatcctgcctcccagctgttccctttgccatcagatgctgagtgatttgacattacagatgaccatggagggcagtgtgggtgatgaggaaggctgcaccgcactgtgggattcacattaggcagtccaatataaaccagacttacaccagactcatgcaacaaatttgcccactagccattattcacaaattactgaagttatcactgactgataaacacagaataccagcaggtgggaggaaatgttgtctagtttctattattagcttgtgctccatctgctgattataaaagtttcactggttcatttattttaacctctcaattgaatcttactgcaggaaaacaaattgtagaatacatcttactagttgtgggaaatcaaatttaatttgaatagcaaaaagtaaatagaatgatattttatgctgaatctaagtagccacatccgtagtcttctttattaaaggaatgttgggttagctcaattgtggataattttattattttcatttaggaaacaattacaacatattagataaatggtaaatcattttttaccctttcttctccatgatttaaaaaataagaatggaaaacatgaattttacatttttttcccactgcattaagttttattattactgtggtttgtttttatttcaaacttttcatgtttcatgtctctcaacgctttttgtcctcaaactttattgctggagtatttaatagcaaatataaacgattcctatagacttttgtatttttgagaaaaaagtagcagcacggacaatctcagttggttttttttttttaaacaaagtactgtttttcaaaagaaactataacaaacagttgtggactttgttagggcttgggtaggtgggccagaagtcatggggtgttacttggatgacgtcatagctcagggtctggttcttagcccagggagactcaccctttctaggtaaacaaactccaaggtgcctgatgtttaaaccagaacttgtttattaacgtatagtgaaaagaattcaacagccaagtggtttggacattcatgttggatagaagactagtacatttttttctatcagaaaatctgtatgagaagccatagtatgcctggaattggaagtaataggaattatgttttgaccagcaaaaaatttttattgggatgaagtccagcctaccaatttttttcttttgtggttcatgcttttgatgacatgtctaagaagttgttgcctaactcaagattataaagatatgcagctacatttttttctagaagttttatagttttgtcccttacatttaggactgtggtctgttttgaattaacttttgtgtatgatgctaggtaatatgctagttacgtatgaatgtctagtttttccagcactatttgttgaaaaaactgtcctttcttccgttgaattaacttggcacctctgggaagaatctgttgaccctatattgctaggtctgtctggaccctgttcagttccattgacccgtgtgtttaattttatgccattaccacaccatcttgatgatgatagctttaaatgttgcaatcaggtaatgtgagtcccagtttgtccttttacgtaattgttttggctagtctgttcctttatatttccatgtaaatttttaaatcagtttatcagtttctataaaaatgtttgccatgattttgattgtaattgtgttgagtctaaagatcagttgggaggctggatgcagtggctcacacctgtaatcacaacactttgggaagccaaggtgggtggatcgcttgagcccaggagttcaagaccaatctggacaacatggcaaaaccctgtctctacaaaaaacacacacctctagtccaggctacttgggaggctgacatggggggactgcttgagcctgggaagcggaggttgcagtgagctgagattgtgccactgcactccagcctgggggacagagcgagaccctgtctcaaaaaaaaggtcagtggggagaaattcacaagtatcaatattgagtcatttgatctatgaacgtagtatatatttagatctcctttaatttctctcagccatctttataggtatatagagctataggtatattatatagactcatatctgggttcaaatcatggctctgtcacttatggagtgaccttggtcaagtttcttagcttctgtgagcgtcatcttccttgtctataaaatagggataatatgtcattggttttgtctaagggttaagtgaattgatgtatgttaaaggcctaatgttatgcctggcaaaaagtttactgcacaatacaagttgttgtcattattatcatcattgtcatctttaccatcaagtaatgatggcctgttggatccacctctgccaaatagttattcttgcccagcaaccagatggttagtagcagctgctcagggctccctttatggtcagcatggctgatgaacactgccacacgcttgcttttagggcctctcttttctctactccacactaccattcattctccagctgtagctgtttacacattcttcctttggattatgttaataccattgattaggccacagctttccttgcatttagtccagtcttcctttgattttccaatattgctttctgcttttgcttggaagattttgctctttttgtatgtcactgtcttaatctctcctactatgtgtttatgggtttaattttcagagtttggggctagctcactatcaccccattttccactggagtattttgtagattgggcaataacttaactagaataacatactttaagtgtttgcacagaatatatatttttaaattttgcctcatttatgggaaagtgggggagaaaatgatattttttatttaaaactttttagaagatgagatgtgaaaataatttgatagtgactaaatcaactggttgttacactgttattctcagtcttatgaattcagaaagtccactgttttgaaatcagaaccttgtcacttacccccatcctaatgaggtttgcatgtcagcactgtcagggtccttcagggaaatgcaaagcaatttcttacggggagatttgggatatctgtgtctatgtgatgtctacatttttgtacagtcatgatttaacttcagaaagagtctgtatttgggactaaatattctattcctttctgaatcatcaaataatcattacattgtattcagtattggttttagaacaaaatatgccacttcccaactgtttaaatctgggcaaagtgtgtatcccatctgtgtatcagtttccttttctctgaaatgggaatgatactagtacctgcctgttttgaggattaatttaagttacactcttagaatggtgccagtaggcacatggtagataataaatgttagcagcttattgtagttctttgaaaagtgacatcccatgcttgtcttattcaataaaaatcatttaaccaaattgatagtttaaccagttgttttgctctttaatcattctgcttaactaggaaatactgaaggtgtttttttttgtttgtttttaatgtgaatctgttcgtttttacttaagagctggtataactactgtagtagttcagggatagtattttgactccatggtgatattaacttcaaatttcagttaatagtaagttcagttttattttttaagataacatggaaattttgtcttccaatagtgaatgtgattttccaaagaccttgtattttaccttgtttctatataaactaactcagtcataaggaaggtatttgatttgctgacacccacataggaaatcaaaactcttggctgcctcgtttgtttccccagtcccagatgattcagtttctttagaaactgcatgatgcacatgatttatgaattatttatcaacttagcttgagaactctgtcagttgtttagaccttgttttacagacaaaagtaatctgagtaattttaatgaataaatgatgatttgtagaatatatatttatttaaatgtttaaaattaaatataaaattaaaaatatggaaatgatctttatataatcagaacactcacaattttgtaccctaaatgaaatttaatgaaaaatttagaattaaaagggatataatttttacatcttgtaaagtgagttcaaaattagttaagcaacctcagcttgaaatgacagcttgaaatgacactatagtagcaaaacttgctgattctactttttatgaatcagtaatgggcgagaagtgttcttgtatgtaagggattactgataattattatcaacagaataaaggcttactctaacaagatctggggaggattatagtttggcttaatacagttatgttcatttcctctgtgcatatgtatttaatggaacttctttagcgtggtcgttagagcattgtctcttctatgatgtggccttaaaaaatgtactattgcagtggaattttaggtaaacctgtattgagcctcagcagattttaattgtcaaaagaggctaagatatattaagatttctttggagcaagcaatataatatttcttgttatttctttctctttaaatcagtatatagtatcaatagtaaattttagtaataccaaaacagttatctctgtgaaactagggtcataattaccttaaatttttttttaacatttatttttaatcttacttaacgacagcttttcctagaactgtatttcagaggcattgcaataacctggttttcagaatttggaaattgtgtaaatccttctcattgcagagtcacagatgatctctctgattaccatgcattcaatccttacggtaaaaatctaattgtggttggagcccttgggatgttttactacttaattatgcaatatatacaccttagtgtatcctgtgtcttggtagtttgattttgtaaatgaaatctatgatttaaacagtatattcaaatttacgcagtaaagatagccagctaaattgtaacaatttggaagactgaatttggtcatatgtttggtattgaggactttagattcagtgaaatggggtggtgacccttgacctttgttctttgctttcatttatgtgatgggaaagctgccttcatttctaacacaaatcttcccttcacttcaaatctcccatttttggagattgggttacaaagaaattgtatctgtgcttttcagatttttccatgaactacagaaattcctgtggcactgctccctagggagttgttctaagctttaacagaaggcatcttagaataatgtaaaaggtcggggttaccacagtattaaagtatttgaactcttggtctgtcaggatgggagttgactttgttggccagcctggtctgcctgtaagattcatatcaggggttgtacgagttggaaaagcatctcctcatatcttttttattgaaagggagctctgcctctggcagtgcagaaaatgattgcgtgaaaagtttgataattatatcaaaagaaaatggtggtagttaggttaaatggaagatgcttgtactcacatggtcccattaaaggctattctattgttttttttcatattttgcagtctccttaacatttaagaaactgaaggtgtatttaatcaatagtgtcactatgatagatattaagaaagaaaaaaacaacgccgatggaaaactaagcaaagttaccaagtaagattgcagcataaattttaaaagtgatttcccaaggaataggctatatccagacacttggctaatattattgcccttgttctacagttaatggtaggtacgctgtagtattttaggagcacagggttttacagttttggttctgccagttaacctaagattgactttcctcacctgcaaaatatggataacatccacttccctgatttttgtgagaatcaaatgggatgatttatgtaaagcatttagctcaatgcttaacacattaaaaacagcccccaaatggcagctattattgcagattttcatctcagctacagtattttggattatttgtcagtactgtactatcttttaatgtatgatattctttctgtgttctgggccttcttaaagtataatgatttcccttttctcgaattgaatttgaccttttcaaaagtctggaatttactgaagacaaagaattatccagtgctttatgaatggggatgtttatattggtttggctggcttccaggtggcaaacaacattcaaaagcagacataaatttttcccttccaagaggccacatggtgctcctttcctgcatcaggctcccatggatatcaatgggtgtaatgtgtgtaaagcaagggaaaggtcttgctactaaaaagtagggcactgtgctatatcagataaattagtacgttcccatgagctcatgctttgtcctaaaagatgtctttgtcttaatgtcctgttagagtctagctggcagttaggagtcaatatttgatataattctcagtggttgaatcctactaggatgttcatagtttgtgtatatatgtatatatatatacatgtataaaactagtagtattaaagcccaaacaaaaatatttattaaaatcttacatgctacactttgttaaagtgttattggctgagtttcccgttaccaaatttaaaaggttgacttacattttttccctaagagttttaagaaaagtggtacttaaattcatagagctaagaaaattgttgctcattgtccatggatatcagaaaatataattttgattgtttatagaattataaaaattttaatagggtactcatattgttaattccatgtcatcattctgctaataatgctcagattattccttaaatataaaaattaaatagatgaatgaaaaaacaaaaaatagaaatggtagtagatattaaggaattagaaattggctttagtttctctcttaataattattatgtggacggctgggtgtggtggctcacgcctgtaatcccagcactttgggaggctgaggtgggccaatcacctgaggtcaggcattcaagaccagcctggccaacatgtccaaacccctcctgtactaaaaatacaaaaattagccaggtgtggtggcacatgcctgtaatcccagctcctcgggaggctgagtcaggagaatcgcttgaacccgggaggtggaggttgcagtgagctgagatcataccatcgcgctccggcctgggtgacagagcaagactccatctcaaaaaaaaaaaaaaaaaaaattattgtgtgacttgtattagtaagattagaacattaaatacattttatattatcacttctttagacttacattgtgatttttttccttggggcttctcaaacattatatgtaagtcctttatgaacatgtcgagtctttgggttctccatgtagttataaagatgaagttacatatttggcgggttggggtggggaagagaattttaattctctctggacattttataagagaagacattttagatccttgactagcttgtgaataatatgtattaagcaaatatacactcccagtatgaaaacagtttatagggccttttcatattattatcttattagatattctcagatagcggtatttcctcattctacagcaaacagacctgagaatcagagaagttaaatgttttggttaaatttatacaaatgaccgtgcttaaacaagtatctcctgagtgtaagtgaaaaacagcctttgagactggggagatacgacaattaaatgcattgtcgtcctggatgagatcctaaaacaaaaagaggatattaatgaaaaactgatgaaatccatataaaatctggagtttatgttttaaaaaatgtggcaaaggttaaaaattctttggggcaacataatgtaaaaagtttgaagacaaccgaacagattaaaattttgcacatgtgtgagtagataggaggtttttttttttttttttttttctccctgagacaatgttttgttctgttgccccggctggagtgcattggtgtgatcatggcttactgtagccttgagttcctgggctcaggtgatcctcccatttcagcctcctgagtacctggggctacaggtgtgtgccaccatgcctggctaattttttgtattttttggagagatggggtttcaccatgttgcccaggctggtctcgaactcctgggctcaagcagtcctcccacctcagcctcccaaagtgctgggattacaggcgtgagccactatgcccaaccttagataggagtttttattttttttgtttttattttttatcaggttgttgctatatacatggcattgtaactattaacacctctgaaaatgcttctctacaactttttgaaacttgttgagtttcttgaatcttccaccagacaaaacctaattttctgttctagagagaggcagattctttttcgctggggatgttctcatcctaggatatcagaggcaccatggagattggggataggagtttttcattgtgctattgcttttcatagagaaacttcagaaacaaactaaatgcttatcagtattataatggataagttagtgattgtatagttgggcaattattactatgtacagttaagaaaatgaactagaattatatcaatagagttgactctaaagaaattgttagtaaataaagcaggttgccagttaaaaacaaacctttgaataactttcaaaacactatactatatgcacatgattacaaaatcaaacagtacagaaggatttataacgaaaatgaagtgtttcagttccccttcttccctttgtctactcggttcccacagtctatttggaattatgtttaaatgtgtctggtggttacaggcatatcttggagatactgtgggttcagttccaaacctccacgataaagcaggtattgcaataagtcaagtcagagaaatgttttggcttcttggtgcatataaaagttatgcttgtattatattgtagtctattaagtgtgcaatagcattatgtctaaaagaataatgtatacaccttaattaaaaaagattgtattggctggacgtggtggctcatgcctgtaatcccagcatgttgggaggccgaggtggggtggatcacttgaagtcagaagttcgagaccagcttggccaagatggtgaaaccccatctctactaaaaaaatacaaaaattagctgggcatggtggtgcgtgcctgttatccccgctacttggaaggccgaggcaggagaattgcttgagcccaagaggtggaggttgcagtgagctgggattgtgccactacactccagttgggcaacagggcaagactctgtctcaaaaaaaaaacaaaaccaaacaaacaaaaaacacaaaaatgtccttattgctaaaaaaaaaaaatgctgaaggtcatctgagccttcagcgagtcataatctttatgctggtagagggtcttgccttgatgttgatggctgttgactgatcagggtggtggttcctgaagatttgagtagctgtggcaatttcttaaaataaaacaacagtgaagtttgccatatcaattcatttcttttcttgaaagatttagctatagtatgtgatttaaaaaaaaaaaaaagagagatagtttcttgctctgttgcctgggctggagcacagtggcacaatcatagttcactaccacccagaactcctggactcaagcagtccttctgccccagcctcttgagtagctaggattataggtgcaagccactggagccagcctgtgatgctgttagcattttacccacagtagaacttctttcaaaattggagttaatcttctcaagccccgctgctgctttatcaactaagtcctatgtatattctaaatctttgttggcatttcaatagtgttcacagtgtcttcaccaggagtagattctgcctcaagaaaccactttctttgctgatccataagaagcaactcctcattcattcaagtttgctcatgagattgcagcaattgagtcccatcttcaggcttcacttctaattctcttgctatttccaccacatctgcagttacttcctggactgaagtcctcaacccttcaaagtcatccatgagggtttggaatcaccttcttccaaactcctgttaatattgatattttgacctcctcccatgaatcatgaatgttcttaatggtatctagaatggtgaattttttggtgaattttttccagaatattttcaattgaatttacccatatccatcagaggaatcactattgatggtagctgtagccttacaaaatgtatttcttaaataataatacttgaaagttgaagttacaccttgttccatgggctacagaacggatgttatgctattaggaatgaaaaaaacattgatttgcttgtacctctccatcagagctcttggactaggtacattgccaatagcagtaatattttgaaataaatctttttttttctgagcaatctcaatagtgagcttaaaatagttattaaacccttctgtaaacagatacgctgtcatccaggcatgtttttctatttatagagcatgagcagagtagttttgcgtaattcttaagggccataaaattttcagaatggcaaatgagcatcaacttcaacttcagctgtattagtccctaataagtgagtcatcctgatttttgaagctttaaagccaggctttgccttctctccaactatgaaagtcctatgtggcatctccaataaagagatatctatggtatagtcttccattggaagactgttttgtccacattgataaactgttgcttagattcaccttcatcaatgattttagccagattttatggataacttggtgcagtttctgtatcagcaattgttgctttgccttgaactatgttatggagatggtttctttccttaaatcttacgaacctactgctagcttcaaatctttcttctgcagctttctcacctctctcagccttcatagaattgaagagagttacgaccttgctctggattaggctttggttaagggaatttctgtctagatcactgaaactttctccacgtcagcagtaaggctgtttcttatcattcatgtattcactggagtagctttttttttttttttttttgagacggagtttcgctcttgtcacccaggctggagtgcaatggcgcaatctcggttcactgcaacctccgctcccgggttcaagtgattctcctgcctcagcctcctgtgtagctgggattacaggcacctgccaccacgcccagctaatttttgtatttttagtagagatagggttttgccatgttggcctcctgacctcaggtgattcgcctgcctcagcttcccaaagtgctggaattataggtgtgggccaccatgcccagcctggagtagcacttttgatttccttcaagaacttcgcctttgaatttacaacttggctagttatttggagcaagaggccttgcttttggcccgttttggctttcaacatgccttcctcactaagcttaataatttctagcttttgagtaaagtgagagatatgtgactcttcctttcacttgaacacatagaggcccttgtagggttactaattggcctaatcttaatactgttgtgtttcagggaataagggggcctgaggaaagggagagaggccaggggtatggtggctggttgttggaacagtcagaacacacatttcttgattaagtttactgtcttatatggttgtggcttgtggtgccccaaaagaatttaaagagtaaccttaaagatcagtgatcacacatcatcataacagatataatgataatgaaaaagtttgaatattgtgagaattaccaaaatataacacagagacaggaagtgagcccatgctgttggaaaaataatgccattaaacttgcttgacacagggttgccacagtatgtaaaatgcaatatctgcacagcacaataaagccaagtgcagtaaaatggatatgcctgtacttctgtattctaaataaaatgcttatgctgtgatttttagaaaaatatgcaaactgcagacatttgctcttaattcctgttaaaatagatgaggatttactctgcttatagtcccctcccttcctttctctctccttccttccttcctccttccttctctccctccttccttgttacgttactacagtatataacaatatttattttttaaaatttagttttttaatcagattgtttatgtagatagtttaaaactgaaataattctataaatcttattatgaaaatctgcagttgcttctgtagccactcacccccaccactcccaaccattgcctgcatcctagagacaagcatttcacactgcaggctgtttcttttgatatttaaatcatatcactagataacaaatttttggatctacttcttgattttctgttttgtgccctgtgtattggatttcctctctggaagaagaacatttagctcactctcaccgtttctaccactagacaggtcatactctccattctctgtcttcccaatgtagttaccacattcattagtctagatcactattctttgtcacattattgtgatttagtaaatgctattcacagctgagtcatgagtaaattatgactgtttctttcttgcatgactttccttgtttgtgctctgtagttaataattgtcttgcttctttgcttagttttctatgtatttatcataaattcacccccagttgttaacgttattttctccaaacattcagacacattaggtattgcatctttttgggtcttacttgcacagaaccttgtgagctgttctgtttcgttctgtatggttgccccgtatccctggggcacagataaccatcactccggggttgctgtttgcctctttctgtgtgagatccctttctgctggatcctgtggtctcaagacttgattacaaccttgttttgacaaactgtcttctctagtagtaccatgaggaaagatgcatggaagagaaattttgtgtgtcctggaaaaattttttattggtgctcttgcacttaattggtactatctagattggaaataatttttcctttagaattttgaaagcgctgattgatctgttgtcttctgggctttcattattgctattacaaaatctcaagatcatcctcccttctctctccctcccccactctttcttgacattataggattgtgattcttaaccctggcttcactttagaattatctggggactttgaccaaatcctggtatgagagattttgaagtaattggtctggagtggagcccaaacatagatatttctgaaaagctccctaggtaattctaagatgtagccagagttgagaactactgttttagtgtcttttctttgtctctcattgctgaaatttcttgatgatatgctatgatgtaggtccctttccatccgttgtgttaggtacttgattgttccattaatctggaagtttatgttaattttggtaattaaaaattttattttctcccgttcttctgatctattattttaaaaatcttgttatttgtagttcctctgcttgtctctctgattttctgtaactttttccttttgtttacagagtgatttcctcagtttgatcttccatccctttcactgagttttccttttctgtaatcctattttaatttttctgagaattcatttttttgtactctaattattctgcttttatggactcctgtttgtatttaaggatgcagtatcttccctcctttctaaggatattaataattttttgttaactttttatctcccttccttgctctgtttcctctaaattactttttgaaaatctgttacttgttttggcctcctggtttttcctataaggggctttgctcagaagccttccttggctatgtacctatttatgtttaaaagctaattatggactcgctatctgtgtggtggacttctcaaccttagcctttaccataggatctggctgggtcattgcagtgggggaactcctgggatcagaatcttgggatcttttctcttgggctggtcatattccttagagagtactcttttcaactccacttttggaagctgatttggcagaagatggctggaggatgacttttaggatgtgaaggcatgcttaatttgcctttctcatttatgtctcttgtcatgctgattagagcccctgtctctttgactctctccagagaataaacctccagcctcctgggggttgggcaagggagaggaatctctgtcttagacttgtcctttctgtgtcaaggcccaccccaccccagctttcatggctacctgctgctatccttttctggtgaggtttttgtggggtttcaaggtatgaatcagattgcttctctcagctttcctggctgctggcttagtggtcacctctctgttgagtcaggtacaacttgttcttgggttttccagctaccaaatgcccttgttcttctcaactccttttcctttctccttgttggtaagtatgtaccctaaacacagattccattactgtcaacgtaatgtgttttcaggagagagtggaggtaagctaaaggtcatctactctgtataatcagaactgaataatatgattgtggtaaatgaaaaataaagagatggtaaaaggcttcagattgtcataatgattctattttgcatgtcagctctgaggttcagtcgaaatacttggtgtgtataatgtctgcagaagcgtagcagtaactcatacttggtgttctttggttggtggcagatcatgctgcaatcagttggactgaaagttaaatttggaaaagttatttaaactcttctgttgcaatgcaggttgacagcctgtattaaaataaaatgtttggtttagaaaccctataaacactgtgttggtttcaaccaaaaaagcttgacttttctccttaaatcagtcatgactgtattaacatttaaaataccattttcttggtaccatttatacctcagcgatgtcacatagaaaattgagaaattataactcattttcattcttttattgtgcatttaaaatataaactctataatgtaatgtttcactttaagatctttttcttctttaagggaattgataacatagcactttaaggaacttttaataaaaatactgttttttggtaaattgattgtattattatccgagacaatatgtacattcttcactgcatgttcatgcaaatttagaaacccagtctgaaatttgctgcactaagaaaaagccagattaaaactttttatactaccaaaagcaacctttaaaaaaatcttgtttttcttttcaaaagcatagtgttcttgtctgtcttaggacctcttttgttagaattctctgtgggtagtttaagagaacaacattttattttgaaaaacttaaagtctacagaaaagttgaaagaatagttatacaaaccctatgtatacctgtcaccttagttcactgagtgttaacattttgctgaatttgtgctttctcagttttttttactgaaccattaaaatttaagtttagacatcatgacatttttgtctctaaataattaagtatttgtgttgtcagaataaggacatcctctttacataatcataataccattttcaactctaagaaacaattctatgataccatctaacatacaatatgcatccctcctggattttccctaacctttaacttctagctcttccccaccctccaggactccaagatgcaaataaggattgctagaacagtgccctctcctaaccttttgctttttttttttttttttttttttttttttttgagacagggtctcactctgttgtccaggctggagtgcagtggtgcgatcatgggctcactgcagccttgacctcaggggctcaagcgagtctcccttctcagcctctgagtagctgggactacaggtacatgccaccatgcctagctacatttttgtattttttgtagagatggagtttcaccatgttgtctaggctggtctcaaactcctgagctcaagcaatccacctgctttggcctcccaaagtgatggggctagaggcgtgagctaccatgcccagccaaccatttgtcttatataatgtcccacaatctgggtttgtcttattatttccttatgattggattcaggttagaacatttgtggcaaaattattacagcagtgatagtgtttacttcttattgcagcatatcaggaagcacatatcagtgtattccattaatggtggtgttgaatttgatcacttagtcaggtgtggtggtgtacccctgtgttcccagctactagggatattgagatgggaggattgcttgagcccaggagttacaggccagcctgggcaacatagtgagaccctatctcttaaaaaaaaaaatcgatcatttagttgagatggtatctgctagatctcttcattgtaaaagaacctgttttactactttttctctcctgtaattaatggataaattgggaaatttgtacatgtcatgttcccccaaaaccttttacctaatagtattccttgatccttacctgaatgagttattaatatttaattgtaaaaatggtgatcatttcttgtttattagctggctttcttccacaaagaagagctttccctcatctcctccttttctcttctttaatgtcattgttgtctctttagaaaaaaaaaacaaaaaaacctcagtgtgttagaattcattatcattgtgattatttttgatgattaaattgtcccaagtttggctagtggcagccttttgaagttggcttctgtgtccttttaccatattctcagtaatctttaagcatttcctttgctttttggcacaacgagatgtttcaggctcactttgtgctttccctgccccagagttggaatagatgatttctctaagaattcagtttgtttcagtggttcttcatatttataaatcaagatttgggcactagatatgtttattgctgctgattatgattatatccataccctttcaataggaatatctaggaaatagatagctttcttttctttctttcttttttttttttttttgagacagggtctcactctgttgcccaaactgcagtgtagtggtgtgatcatggctcactgctgcaccctcgacatcctgggctcaggtgatcctcctacctcagcctcctgagtagctgggaccacagacatgtgccaccacacttggctaattttaaattatttgtagagacgggatcttcctatgttgcgtaggctggtctcgaacttctgggctcagtgatcctcccacctcggcctcccaaagtgtggggattacaggtatgaaccactgcacctggctgggtagctaatttttaaatcatacatttattactgatattcgctattcaaatttgatactgtaggtttcttttttttaaaccttctcccacttttatatccctggttcccagcagtgagaactctggttcacaacattactgtatttatctaattgctctcacctacaatatacacaatacagtgtctcagttactatacctatacctttaccagtcttatttgtttgtttatttgtttgttttttgagacggaatctcgctctgtcacccaggctggagtgcagtggtgccatctcggctcactgccttaccagtcttatttggattcaaagtacagagattaattcaggctactggaaaatgataaaggataaaggattcgtgtaaggatacatagtagcatggatctaaaaggtagcttctggcatcagctactctcattcacccactctcttggccttctttgttggcctctctttctcattccatgtgtctctgcatcttgtctctcaccttcaacctttctaagtgggaaggaatttgttaggttgattatttaccctctaagtagcatttctgttggacagcttgtgatccaggtatcttggtcttgttggccaaagtgtgggcaatggggacttcttttgttcaaaacaacggaaagctttcttgtatttggtcagtataatcactgggcacttttaggttttatggtccagtacaaactggttttcatttttcttagtatagtgatagatttcctttaccctggagtgtttaaagttcatgagtaattttgaaaataaggtagtaaaatatatttaatttccagctgccagccagaaaactgtagtctatttctgaacaaatgaaactcagtacacagacatatttagtgattaatgacctattctaagaggaagcctgaaaggaggaagaaggtgtgttttctccctgggctgtgaatgagaagataaagtaagtatccaaagtacataaatctgatattctgagattaataataggctttatctggggtaggtgttagtgactgagaattaataagacagtttttaaaatgtagcatgcatagtgaaaagaacacaggctttcaaatatgacagacttaaggtccacatttggcttggctcattcaaactctgtgacactgggcaaattaccaatgtactctgagcctcaatctcctcttttgtaaaacgggcatgataaaacttactatctatcatagtagatagtaactatataaatgagaaatcacagatgattggacagttaaaaatttttttttttgctttctggcaagaaaaattccggctctggagaaataatgggaaagtccccagtgtcagcaaaggaaaacatgtccaggaagggtaacagaaggagaagtatgacctgaaaacctgggagcagtctaggcatgaagagaaatgagctcacctctttgagcttcactttactcatctgaaataaaagaagagagcatccctggtagagactggagtctgaaatatcatgaggtcaagctaggaagagttcctgctgtgtatgaatatttgtaaataagcacagatattgtacatagcagcgttatttacagtggccaataggtggaagctaagtgtccattgatgggtaaatggataaacaaaatgtcgtatgtacatacaatggaatatcttcagccttaaaaaggaaggaaattcggacacatgctaaagtgtggatgaaccttgaggacataatgctaagtgaaataagccagtcacagaaagacaaatattgtatgattccacttacatgaagcatctagagtagtcatagtcacagaagcagaaagttaaagtggtagttcccaggggctgggggagaaggaaattgagagttgtttaacgagtatagcattttagttttacaagatgtaaaacttctagagattgattgcacaataatgtgactattgtaaatatacttaatgctaataaactatacttagaaatggttaagatggtaaattttatgttatagttactttactgcaattaaaaaaagtaagcacagcattttaaaaggtatcatttgtataatagaggtgtgtacatatgcatatataactatatatattttttcaattttatttaattttttaggtgcagggtttcactgtgttgcccaggttggagtgcagtagtgcaattatagcttactgtcaccttgaactcctgggctcaaatgatcctcctgcctcagtctcctacgtagtgaggatacaagtgtgcatgacaatgcctggctaattaaaaaaaattttttttatagaaacagggtctcactatgttgctgaggctagtctcaagggatcctccattcttggccttccaaagtgctgggattataggtgtgaaccactgtaccactatatattaatggttataaaatacaaatatttaacaattaatcatatgtatttcatattgtaccatttaaaacaatgtttctactaagactaaaaatcatacaacctttctgcaggacaaggtacagattcatgttgactctgaaattccactttcaggaattataaggaagcatgtgtacaaaagtttaacaagtttaatataagtatgcttacaaaagtttaacatgattcacagtactatttgtagtaatagcaaaaagttggaagcaatcataattgctcagtactggagaattcattaagtaggttatggtacatttatcaactcattgggatggagtattgcagaaatgtatcttgacattgaaaaatatctagactgttaatacttgggaaaaaagtagtttgcatgtataaataacagaactcatttcttaattttacatattgtgctgtagccactgtaacaaaatatttctcttgtgctatttttattacttacacaattttgttacttacataatttggtatttataagcttttgatgttcagagtacctgatgataaagaacataatacttaggctgggagcgatggctcacatctgtaatccaagcactttgggaggccaaggtgggcagatcacttgagttcaggagttcaagaccaacctgaccaacatggtcaaacaaatacaaaaagtagctggtggtgcacacctatagtcccaactacttgggaggctaaggcaggataattgcttgaactgggaggcggaggctgcagtgagcagagatcgtgccgctgcactctagcctgagtgacagagcaagactccgtctcaaaaaaaaaaaagaagaacttaatactttcgatacttgctataattaaatgttttcagagtctgatttttttttttttttttttttttttttgagacggagtcttgctctgtcactcaggctggaatgcaatggcgtgatctcggctcactgcaacctccccctcccaggttcaagtgattttcctgcctcagcctcacgagtagctaggattgctgggattacaggtgcccgccaccatgcctggctaatttttgtatttttagtagaggccaggctggtcttgaactcgtgacctcaggtgatccacccgccttggcctcccaaagtgctgggattacaggtgtgagccaccacacccagcctcaaagtctgattttgaagagaatatatgcttcataaagttgcatttttcttacctaatattcatttaatcaagttaacattatagtactttcatagaagaagttattaaacactttcatgttagaatctaataaccatgattgttttaaaacaaagtttggcatttatttggttattaatcactcaaacataattaatcactatggttaattactgtgtttctctgtaagttttgatattaattctaaaggatagaagtctacatattattttttgtggtttgtgttacaatttcatatttgtccatgccaatcctggtgagaattgcagcctgtcttagctgttgaagtacttcagcccataaaatacttcaagctattttgtatcattttgtatagtgtctaggaatgtagactatttagtctagtttgttggactcaatcctgtacttccaagtgaagtcaagttgctgtttgagcggccctggctaaattacttcatctctttgagcttcactatactcatctgaaataagacatgataataaatagacacagccttattttttgtgaatagaatattattcattccattatagtgcatttcactatatgtgctcagcatgcagagtctatcctaccaactcatgctcctgagagagcttaagaattcccattccctcagtggttctcagttctctcatcctctgatagtttgaccattttttgtgtctccagttcctcatgtataaaatgagaacattgattgtacctacttcatagggttattgtgaaatgaaattatttgttgtgtgtaaatttgttgaaacggtgcctggcacatggtgactaataatcctgtgaatattagttattgctgttaccttggttcagagtatgtaatgcattaattttaaaaaggaaccacattgcccacattcaggtgatggatgatttttttatcccctcattgatggactctcagtatcctttacttggcacttcctaggttcttcttgggttaaaaaggtattggggttgggagtggtgattcccacgtaatcccagcactttgggaggctgaggcaggcagatcacctgaggtcaggagttcgagaccaacatgtgaaaccttgtttcttctaaaaagacaaaaattagctgggtgtggtggcgggtgcctataatcccagctacttgggaggctgaggcaagagaatcacttgaacccaggaggcagaggttgcagttagcccagattgtgccactgcactgtagcctgggtgacagagcgagactctgtctcaaaaacaaacaaaacaaaacaaaaccaaaaggtactgggactgggatgttaggggcatgatatcaaaggaagtaatcagcaactatggagcttggtgataaacacataggaaacagcaagtaggtcttagggtattctcattattaggtgatcaggaagtcagatattgtaaatggccagacaagattagtgttaaattctgaagaatgcaggcttactatctgctaatagaacaaacacacatctgtcaaatacaaggatgtctatctaagaaatgggtgaacctgaaagcaataaagactacattttgtaacaattcaagacttggagatgggggaatgaatcattgctagtagtagactctttaattgtttttcttcaacccctcccccccaaatgaaagacacacactcatatatgcacacgtgcacatatgtgcatgcacacacaaacacacacagttttattcattaatgacagcttctgagttaggtgctggggacatgaaaatgagccctcagagagttaactataatacaatgaaagtttaatagaatgataatactgatgtgtgaatatagatgtgataatgttgataagtgaatatagatagagcctaaagctgctcagcttccctcaagtgtaaggaaacagttacaaacaagatcaagaataaggaagagggggaggagccaagatggccgaataggaacagctccggtctgcatctcccagcgtgagcgacgcagaagacgggtgatttctgcatttccatttgaggtaccgggttcatctcactagggagtgtcagacagtgggcgcaggagagtgggtgcagcgcaccgtgcgccagccgaagcagggtgaggcattgcctcactcgggaagcacaaggggtcggggagttagttccctttcctggtcaaggaaaggggtgacagacggcacctggaaaatcgggccactcccacccgaatactgcgcttttccaatgggcttaggaaacggtgcaccaggagatgatatcccacacctggcttggagggtcctacgcccaccgagtctcactgattgctagcacagcagtctgagatcaaactgcaaggcggcagcgaggctggcggaggggcgcctgccattgcccaggcttgcttaggtaaacaaagcagcctggaagatcgaactgggtggagcccaccacagctcaaggaggcctgcctgcctctgtaggctccacctctgggggcagggcacagacaaaaagacagcagtaacctctgcagacttaaatgtccctgtctgacagctttgaggagagcagtggttctcccagcactcagctggagatctgataatgggcagactgcctcctcaggtgggtccccgagcagcctaactgggaggcaccccccagtaggggcagactgacacctcgcacggccgggtactcctctgagacaaaacttccagaggaacgatcagacagcagcattcgcggatcacgaaaatccgcggttctgcagacactgccgctgatacccaggcaaacagggtctggagtggacctctagcaaattccaacagacctgcagctgagggtcctgtctgttagaaggaaaactaacaaacagaaaggacatccacaccaaaaacccatctgtacatcaccatcatcaaagaccaaaagcggataaaaccataaagatggggaaaaaaacagagcagaaaaactggaaactctaaaaagcagagcgcctctcctcctccaaaggaacgcagttcctcaccagcaacggaacaaagctggatggagaatgactttgacgagttgagagaagaaggcttcagacgatcaaactactccgagctacaggaggaaattcaaaccaaaggcaaagaagttgaaaactctgaaaaaactttagacgaatatataactacaataaccaatacagagaagtgcttaaaggagctgatggagctgaaagccaaggctcgagaactacgtgaagaatgcagaagcctcaggagctgatgcgatcaactggaagaaagggtatcagcgatggaagattaaatgaatgaaatgaagcaagaagggaagtttagagaaaaaagaataaaaagaaatgaacaaagcctccaagaaatatgggactatgtgaaaagaccaaatctgcgtctgatcagtgtacctgaaagtgacggggagaatggaaccaagttggaaaacactctgcaggatattatccaggagaacttccccaatctagcaaggcaggccaacattcagattcaggaaatacagagaacgccacaaagatactccttgagaggagtaactccaagacacgtaattgtcacattcaccaaagttgaaatgaaggaaaaaatgttaaggagaaccagagagaaaggtcaagttacccacaaagggaagctcatcagactaacagcagatctctcggcagaaactctacaagccagaagagagtgggggccaatattcaacattcttaaagaaaagaattttcaacccagaatttcatatccagccaaactaagcttcataagtgaaggagaaataaaatcctttacagacaagcaaatgctgagagattttgtcaccaccaggcctgccctaaaagagcgcctgaaggaagcactaaacatggaaaggcacaacaggtaccagccgctgcaaaatcaagccaaaatgtaaagaccattgagactaggaagaaactgcatcaactaacgagcaaaataaccagctaacatcataatgacaggatcaggttcacacataacaatattaactttaaatgtaaatggactaaatgctccaattaaaagacacagactggcaaattggatcaagagtcaagacccatcagtgtgctgtattcaggaaacccatctcacgtgcagagacacacataggctcaaaataaaaggatggaggaagatctaccaagcaaatggaaaacaaaaaaaggcaggggctgcaatcctagtctctggtaaaacagactttaaaccaacaaagatcaaaagagacaaagaaggccattacgtaatggtaaagggatcaattcaacaagaagagctaactatcctaaatatatatgcacccaatacaggagcacccagattcataaagcaagtcctgagtgacctacaaggagacttagactcccacacaataataatgggagactttaacaccccactgtcaacattagacagatcaatgagacagaaagttaacaaggatacccaggaattggactcagctctgcaccaagcagacgtaatagacatctacagaactctccaccccaaatcaacagaatatacatttttttcagcaccacaccacacctattccaaaactgaccacatagttggaagtaaagctctcctcagcaaatgtaaaagaacagaaattataacaaactgtctctcagaccacagtgcaatcaaactagaactcaggattaagaaactcactcaaaaccgctcaactgcatggaaactgaacaacctgctcctgaatgactactgggtacctaacgaaatgaaggcagtaataaagatgttctttgaaaccaacgagaacaaagtcacaacataccagaatctctgggacacattcaaagcagtgtgtagagggaaatttatagcactaaatgcccacaagagaaagcaggaaagatccaaaattgataccctaacatcacaattaaaagaactagagaagcaagagcaaacacattcaaaagctaacagaaggcaagaaataacgaaaatcagagcagaactgaaggaaatagagacacaaaaaacccttcaaaaaattaatgaatccaggagctggttttttgaaaggatcaacaaaattgatagaccgctagcaagactaataaagaaaaaaagacagaagaatcaaatagatgcaataaaaaatgataaaggggatatcaccaccaatcccacagaaatacaaactaccatcagagaatactacaaacacctctatgcaaataaactagaaaatctagaagaaatggataaattcctcaacacatgcactctcccaagactaaaccaggaagaagttgaatctctgaatagaccaataacaggctctgaaattgtggcaataatcaatagcttaccaaccaaaaagagtccaggaccagatggattcacagccgaattctaccagaggtacaaggaggagctggtaccattccttctgaaactagtccaatcaatagaaaaagagggaatcctccctcactcattttgtgaggccagcatcatcctgatcccaaagccgggcagagacacaaccaaaaaagagaattttagaccaatatccttgatgaacattgatgcaaaaatcctcaataaaatactggcaaaccgaatccagcagcacatcgaaaagcttatccaccatgatcaagtgggtttcatccctgggatgcaaggctggttcaatatacgcaaatcaataaatgtaatgcagcatataaacagaaccaaagacaaaaaccacatgattatctcaatagatgcagaaaaggcctttgacaaaattcaacaactcttcatgctaaaaactgtcaataaattaggtattgatgggatgtatctcaaaataataagagctatctatgacagacccacagccaatatcatactgaatgggcaaaaactggaagcattccctttgaaaactggcacaagacagggatgccctctctcaccactcctattcaacatagtgttgaaagttctggccagggcaattaggcaggaaaaggaaataaagggtattcaattaggaaaggaggaagtcaaattgtccctgtttgcagacgacatgattgtatatctagaaaaccccattgtctcagcctaaaatctccttaagctgataagcaacttcagcaaagtctcaggatacaaaatcaatgtacaaaaatcacaagcattcttgtacaccaataacagacaaacagagagccaaatcatgagtgaactcccattcacagttgcttccaagagaataaaatacttaggaatccaacttacaagggacgtgaaggacctcttcaaggagaactacaaaccactgctcaatgaaataaaagaggatacaaacgaatggaagaacattccatgctcatgggtaggaagaatcaatatcttgaaaatggccatactgcccaaggtagtttatagattcaatgccatccccatcaagctaccaatgactttcttcacagaattggaaaaaactactttaaagttcatatggaatcaaaaagcccgcatcaccaagtcaatcctaagccgaaagaacaaagctggaggcatcacgctacctgacttcaaacaatactacaaggctacagtaaccaaaacagcatggtactggtaccaaaacagagatatagatcaatggacagaacagagccctcagaaataacaccacatatctacaactatctgatctttgacaaacctgagaaaaacaagcaatggggaaaggattccctatttaataaatggtgctgggaaaactggcaaccatatgtagaaagctgaaactggatcccttccttataccttatacaaaaattaattcaagatggattaaagacttaaacgttagatctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaatttttgcaacctactcatctgacaaagggctaatatccagaatctacaatgaactccaacaaatttacaggaaaaaaacagacaaccccatcaaaaagtgggcaaaggatatgaacagacacttctcaaaagaagacatttatgcagccaaaagacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactcttggtgggactgtaaactagttcaaccgttgtggaagacagtgtggcgattcctcagggatctagaactagaaataccatttgacccagccatcccatttctgggtatatacccaaaggactataaatcatgctgctataaagacacatgtacatgtatgtttattgtggcactattcacaatagcaaagacttggaaccaacccaaatgtccaacaatgatagactggattcagaatatgtggcacatatgcaccatggaatactatgcagccataaaaaatgatgagttcatgtcctttgtagggacatggatgaaattggaaatcatcattctcagtaaactatctcaaggacaaaaaaccaaacaccccatgttctcactcatagatgggaattgaacaatgagaacacatggacacaggaaggggaacatcacactctggggaatgttatggggtggggggaggggggagggatagcattaggagatatacctaatgctaaatgacgagttaatgggtgcagcacaccagcatggcacatgtatacatatgtaactaacctgcatattgtgcacatgtaccctaaaacttaaagtataatattaaaaaaaaaaaagaataaggaagactaatgccacatatctacaaccatctgatctttgacaaacctgacaaaaacaagaaatggggaaatgattccctatttaataaatggtgctgggaaaactggctagctatatgtagaaagctgaaactggatcccttccttacaccttatacaaaaattaattcaagatggattaaagacttaaatgttagacttaaaaccataaaaacccttgaagaaaacctagacaataccattcaggacataggcatgggcaaggacttcatgtctaaaacaccaaaagcaatggcaacaaaagccaaaattgacaaatgggatctatttaaactaaagagcttctgcacagcaaaagaaactaccatcaaagtgaacaggcaacctacagaatgggagaaattttttgcaatctactcatctgacaaagggctaatatccagaatctacaatgaactccagcaaatttacaggaaaaaaacaaacaaccccatcaaaaagtgggtgaaggatttgaacagacacttctcaaaagaagacgtttatgcagccaaaagacacatgaaaaaatgctcatcatcactggccatcagagaaatgcaaatcaaaaccacaatgagataccatctcacaccagttagaatggtgatcattaaaaagtcaggagacaacaggtgctggagaggatgtggagaaataggaacacttttacgctattggtgggactgtaaactcattcaaccattgtggaagtcagtgtggtgattcctcagggatctagaactagaaataccatttgacccagtcatcccattactgggtatatacccaaaggattataaatcatgctgctgtaaagacacatgcacacgtatgtttattgcagctctactcacaacagcaaagacttggaaccaagccaaatgtccaacaataatagactggattaagaaaatgtggcacatatacaccatggaatactatacagccataaaaaatgatgagttaatgtactttgtagggacatggatcaagctggaaaccatcattctcagtaaactatctcaaggacaaaaaaccaaacaccacatgttctcactcatagatgggaattgaacaatgagaacacatggacacaggaaggggaacatcacacaccggggcctgttgtggggtggggggaggggggagggataccatttggagatatacctaatgttaaatgatgagttactgggtgcagcataccaacatggcatatgtatacatatgtaactaacctgcacgttgtgcacatgtaccctaaaacttaaagtataattaaaaaaaaaataactaacagatttgaaaaaaaaaaaaaaaagagaaaagaataaggaagactctgggcaccagtaggccctcagacctgtaatcctcttgcaatatttctgcctcagttctgtaccatgataacctggacaattttgatttgtttttatcctaattcatggtgttgcttagggagacagagatgaatgaaaggctcccaattccttgatttcatttatactactgacttaaagaactatgctagtagaagcactccttggatttactcaatttttgtgcttatacgtgatataataaatttgtaactggaataactgaaccaaggaatatttacatttaagttttcttagaccttcttttgcatttaaaaatactccttacaggccgggggcagtggctcatgcctgtaatcctagcactttgggaggctgaggtgggggaattgcttgagctcaggcatttgagaccagcctgggcaacatggtgaaaccccatctctacaaaaacagaaacgcccccaaattatccaggtgtggtggcatatgcctgtagtccaggtacttgggaagtgaggtgggaggatggcttgggcccagaaggctgcagtgtgctgcaatcatgccattgtactccagcctgggcaacaaatcaagaccctatcttaaaaaaaaaaaaatcctatgtgggaaatgcttctttcctatttctaatgattcacttcatatgacagagaccccattagtgtaatatttatgccttcttgtgccttttggaagtgactgaatgtgattggtgagtttcaaattagaaagtgggtttatttggaccactcactttttcctctttcttttatgagcaagctatctgtgatttagcctgttccatcatgctgtaagttttacagggtcaggctgtcccacttgcatgacactgcattgcctgtgactgggagggtaagtcttcaattatgggacttagtgtttggaaaccatctacttgcctgtagtaagtaatattctttaagctaggttatattgttagtaaaggtaatattttgctccttttgccttcgtatttctcttatccttctatctaacttatttctcttacttcttatctattttatctcacttctcagttgattcagagtttattcagaaacagggtttcctatttgttggattgccttaaacataaatgtcttgtacttccttagataaatcagggttaattcaagtcaagtgttaggagccactgccaagtaaagaataatcagcaataagagaagcatttttgtctctgcatgaagatgagcagtattcattcttaatttctagccaatttataaaacataatggaccatgttaggatgaccaaacagtatttgtgtgtgattccattactataattgttaaaatttcaaattaagctgtcacaatgcctgtctcctcaaaactgacttttccctggtatgttgatgagattcaagtcttgatttgattgtgatgtttaaacaatttgcttcggtaatgctattcaaaataaaatctctggatgtgataaaggtcatttagtgccagtaagtttttaaaaaatattttgaaaataaaaataaataatttaggtgtagagtttgcctttttaacaatattttttattgtgaatcttaagtctgcagtcctctttttcactcttgaaaggtttcaaaatatgtgacccttttgaaattaaaaaaaattttaataaacttttaattttagaatactttagattttacaatagtattaaatagtaatggatttagatttaggatagattttagatcttggcaacagaaaagttgcaaaaatattacaggtaggtcctgaacaccctgtgtccaacttcccctgttgttagcatcttaaattagtatgtacatgtatcataactaatggaccaacactggtacataatctttaattaaattccatacttgatatgagtatcattagttcttccctaacgtcctttttgtttttttgccttctggcatcctatccgggataccacattacatttcattgtcatgtctctgtagtcttctctggtctgtgacattttcttagactttccttgtttgtgatgattttgacagttttgaggagtagtggtcaggtattttgtagaatgtccttcaatttgggtttatctgatgtttttcctatggttagattgaggttatgggtctttgcaaggaagaccacagaggtgaagtgccattattaacatatcaattcacatgtcttatcaagggtaggtgctacccacatgacttgtcactatgatgttattatccttgattacctgactgcggtaaagtttgccaggtttctttcctcccccatccttacttacatcattatttggaagcaaagcactgtaagtgcagcccacaacgggggatggggaattaagcttcacatccttgagaggagaatatctacataaattgtttggatttttgtgtgaaggaaacttctttcttctctaattttttaattcattcagtcacttgatgtatgtcaatatggacttgtagatatttatactttggattataatccaatgttatgctacttgttttgttgctcaaattattccagctttggccattgggagctctttcaggtttgctcctgtgtgctttcgctatgctcctttgctttgttttttgagcacttccttccttttctgacattccaaggtgcttgaggctcatcttgtgtatttcctgccctagccctgaaatcaaccatttctctaaggagccctggttccttttattggaagctgatattagaaaccaatatctaagcgctgggcctttgaaatgttttgccatctatctttaagagtaatactgctattttgaaatcatagcttataaaactttagacctattttagttagtaagtgaaatactttttggtacccattgtctatgtaattaggatggccacagttccatttagagataaaaaggagatattcaaggttaaataaacaaagcagcctaaaagtttgtggatagtaatgacgttggctatggatgcaggtgtgcttgggtttaacggagactgttagggttgtttagaggatgcctgttggctgaagaggatgaggagaggcttattttagtaaactgttcttcctctcccagatcaactgtaatctcttccttgttctttctgttcttcctgggagaatttagttactcttgtaactaaaattcccctcaaaacttattacactctactattgaagctgtttgcatcttgcttttgcaagaatctgtagactcccggatgttagggatttgtatttcttttcctttttttttttttttttttgagatggagtttcgctcttgttgcccaggctggagtgcaatggcgccatcttggctcaccacaacctctgcctcccgggttccagcgattctcctgcctcagcctcccaagtagctgggattacaggcatgcactaccacgcctggctaattttgtatttttagtagagatggggtttctccatgttggtcaggctggtcttgaactcccgacctcaggtgatcagcccatctcggcctcccaaagtgctgggattagaggcgtgagccatcatgcccggccttgtatttcttctttgtataatctttagcacagaatttagtaggtgatgacttcagggtattctgtaattatggtttgaagtgaactgaattcagttttgtagatagcatatttcatcatagttagtgaacaatataaatgtctgaaaagataaacataccaggttcaaagaaaagttcaagatggcagtaaaagagccattgaactgatatgtgttgaatggctaaatgaatatcttgactgttgtttgttgcaggactttagaggatgatgggctgtcagggaagtcttacctgaggaagtgatatttggtttggttttaagctatgggtagggcatggatggggcaagttggctggaatattgtgggtgggaaatgacttttttagagagtgttggataggcctgtctgccgtaacagaacatttcaatagagactataaggctggagaggtaagtttgggtcaggtagattgaagaggtatgtgaatgtcagctttctcagttagagaaccatggatagtcatggataactcttaaatgttttgagcaggggaatcaagatctgagataaattctttttttttttttttttttgagacagaatctcactctgttgcccaggctggagtgcagtggtgccatctcagctcactgcaacctccacctcctgggttcaagcgattctcctgcctcagcctcccaggtagctgggattataggggcataccaccgtgcctgttttttgtatttttagtagagacaggttctcaccatgttggccaaactggtcttgaactcctgacctcaaatgatccacccgcctcggcctcccaaagtgctgggattacaggcgtgagccaccgcgcccagcctgagagaaattctaggaagactgatctagagtagaggctggaaattggtggctcacaggctgagtccagatggtagatatattttgttctatatactgtaacaattttaagccaatattcaaaaattgagaaatatcataaaaatagagagtttagggtcttcgtataaaagcaggtgatctggcaacactgggcccacatactcacatggcagcagttggttggggttgagcagaagacagcaccctaagaaggcacattcatcctgatgttcaccactgtccccaacctccccattaccttatgcttagtccacttgacattgcctgaatatctcatatatatttgaatttgggattcttgacttagagatatagtgtatagacttttgtggtatttttaatagtgagattcaggggacccaaatctgggtggttgcaaaggaaatgaaaaaagtatatatataagcagtggttatataagagacagggtgaaagaataactaaataaatctggaccaataacttataaggtccaagaggctaaaaaaaagaataaaagatgactgtatctgttacctattgctatataacaaattaccccaaaacctactagattaaaacaagaaatatttactgtatcacagtttctgagggacaggaatctaggaattgctcagctgtgtgttttaggctcagggtctcccatcaggtggcagtcaaggtgttgtagtcatctcaaggctcagctgagttagtggatctgtttccaggcttactcacatgcttgttggtccacctcagttccttgcttgctgttggccagaagccacagcatgctcaccacatgacagcatgctttccctagaacaagaaaccaagagtgagggagagtaggcacccaagctgaagattttgtcttttataatgcaatcttggaagtaacgtaccatttttgctgtatacagttggtcacaatgacaaccctagtgcactgtgagaggagactgtgtaaggatgtgcataacagaggtggggattactgggattcctcctggaggctggctatcacaatgactctgaaggaccaaaatatttgtggcagcaacattcctgaggaattttcgctcatgtatgaaatgttgttttggggcatcctctaatgaaaactacttgtgattttaattgttctgctccactaattgaccctgattcttgtttacttttgatatactcttagataactttagaataaaataattagcagttttaaaggtcatatggggcattcctttaacttcataggttttaaaaattgggatcccgaaagataatgacttgatcggaatcacatggctaatcagttgcagttctaggagcagatcgaagagagttagcttgcagtatgtgccgtttctgctctgccatgcagtctcctgccccacgctcttctagtatgggcagtatcatcacataaaaacatcactttaagaaacttctacctatgattcagctaataagtaacatgtatttttagttcttattttccatcacatgaaataatttagatgttatattgcaaatttatgtgtttttatatgtaaatttgacattcggctttaccaaatgattaagcatttacataaccgaagcctgctaaagaagcctaaaaatatacctattttaaaagttgagattttgacatgtcagctttcttggcattactcaatcctcatgtctaaaataacctggaccccacatgctagggtgttactcttccctacttttatttcagtttcccttttggagaaccttttataactaatactggtattcttttattttctcactggagtattaatactttatatataagtcattctgcctgtgtcttagaggccaaagtacatgtctagtgactcttcaatgcaatgttataatgggatttttctcctggttagaagtttttgggctgaggtaaaaggtcggttactttctaagtttgtaaggtatagttttgtatacatgtatatgtgcatttagaagaaaagtccacagggttcatcagattcttgcagagagctatgagccaaaaactgttaatgatttctagtgtttgatgcagttttttccctgtagttgtgattgattttgctcttacatgtgtgcattttgtattcatggcaagcaatgtccaggtatttccagttttttagataggaaaatggagcctcaacatcttgtccataaatagtcaataataaaatatatacctaaatattttgatgcaaggcttttgtgtttatttgatgatgatttatacatttagaaatgttagaaaaaaataaaattacagcaacattttaatactctgcattcagtacaggaaattatagtgtctccttaaatgacaccacattctttacctattatatcacagacagatccagaatgtcagttggacaactgctctttgcagacaattttagtcacatactagtgtgaggattatcattagcctaaattgggggccctgtgttaaagaatttatgaacttctaaagtaatactcagatttctaaggtaatatttatgattccattcccttttaaagagactcttatataaagggaatatagttaagattcctcctagtaattgtataatcagagttttttttttttaagataaattattttgggatgtggtagctctaaggctgtgtttatattgaccagaagagatatgtttataaatagagcttttcttttctcaaattcctaccttactccttgataatttaggctccttgctggatttttctttttttttttttttgagatggagtttcgctcttgttgcccaggctggagtgcaatggtgtgatcttggctcacgcaacctctgcctcccgggttcaagctattctcctgcctcagcctcccaagtagctgggattacaggcatgcaccaccatgcacaggtaattttggatttttagtagagacggggtttctccatgttggtcaggctggtctcaaactcctgacctcgggcgatccacccacctcggcctcccaaagtgttgggattacaggcatgagccactgtgcccagcccctttgttttcatttttaaaggcagcaggttttactgtaagagtcccattttacaggtgtagcaaaaactagcctgggaaaaatcctggttcatcatttcaaacccttattatgttgcagcactcaggtaaattgactgaggatgccaacttttagtttatccagtagtgaacctgagcccccaactctatgtggatgcatggaatgaaatagggcatcccacactctgcgttttattgtattagcagggtttgaaattaggagaaattatgatctttataaattaaattcagctgattttcagcttaactaaattatttttattgagtcactgccttttacaacttgaagataacattaggtccaaaaattatatcatactttatggcgtaacaccaataccatgaggcctgggagtcaaacagaccaaatgttgaaaacctggctgtaccatttttaagtgggacttttcatgatttgtctaacttctctgtaccccagtttctttaccaaattaatggtttcctggttactattgcatcattaaactctcttatctgctgtttaggagtcttatctgctgtttagacactgattaagttataacaccagaatggatgctctgaagggcagattcatatgcaatgagaacatatagtgaggcttgactgaaggaagtcagcaaaggaacatcaataaataactctttagccaaaattttgatgtaactgtattgatttccttacacatgagttttgatattttatttctacttttagtatccttttcgtatgtgttaactccatgttggaagtgggcagagtatggataataaagtaataagagaataagctttttgaggacaggaatacattttttctttccttctttgtgaaacggggtctcaacttgcaacgccacttgcccaggctggagtgcagtggcgtgatcttggctcactgcagccttgacctcccgggctcaggtgattctcctgcctcagcctcctgagtagctgggactacaggtccctgccactacacgtggctagtttttgtgtttttttgtagagatggggttttgccatgttgcccaggctggtcctgaattcctggactcaatccacccgctttggcctctcaaagtgtgaggattacagacatgagccaccgtgcctgaccaatttttttttaatagacttttagagcagtttaagtttacagaaaaattaggcagaaagtacagagttcccgcatccttcctcttctcacatcatttgggttaatgccttgaagtgtaattgctgaattatatggtaagactatgtttagctttgtaagaaacaactcaaagtagctgtattgttttgcatttccaccatcagttaaagagagtttctgttgctccacctccttgccagcgtctggtgttgtaatctttttagattttagccattccaatagatgtgtatagtggtgtctcacgttgttttaatttgcaattctctaatatggtgttgagcatctttttatatgcttatttgccaactgtatatttcctttagtaaactgtctgttcagatattttgcccacttttaaactgagttgtttgctttcttatgattgattttttaagatttctttgtatattttggatactagttctttatcatatatgtgatttgcaaatatatgtgtatattgcgatggagtctcactctgtcaccaggctggagtgcagtggtgtgatcttggctcactgcaacctctgactctctggttccactatgccctgctaagttttgtatttttagtagagatggggtttcaccatgttggccaggatggtcttgatctcctgacctcttgatccgcctgccttgacctcccagagtgctgggattacaggtgtgagccaccgtgcccagccatgatttgcaaatattttctcttagtctgtggcttatcttttcattttcttaacagtgtcttttgcagagtggaggtttttaattttaatgaatccaacctatgttttttcttttatggatcatgatgttggtattgtatttaaaaattcatcatcaaatccagggtcatctagattttcttttatgttatcttcctaaagttttatagttttgaattttacatttagtctgtgattcattttgagttaaattttgtgaaaggtataaggtctgtgcctaaatttgtatattttttgcatatagatgtccagttgttccagtaccatttgttgaaaagattatccattctctgttgaattgctttttcttttttgtcaaagatcactttactaaatttgtgtgggtctatttctgggccctctgttatgttcctttggtcgacttgacttttcttttgccaaaaccacactgtttcgacaactgtagctttataataggtattgaaattgggtagtattagtcattcaacttgttattttctgggattgtgttgtctattctaggttggaataattttttataccttagaaataagcacttggtaaatattctgtgttgagaaactttttctcggtacacaatggttacctttttaaacacaagtcagatctgttattcttttgcctcagctccctccagtggcttcctattttagtgagaatcaaattgaaggtcttcgaaatggcttatatggtcctgtggtacctggctcttctgttacctctttagcttcatcttttaatactttttgtcttggtctctttatttcatacctaatggcctccttgctcttgtttgagtacaccaggcatatcctgtcttaggtctgtagcagtggctgttggctttatctgaatgtctttcttccagatatctgtatggctaactccttcatctcttttaagtcttattcagatgccccccttctcaatggggactctctgatcattttatttaaaattccatcttgcctctcacttgtccctcaacctccacaccctcaatttctcttaacctgctctgttttatttcacagccatcactatgaacatcctctaatacttatttgttttatttatttatttatttatttatttatttatttatttatttgagacagggtcttgctctgtcacccaggcaagtacagtcgtgcgataccagctcactgcaacttccgcctcttgggttcaagcaattctcgtatctcagcttcccgagtagctaggattacagatgtgcaacaccatgccacgctaatttttgtatttttagtagagatgggatttcgccatgttggtcaggctggtcttgaatgcctgacctcaagtgatctgcccactttggcctcccaaagtgttgggattacagatgtaagccatcactccctgccacttgttatttttattattattgattgctgtttctctttttgttagaatttaattccacattgtcagggctctttgttttgtttaccagtgtatcttcaactcataaagcatagtaggttttcaataaatattagttttaaaaaatgtatgaatgtgtaagttgagactgatagagcattagctgtgtgcaagaatgctgattcattagatcttacctgatctttagctgatgaccttctaagatgaactgaaaactgaaaccaagccaaagaaatgtttttagaaaattcattgattttttttgacaagctgcagctgcttgtggtggtataaataggtttccttactgtgttatttaagagtagcttaagggcatgagccaagtcaaaacagaaaaaaagcactgactcattagatttttaaagcatgggttgtccacttgtgtttctaggttaagagaattggggtttcccatataatcagaactattaaaggtactgcaaggctgtgtgcggtggctcatgcctgtaatcccagcactttgggagattgaggcgggtggatcacctgaggtcaggagttcgagaccagcctgaccaacacggtgaaaccccgactctactaaaagtgcaaaaattagctgggcatggtggcgcgtgcctgtaatcccagctacttgggaagctgaagcgggagaattgcttgaacctgggaggcggaggttgcagtgagtcgaaatcacgccactgcataccagcgtgggtggcagagcgagactgagtctcaaaaaggaaaaaaaaaaaaaaaagataccgcagcaattgcagagaaaggccttatatgtctgatgagaaactgcaagctttagaaagacagcagtgctatcttcccaaacaacatgatagccagcatgtcaaagccagatttcttttacccatctttgtatctcggcatctagcctggttagtacttggcatgcagtaggtgctcagaaactacttgttgaaagaatgcattgtcagtgaacagtggtcacattcatgatgtggaaatgtcatggacatgggagacattatactcatgtgttctcatgtgttcttgttttataagaacatgctttttatactgtatcatagaaattgtattaagcaaattgactttgacttgaagtctcaggcatgtaagctttctacaaaatgtgaatccatgcttcaattaatcaatctttgagagataaggctcaactttcacagttagagtggatggattgggttttggtcccatgaggctgtagtgtaagaatactaacttgtgcgtgtgactagctaagtaggacaaatccttttgctcagattctctttgcccacatatagttcaagtaaacacaatgaacccaaaaccaaatttgctaagtccttagaggaaatgttacttaggtgtttttagaatgtttaaaatttttgagtttttgggtggtagagatgcctttgttttcctgcttaggaaagttgaataaaaggctgtcatagctccattcctgatagttgtcagggaccaataactgaagtctgagtaaaatctttggagacttcttccagatgctagtaattgctttaacttgagtctgtctggcagtacctcaagatctctgttatatctcataactcatacttcaccattcatcttaacatctctgttctctaagcacagattgctttttgctgcctctcatcacctctgcctcaagacagaccagaaatctcttgcatatctcacctctgcactgtacgtttattttacagtcttctcctttatgatatcctggcatgcatatgtttcgtgcattatttctactatggttgattggaattcattctcttcattggcagttctagtttctacctgacttcttccttgagtgacttcttatgattctagaatagtaatttgataacacttgcaagttctgttactgcatttcagtatttgttatgaaattcaaaatatctcaaaacataaaattgggggcaaatgatatctgcagaaactagtaaagaaggtcaaggctttgcttttgaaaatatcattgaaaatgggtgtttgtcatggtgactttcacaaacatggtggactttgtataaaacaataggatgttagaatctacaggttatggggtctcagagattatagactattgtccagtagtcttacagataagaaactggaaccactgaataagttattcctactcttacggctagcaagtagcaggcaatcatacacagatttcctgagcctgaagttagtgcctattgcttcttaccctccctcccttcctccctccctccctccctccctccctttcttccttccttccttgatggagtctcactctgtcacccaggctgcagtgcaatggcatgatcttggctcactgcaacctctgcctcccgtgttcaagcaattctcctgcctcagcctcccgagtagctgggattacaggcatctgccatcatgcacggctaatttttgtatttttgtagagatggtgtttcaccatgttggccagcctggtcttgacctcctgacctcaggtgatccacccacctcggcctcccaaaatgctgggattacaggcatgagccaccgtgcccagcctaacatccttctttttagtgttcttcccactccttcttttttaaattttcttctttcttcccataaatatttgaatgtcttctgtcagctaggcagtgtgtttactacaaacagacatgaaacaaggtcattgctctcaagttttgccattaggcaaagctagatgagtaaagttagggagctagatgagtaaacataccgcacctgcagccaggggatcccaggctactagtgcaaagggagtgtagaaaatcaagcagcatgtcgtggggctccagaaattgcagaatattgaaagtgaccaaagaaagtgaaagaaaaggctacaagccaagcagaatagtatatggtatttgcccttacagtggtttgaagagaaaacgttttggagattgtgcttgttgctttgcttgttggtgacttgcatttttcagttcagccactggggagcatagaaaaactgggaagagaggttcacagaggcccttgtctaggcagaagtggtcagaccagggttgatgtctcttccagaggcatctgaggctgtgtgtgtgtgtgtgtgtgtgtgtgtgtgtgtgcatgtgcactttgggaaaaggttttgactgtgaggaagggtgctcaggaacaggtagatgaattttgactgcagacttaatactatacttaattattggactatcactactgataggttagactattgcatattaatctgtatatttatagtatgtagtttcattagagggagctctccaaactggagaacagaaatattttcaaaccttaggtcattgtgtacttagtctaagtacattttcaaagtgaaaactggaagtgatgtaggactagagttccttgtgggattggaccagcattcctcaagacaaatggtaatttgctaggcacatcctttggttttctcccccccacccccacccatccctatatgtgtgtgtgtgtgtgtgtgtgtgtgtgtgtgtgtgtgtgtataggtattttttttttttaagaggagtctcgttctgtcggctggagcgcagtggtgtgatctcagctcactgcaacctccacctcccaggttcaagtgattcttgttcctcagcctcctgagtagctgggactacaggtgcgtgccaccatgcctggctaatttttgtacgtttagtagagacgtggtttcaccatgttggccaggctggtttcgaactcctgacctcaggtgatccttctgcctcagcatcccaaaggactggcattacaggcgtgagccaccatgcctggcccatccctatatttttaaattaattaatcatagtgaaaagctaggacatgttggacttgatccaggcataaagaagcagcgctttgacttattaggtaagtgatcaggaagagaaggcatgaattaatgcttatgtggacctgcctgaaatatgtaaggagaaaactagaacacatggtcatgtatggcaaatccctgaggtaaacaaggagaaaatgctttctataaaggtaatgttctcggctgggtgctgtggctcacgcctgtaatcccagcactttgggaggccgagatgggcagatcacctgaggtcaggagttcgagaccagcctggccaacatgtcgaaaccccatctctagtaaaaatacaaaattagctgggtgtggtggcacatggctttaatcccagctactcgggaagctgaggtaggagaatcgcttgaaccggggaggcacatgttgcagtgagctgagatcacgccgttgcactccagcctgggcaacaagagtgaaactctgtctcaaaaaaaaaaaaaaaaaaaaaaaggtggtgttctcgtaaatttgttttacctatggtatagtacaaagtgattgttaaaataagttcttattgaatgagagcaataaactaatcaagcaaaaatatctcacatttcaaaatccaaaaatatgtgtagaggtaaagagatgaagggaaagtagttgcgcaggtattttacattgttctgttaagcaaacagttattgggtgactcttaagtgaaactgtgatagtgaaagaaggggactacaaaagagttatgatagcattcttgtctttaaagaagtatatagttaagaaagggaggcagaagtgcacagataatatcaagggatgcagtacgaattgtgagtgcgggcagccattcccaatttccagatagcaacactggggctggactctggaggagctgcttttgaagcccacttctgctttgtaaatttttgttgggcctgggcgaaggcaagtaggccattctgagatgatttctaaagccccttctcactttcaagttatgtgaaactgttttaaaatttctagagtcttgtcgggcacgccagcactttgggaggccaaggcgggtggatcacctgaggtccggagttcgagaccagcctgaccaacatggagaaaccctgtttctactaaaaatacaaaaaattagccgggcgtggtggcgcatacctgtaatcccagctactcaggaggctgaaacaggagaattgcttgagcccgggaggtggaggttgcattaagttgagatttcaccattgcactccagtctagacaacaagagcaaaactctgtctcaaaaaaaaaacatttctggagtcttgtttaaagttgacatctgtgccatgatgaggcagaagattggttaactaatagaaattgcttttggggttttggatactcagctataaggtgcactaaataaccactaatgtgtagtgaaagcaaaagctgtattcagattcataaatcaagtttctatatataattatttggtaaaaagtgattgtgatgtaagttcttcttttttgacttgaagtatcaagtgagtagaaccgaataatctttatcttagttgtcagaaggaaatttgagcacagttgtgagaagtcaagcttattttttttttttaataggttcctaacctggggttaagatgctaggacccaaccctaggcctgttcactctttgaggatgaaacccgggcatctgtaaaaagttgtacaaatgattttaatgttgagaagggctgagaaccactctactatgctgtttaacttgtgtagttggaatttgaaaacatttgtggtgtttagtaaaattatagcttggttaaattcctattatcaatgataaaaaccacaattacttttgcaccaacataacatggtgtgcatttatctgaccagtagcagctttcagtactggactgcttgggtttgatcctggctcagtcacttgttagctgggttagttatttctagccgtataacaatttgccccccacttggcagctaaatcagtaagcgtttaataactctgtgggccacgaatttgggagtggcttaagtgagagtaaggttaaagttcagatgttgcccagggctgctgtcctctgaaggcttgactggggctggaagatctgcttccaagatggctcactcactggcagagggcaggagggcctcccttgccacgtgggcctctccacagtgctgtttaagtgtcttcaagacatggcaactggcttcccccagggtaagtgatgtagaaatcaagaaagaaaccacattgctttttatgacctagtctcagaactctaacacagttactttagttatattccattaattagtgtccctacatgcacagtgattggaattagctcttgaagggagaagtttccatgtatggacatgttttaaaaccaccacatgagttgtctgtgcagtttcactacacttttttttgtttaatctcagtctcatccataaaagggagatttaattatactatccactttatgttgttattgaaggatctgatgactttaatacatgaaaagtactcaaaacaattcctggcatataataagtgctcagcaaatgctaccttttattacttaaagatatgtttagtagtattcaaggtagtaattcctatattgacagaataagggaaaatcaaggatgcattttcagccaccttatgggcaagagctgggggcaaatataatacttgcttgtatttataattaccctggcaccaaatgcctttatctatggcctgatcagcttgctttttacttaaccaaattctggccaaaagatctgagctcataaatatctgaaagctgatacacattagagtttaaaaaggaagaagattaagcatcattacacagtgggtcttactggggtttagtggctgatacacatggagagacatacaaaaaataaagtagtattaagagatgctggaaactaattttaaataagttttaaataagatacattaaaaggtgtattttaataattcattctcaaagttgtttaatgtccttacccatattaccccaaaacatggcttaatcatgtggcatttcttagcagttcattctatggatttgctattaaattatttgcctctaggtacatatttcaaagttagatatgtgtctttgaatatatttagaaatgttcagacttgtgcaattttcttttaaatttgtgttctctcaaagttattttcttttttgcttttgggggacatggaagaaccaaaatatcctttatatgcttttattttttgagtgggtataaggagatagaaatcctattatttgttaatttaaaaaataaaaggattttgacatatgcagtgcatactctatggttggaccacaaaatgattctgtgaaactattagattcttcaaggactcactttgcttagaggacaagaatggcaggtggaaggagtgctctttgccttgcctagagtgtagtgtctttgatggggagtagctgtttaatgagaggctttaggacacatccagtcagattcacacgcgcctctggaactctttgttttcaggctgcagttccttggctgtgtcagcatctttattgtctgagctcagaaaccccttagtgcaccaaaccaggaagggaaactggcagcatgcaaatgactgacaaagggattgtaatatattagaggtctctgatagtcattaaaaattttgaatggaaaaaaatatgccagcagttaataatatcaaataaattaaaactacaaagtcattcctgtagctgtaaaattagtttcttgagatagacgtttttgctacttgtggtttttgatttatttatttatttattgggatggagtctctcactctgtcacccaggctggagtgcagtggtgcaatcatggctcactgcaacctctgcctccccgattaaagcaattctccttcctcagcctcctgagtagctgggactacaggcatgtgccaccatgcctggctaattttttttgtctttttaatagagacagggtttcaccatgttggccaggctctccaactcctgacctcaagtgatccgcccacttcggcctcccagagtgctgggattacaggcgtgagccactgcgcctgggctgatttatttttaaatattggggtacataagtattctttataaatttgctgcagtgacccacaataatagtggctttaaatgatcatttgtatttccacttatgtagcagtcgagaggtggggagtgcaggatgataatgcagctcagcttcatgaggtcagccagggctggtatgatgctcagggtcaggcgctgtatgggttttaaaacatgtgtgcaacttctttgctgcttttcccattgtgcactctggttgaatctggttgggcacctggctctcttgtaaccagtagaataccacatgactttcatggttatgtcaggaaaggtgatgcagcctctgccttgctgctgggtccgttgcttttagaaccttgaattaccacaaagtagtttgactaccttgaagctgccattcagtgagaaagtcaggccacatgtagatgacacctgtggctgttctcgctgactgcttcaaatgaggttccagccaatagttaacatcagccaccagccatgtgagtgaggatgcctccagatgattccagtccccagtggtcaagccacccagctgttgagtgttactagctgaggcccagacatcatggaacagcagcaacctgccccccttgtacctggtttgaatttctgacctacagaattcttgaacataaaaaaatggttggttttcatagttgaattccagtgtagtttgtcacatagtaactggaacagggacccaggttccttttgtcacattgctttgccatctaggttgttactcttacatgtttttttagatgtttcaccaccacatctgcattccagccatctggattgaagaagtacaaaaaaaggcactgtattccccttcaagggccctcctcagaagtagcacagtcacttctgttctcatctcaatggccacagctgaactggaacatagccacatctagctcaaggaaggctgggaaatgtgtatttattccttgtgtatttgcacctagctaataattagagaatttgtttctttgagaaagaaggatacaaggatatggggaaaagtttctgctacagttgtacgcgcttgattataccaagttctttactttgtgctgtattaatggtagttgtttctttcctgggaaattttccatttcaaagagctcttagtagtaggtttgttggaaagcattgtatttgtgggtaggattaggttggctaatattggttctattttgcacatgaaaatgaaacaatagtaactttaagagaaggaagtttacttttctcttacttgagagaagtccagcaggaggcagtccaggactggcatggttatagccaccatccacagaggctccttacttcttgttcctgcagacttaggctgctgctttgtggtcctagatggctgcttgagccatattcatcgggtctgtgtccccagccagtagaaaggaggagggaaggaagaaggggcaaggggctcatgccagatgtcttacaaagaaaatttctagaagctgccatataacacattagcttttatttcatttactggaactttgttattgaaagtaaggctggggaggtgtagttttattccaggctaccatgtgtccccatcagaatcagggtttcttttactaggaaatgtagcacagctcacagctgtgagtccacagctcacatcatattccttatactgtcaatttgaaaagagctatgtggtttgccagaacttgggccacactgtatattgcaccataaacagaatggttagaaactgtgcatttcagaatgttgtgatttacgtttgtgttcacataaaacttcagccattctttccccattattataaacacttgggtttgtagggacatctgatgtttactggcagatgacatgccatgtacagactgtcagtgttttagcctcaactctcaaagcctttcctgaaaaaaataaatcccatttctagtgtatacataatagggccatctgtcactgtttctcagttgtttaaagttgcattgtttgaagtcctgcttttctaaaagtgtatttttttttcttcctggaaccatctctgttcctttgctttaaaatgaaaatagtctgaatgagtattttagccctttctggaatgagactgagcttgctgcaaggcattgattcatccagtatcacatacagttgctgagagcttttgtcttattaatacttctcttgaaaaaagaccatgactctttgttgttctctgtataaaaccaacttttctgccctgtgtactaggcttgaaagatttaattcatgattgaacttggaaatgcagagaaaatattgtcttttatggctgatctagtcatctttatgagtttcaccttctgattagtgagaaaatgtactaaaattgaatctgttttaaagcatagtctgatgtggcaaatcgaacagtctcctctgatctttgttctgtcttagataaaaatgcttggttgttgaaggcagcttcctctccctctctttttctctgcgtgtcttgagggagagatgtggcttttgcaaccttgcatttctggggaaaacactgtgctcattcctgccagcgtctttatcctggcttttaggacccctgcttcctgggtgatttgtaccccttttctgtcttggatgcctggcaccttgtgggccactgattcttaagtcagctaccagtgaactctggcccattcttgtgactcaggccgtgtcccacattgatgtgacttccccttggctttccactagtgctccacacccatctgcagtctttctgggatgcttgattgttcctggcccatgtgatcttctctgtatcccttgctagagagccccctctccctgctaggatgacccctctgggaggtgtcccagccagacacacagacacttctgtgtctggtctgtaccaagcagaaccaagggtagcctcctttacacggtaccagatagggagtgggtcaagagccccctgtgccttccacatcactccttattcactgaatgcacctcctcctctcagggccaaagcctgaacaggaaaaattagtcttgactcccctcttgactccgtcgtctttctcctacatatactatatcatatcctccttttagctagccctatggctctgctgtcatcgctggaagtggcgtgtcttttctaccctggagaagagctagatcaggcccctgattaaaaggaggcagggaagggagacagaaataaaagcaatttggaaacatctttccaggcaatagtatggctagcaaggctatgtgtcttgctgaataatcctattttataaaccagaaatggttattcctgtctttttatagaatttctataatctcttttttaggctgataaacacttcatgccaaaaggcaaaagagaaaatgggaataaatttcaaaatattattttataatacttgccttaaagtctaccaaaatttttgtcttcttaaactttacatcatcaaagtcagtctctgagctagtagtgtttagcaagaataggggatttggtaatctgaagacctgtgatcaagccttgattacgagatcagtgataaggataagctgctctcattgagtagtacctcagtttcttcatctttaaatgtaagtatctgccttacttacagagtatatgtgaatgtaaagtggggtaattacatgaaagtattctgccaatgcagtgtgattttattaatactagtttccttgtctcacattatgctcatttccatttgtgtatttctgctactgctacctacaattgtcttcttaaattttacataatcaaagtcagtctctgagcttctagctacccacaactgtgcaactcctgtacaactcctcctgcgtgcccacaggtctgttacaagtactcagggttacactggtaactcttctctcagtccctattctgcatgtagtcaaccggtttcctatttagtgtctaatgtcttgttttttttttttttattttcttcattagatttgaaatgacttgatggcaaggaatatatactttatatatgttttatacatttcatacattttctggtattttttatagtcctggaatgtacttcggagctgaaaaaaatagacattacttggtattactataagctagtgaaatagaagggataatccaattatattttctttataatcctgttgtttatctcattcctttctgattctgaagagtacctaacttctgaataacttatactaactgaaattattcaggacttatgaactaaagaacatatgtttaatttaaatactttatccatatctagttttgactgttagaaaatatttttaggttttacaaatttatcttggaaccatgaagtcatttattttaccacactaaaatattcatgggtcaaagatttaattttttaattttttttaagagttgatttgtttgaatccagctctaatatatgtaacatttttattttagtggctgtgtttacatagctcttggatcttttcaggggctatatcttcagtttctgtaattcagcagattttgtctatattttgctaataaatatttatgaggttgccatgtgggagaaactagtgataatgagaatggtctgtatttagaagcaattgagcacatttactctcaaggacctgtgatagatgacatgctaaagtagattaaatgaagtctggatctctcaattaagaacatagaacttagaaagaatcagtcacacagaccccatcgcagaaataaaatttcatagaaaaattgtataaattcagacagaaatctgcctttattatgaatgttacttattttgtttacactttttaaaaggttagcatctacaaataagttacgtatttcttttgttgaattaattgatttccttttagaagttgtactttataaataagttactttactcttaccagagatcacttggaatggcatctatcactatatattcttcagtttctttcttattcctattgctaaaagaaaccgaaagtcatttcttttgtaattgaaaatttcattatcagtggtatgaagtgaatttccaaaatggctcatgtaaacaaaaagctccattttaagaagcattactgtgttctttgttctaggctgcattttggaaccatggacatttcactggctatgctgttatgctgttactctaactggacaatcagttgtgttttaagggtagacataactatgaacaagtgtctagttaatgaatatgcctccatgatacatgtcctgttgccacttccaaacctcattttgttaacttgtgcttactcatttcatttttttcctaaacattttctccagagaactttggttaacttaatttaaaacaataggtttcttggagtcccatttgataattctgtggttactaaagtagatagagattagcagaagccagaaggatgcctctgatgttgccattactagattgcaggaaatatttgagatcaatgcatttaagtctatcaaatagcactaagaagaactacagttttatgttaagcattctcttaggtgcataacattcattatttctttttagcttctatgcaagtgtttgaaatgggtgctatttatccctattttacagatgatgcaaataaatcttagggagtctttaataagactgttgctttagccaatagagttagtagcagagtggggatttgaggtctggtatttctgcctttgaagttggtgctctctaaactgagaggaaaatgcttatatgcagccatttgaatgttctgttcactgttttctgttgccttcctgatagactcccagctttttagcatggcatatctttgtaggtgttttattctagtgtagccattcatgactcttctgtatgcattgcataccatatccactctcacagttatgccttcttctaccttatactcgccatatcactgcctcctacgtaaaaccacacaaatacaaatcaaagagatgaaacagatagataaactcagtcttgtggtggctcacacctgtaatcccagcactttgggaggccgaggcgggtggaccacctgaggtcaggagttcgagaccagcctgaccaacatggagaaaccccgtctctactaaaaatacaaaattagccaggtgtggtggtgcatgtctgtaatcccagctactcaggaggctgaggcaggagaattgcttgaacccgggaggcagaggttgcggtgagctgagatcgtgccattgcccttcagcctgggcaacaagagcaaaactccgtctcaaaaaaaacaaaaaaaacaaaaaaactcaatcttgtttatagtaatacaaactgctattgtattggaaagtgtccaaacagccttagtaggtgattgaataaacaaactggtaagtccatacagtcaaatgcctctccataatcacaaggaacaaatcactggtacatgtaatagtgtggatgagtcccaaatgtattatgctgagtgaaagaagctagattcaaatgactgcatgcatatatttatgtgaaacatagaacaaccagagctaatcaatctacagtgtcagaaatcaggttgcctgtgggagtgggggtgggtattaatggcaaagaggcacaagataactttgttgggggatgaaaatgttctttatcttgttttgggtgcgggttacaggatgcaaacaattctcaaaactttttgaacagaacacttaaaatttacttattttatgttagttgtaccttgatttaaaaaaaaaaagcataaaatcaagccaagctctttttgcatagttctgtcatagcacttaccatgcagttttgcaaattctggcttcctagtctgtctcccattggactaagacaggatgactcatgatgcctttttgtattgccagtgcttagcacttgcctggtgcttagtgggttttcaagagatgcttgttgactgaatggaatgctaccttgttaaaaagcctggcccattaaaaaaaaaaaagaatagtttggaaatactggagacccacttgtgtgcttgatacaagctttagaagcatggaaatctaagcttcataagagttgtgattcaagccattattaacttatagagatttgtatgcaaaaagtgtagactgagtttctacatttttagtaatttgctttgagcttttctagtcaggtgtcaggtgatgcctgaagtttaaaattctataatatccctattctaccctcctctcttctcttttattttggaatgattttggcctggagcagatccctgagtcatacctgtggctttaggagtcttgaaattacttcattatggaaaaaaattttagtttctaagtttaatttcgtagttatacagaagctgctaaatgctcacttggtctgtaggtaatgggccacatggtggttctctattctctgagggaacccagtggcttattatctcttgggaaaaattccatagcattttaaatggctgcctgaacctgggattgcagctttaaccctgtatgttcaagctgacaccagcagtagtgtcacacattttaaaaagtattgtacaaattgagagattctcaaaaccaaaatatcacaagaatgcctgctgtaaaaaaataattgttaaaaaatagatattctttgaagaaaaattggaagaaaaaagatgaaaataaaaattactgattatcttaccacctacatttaattactaatgttatattggcatatccccttataatcttttttcttaggcacttccaagcattttttccctattggtgacgtctatttaatcaatgcgtaatctttttttgtggctctatgataactgacttgataatttttctattcttggatgtttaggatgtttttctactagtagctaataataatagctaaaaaatattgactattaacaggcatgacttgcatttaatgttaaaataaatattttcttgttttgatcttcatctgaagtttggatttttttttagattccagaacctgaagcattgggggttaagagcatggattctggggccttgaacaaattacttaacttctgaatgcctctttttaaaatctgtaacagaggaacaataaccatctgctgttgtgaaaaatgtaaatgcttgggacagggcctggcatatagtcagtgctatataaatatgagacattggcttatagaacacaaaacattatgaacacttttaaagcttttgctcagtattgccaaattctggaaaggttataccagtggagtctcccatcagtgctatctcagggtgattgtttttaccacacagaattagctattaggaaaacttcctcagtatgtgtctgttgctattggcacatcattcattctttcttctttactagccctgatttttgttagataatttatctacttcttaataaaagtgtggaaacaaagaaaaatgcatttcctcttcttttcttttgcatattttcttttttttgtcttagggactagaaggtgactatgttactttctcatgaagatagataggagggactgtggaatttgaaagtttgagaccactcttctcatagtaggcaataaagaagcgtatattatttttaaaatgtctgtaaggagatctcagaaaggtgtccagttcttcaaagtttgcctttggttttcaggacaagcaagtggacaaggcaagagttcactataaagttaaggtatggtgcttgctttggcagcacatatactaaaattggaacgatacagaaagttgaggtatggagatgatcaacccaaggtgatattctctagtgggtaaactcttctcctctgactccagtcagagctactttatctctgtctgttttacatgttgtgttttgggtattgactgggagaatgagtccttagctaaaacaggtttgaagatctttttaccaagaggaattaagcctcagagagaagtctgcgggcaccccacacacttaacatttaatgtgtgcctttccttttgctcatctgtactcctgggtgtggctgcagggagaggggtgcagcgatggtggtggtagcggcagagcccttctgggatggtgttgggttagtgtggttgtgttgagtgtggttcctaaagcccactggggcatgcatggtgatcctgtaactaaagcagttgtccataccagctgtaaactacagttaaataagcaactttaagtgggaggccatgtgattatgaacaaacccagaatgaaaattttttccagtggttcagagcagttgtctttggtgttctccacccatttattcctgctgatgactcactctgtgactggccctgttctattataggaatgaaaagcattacacatgtgaatcatacctgtaatttccattgccttaaaaaatgtggcctcacaacctgaaaaaatactcttaaactccctggtcaaattaaagagaccacagtgatatgaaagtagttactaagaattctagatcactttttttcatgaaaaatggaacttcttatatgaatattaggccgtgtattaaggtatatctgattttattccttaggccgtattcatggtaccagtccatacttatcaagaaaaactgattatgttcagggtaaacggaattagagcattccactgtgtagtaacctacagtatcagagaaaggcaagagctcccaagctcttattttttatttttttgagacacagtcatactctgtcacccaggctggagtgcagtggcccaatctcgtctcactgcaacctctgcctcccgggttaaagcgattctcctgcctcagcctcctgagtacctgggactgcaggtgcacaccaccacgcctggccaattttttgtatttttagtagagacgaggtttcaccatgttggccagccttaaactcctgacctgaggtgatctgcccgcccaaaatgctgggattacaggcctgagccactgcgcccggcccaagctcttatttttgaccttgtattgatttataccatcaccttgagaagaatgaaaatttctctgtacctttttctaatttacaatataggggacttttatgcagtttatttagtgaacggcttgatcctaaacagccaaggacattttattttggtttttctttttctggaattgatatagtaagaaatcacatctgtttatcttatgtcctgtcctagttccttgatgttggagactgtatgggtttgattcacccttacctcttaattttgtacagtggaaaaggtattagaatatccgggccaaattccagctctgctgtttccttgcttacagaaatcttgggctaggttatgttctttgaaatttatttttaaaaaatcaataagaagaggatgatgatccataaagacagtagtaagattgttgtgagatgatgtgaaattctgtagtgtatagtgttgtgattttgacgtttattgcatgttctggataagaatttgctgatttaattgaagtgtctaggaagccagtgtatttcttgagagcctactacataatcttaattatactctattatcgtatttagtgcttataagaatactgtgtgaataggtgtctagtaatacctatgattctgttttatagatgagaaaacttgagttgcacagaagttaaatcattttcccaagctgaaattgctagccagttttgatgctaatatttgaacctaggtttatgtagattccttgcctcctactgattcctaaatcttgttttttgtccttaccatagctgcctaccaaagcctaccaaatacaatctagtgaagccatatacagggtatacaaccatatacaaccataaccatatatgaaaccatatataggaatatatattcttttatattttgaagtctaaaggcacctacttatttaatgaacttatgttggtatatgttgtccaggtaggctattggctgggacagaaaatagcataaaggtaagaagaaataggattctttcagaaaccaacaagtcataaaatttcaaagaaacttgaaaaactgtatttattccttataatttgttgattttatttttatctgagttactggaggtcctgctttaataaattttgaaggtatcttgtatgaatttgatttttaaagtgaaaactgttctgtttatgtccttacatatatgtagtgattataaaagttttcaaaactgaatactttaaaacaccaaattacttaaggtcttcataatataatggatttaccttacatataaataatgtagaaatgatgcttattgaatttattttcatcgagttacatatctctgtgctttggggtatattcttatctagagctctgaatctagaaagaaaggctgatagtgaaaaccttttaaaaaagtctaatttcttaaggttagcatgttacagattaagagttgcagaagctttctgtccttaaacagtgactcagatcagcagaagttagattatatataatacttaaatgttatagcagtataactataattaggaatctctttatatgtttttaggatgctcaggtaggagaaggtagattctaggagttttatattcaattcttagccaattgtgagaacagataccagtaaattccttgtcagagcagaacctgatcccctagatcccagccaacaataagattgaacctcagctgctcagcaactgcacttacaggaaggcaggagatctgatgactgggagagcagatagtggtagaggaggagatacacaaaaaagcatttgtatggagagatttatggcatttgtagtttacatctcagcttacctagcacattctaccattctactcttgtcctgtgtctggattcatgacaaatgctgacaaaaccatttgttttgttctgtggcaattaaactttgaacaaggagactcttcacgcagtataatttctgactatattctcagtaactgattctcctttcagagacctcctgtgccttcactgttttgtatctcagactgggcagccattctctgaaaaaggtatcaccagttgcaccttcacctctgctcgccaactctcacccctcccctgtcttctcccctttgccttccctcctgcagccatcagcctaagagcaagtccagtcacgcctggagtgcttaactctgccttcagaccagaatggggtactctggcatgtgtctcagtatttttttctatatcttccatagagtccaccggaatatgtaatacataaatgaataaaatacctgaaacacatttttccctcacagttattattaatagtaataaacaaatacaccctctttgtaaaataatcaggcactcaatctggaaatatgtagaatgagataggaaagacaccatctaccaacctctctccttatagcttccactctcttctactgatgaaactgctcttcctcatgatatacaccttttatatatattattttccattttttttcactgatcttgtaaacctcttttgtgttactatgtgcagattttcctttattaaaattttataggataggtgaaaggtgaactataattcattcatttagtctcctggtgactgatatttaaattgtttcaaatattttgctatggtaaacatcttagtatgctaatcatatataagcaagtatttgtttcttacaggtagagttattggttcagaaagtatatggattttaagttacagtggacactactaaattgctctcaaaagagtctttgtggccgagtgaggtggctcatacctctaattccagcactttgggaagccaaggctaaaagattgcttgaggccaggagttggagaccggtctggacaaaaaaagggagatcctatctctacaaaaaattttaaaaattagctgggggtggtggggtgtgcctatatagacccagctactcaggaggctgagttgagtggattgcttgagcccaggaggttgagtttgcagtgagctatgatcatgccactgtactctagcctgaatgatggagtgaaaccctgtctgttaaaaaaaataaaaaataaaaaagtctctgccattttacacacccacattacggtagcttgggactacctatttctctgcattcagcattatcattcttacaaatttgtgccaatatgaaataattttatctgcatttcctgattagaaagatgctttagtattaccccatatttttgttggccatttgcatttcttctatgaattgtatgctcacatcatttgtaatttaggaagagctgtccttcttactaattaataggagttattactctatttggatattattgatgtatattttacatatatagcagatgttttcttctagtgagtttttaaactttgtctacagtgtctgctgttatatcagtggtttgtcaaatttgatagttttgtttagttttttttggttcatgacttgttttgaaatattcttcccacccaactattttaaaaccattattttctatatttttaaatggttccatttgttttaagaattgtcttatttctaatattgtataatttcttcgtgtactaccaggtagtataaatccaaagattttactgtagctgtgtgttggacttgttatttccacacttctcttgaaatgtgcaagaagaaagcttttcttaacaccttacaatatttctttgtacatgcagcaacatgagagtcttttgttgccacaacagaggcagacaatatttattactgtgagaccaactgtaggctttatgtatgtgggactttgcagtagtgactaagctaagaaattacgtggaaataacagcatttgtatactttcacctatggagtcctaaagtattttggaaactttttcttaatgatgaataattttatctgataactttcctggtaaggaccttccttttaacaaaagtagggtggaggggcgagtggctggggagtggactgtggctaaggctcagagttattaagtagcttcctctaagtctgtccttccacagagataagtcacagatgagtggatgaaagttggattgactagaacatgaacatcagttgtacgtctatactaatagaaataaaccataatgatgttcctgtgggaatgaacatttgaaaagatttttcaattaaaatgagagtggggactttttcctattacccatttcaactacgtggcagctacaacctccagtcaccaagtaatgttggctgagatttctgtggttgaaggtcaaatcaggtaggcaagtgaggtgttactagagtgaggcagtgctgtcagctgatgattgggtgtgagctgatagctcacaggtggtttgagatgggattctgcagggtggtgatgtgcagcctctttgatttgttttcacccagctccctgttcaccaaccatccattgtccatctttttcaggaactgatcttttcaacgatcccaactattccttccttctttcgtctataataccaacaatcttacagctgtttacttgcaatatttttactgtgttgtaccacagagctatttccaggcagtaatggggaaactgactagcgtcctttcttctccctccatattatttctacacaactctaacacttaatgtttaccttttttttttttgagatacagcctttttcaaagtttttctccatcttttaaaattcacatctgatccttaaactcagaaatctcatccctgccttaaattctgatgtaacttcttagtgaagcattgcagctcccctccctccactctttagagtcattaagctcagaaggtaaattccatcttctgtggattcccaccattaacaatcgggccaagctttacttttttttttttttttttgagacagagtttcactcttgtcgcccaggctggagtgcagtgctgtgatctcggctcgctgcaaactccgccttctgggctcaagcaattctcttgcctcagtctcctgagtagctgggattacaggtgcctgtcaccatgccctgctaattttttgtatttttagtagagatggggtttcaccatgcaggtggtctcgaactcctgacctcaggtgatccacctgcctcagcctcccaaagtactgggattacaggcgtgagccatcatgcacagcccaagctttactttttatttttaactcattttttaaaagttagaattttatttcctaagtatgaaattataaagttgagtaggcttttacaaactgcactctctgctcttggtagctttgtgatcctgggcaagttgtttaacctctaagtgcctcagtttcttcatctgtaaatgaaagttatctcactgattgttatgagtataatgtgcagtgtgtgtgtgtgttatatatgtgtgtgtgtaattgagaacaacatctggcaaataataagtgctctctaagtgtttgctattattattatcctggtttcagtgaaatagacaggcttaggctttcgtgtagcggaggcaagggctctaaagataattggaaaaggagagataggaagagaagggctatttactaagcagatactttgaacttctcagcaggatctggtacaatttattcatttacagtatatttagaatagggttagaaaatcatataaagatgttttaaagcattttggcaactgttaatccagcagtattgtggtgtgattgaatggtggttttctattgctgaagtaagtagtgatcatttttgtttgtttgttttttggaattaactatgtatacagtttctattcaggaaggtctattggtctaacgtttcagacaagcataagaatgccaaagatagtttgtcttttgcttgtttagaacaagggttcttatgtcttgacttttcattattcatttattcatacttagaagtgaagtgctcctaaatttgaggcaccttgcttttcctgcattattagattaggggttctattgtttgatgacataaacgtttagaatcagacttcttaagatcccactttggctgtggaattttaggctagattgttaatctctacaactttaattttcacagctttaaactgaggacagtactacccaactcagaattattgtgaaatccaaatgaaaatgtatccataaggcatacataaagaaatacccaaaagtggttttctcccagaaggatgtatgtctagcctataaaggtgatccttccaaatcatgttactagcacacatatcagggataagttaaacaagttaggctggattttttttatttttattgcagggaaattctgcctggggtgttagaagagagaatgtgatgagttagttcagctgtgaaatctaacatcctattggttcgcctcattgcaaaacaaaaaaagggaattaaaactttttttaaaggacttcttaagaacaactttaaaatgaaaagaagaaatagacaatttggtttctttttagtaacagttgtatatatcccctacaaaaatagtagaggagtctggctttgttaatatttgtttaaaaggaggtgttgactagttttcagcttgcaagtaggagtgtctagtcagtgttttcttttctacatagaaagttaacaggactctgacacatcagagtttgtacggagagagtttagggaactgctgcacagatttcctgcagaatgatggggcagctcatgaaaaatgatcaagattggaacgcaaagctggtgggactgatgtgctgtatgggttagtagtatcacatatactatcactttcatgttttcagaactgggaagggaaagttgcactacctgctttggtttgcatggcgatagttcagctgattgtcgggcatctttcgaaaacctgtactgaaatcaggacaacttctgaggctccctggagagaactcccctgcctattgttgtccacagaatatgtatttatataatctcaatacttactgcgtgtgtggtactgagtgagtttagctttgtttggatttcactgaaaaccagtcaatatagattgtaataatcagtactctttttgcatttatttgttcccccccaattctgttattctttgtcttcattgtcgttacatattttcagctgttacactttataagggggatataaatatatatttttattgaaaacttaatctataaatgaaataattttcaaatagaggaatgttataaaagttcaattgtttaaaatcacaggaatgagtttccctttttgttgctgtagcaacattgctctaaatataaatctcagtgttagacatctctaactgaaatgaaataaagaaccattatgagacttgtaattggaaaattagatggtgtaatctggaatactcccttttgaaataactcccttttgaaataatgtgtatggaaagtggtgtgatttacaaagtcttcccagacttaaattattctctgactctaggttgctctcttgaagaaagttgaagcctttagaattcacattaactcttttctcattcctgtagcattgtggaagccttctcatgttaaagagcatattttggtatttgaatgggactcatttaagttgatcatggtttaaaagaagaggtttaggttgttcctgttagaaaacagtatcagaatttatgaattatgtgtgttatttagtctttgtatcttatgtactttagttacggatcataattcctagatattacctcagtagtacctacgaaatatcatgttattagcagtgcttttgagcatctagcacaacaacaacaacaaaacctcattgatcaaaagaacctttgtatagtaagtacctctgtacttagaggtaaattatttgattaaatcagctttcttaatatactgctttggtaagtaattagccaatttatctatagaatctgttttacctcatgttccttgaactataggaccagtttttattcacttagaaaagaagaaatctattttgttaacccttttttacccaagaagaaaatagtttatataatacacataatagattaaatttattttgtgacttatatggaaactctattcttgaattataaagatttttaatatattattaatttttttttcttgaggatttagcatcaggggccttggttgttatttaatgggaataatatggatattacctaggaagtaatttttttcatttactctgttttctttttgctggatgcttagaacatcactgctgaaaatgtgatatgagtgctagactttggcacagaacttccattgtttgcaatcagttgtccaaagttcacatcacatcacagagccagattccccagctccctgtctgtgactgagatgtggtcagcacttccatttgaaaaatgacagtatcttggggatagtggaagcaaccttgtagggaaacataagagttgggtcctaaccaaggctctttcaatgttaaatgattaagtcagagattctttttagtggagaaattgacacatggctggcttctgttttgctaccctacttcctgtcctttaagccccacctgactgccctggatgaggttggtccttctctcttttgtgcttgcatacatggtgagtgccatgtacttctctcaactggtgtgcttaccacactgcctttctgtcaggtgtcctctccaggtcatgagcttcagaaaccaagactagtgctttctctgcagcctggtggtctcagtgttacaggacaggggtccagattcaaaccccaagagagggttcttggatctcttgccagagagaattcagggtgagtccacagaataaagtgaaagcaagtttattaagaaagtaggccaggtgcggtggctcacgcctggcctacactttgtaatcccaacactttgggaggccgaggcgggaggatcacctgaggtcaggagtttggaaccaacctggctaacatggcgaaaccctgtctaaaatacaaacattagccaggtgtgttggcgcatgcctgtgatcccagctactcaggaggctgagacaagagaatcccttgaacctgggaggcggaggttgtagcgagctgagaataaagaatggctactccatagacatagcagccctgagggctgctggttgctcatttttgtggttatttcttgatgatatgctaaacaaggggtggattattcatgcctcctccttgtagaccatatagggtagcttcctgacattgccatgggatttgtaaactgtcatggcgctggtgggaatgtcatagtgaggacgaccagaggtcactctcgttgccattttggttttggtgggttttagtcagcatctttactgcaatctgttttattagcaaggtctttatgacctgtatcttgtgctgacctcctatctcaacctgtgacttagaatgccttaaccatctgggaatgcagcccagtaggtctcagcttccttttacctagctcctattcaagatggagttgctctagttcacacccctctgacaccagcaccaccatagcactggactcattaaatgaccagatagatgctaggatgaagagtgagtaaatgagggaagtacagaatctgcacttatcagtgaagagaactagtaaattgtttctgtttccttgttcttgctttaccaacaaattggtaatttaggttcattttgaactgtctaggaatagcaaggccgaaagacatttaggacaccattattgctttaagagatatagttgtatatactactgtatatatgtatacaagtaattctacattgttttcctcagttggattgtccttcctgaaataaaattatttcacacaatgggcatctatctgttgagcgcatagaggcattgcagcatagaggctttgtggcatctagtatgtggtagacaaagatgaatgaggtatagatgatgcccctaaggggccaatagaggaattaataaatattttgtggataatattattggttcataattattaatatcattgcttttgatagcagttttaagcaaagtgcctgggggttttacacttggaatgaggcaaataaaataattttagggtcagacacagtggttcacgcctataatcccagcactctgggaggctgaagcaggtggatggcgtgagcttaggtgttcaagaccagcctgggcaacatgacgaaaccccatctctgcaaaaaatgcaaaaattcaccaagcgtggtgacatgcacctgtagtcccaactccttgggaggctgaggtgagaggatcatttgagtccagggacgtggaggttgcagtaagccaagattgtgccactgtagtccagcctgggcaacagagcgagactgtctcaaacaaaacaaagataaaaccaggccagactcggtgtctcacgcctgtaatcccagcactttgggaggctgaggcgggccgatcacgaggtcaggagattgagaccatcctggctaacacggtgaaaccccatctgtactaaaaatacaaaaaattagccaagcgtggtggcacatgcctgtagtcccagctactcgggaggctgaggcaggagaatcgcttgcacctgggaggcggaggttgtagtgagctgagatcatgccgttgcactccagcctggacagcagagcaagattttgtctcaaaaaaaaattttagtataaattctgagcatttatattcagaattagcaaactacttctactgtctgggaatgctttctgcacccctttatctaatttttaaataagaagtagattagaagttgggggcactgaaaaggtattataggcagaatcaaaagatgggctgtatataagtaccttttttttctccctgacagtgataggaaatggaaggtgtttcaatgaggtactttggagaagaaatgcttatgaaataaaaagtacgttatatgttcctcccccccattcttattggcattaaagtaggagaactctaaatgataatactatcactgagtagtcttacaacaagttgaatttgaacagaccattgtatcactttactaaaatttccttatttccttttctcgaacatttgtgttttttcagaatttttattttcctattgtaagcactctgatttatattctcatagttacattttgtacataatatgattataacttcagaatagattttagaagtagatttgctgggaaaggtcgtaggtatttttagggctttttatgtatattaacaaattgttgtacagcagtgttgtccagtagagctttgttttagagcagtgctgtctgacagaaacttctgtgatgatgggattattctatatcaaattattctaaagtagcgctgtccagtagagctttgttctagagcagtgctgtctgataggaatttccgtgatgattagaatgttctatttctctgcttttcaatatgttagccattagctacatgtgactgtcaagcacttaaattgtgactagtgcaacaaagaaactgaattgttaattgtattttgctttaattaactttggtttaaacttaaataggtgtatgtgactagtggctacagtactgaacaacgcaggtctagaaagtttaaattaaattacattttcatcagcaatatgtgtgtctgtttcttgtgtccttttcaacatgaaattttttaaaaaataaaatcttggcaatttggtaagttagaaagctttatctgtgttactttatattattattttttgttagtgagattgagtacctgtgtgcattacatttttattgttattttattattttttggagacaaggtcttgctgtgtcacccaggctggagtacagtggcgccatcatggctcactgcagccttgagctcctgggctcaaatgacttgcccacctcagcctcccaagtagctgagactacaggtgcatgccaccatgtctggctaatttttgtatttttttgtaaacacggatttcatcatgttgccccggatttcatcatgttgcccaggctagtctccaaatcctgggctcaaacaatttgcctgcattggcctcccgaagggctgggattacaggcataagccaccacacctgacccttgggcattactttttaaaaaattgattaactgtctgtttttgcctgcttatgtattaaaatgttaatctttttcttcttgctgttttttcataatagtaacatttgtctcatattgcgtatattttccctagttgatatacttttgtttacattcaagttattctagagaacataaatacttttaataaataggacaaacattttcaaagaaactttagttatattacagtagtttaaagggggttaggaatgaagaatgaggagaaaaagagatgaagaaagagaccgagacatatcttacccccagggaaaggatggagaacatctgaattgtggtagaagaggaaagaagaccaccaaggaaggagaaagaggtagccctggaggcagaaaggagagaagaaggaaataagaaagtaaggaattgctgtctagaagtagggaggaagaagatagtgtaatacagttttgaatgctagctttaggtgttggatgattatcattctcctttgaaataataacttgatgaaccacagcattccaattgctctttctccttaaatcagaagaaaacttttctcactcttctttgtgctgtctataggaaccagggcaggatcactgtccacagtaaagatctagttggggcatttctttgttgtacagttcaacacaggaatctaggaaagaaatagcataggccaggcatggtggctcacgtctgtaatcccagcactttggaaagccaaggtgggtggatcacttgaagtcaggggttcgagaccagcctggccaacatggtgaaacccttactaaaaatacaaaacaaacaaacaagcaaacaaaaaaaacaaacaaaaaaattagctgggtatggtggcgcatacctgtagtcccagctactctgggggctgacgcaggagaattgcttgagcccaggaggcagaggcggaggttgcagtgagtggagatcatgccactgcactccagcctgggtgacagagtgagattccatatcaaataataataataataaattactacttaatattaattaagcagaataattaatgttcagccagagtctacttcaagccaaaaagtctcaatttaggccttgccttttgtcaagactttaaactatttgctgggtaatcatgaacaagtcttttatcctcgttaagtcttggtttcttattctacaaaatgggagtaacccttcctcttatggctgtgaagagcaaatgggatgtacatatggtaaagggctttgggaaattcagtgcaaggacaaggcttacgttagacaacttcatggtggtggtggtggtgatgaggggttatgggacagaggggcagagggcatttgtttaatggaggaatattggtaaatgcagtactgggaagagaccaacctgacaagcagctctttaaacactttcttacagatagcctgaagttgccaaaatttaacaagaaactttgaatacactgaagcatatcttttaaatatctcatttttgtttatattcatgatcacaaagtcatctattcatagattttaccaaccttatctttatatatattttttccttccagatgaacgggacaaagttcagaagaaaacatttacaaaatggataaatcagcatctcatgaaggtcagtttttatttcgttcacttcctggaattgtttggaatatttcagtttattttgcagtaattgattatatagctctgaagcacaacttttgaaaatcatcttgaaagtttaaattctagagaattttgcatgcattttaggcatctataattatttggtgtgtggacggtgggtaatgatggaggtggataggtaagtacccagtgatttcagtgcattctgtgacgttagtaaaacctgttactattggaatctataaaatctcagaagtttcagaaatctgtaaatatttatatgttagtgcatggaaaagctacatttcttagtaagattttttttctctctcaagattcaaaccaagttctggcctcaggtttatgtggatggcagaaggttagatgagaataaagatattgtagggacagaagtctagacttattatattcttatacttaatttaatccagtgattggtgcttatgtctaactttctctatgaagcagttaatggttatggttcttaaattaatatttacttgtgtaccatgggtaattttgagaatataaactatccagaaaatagataaacacaaaatttgcatgtaatttcgtggagttattggaccctattgaagcccttctgtaaatcttgtgtaaggaacccttaggatttcacaataaactattggtcacttcccctttctcccaccttttaaggagagccctaaagttgaaataggtcatgtttctatttggagttttctcacatagaaatgttattttaaatgtggttatgtattcttaagctagccaacaaatcttatttaaactatcatgtagcttaagagtggtaccaataatgtaaattgcgtttagtcatcttctataaaagtgatttttatttcatggatgtatcagaattaccttagaggtgtgtcagtcttgtctctctcaccacttgacagaacctttttctcaaattctgataatatccctcagggagggcacatcacgcactctctggttgagaatcacaagcgataaaaggttgaaaccctctgctttgtgaggaaatatattgtgaattctgacgcagcatgcggcagttcatctgtcctctctcaagcttttctttcattctgcacatactttatgggagaggatctcttccttacaggctaggacactctgtaaagtttggggtgtggatactgtaataagttgcctggagtgctgactcaggctagggacgtgttccctgtcttttaaataattcttaaaagttttgccttttctaaatttttatcttgttaacttaaatttaatattattcacttatttccccctgtttttttcacccttgttgtgactccaagaactattcttgtttgtcctattcctttggacagtgaggtgcttgagaggttagtctccagacaggcctttctttactggattcttttttttttcatttttgtaaaaggtatattatgttaattttgaacaaattagctttgaaaggaaaacatcttttgcaaggttatcagtctgtgacatgtacaccaaacagaggagcagaagaagcctcacctttgaggtcaggtaaatggtggtgtgtccaggctttgcaattcattatttgtgtgaacttaatctctttatgccctcatctgtaaaatggtggtaatgccagcttggtgtgaggatttaaatgagatagtctaaataagcataaagcatagtacttggcatattgttaggcactctataaatgagagcgtatggtgtagaagggtggattgacttggaaggtgtcagacaaaattgtgaagttaagtgtaagttgcttttggtgcccatctgcttcccttatctgtgtctctttttattacatcaagtacttttccttttagtttattcattttagaaaaagctacagtttggggttcagactctttttgaggagattgataggtgtgttgcctctttaccttagagttctgctgggacactgaagaatggcttacctgtggtaatcctgtagctgtgctctccttgccccctgcctacccctccacagatttttaaaggttgatttgggggcctggagtcctttttaaatctccttttcttcttctcccacacattcttctcacagaaagggagtcagtgaacactcatcttacttctgaaaggttggcagcttttggacctcaaagttagttttacttagagtcacacttggagggcatcttcaaaatcttctggttctgttccctcgtttaaaagtaggggaaacttgccacagctgctactggtagagctgcacttgaagtcgtgaaatgagaatatgaattcaaatgagacgctgtgtccagtgtttgacttctttgagcactgcaataggttgcagatcccagcaggttccccttggatgtggggttgtgtttacttttcttaacttattgtttcaactatttgctaatttttgtgacttaggaagttgtgatttatgtagctataaaaaagcatatacacagtgctcagggttgatactggcgtggtcaatttttaaaagtttatataactggcaaaagtaaacattgtggagcttttaaatgattgtataagttactgttacatttatgtgcataaatattttcttcttaaaatatttggtgaggatttttttgctcttcgatacagtttcttttgttgttttttgcttatttcaaaagcatgctcattaaaaggaaaaaagtcaaaattataaatgtttctggaaaatcagttagaaacacaaaagcaattattagaaaaagttttcctgaaaactctggcacagaagcttgaaaaacaacccatgatgtaccaaaattagcgatacttgaaaaaaagccataactgggggatattccttttcaaccaaatggctgtttaggccaaattgttgtgatgatcaaattgcttttaaccaagtgtatgccactctatattttcaaaccatggtctcatttatctttaagctttgcatatgctgcttccttagaagagggtccttttcgatctccactttcatctggctgattagtgaagaattaactagcacttgtgaactagaacccattaaaattaggaacatgaaacctgattaaaaatttcaagatttttagttctttgttttaaaagtccttgtttatccagaaaaaagcaatctctaaaaatattattgtttaaaaagttaaatatttgatttgtgacatcatttgttttattatatcatttaaaatatctagatagggtaacaatgtcaaatattaaagcaactttataagaaaacaaaattttcatgattattaaattctttctaagcccaaacttgcaacttatgtataaaaaggtaaagtaatcctgagaccaaaaagtttgagaaatattactctatgactgtatgtaataggttatttattgcagcactgttataactgcaagaggttggaaatgacctacatgttcatcaataagagattggtaaaaataattatgatacatccaaacagcgaaatacaacattaaaaagaatcaggagcattaggccagaaaatgagatgaaacacatcaatctcttattgatggtttcactgagtaggaagaggtaaaaccatctctatttgcagatgatagcatcttgtttaaagaaaatctcaaggaacctagcataataactaccagaatgaataaatgagttcagtaaggttgaagcatacaatatcagtatttaacaaactattgtgtttctatacacttgcaaagaacaatccaaaaatgaaatgaagaaaacaattctgggccaggcacagtggtgcacacctgtagtcccagttacttggaagactgaagtgggagagtctcttgagtccagtctgggtaacgtggtgtgaccctgtttcttaatcttttgattatcaaggaaaattcaggatcaggtcagagaatatttttcactcaacagtccagcagataacactaaactctgtttagtctcagtggatgacacctagccctcagcctggccttcaaccactgctgctccatctcgctttcccactggcatcctggtgccctgcacaccccagccctgggccaaggctgcttgaggatgggccctgaggacttttaaaatgtaaccttttctccagaaaaaagttaatatggccttattttgtatttttcaggctaaaattacatttgtttaaagcaaatcggctaattaattaaaacttgtatttgttggtgagcagacatccgtggcttttttccagatgtatttaaattttagtgttccggtagttcagttgtatgactaagcctgcccttgaaactgattgttctattaagaatgttttccttttgattcatcattcttcagaatacttttaagaataaagtgcagttaacacacagattatttaccttgcaaatcatggtttctaggtaaattactggtgtcaggaacatttatatattattctttagcataatttaaactgcagaactagagtaagagctggttgttattggaaatacctgtgtcttcagttagctaaattttacctggagaattgttccaaaatataaaattgatgacattcttttgtcatttacaacatttatttctgcctcttctacctatgacactaggtactccctctttatattagagggttttatataactacttgttgttactcatcatgtgcaatttgctgtctagaaattcataggacaacaatatgagaaatggcacctatgagttaagtactgatttagcttttgcttttctcggggaatggggtgggggacagagaaagaaggaaggactttattttctgaagtatgttaacagctatcattagaagactccctttaatcacttacttgggcctggaattagaacttgagccatgagagactgtgtttaggaggagtagtttaaggggataaatgatttttaggggaagattggagtccagagaagtctatataatgtggtttccttgcataggatccatctaattggcaatttatggtggaaatatattcttcaatactgatcagctatattttaaatttattccttcacatttgaaagaggatatttggtctaaatattttttctttttgtaaactttaatttattgacacataaatgcatttggagaggaagaggccctggatgccattgttggacacactctgtttgttagtcatctacttggttactgcatgggagacacccaactgactatcacagattttatcactgttccatcacgactttggaaagcttaatttactcatggcgcagatattctttgcccacatagtgaagtcagtgacttcatgactccaccaaatcaatcacactgttctttattttctgatttggtggcgggaagataatataaatcctcaagctgagaacacagtggtatcttttagagaacagaaaaaaaagctctatttcctctgtggttttgaccattgcaaagtgatcgagaataatttcacatctgtgggctcagattaaataggggaatttttttttttttttttttgagatggagttttgctcttgtcgcccaggctggagtgcaatggtgcgatctcggctcaccgcaacctctgcctccccgcaatctccgcctcctgggttcaagtgattctcctgcctcagcctcccaggtagctgggattacaggcatgtgccaccacgcccagctaattttgtatttttagtagagacggggtttcttcatgttggtcaggctggtctcgaactcctaacctgaggtggtctgcccgcctcagcctcccaaactgctgggattacaggcgtgagccactgcccccagccaaaataggggaatttttgaagcatcaactttataaagggctaatgaaaaatactgcttggtagagtgtattgctttgggttcttaaaacctacaaataagacttttttccccagaccttagatttatgttagtagttcctaaactttagccttatcgaactcacttggaaatattttaaactttaaaaagttgcaaaaataaagtagtacaaggaacactgatagactgtttacccagattgagctcttgttaatgttttacctagtttgctttattattctcccttccccagtcgtgtgtgtgtgtgtgtgtgtgtgtgtgtgtgtgtgtgtgtactttttttatctgaaccacttgagggtaagttatatataccataatcctttacctctaaatacttcagtatgtatttcctaagaatagggttattctgttttggaccacacagttagcaacttcataaatttatattggtataatattttaatgtctgtatttcagtcttgtttgttgatcttttacatcatcctctcttccccgagggcaaggaccagttcagggtcaggtattgcatttaggtgtcatgtctctttaacctgctttatttgtttatttaattaattattttttttgagacagagtctggctctgtcacccgtgctggagtgcagtggcgtgatctcagctcactgcaacctctccctcctggattcaggtgattcttgtgcctcagcctcctgagcagctgggattacaggcatgagccaccatgcccagctaatttttagtattttttaatagagacgaggtttcaatatgttggccagactgctgcctttgtctccctaggtgttgggattataggtgtgagccaccatgtcctgccaacctgctttaattggaaacagtttctatagcctttttggagacttgtatgaaattgacatttttgaagaatacagaacaagaatttatttatatagaatggaaaaatggattaatagcaaaatatcttttgaacctaaaattatttcatgacaagaagacaaactttttgttttttcttatgagggccatttaagcaattataagtcattttagtgtttgttgataaaattgtgaactatcttttcaaattaagaacaccaaaattttattcagtaattccctcaaataactttagttctatcttgtggtcaacttatagtttttcttcttcttgactttcttattcctgattatcattattactaccaccactgtcaatgccatttattgagtgcttattatgtgcttgaccctgcactagatacattacatacattatctgatttaatccttattttatcagtgagaaaactgaggctcagggaggataagttatctgcccaacatgaagtagctaaaatgttggcagagctgagatttagtccttcgtccttcctggctccacagaactacatcatgccattgcattatgccaaaatataaagacacagaatcttgaatcatgaagaagaaatggagacagagaagtagaaagaaagcaatatgctagggcacatggcctctttgctgtgttctaatttctttcagcattccctcatatactctatcttggctggtatgccctggccttgttatgtagccataaatttctatttgcattcttcttcaatcaacacactaggcaagagtttagagatacagataaaagtatgcaaagaagccaagcagcattcctgagggtcattgttttagctggaaaagggtaatttctaaagcgttttcaaagaagaaaaaaaattacactttgttcagtggtgctaacatattctaaatcatgttgtacagatcttcacattggaagtgtgtgtgttctgtgacaggtctcagttaatttagaatgtttgtttttccaaggttgaggatgtgtgcccatgacatagcctcaggaggtcctgacgaaatgtgcccaacgtggtccgggcacagctaggttttatgcattttagggagacatgagacatagatcaatatgtgtaagatgtacattggttcagtccagaaaggtgggacaactcaaagtggggaggtggcttccaggtcacaggtagataagagacaaatgattgcattcttttgagttctgattagcctttccaaaggaggcaatgagatatgcatttatctcagtgagcagagggtgactttgaatagaatgggaggcaggtttgccctaagcagttcccagcttgacttttccctttagcttagtgattttggggccccaagatttattttccttttacagttctgtagtaggaggattaaagcactagacttggtttgttattcaaaactagactcaaagctgcataaggacaggttatatctgttataagaaacaatgcatctgcggcctctagcatattgtctgatacactgctgttttcctcagaccgtactaaggaatttgatgtgtaatgaatgaatatgaaactaaataaagctttttttcccactagtatactatattacttctatgatggagaagtgaaaggcttgctttggtaggagtgagataaacgttagtctgcaggaaaagagaaataaacttatggtgactttcttcttataaagctaaaaaggtctatttaattataggtatagaaactgaggccccaagtccaacaggttgaccagtggggtccaagttaggattcattcttctgactgctatgttctgtccactggataaaccagtttctccatttatagctaggtagtaggaagtttactcatattcataggtgagattaattaatttgccctaagttactaattagctttgctgttcttaaccactgttgtcttattgtagatgtagccaggtttctttgaaggtctaagatattcttttccatagaatcaaatagaaaaccccatttccaggctctagtgagggtttaccatattgcaaacctgagggagaattcagagactagttttagtctgacagagggactgacagagaaagacaaatagcaaaggaaatgaaacctgtaatcagagaggtagaaggccactccttccagggaaggaattggacttgctgaggagtttggaaactgagtcatttgaacctaatataatatagaagaaattactgtgttgtgaacatttaaaagagggctgacttcaaagggaagctgttgaagctgggaaggctattgcgtatttccaaaagtgttgaaattcatacctgactggatggcacaatgctgttgatgtacagtgttaatatattctgatgctgttgtttgcttaaatatatttttatcaaaaaatttcaagtaatcttgtttgtgattaaaaaaaaaactctcctggaaaatccactaggtttaaaatttaaggaacccatggcattcattaatatgtcagtttttgctgctgcatatgtatagagttcttaacatatggaatgggagctttcataagtcattcttagaggcctgaaattgcatttccttaaatgggtgaaacttgttacaatgtagaacaagaactggtcttgttctcaggctagccctctagatcttatttaatgcatatactatcgtacagatgttaagtgctcaagaagccatatactagaggagaaagagtggtttcctcctctcattcccaaatagatttaaatttcaaactacctaactccttttctttgtccattccttagaatcaccctcttctacccaggggcccagtgcatgtgtgtgtcctcccgaggcactctcttttccagagtgttcatgtttcatcttggactcccagagcagctggtttcagctagggtcatgaagaaagactgatgggaacctcattcactgtagtctgtgaatgatagagcacattagccatcccgctgggaaataaatctccagtggaatgtcaaatagattcaggaagaaaagtcagctgtgcataggaaggtcaacagggtagtaagctagtcatacctggagtctgcctcagtggtaagttattctaagatattcctactttttgcaacacattctttcattgtactttgtgacccagggtaggtggcacagtgtggtggggaaaagcacagactctggactgagctgcttagactcacgtctctcctcaactattttctagtagtatgactttgaacctttctaggccttagttttctcatttgtaaaacagataagaatagtgccctcttatttgggttatattccatgaaataatttacatagaattttgaacacagtgcctgttacacagtgtgtgtgtgtgtgtaaaacagcctgttatatatctttatatctatagacccttaagattgtcaaaaagcttcagatttgtccgcctgtcttctctaacagtggcttgtggtcctgattgcttttttatgtatttgagtcataatattgcctatatattgaaaagggaagaatgcctgcaatatgcaactgtagtggttttataatagtattacagtgatgaatgccagttaaacagtgagctctaaataaggaatgtgttttctgtggtctggccaagaaccactctaacactagtttttcccccttcacatggatatgacagtgtgaggtgagatgctgtgagtgcatggcagagactgtttggattatttgtgagccatcatatcactagttgagtttagccgagattagataatttgcagagcagtagcccagtagagtcatagccacaacatagcatttcaacctcctgcctgagcagattctagcacttaggttttctacaagagcattagcagccttcccgtgttattgttattattttttaaaccaacaaactcaacacttggaatctccaaacaccaatactacttactgaattcttggagaatagtgtaaacatttcttatcttagatttaagtacagttacaccagaaggacacagcatcagtatccatgcatattctaaaagtagaaatgattcctatagagctattgtcctagttaatgggttttaatattatcctttcttttacctcatagtttgttattgttcccaaatgtcttaaacatctaactttaattttatgttaacttaaaaaacttaagaaacacacttaaggacactttgattttactgagcagtatatataatagagcagttttaacatgtcttccaggttgctaaatagaattcaaatttaatttctgattaatactttcttgctgaattttaaaattaattttccagtgttgagaagattaaataaaaacatgttttttggaagggaaacagcagttttcaaatcaggttcccaggaacaccggtgttgtgggataccctgggttgggggagcagcggaggaaggtttcatttgccaaagagattggaaagtagcattttctggttgaagagatttatggtacacattagcatactaaaaagagaaaaattctgtgggagagaaccctgtttaatccaatgtttcctaattcatttggtcttggaatcttttgtcaaagagtatctattaatctccctttgggaaatcctgcagtagagttttaaagtgagtgctttcaagcaaatttaattaatattgtattaatttgagttacagatctggatggggcctagttaatttggtggtcattgcagaaatgttttctcacagcccttcttttttaaattttttttgaaacagagtttggctctttttgcccaggttggagtgcagtggtgtgatcttggctcatcataacctctgcctcccggggttaagcgattctcctgcctcagcctcccgagtagctgggattacaagcatgcaccaacacgcccggctaattttgtatttttagtagagacagggtttcaccatgttgttcaggctggtctcgaaccactgacctcaggtggtctgcctgcctcagcctcccaaagtgctgggattacaggcgtaagccaccacgcccagccctcacagcccttcttataggtcaattattttctaatttatggatgacttacccttttggttctcttgaattataactgagctatttctttaattgtctaaaattctcataccctaacttccacctacttatcttgggccagccccccagaatgatataaaatgtatatggcagctcttgaatacctgaagaaactattttgtcctccttcaccacgtttttcttttaacttgtcaaccagatagttccatttcctttattttattctcatgtgataagattttctatcatacatttctaacatattctctttcagtttttatatttgaaatttttaaggctactgagttgaagacagaaaatgagttgaaggaaagtctgccatgtaatcagagctatacaatgccagagcatgcacagaagttacctatgttatgatctcaactatgtttatattatcttctacctttcacctccctgcctttgtacatgttcagctatttacttacctttatagccgctttttatttctacaatgtaggataattcctgtagtcttaactactttaaagtttttctaaaaagaacatgtactacttttaggctgggcgcggtggctcatgcctgtaatcccagcactttgggaggccaaagtaggtggatcacgaggtcaggagtttgagaccagcctgaccaacatggtgaaaccctgtctctactaaaaatacaaaaattagccaggtgtggtggcatgcacctgtaatcccagctactcaggaggctgaggcaggagaatcacttgaaactgggaggcagaggttgcagtgagccgagattgcaccactgcactccagcctgggtgaaagagtgagacttcgtctcaaaaataaataaataaataaataaataaataaacaaacatgtactacttttattgtcaaaaaagaacaaggtaatgttactttgtaaaaacttagtcattcccactcttaatttgccagggcaaggcaattggataattcatctcctttaaaggagttaagggctgataatgactaatgtgctaattcctcctaagtgtatttgcattctaaccaaggagcctttggacaggggtctacagactatggcctgtgggccaaatccagtcatgacctttttttttttgttaatgtccctgagctaagaatatgttttacatttttaaataattgagaacaaaagaagaagaatattttgtaccatatgaaaattatatgaaatctaaaattcattgttcataaataaaattgtattgaacccagccacacccattcatttatgtgtggttatatactatatggccctcaaagccaaaaatactttctggccctgtattgaaaaagtttgctgacctctgccttagggtgaggttttgtatatatttaagggaaagttttgtgtatattcacttgaatggtgaagacaggatggtcttctgtattttccctaaatcggtttatgaaggtggctttcctttcctgtatgtaaatccagctgtggttctatgaatgtgattttctaccataactgcttttgtgaatgagctttcctctttgatttatttaacaaaatggtatttgaataggccagttcagtatattgctttactacttagacagaattttatttctgtgataattctctgttgccggaagtcagggaccccaaacggagggaccggctgaagccatggcagaagaacatggattgtgaagatttcatggacatttattagttccccaaattaatacttttataatttcctatgcctgtctttactgcaatctctaaacacaaattgtgaagatttcatggacacttatcacttccccagtcaatacccttgtgatttgctaggcctgtctttactttaatctcttaatcctgtcagctgaggaggatgtatgttgcctcaggaccctgtgataattgcgttaactgcacaaattgtagagcatgtgtgtttgaacaatatgaaatctgggcatgttgaaaaaagaacaggatagtgcccccgcctggcagctgccccatctgggaggtggggggcgcacccccgcccggcagccgccccatctgggaggtggggggggccgcccctgcccagcagctgccctgtctgggaggtgggggggcgcccccgcccggcagccgccccgtctgggaggtggggggggcgcccctgcccggcagctgccctgtctgggaggcggagggggctgcccccgcccggcagccgccccgtctggaaggtggcggggggcgcctctgcccggctgccccgtctggggggtggggggcccctctgcctggccgccccatctgggaagtgaggagcccctctgcccggccgccaccctgtctgggaggtgtaccaaacagctcattgagaacgggccatgatgacgatggcggttttgtccaatagaaaagggggaaatgtggggaaaagaaagagagatcacattgttactgtgtctgtgtggaaagtagtagacataggagcctccattttgttctgtactaagaaaaattcttctgccttgggatgctgttgatctgtgaccttacccccaaccccgtgctctctgaaacatgtgctgtgtccactcagggttaaatggattaagggcggtgcaagatgtgctttgttaaacagatgcttgaaggcagcatgctggttaagagtcatcaccactccctaatctcaagtacccagggacacaaacactgcagaaggccgcagggacctctgcctaggaaaaccagagacctttgttcacatgtttatctgctgacgttctctccactattgtcctatgaccctgccaaatccctctctccgagaaacacccaagaatgatcaataaatactaaaaaaaaaaaaaaaaagaacaggataacagcaattgttcagggaataagagagataaccttaaactctgactgctgttgagccaggtggaacagagcctatttctcttctttcaaaagcaaatgggagaaatatcgctgaattctttttctcagcaaggaacatccctgagaaagagaaggcgaccctgagggtgggtctctaaaatggctcccttgggtgtggccgtcttctatggtcgaaactgtagggatgaaataaactccagtctcccatagtgctcccaggcttattaggaagaggaaattcccgcctaataaattttggtcagaccggttgctctcaaaccctgtctcctgataagatgttatcagtgacagtggtgtctgaaacttcattagcaattctaattttgccccagtcctgtggtcctgtgatctcgccctgcctccatttgccttgtgatattctattaccttgtgaagtacgtgatctttgggacccacaccctatcgtacactccttccccttttgaaagtccctaataaaacttgctggttttgtggcttgtggggcatcatggaacctaccgacatgtgatgtctcccccagacgcccagctttaaaatttctctcttttgtactctgtccctttatttctcaaaccggctgacgcttagggaaaatagaaaagaacctacgtgaaatgtcgggggtgaattttgcccaatatctggctgaatttctcctgataattctctttgaggaaagatgtggtcatgagtgatgatctcattgcaaatgtgactttcaaataacagttcagttacgtgtgtgtcaaggttaaagcctatgctaatgtagaactgaggaaatgtttcctttatcactcagattaatctgtttcctaactagaccacttggtaaccttttgcacatgactttccatttgctttttgccctcttaatgtataaccccggctttggtctagattaagggttttatagtggttgacactgacagattttccttatttattagtattatgatcagtcctttaacttatttattgataatcttggagctatttttcaataaatacaaattacacatccctttaagagtatttcagttgtatgtactgacccatattagaatagtctaacattctgtcttacattctgggaaccattattaatttttattgaattttgacagatacagatatttttcatgtgtgaacactgctgtcactccattttttcaaaaggagtgtgactaaaatatttttttaaatctcagctttattgagataatttacatattataaaattcatttaagtgcttaattgaacaatttttagtaaatttatagaattatgcaactattaccatagcctaattttagaatattttcctcaccccaaaaagaaaccttgtacccatttgtcctgtttctcccctgcctccagccgtagaccacccctgataaagtttccgtatcaatggatttgtcttttctggatatttcacataaacagaatcatatatgttgttttctgtctggtttcttttagttagcataatatttttgaggttcatccatgttgtggtatgtatcttccttcagtcccttttattgtcaattagtattccattctatagatagatcacattttatatgtccacctaagagttgatggacatctgggttttttgccactttttgactcttgtgaacaatgctgctataaacataaatgtgcaagactttgtgtagacacatgtttttatttcttttgcacatttccctagaaatggaattgttgggtcatatggtagatcttgtttaacatttcaagaaacctccaaactattttccaaaatggttgcatcatttcacctttccactagcaatgtttaaggattccagtttttctgcattcttgttaacacttgtcattgtctttgattttagcaatcctagaaggtgtgaagtgttagctcattttaattttaattttaattttgctaatgactaataatgttgagcatcttttcatgtgcttattggccatttgtgtacattctttggtgagttgcctgttcagatctttgcctatttttgttttttattttttgagatgaggtcttgctctgtcacctaggatagggtacagtggcatgatcatagctcattgcagcctcaaacttccaccatagcctcccaagtagctggaactaccggtacataccatcacacctatttatttatttatttatttatttaagacaaggtttcactgtgttgcccaggctggtctcaaactcgtctcaaacaattttcccacctaagcctcctgagtgtaaccaactgcccagtggactcttcttgcctgctgcctagatagagccaatttatcaaggcaggggaattgcaatagaagagttttatacatgtagagccagcaaaacaggagactggtgttttattattactcaaatcagtcttctccagaattcagaggcttggggttttcaaggatagcttgggggaagagaggcagttggctagacaatgggtgctttctgcagattggttgagagtgctatcatagggctgttggaaatggtccttatgaacctgtgtcatttctgggtggagccaaaatagtaattggtgggttcaggtggagccagcagttgtcagatatgcaaaaaacctgaaaagacatctcaaaaggccatattagcttctgcaatagtgatgctatctgcaggagtaattggggaagctgcatatcttacgacctctggaataatgatgggtaaccatttatgtctgtaccttagcagaatttagactcctctcatcccttagtctggtggtctctcattagctttacaaaggcagttagttgaatttgggggaatggctattatcatttaaaccaggggtttccaacccctgggccacagaccagtttctgtctgtggcctgttacagcaggaggtgagtggccagtgaacaagcattatcacctgagctccacctcctgtcagatcagcagtgccattagattctcataagagtgtgaaccctattgtgaactgtgcttgccagggatgtaggttgcatgcttatttatttatttatttatttatttatttatttatttatttgagacggagtctcgctctgttgcacaggctggagtgcagtggcacgatctcggctcactgcaagctctgcctaccgggttcacgccattcttctgcctcagcctcctgagtagctgggactacaggcgcctgctaccacgcccagctaattttttgtatttttttagtagagatggggtttcaccgtgttagccaggatggtctggatctcctgacctcgtgatccgcccgccttggcctcccaaggtgctgggattacaggcgtgagccaccgcacccggtcggttgcatgcttgttataagaatcgaacacctgatgatctgaggtgaaagtttcatcctgaaaccatccccaccaccctgaccctggtctgtggaaaaattgtctcccatgaaaccagtccctggtgccaaaaatgtagtgggccactgatttaaattataaactaaatgtctcccaataattaagggcagtttgaaggctggactgcccagtttggtggggttggttagatctgatctctttcactaccataattttcttactcaagtaattttcacaaaggcagtttcatgagtagctgggattacagttgtgagccatccccccggttctctttgcctatttttagattgggtttaaatgctcgtattgttaagtttttaaaaaataatgtatgcttttggtatcatacataagaaatctttgcctgacccaaggtcataaagatttactgccatgattttatctaacaattgtgtagctttagctgttacatctaagtctatgattcattttgtggaaaaggttcaagcaaatgattttgcgtaaggatattcagtttcccagcatcatttgttgaaaaggctatcctttctccactgaattgcctttgttcttttgtcaaacaccagttgtccataaatgtacaggtctatttctggactctctgttctgttccattgatctatatatctatttttattgaaagtgttttgttttacgattcattattcagtcttgaaatttgatttatctagacactttccagccagtcatttaccagactaatttagatggataagagttttaggggtggagggcaagcttcctttttgccctctttgaagatttgctgaaatgctgacaacagacagattcataggagaaaaaggcatacagatttatttacgaatgcgtagacttggaagtccttcaaatatgagactcaaagaagggccagatggttagggcttatgtaccctcttcacaggggagagggaaggggggcgtataggaaattttagaggggcaataaatgattttcaggggaaatgaatgagcttaaagaacaatggcctgggtacaaagttcctctgagctctggggaagctgctgggaaggtgaggggcagaacttcatttgtcttattattcagataaagtcttttaggtaatctctctgagctgccctgagaagaatagatgaaaagtctgtctgggcatggtgatgacttttaatctcttctcttttctgtggttaatctttcctggctatttgatgtaactgctagagagaggtcttaaggcaattgcatttcttttggacagaaatttccctagtcagctaaggaaattctagagatcctccctctttgcgcttggtgaggagtgggagagaaacaagagaaggttagaaagttaggcaacttctaaagacttccaatttcttctcttcaaagtgctcagcatgccaaagcaccatactttggaggtgtcattctgtgctccttaataggggaaatacttaggaggcttggcatgcagaagtggacatttctcttcaatgtgttagtcattcagaagcaatttacttaactccaactgtgtggcagaacatgatgccaggcactaactccgatagatgccatgatgggccttggggcaaacacaaatcccctgctaggaagtcatttgatgggatttgtgaatccatttcctgagtttctgtttttttccctgtgatccggcaggcattcaagagcccacagctgagtgcatggctaaggtcaaatgcaaagtgtaggtgactaatcttttgtttattcaacaaaagttctttgaatatctactatatgaaaggcactgtgtcagacattaagcatttgcagtgaggaccaaagacagggccctttcttcttaaggaaattattaatacatttatgtatattgtctacataaaactataagtaaaatgatgattggtgtactggtataatccaaagaatatgggagtgcagaagaaggaaaccatcactgcctggatgacgttagaatttgacctagtaggaaaagtaagatttcagtaactagaggaggagttatcaatagagaaatatcacagcagaggttttagaatgtgacctcaaatattcaggagacattttgtttcaaaatctctcttagccatcaggaatggacatgaagctctagttagggcactgggacctgagcatcttccagtaaacccatagctgttatgtggttcactttcagaagtgtggcccctgatttgctaggtgttacctggctctagcctgctcttggtgaaacttgtcactttaaaagggagtgtgctcagacaggggctggagagaaaataacttccacttagatttcagctttagtaagagacatcagtgcagtacctcttctgtgacactgggcttttacaactgggaaaactagtttttaagcatctgtggtccggagatctctgttgagtagactagaatctgaaagtttggcagacttatgatgtcatttaggaagtgatcactttgaaacttttaatcctcctacagaaagtatatttctgttgcagagattaatttaacaggagtgtatatagcatctgtcaaatttttaattaagtaattaaaagaataaacctgtatttataattccattccaaacatatcagttccccagatatgattttgggtggttttattttagaaaaatatgaatcgtggtactggggacatggagtgtcatctggatttaaggaaacattctttgacagggaagaggtgttaagcatcagaacggattgtagcagtggcagtggtatctcatcatctgggggtgtctttaaaaatagttttagtgttcctctccttttgtcagttgtcttgatcataatcctgggttatttcaaaggtttaatgaagaggatgcaaccagttgctctcagttgtttattttcaaggacccaaggaaatgagcttatgtttaaagaggagtgaattagtttgcatataaagtatctgaaagtatcagagtatcgtcaaagccttaaaactataaaatatgctatgaagagacccctagattttccagtccttgagacttgaaaaaaagagatgaagcaaccacttgtgtcatgcctatcctaatctctcaccttaggaaataatgctctgaaagggacaccgggaagtgcccatgatggcatgaccagaaggtgtctgcactcctggctggctgcacctttcctggagctgtatctaccagtggattctgttacttgcccagcactaaccccgctctatgaggaccttgcttcctctcgagtctgcagcctgactcatattgtaaccattccagcaagtggctcactgttcggttaaggatagagccatgtaagacattatccaggaagtagatgaagttaatttttgaggttcaggtagttctttgattgtgtgtgtgtgtgtgttgagattataggtcaggcattgacaacctatagctcatttgacaaaagccccaaaagagatgattcagctcagaagtattcagggtagttgccacaaccagcactttaatcagaattgcaaagtagttgaaatttttatttgtcacatccttatattccttttctgatgcttctcttcccactcaccagctgcccagggtcttcagactgccttttacctggaatcataccatgccctgcactgcagtgctactcccctacatgttattccatcttatcaccaaccatgattaagatttctttaaaaccaatgataggtaggtataaagagaaagtcagtctggtaaagtgaccttgtgttagaagcacatgacttgagaggttgctgtatctgtcccaggagctctctttttttgttgttgtttcaaagacagaatgcttttacttgaatacatctctaaatttataatgatcaatttgaatctgatttatgaatttggtataacgttacaagagagtcattagctgggaggatttgatgaggaaatacacattttttgaactagtgtgaattttgatcatgatataaatttaaataaaactaatttaaaattatttaaaataacctttgcatgatttttattttaaagtatttacaattctgttttaaaagcttttcagtaaaagctggaatttaaaaatatagtggaatctctttaaaacagtggtggtaaagaataagactgtaatggtgtcattatagactacctgtgtcaagcagactttgttacacctagttatattttttaagtcatggcacacagatgaactatgtctaattagctattagtattataatagcattctacttcgttgtcattatttgtctttatattacaaccacacattttcacttatttccatcaaaattttgtttccttgattaggttttctccttagacacgttaagtgataatgacccttgctttcccagctttttctttcttttgcccaaattatgagaaagtaggaggagtaggaaaaaggtgagcatagtaaggatatggattggtttctcctcttttccttatgctggtgttaaaaattgctcttgacatagtagtacttaccatgatttttttaaggtgaaaaagagtttaaagaaagatttatataagtaatgagctaggaggatatttgaaaaacctgtaaaaggtaatgcccatattctcctgccaaacagacagaatactggaaagaagcatccttagtcttatctaaaatacctcctcctattttttttttttttttgagacggagtctcgctctgtcgcccaggctggagtgcagtggcgggatctcggctcactgcaagctccgcctcccgggttcacgccattctcctgcctcagcctcccgagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccacctcctcctatttttaaaagattgcacaataatatttattagctgttcttctctctctcatatgtggaatgggtaatgctgatgcctttacaagccgacgctcgtttgttagacattgtagtgtggagtttgtcaagaatacatctttaataatctgtccaaggaactggacagataccaaaaaagatatactatgcagagtatattgatttctgaatttatttctccctttcagttacattacattataattaccccacaccaagatctgtacagctatgcaagagatgaaaaatctacaggttcaggggaaaatgtgagcaaaaatagattttttatctgttttcttgataataaaagggaagataggaaagatagagacctaaactcaaaccaaaccagaaccaaccaaccctaacctcagactgttacagaaaagttacctatttaaaaatatttaaaaattgaaatagccttttaaaaaggttactgcaaccatggcgaaactgtatagaagagaataaaaaatacctaggtgaaacagtgactaaaataccccaaatcttaaagtgtttatctgtaatatattaataaatgtttttattttatttaactacctagttccaccttgtggtgaaagactaggaaaggccattcagtttttgcattttaattgattatagattgtctacccaaaagctaaaaagagaagccttctttgtgaaggagtgaatcaggtccaaagaagtagacacattatttgtaccacctagtaccaatgtggattaaaaaaaaaactctctattattttatccattaataccttaagatgtgtaactaatacctttatttcatagtttaaaaataacctaaaggagatgaattctatgtggccttaatgttgacttaacgtagtaccttaaaaaaccataaccgcctttttatcatgccaaataaggatatttccctgtttgacttaactgcaccaatttcgaatttataataatttaggtagaatatgaattgtagttttattctttcacaactcctgaagaagtagtactgaaataaatttgtaatgaaaaaacaactttagataaggcagctacctaagataatacaatgtttttgagcattttttgtgtgtattttaaaagcattaattttcttatcaataattaatatgttaatatattgatatttatgttacctctattttttcaagtaggctgtctaaggaactctcccaggagaacctgacagctaattttttatgaacgtacttgtttgatgtaaaaaaattgcattgaaaaatattttaatttataattttcactaaagcaaactatccttcttctcgtcacccagttagtataagccagtgaggcgatctcatttgggacaagccttcttttattatttatgtttctttctaaagatagctgattgttttccagaatactgtatcctttagatatagaacttctttaagagcggactgtgaaccctttatgtggctgatgttttgctccctactgcagagctcactaggatgcctgcattttacccaaggttcattaatggaatgactcttccagtttcctttttttcctgagggacctttcctctattattgtgtacagattgggctcttgattttacctgtgattgatttgtttttgcttaagataatagtttacagggaagcttttatattggtcagagatattatggcctcattctgtttaaaattcgtagttttctttgtgtaggaaaagttcaagcttcttaacctgggatataaagcctctatgtccaccggcgcatcgttccagcctcatcttccacctcatgcttcattgacttcaccactgctttccttccttgcaactcatatgtagttttgtgtgtccttgcctttttcctttgttcttgctcctccctccacctgcaacattcccatcttctttgctgggaagacctcagactgggttaagctcctcatagcttcctgagtgttctctgaatgcatttattttatactgcaatttcttgcctaaatttctttcatttcagattacaggcttcaagaggtggcactcttattattcatctttgtacccatagaacttaaaggataccctggcatatgacggatgaatgctcaataaatagtttgtgacctgaattgaattgcagctaaacaatagtaataagtttaaataatgggaagtcaaatttttgtgaaatttgtctagattaacatcaaccactataatgtcagacttttaaaaaaggaagtttaaacattcagcaagcagttatataatgattctcttttcttcaaagttgaatttgatttagcctatataaaaccaaacagttataggttaacaaaaggaaattttcagtgtagtatttttgataagttaagccatttaggtaatacagacctggcatgagctaatgtgttctcactccaaaataaatttgaaatattgtccatgtcatcgccagcatcttgtttagaatttttgttgcccatagagtgttttctagtctattttactttcttgggatattcttttaagtaaaagattagtgccccctagaggtaaactctaggtgcaatgctatatacatatttttttgaagtactgcaaaattctacgagaattgtgtgaaatacagaaaatgctgtatcagccttgttatgtaattcaagttatgtaagttaatcccagagtatttcatagtgcttttactttgctcgtcacttcctctagcactattgatccagacagttttttgtcccatagggagaacatatccaaaaagagaaaaaggaatgctttattaaaaactgaaaatggaatgttagggatattggcggttagtatagtcatctgtgaaggaaagttaccaggcccaatgcctatgactcactcctagggtaaaataaaagcttttctatgtaggcttagctgtctactttcccttcttttctttcccttaaatttcttgctcgatcagattggaaccccaattctttcccctcagttcattcccgaccaccctttacccataatgttgatttttaatttttaatagcatcctcttttattccactcatttgtgctgaggaaactgactcagtattataaagtacttagcacaaggttaggcatctagtagtaactcatggtgtgtgtgtttttgtttattattgttagtgacatttgcttttcggaaaatgatatcttatattttgtaggatgttttccatatacagtatttctgtggaccctcagaatagtcagctgagacaggaaaagcaggcagtattggggatagccagtgtctttggatttttttcaagcattatagaagttaaattagtttatttctgcattttcttctaaaattcttaaaaaattaagccataagtcttaagagtagcttttattttatacattttctaagttgacaggtcattgattttttaaaatgataataatttgatttaaagattacagactttttgttctctaggttgaactaggagttttctgttttccaacctttattttaaagataaaaaaaaccctgaagcctagagagtttaggctgttggtacaaattcataaggccaagggcagaagcaggactaaaatgtcttttcccttatcacaggttttctcttttcctaatttagagggagtctcactcttttgcccaggctggagtgcagtggcatgatcacagctcactgccaccatgcccagctaactttttgtatttttagtagagatggggttttaccatcttagccaggttggtcttaaactcctgacctcatgatccacccacctcggcctcccaaagtgctaggattacaggcgtgagccaccacacccggccatcttttcctagtttagatttgcatggcttaatattattattttccttctctaaacatgtctgttttaattttcctttgttgtcacataaatacgatagtagcaaatgacacctggttttggaaagtttcccttatgtagagggttttgttcagtctggcaagtcaagttgtgaaattgccttactatgagataagtgttcagaatcataccccatctttaactgtcctggagtgagaaagacacaagaagtggaatatagagtgaaatgtaagtctggtagggtgtaggcatagtggaccagagagcacagaattctcagcactattacaatcctggaagtccccaaagtaatcatgtgcttggattctactgtccttctgtgtactgaggatatcagacctgcacaataaagccatttattttgagagacaaagcagctggctgaggatcaggagctgtataatattgtttatataaatataatcttttagtgttcccattcaggctcttttagagtttggctgctttctggttatattgaagatacgcagagaagtacatagatttagaatgtacatgacattcacaagcttagcttttctgccttgtttttaagtaggccttagccttataaattcaagcttgtgccttagaacgggactgggtgaattcttacagtgctctaatacaagagtccccaacccccaggccacagacaggtactggtccggtccatggcctgttaggaagtggcctgcacagtaggaggcgagcattgggccagccagccttaccacctgagctctgcctcctgtcagatcagtgatggcgttagattctcataggagcatgaaacctattgttttgtttgtttgttttttgagacagaatctcactctgttgcccaggctagagtgcagtggcatgatctcggctcactgcaacctccgcctcttgggttcgagtgattctcctgcctcagcgtcccaagtagctgggattacaggcatacgccacattgcccggctaatttttttttgttatttttagtagagatgggttttgccatgttggccaggctggtctcgaactcctgacctcaagtgatccgcccaccttggcctccaaagtgctggggattacaggtatgagccaccacatggctgtgaaccctattgtgaactgtgcatgtgagggatctaggttgtgctctctttatgagaatccaatgcctgatgatctgaggtggaacagtttcatcccaaaaccaccctcccctgcatctgtggaaaaactgtctcccatgaaaccagtccatgagtaggaaattgcagtattagtactcatttccctaagtgcttatctgttcgcgtacatatcatgcatgtaatagatatgttcctgaagaggcccttgaaaattgattcatctctgaaatacagttgagaagttgagagagttgtcatttcatggtatctcaaggtaaatattctaattgaatggataactcctttgtaacttatttggttatttacaggtttttctttctttctttctttcttttttttttttgagacggagtctcgctctgtcacccaggctggagtgcaatggcttgatctcggcccactgcaacctccgcctcctgagttcaagtgattctcctgtctcagcctcccaagtagctgggattacaggcacctgccaccatgcacggctaatttttgtatttttagttgagatggggtttcaccacgttggccaggctggtctcgaactcctgacctcaggtgattgatccacttgccttggcctcccaaagtgctggaagtacaggtgtgagccactgagcatggcgtatttacaggtttttctaaacaaggattgctcaaaatgtgttataacattttttggggctaaataaagtatttttaaactttgtcttactttggtattatgacatcagagattcaactgatattccttgggaattaggaaatcaaaataaaatgtcaatttgtaaagatggagacttggttaaaagtaatttgattcaccttcagttttgctgtatttcaaaggtactattgacatgaacagttactttgtggtagagctattgagcctaagcttagtatttatattatttgtagttaattatgcctagatgggtaattgaatattaaaaggttctgtgacttatgtaaacagtgccagaacactggatgtaaaagctggtaaatttgataagaaattcctaagggaacttcttcttcatcaatcaaaaacattttctgacactaacaaaagatattgtaaaacatatatatagagagagtcaactaagataataaagttttatgggatttaaactatttttggggactgagagacttaccataaaagtttgcttccagtttacattaggcctcttctttgtgtttgtgtagttatatagttttgattataagtttagatcttttcattattttgtgctatatactcacttgacattttggaagtgcaaaggagttggattcatttgtatacagggcttgtgccatgggtgaagtaggtgggattctggttcctgcctctttcctgcccacttctttggctcctttcatgggagtagcccagaatcactgaaaggcgagaaaatggaaatgtgccagtccactgtggaacagccatcttaatacctgctttgacatttgtctgtccaacacaaaccttgcagtgggccatgtggttactagagctatccctacttggcaggctaaacaaagcttttgggaaatctttgatggtttgggttctaaaatcacagacttctaaatcaggcctgtggaacggggaaagctattgtaggttgagtgttgattttgtgctagtgttatttagttttgaaaatcttccgttataagaagacttacattgtgcagaggaagggtttggacagaggacttctaacctgacacatacggatttcaaaaaatttttttgaaataattataggctcataagatattgataaaataatatgtagagtctcatactcttcacccagctcacgtctatggatttctaaaaatgttcctcggcatccttgaacctgttttaggctagaagtagaagatcaactgcgggggtgaaaactccaccctcttgttaaggtggcactggtcactgtatcgggaatcatgaataaagtcagggcattgtccgtatttgaagaattgtaaccccatgtagtagtccaggcttatgtttgttctggtgtcttaaaaatgtaataatttgaattgtcttcttgaattattaatctgaaattcacttttttaagtttttaaattaaatttagtttttaagtaataagcattttaaaaatttaaaaataggtgcatgaatgaataccatgtgaggaatgttttctacttgtctcctttttatgtttaagaatgttaaggataattctgagttctaggaccccaaattttgcttttctctttataggttcgaaaacatgtgaatgatctctatgaagacttaagggatggacacaatttgatttctcttttagaggttctttcaggagataccttggtaagttttaactttcttattttattttgaagaacgtgtaatcttttctgcataggaccagtatgttttcagtacagactattcagatttttgcaacattcatcttttgagctatgaattctgcctgaaaaagaagttttggttagattcctaagcattttcaaacttcaaatgatgtgaatttgagagattgaagcactttgattacttcacttatataatcagttctataattaaaatactatttttgttcttgcttcttttttacctttgggtttttttgcttagcagaagttggatgcataatataaccacatattaaaagacttacaaatagcaagaaaataaacattgctttctgaaaaatgatctaacccattccgcaggtgtcattttttttttttttttggtgaacattacttccccttcttgttacctgttctccttcattatgttctgttcatgctcttcttttcatttctggtctgtcttgtgtctttgctgtcctatcttctgtctgttatattcattagccaagggagcgagattttttgaagaccttacgattggtgagtgcaacagaagcatgcgaatatgaacagcatgaggatgtggaggatgaggataagggggtaggtgtcgcccccataacttgactaacctagccgttcccatgcggtgagcgctaacctgatagagaagtaactcctgggttcaggctcctttttagaaaagcatagaaagggccaaaacccacattgaggtagatgtgtgtgtaccaaaaaattggataaaggaaatattttctctttaaattatcttcagagagctaaaatgattgaattatttatacattactgtgcactgcatggtaattaaacagacttaaagtacatgatggcattttagttaaacaattttatatacattgtatataaacatggaaattttacaagtctgctaatttttgtgcaaattcattcagtttctggaagtgatatttcaaacatagcaactatttattgctttttatgaaagaacttagggaaattttttttagtatttaagtttctgctttaaaccacacctcttggcaataggtatttgatggacatgttttacctctctaatatatcacatgtatttaaaagggagatttaaaaatccagtattccaacagaactcacagagctgtttaatctccgtgactcttagttgactgcagcctacctttgcaagacagacgtgcttcttcttttgtcttctacatacctagtgccccttgattttactggaaattgtgcttttgttggatccagtgggtaaatttatcaacatcgtttctacttgttatgcagagcttacttttccttctgtggtgtgctgtctgttttcttatggcacctttggcttcagcaacctatacatattgaagaagccaagctgtcaattgtcttttttcttttttacctttggaagattttatgtgataaatttcagctccattttttgtatttttgctaagcatttctcagctctgtttcctctgtttccttcatgctaacttgtaacatttcttaagggaaatggcattaaggaaaataattctcatctgtcacttttcctgagactgagaaaataattgtttccatccccaagtagtataaaacgagtatagagtcctttctaattatcgtagtgtccacttttgtgaaaaagctaaaataaagaggaaatatatggttttaattggttttctctctttctctatcatggctaagtaaaccttctctgtctttctccttcttggtgatttttatactaactgcatgctactttatctcattttcattaatatgccatatgtatatatatatgtgtgtgtgtgtgtgtgtgtgtatatacagttataaaaaccctcttgctaatagtgttcaataagaaggtaaaatgatgaatgatatttaattatttttgtgcctccatagctaaataattgtaggctagcgttgttttattaccaaatattaagtgtctgtatattctgtaacatcttctcttttccttttgtttaaacaaaaaatttgtcataaagtatatgtttaaataaaacatacttggaaaaaaatccctagtagtttacattcaatctcagacaatataaagaaattgaaaccttcttagaaaatcttatggccttacctaaacggtaaatactgttttgatatattaagatgaacagaaattatatttaaattagcatggtctgtgataacagaaactctttttcatacctgcatttttctgttcttagcccagagaaaaaggtcggatgcgttttcacagactacagaatgtacaaattgcacttgactatttgaaaagacgccaggtatgatgttttgaaaatactgtaatcatataaatatatgttactaatacatccacgtagaaacatgtcaaggaatgacaaggttaaatttgcctgtgaattgtaaccagtaagcttgtgctttggtgaagcaaatatttaaaaatgtttttaaacatttgctcccaagaaaagaagttaatagtagggataagcccagaggaattataagtgactacatttccatctatgtaagaacttgtgattttctttctgtttgaattggattgcatttgcctaggaagttaatgacattttagtagcaatagaatgttaagaatgcctatgaacagttcttaattgtggggaagcaatacttcattttttacacttagtatataaaaatagttaatttttataaaaatactttatataatacttttaatttagtataagcatttttcatagtagggataaggaaatcttttgtttttataagtagataatattggaaaatttatgagtaaagatataacaacatttctgacaatagcccccaacttgcttgaggtatcaggagaaatcatggaaaagaattaatatattggatatgatcttgacttggtggcattacgtcataggccaaaatattagtaatttttcaattagtacaaaaaaatgcaggagagttcaaaattattgaagacagtgagagtcagagggggcagcaattttttttttaaatagtttgaaaaaaaggaagaggctgggtgtggtggctcatgccagtaatctcagcactttgggaggctgaggcgggagggtcacttgagcccaggaaattgaggatgtgttgagccatgattgcaatattgcactccagccggggtaacagaatgagaccctgtctcaaaaaaaaaaaaaaaaggcaagagaaaaagggggagagggagaggtaaacactagcttttattatttcttcattattattcttaaatattatgaacattaaaatgcttttccctattaaatactagtaaatcctcagtgcttaaatattttaaatgttattgttgtttgcttattattcatcattctagtgaaagtttccagatggatacttctgaaatgttttctggcagcattttgtccaagaagtaaaatgttaaatatcatagtatataattctcagtatttaaattcatgatattaaatgattttgtccaggaagtaaatgttagggatcatcatttgatttatttacctgaatgtacagtttgacagttgataagctttaagtctgagtattatattattttaaaatatttgaacagccttccaaatgcccagtgacttatatatttatggcacattgatagcaaaataatgctagttattttaaaaccttgtaatggaaatttgagaaaattgttagaattgttaggatagtttcatacttaatggtaaaagtaaaataaaatttatttttaaaagacaaaattttttctaattttaagatctcaaatatttaggacttctcacttgaggagttgtatttttgtattgacaagtgaatgcttttagtacttgctctagaacagcagtccccaacctttctggcaacagggactggtttcatggaagactatttttccatgaactggctggtgggaggagtgggggttgtttcagcatgaaactgtttcacctcggatcatcaggcattagatttttataaggagtgcgtgcgcaacctagatccctcaaatgcacagttcacaaatagggttcacacccctataggaatctaatgcagtggctgatctgacaggaggtggagctcaggtggtaatgcttcctgggccgctgctaacctgctgccatgcagcccagtccctatggtataggtttgggggttaggttggggatccctgctgtggaagacaagaatgcaataatacttgctctttctttgttgttaccatatgatttgtaatataaaatgattgagaataagggtaaaacaatatttagttgactactggtgtttaaattattccattttttctttgtataattttagaattgcttttatgtaggtaaagataactggttcaggtttgataaacagttggttttatctcttcttcacattcaaaacaggtgaaattagtgaatattagaaatgatgacataacagatggaaatcccaaattgactttgggattaatctggacaataattttgcactttcaggtaagcccaaattttcttaatttcagcatctaattgctagttttcaggtggttcctatgaagggtgaatgatgcattcatgttctatggaagaaaaataaatttcaagcttctttctttaagtaatatatttgaattgttcttttaagcaacatgctgcttgtgaatctggcaactagtttcctgttcttgataaacttaaatgtagttttaaagacaatgtctgttatctcagagttggaagacatatttctttttattgactggagacacactttttttgctcattagaaagtattacctgttttagatacttaaatgttttatgattagtccttatttagaatgttttttagtaatacaggttcttagcactgtcaactatttcctcctttgatagacactagatggcagcataattataaagagatgtgaagaagaaaagtattcatgttttatgcagagctgtgctttctctctttagatttgaggaaaatgcaaatttattgactgaattattatctaataaacctgagccaattgaggaccgattttgatttagttttggggaagtgatacattaaaaagaatcttcatttgatttaaggagattcctaactttagaacttgctttagtttactaactgctggtctgcttaagaaatgttctgctactagaggtgggaaggagggggaaaagggcatgggctgaaaaactacctattgggtactgtgctcactatctgggtgatgggatcatctgtaccccaaacctcaacatcacgcaatatacccatgtaacaaatccgcacttgtaccccctgaatctaaaataaaagtttaaattataaaaaagacccagaaatgttctgtgtgcagcacagagcctgacccacagtaggcactcagtacatcttaccaatagattactgtacagttggatcttgaaggaggaagtgatcctttgccagcttcaaaaaggacctggggttttgaaacaaatctggtgaggaataagacttttttaaaggctgggcgcggtggctcacgcctgtaatcccaacactttgggaggctgaggcgagtggatcatgaggtcaggagatcaagaccatcctagctaacgggtgaaaccccgtctctactaagaaatacaaaaaattagccaggtgtggtggcatgcacctgtagtcccagctactcgggaggctgaggtgggagaatcgcttgaacctgggaggcagaggttgcagtgagctgagattgcgccactgcactccagcctgggcaacagagcgagactctgtctcaaaaaaaaaaaaaattttttttttttaagttggctgaaatacaggttacgtagacaaatggtggagaataatgtacctggggggcttgttgggaacaggatagatttgacaggtatggagagctacaggaatcagagtctaggtaggtctaggacctgaacagaggcagctgaatagtttcagcagaaggacattcatggagatccaggtaatcaaaggaaaaggtgttagtcagccagactacagggcagctaatacaggtgaatatccacttagctgagctgttaatgtcagggagagccagtaaccagaactggaagccaggaccccaaaggactgagggcattactggaatcaaagatattgaacctaagtgaaggcaataatttggcatgaagcgcagaaccagaccttgttatcagaattgggtaaagtctaggtagaactggccaaaaagttgatttcatatggagttcctcagtggctttgtcagggatcatttaagtagtcctaagtggatcagatcctagagcttttagcagagttgaaactgcaagaaccccagacgggaaagtcagaggtctattggagagaatcaatcacttcatcaccagctggtgaggtaggctgtgtctgaattttgaatgttagacgaaggatcactggggcaatggaaagcattcaggcttcggagggaggtagaattaagtttcgttcttggctcttttacttactgttgtgatgccagtcatgttactactttgagcttaaaaaaaaatgtgtttctgttcatcactttcctttttccgtccatcactttccattttctgtccataaatctttttcggtgacaggacctgtgctggagtctctctgaatccattctggtttgggggctgcctgattctcaaatcgttttttgctcaattaaattttgctaaattttaaaaaatgtgttttaggaaacaacatccattaaaatagatagaaatgagcagagtccatagtgagagagataagctgtgaagctgaggtagtgataaaggtcaggactcagttggggatgcaaaattgaatagaagaggtcacactttccaggaagaaagaaagggacttggacacagggcatagagggtgtaggaaagggatttgttaaagataacaaaactttttagcctgagagattacgaaacagtagactactgagagacacaggggtgatgctagggggaaaagcacttactttctgggtgggcttgatgggatggtgggatatcctgtgcctctgtctgctgagcagttggagacatgagtggagctgagaagccagaggtacagatataaacttggagaagttatcactacacaagtgatcactgattttatcggaaagaagggatcttcaggggacccaagagaagagcacagatggagaagagatggagcactaaggataaaaatttggagaaggcctgcgggaaaagattctgctgaggaaagagaaaaaaggagcatttggagagatggatgaagtaataggaaaatgtactgatgaaaccaagggaagagaatttcaagtagaaataatggtgagcagtatgaaatgccactagagaccacaagaaaattaagatggagtagaggtcaatagtttgttctagaaagaagacattggagacccaagctcctgggagcagagactagaaaataacaagccaaaagggttgggaggtagaagcagtgtatttagaggctgagtttgagaaaatttaaagcaaaagtcttcaaaaaggagttatatactaagagagccctttggggttcagctgcctttggaggagagaggaagactagtcacagaagtatcaaaagaagttttgcgggccgtgcacggtggctcacacctgtaatcccagcactttgggaggccgaggcaggtggatcacctgaggttgggagttcaagaccagcctgaccaacatggagaaacctggtctctactgaaaatacaaaattcgccgggcgttgtggcacatgcctgtaattccaaccacttgggaggctgaggcaggagaatcacttgaacccaggaggcagaggttgtggtgagctgagatcacgccattgcactccagtctgggcaacaggagtgaaactctgtctcaaaaaaataaaaaaagttttgcttctaatatactgtggcatagtgttctagaatccattgtattttagggctttaattataagatgatgtaacaaattatcaccaatattcataaattagaccaaaatctatttggaatggaacacatctatgttttggttaaatggaaatgttctctcttatttaaatgaaataactttttttagtatgacaataacttgagataagaattgttttttggttatgccaagatataaagatttatagcagtggtaatcatcctcactcagagtgactcagcctttttctctatactttacataaataatggaagcaatttcaaaagaccaattgttttattttaacaatatttgttatagcatcataaatggaatctgtttttcagtcaggctttctgaaggtaagcattatcattacagtaatcctatatcattagccaccacatgctagatccagagatactaaggtaatgaagtatattgttctgtttattgggagagtgtccatgaaattaactataacatagggtgatgaatattattggtgatataaatgaaaatagaaatgtatgggaaaggagcattgtagtgggatctgaatggctttagagaatgtaggaaattttcacagatactagagataggctttgaaagatgaatgccagtaaccaggcagactaagttgggccatttctgggagaggtagcagtgtatatggcctagaaatggacagctgcttagtttggcaggtgtattagttcattttgtgttgctgtaaaggcatacctgaggctgagtagtttataaagaacagaaaagaggtttatttggatcatcatggttctgcaggctgtataagagacatagtcctggcatctgcttctggtaaggtctcagaaaatttttcagtcatggtggaaggcaaaggggaagcaggattgtcacatggtaagagagagagagaaggaggaggaggggtaggaggtaccaggctgtttcaaacaactaactctttttttttttttttttttttgagagggagtctcgctctgtcgcccagactggagtgcagcggtgcaatcttggctcactgcaacctccacctcctgggttcaagtgactctcctgtctcagcctcccaagtagctgggattatgggcacgcatcaccacatctggctaatttttctatttttattagaggcagggttttaccatgttggccaggctggtcttgaacttctgacctcaggtgatccacctgcctcggcctcccaaagtgctgggattacaggcatgaactgccgttgctggcctcaaacaactaactcttaagtgggtaagaactcattactgtggggatggccgaaagccgttcatgagggagccgcccctgtgacccagacaccccccactaggcccatctccaacattgggagtcacattttcaacatggaatttggaggggacaaatatctaaacttcatcagcagagatggagggaaggattgggggagtgcagatcactggttgcccctccatcatgttagtacaaatatcagccattatacatttatagtctcttgaataatgtaccactcattacctttgaatacactgaaaatcaagttaaaaacaaaaaaaaatctgggaccttatttttaccagcttctcttctgggatgttcagtttttgctaccggagaatgtttttaaatgattaaggaaaattttacaatgcaggatctgttattgacaaacatctacagtatcattgctaacttgactaactgagtattcttacttagtaaaatataatgagttccatcttttgatcagtctaaagactacctagtgaaaggcaattattaatttttttagtagtgaaatgatttgtacttatgtgtaaatccatttcatgctattctaatttttttttttttttaccatatctatgactcagtgttagaaatatgcacaccttagataatcaagtctcatactgattcattatttttccagcaaggccctcataaaaactgtataatatttaactagggtatgattataaaagttacatataaagtttaactacatatatatatatgtatatatatatatatgaatgcacatatatttccttttgctaaatctttcatgctttaaattatataatttatctatttggtatcacattaaagtcctaataattagataaggtcatggcttggaaatttatattatttgaaaagtattataaactattttaaaagattgattttttttagaaacaattttattagagaattataagcatttagcacttatctctcctgctagctattgaatcagcttattattttttatgacttgttttgaataagagtcttaataaaatttacagagatctttgagcttttgatgtgtttgtgtgcaagtaccaaaattagttggtatttcttaagaaaaaaaaatatatggtagagggtagagagtctctgaaattcaatttgaaaggcactttgaatccaaatttgaagggcactttcctaaatctctcctgactggtgtttgctttctttttgctctcattcgttgaaccaccaaatagtttcaaaggttaagtgcaaacttcattagtgtatctgcatttcagaaaaccgaaggttaaaaacagtcataatcttctcatacagtgaagctaagggtttgccttgagagctcatcagtgttgtaatttgacagtgagcagtaatgtttgtctaagaggattggtggccagaaataagccacagtgtctaatgagacacggaccggctgggcaggatgccacggcatttcttgtgtgtgcctttctcataagcaaaatggcctcagactgaagaggatggtcataaagtctgtgtggaacagatgtcagagtggaattttcagacttaatggagaggatctaagtaagctctggattttgaaatgagtgaatctatggagctgtgatctcctacaaatcaaatggggaatgtctgtggatgtgtaagagctgagaaagaagaacaatatgtagatcctgccaaaactcctttgaaccctgaaaaatactctcctggaagaaaatatttcagaagaaaaccgatcaaaaaaactggaggtgacaaagagtcagttggggcaaacaatgaaaatgaaggcaagaagaagagcagcagtcagccttcaaaagaacagccagctcctttatccaggggactggtacagcaggaatctgttaccctaaactctgcactgggagatggtattcagcaaaagaagacagaagttgtagctgacagcgttaaacagaaacttctgccgagtgctgtaagcagttggtctgactgtgtgaacacttctcctgctaaagacagtgaaacagaagtaaaagttagtgaactggatgaaaggatttcagaaaaagacagcactccatattgcgcaaagaggaagaaacatttagatgatgtcaacacaagcgaaataacattccaggaaaaaactgatgttttttctttccgaaaggcagccagcttaagctctattccctcgggtatagaaagatcactcgaaaaaagtgggtttcctgaagacccaccaaaaagttatagcagtattcaagaaaagcaaaacactgagagattttgccctcatgcaacacagcattttcagtttaaaaaaaagagatgccattccctttatactagtatgtcctctgtttctaaggacacagatggaaatgaggtaagtgaaatgtggagtctgagttcaagtaaataagtgttccaggtgctcacatcagactgacatctaatttgtcttttataaagttattttcatattagtgtatgtaaaagccatagagtttctgttgcgttttgttagtagcctcaggtttgattgttatgattttatttttgtgctgtgcacattctttgaccacactttaatctaaaaatcctgtacattttcattattggtggaagactttaaaaagcactacagtaagagagtgcatatcttttgaatttttctggttcatgattcttgactttgcctgtggaatagcctgtggaagcttagttggactgtaggtaaaagttcaattagaaatagtcatgagaagacaatagctttgtaacaaataataggatactgtaaaattatcagtcaataccgacttgctgattcatgagtttgaaaagccagattctggttctctgttgattttcatgtgcagaaacattcacataattgctgtcaattctgtgcatatgttttgagggctagggtacatcttttcctttatgttattccccagccccagtctaaaatcagaaattgttagggtagcatgccataggaatttgaaaatgacacagactactaggaagttgagatctttattcctaacactgatatttagctttagacaagttacttatctggggtttttacttgtctttaaaatataattagataggtatttatttaattgctcaaaaaatgtattatccacataacctctacatgttactactcaggagttgatggctttttctttaagctattcctaactttatcttttaataaaaaatctgaacataaagaatatttgtgatgttaaacattcttggcaaggtcattgtatcaatgagcagagatcatttgcataatgatagaatgaggttttatgagggttagtgtgcgccatcatcactgaccttggtttctgagttctcctgaaggtgtcctgtttatatacaccgctacaccttgccaatattatgccatcagttctgtttatattttacagtggttatattttaaaaagaaagcattcagtctgtgtcattatctatgtagctctgtcataaagcctagtgcaaaagaaaactacttgactactatatgtttatgaatataagcacttggtttaatttcacatatgttttccagcataatttggcttcaagtaagctgtacatttttgcattaatggaaatttttataatctgtttccttagtggtacattagcctttccttcaatggaaaatatatgtggaaataagtcataaactgaccagtcagatttgcgaaataactgtaatgcaatgtatataaagcctgacgtcttctaggttaaagctgaatgggtagtcattatattatctgaagggtttgacatctcatgtccctgtagttcagataaagactatttatttattctgtggcacacaaagagtccaaatcaagagtttagctattcctcttaggacattcttcctgttaccttggaggtgtttgactctgtttcttaattatctttggttggaaacttccacagaactctttatcttgcattggattctacatttttcattggagaattagttgcaaatgagagcttccagccgcttcattggcatttcatcccggaaatgactgattaaccaacattccttttgtttgttctttttcatagcttccctatgtgatcagtttttgctctgagttgcatgtagggttggacttaacttttgagttaacttctaagtagaatagtgtacaattttttgagcttatcttaacctgacttgatctcccctagtcctgtgacattcatcattctcagcctacttcccttttgagtcgttgcaatgacatgctgacctagagtggtcttcctggttcagggggctctgtggaggccattcatccagcccttcctgctgcatataaatgttatcaacatgttatatttttattaggataagtaggtaaaaaaggagtatattagatttgtatactgctttggaattggaataatggtttcagacacatcgcgtcatttgatcatccaaacaactctatgaaataggcaaaatagactatgcctcatatacagaatgaaaaaatggaaactcaggttaaataaatccttaaggcaacatggtaaataagattacctgagttaaattatggcacgacatcccacttgttttacttgtcaatgaaatttaagggagattgctaaaaagttagagcaggaattgatgttaatagtgtcatctgtgaaggatatgttataaacaggtggcagaaggtagatccttttgggagacaaggagtaatgaacttagtgtttgtacctttttcaaggatcttctgtttgtcgaagactcaccttgtaccttgtgacaaggtttcctacctttgtccttgagctctttccagaaaacattcttttttctttagtttcacaaatcccacctcttcccagttttgttaagttgatattggcaaagatagttgttttcatcatctgtagactgtgggttctctaacctggccatatacatgtaagagtcatctgaagatatttcaaaacagatagatgcctggatgtcacctacagttattctaatgtaatagataagggtgggtgctctgtaggtgattctaagggtcaggacgttggatagggagctttttactattcttattctgcagcagtacttctcaaagcctggccccagggtccctgcaggagaatcctctagattgcttattgaaaaacaccttgcttgagatttaatttaatcagaatatcttctgtcatgagacagtattgtatatgttttaggcacctgctcgtgtgtttttaaaaacacaccagatttagagaatcagcatcaccttagcttagtatttgccatttcattttcttcttaatgtaggttttctgataagcaatgtggactacgggcctggcaggcagaagatcgaagttcttctagtcaggctttgccaccagacagctgcatgacttaggcagtcttctttatttctctaggtctcagtttcattttctataaaaggaggatactgtactagatcatgattctactgctaataataatgctatttgttgagtcctgctatattccaagcactccccaactacatttatcttcagagcaagtctctgaagtgttctgttatgagctccatctttatagatgaggaaactgagtctcaggaaagttaagtagcttactcaactcacttaacaatgagtggtacagctttgatctaacccaaaattgtctgccaggctgaactgttacctgaggcaatttaccctccttttcctacatacctcttttccagttttaaatttctgtgaattcatgtgcataagtgtatgcctttttgtttgtccagtgttattactcctctctctttccctctcttcctttatttctttatgaaacatttattatgtattgaacccaaactaggcactcagagataagtaaaacgtagctcttttccttgtgcattatatctcattgtttgttcataacaaatgacagggaccatggctgtaaagttagtcacctgagaattagtcacctggggtgatgatcaggaataagtttaacttctcagcaaaccatgtggtgactctattaagtaatgaaaattgaactgcatttctgttcctttccatcctttggtgaattgctaatgaatagtgcagtggcctaaagtaaagaagccgaagagagaaggttaagaaatgagtgtggctgttgtacacaatatattgtcagtctctgaataatgaagaattgaatatttttattaccttggcttttgtatttaaaaaactttgaaaaaaaattaagagctatctcagaatgtgagaggaattacattcaacctacctgaaatatatttattcattatttttttctctcaccaactcttttatgaagcttagactataaaatttatgattggaattcaaggaccaggataaaatctgaatgtgtttagccttgctccacagatcttgaagacgaaggtcattcattctataattgactaactcatttcttgctgaaccattttatctctttctttaaaaatgaacattcatattgatttctcttgactatttctagtcatttagatttcataaccagtttgtgaaaatatagttttagaataattgtatagaatttgggtccctatcatcatgatgcctttctctgccttttaagttaaatgaaggacatgcacagtttaaatccttggctttacaaaaaaaggtagcctttcccctctgtttgtataagtaaatgataatttgttcaaagtagttatcaatttagagcattagcacttggactttatcagctttttaattacttttgttctccatttcacccttcccttatataggcagtttgtaccagttaaaattttaaaaatgtttgtgctgtctttacagttaaaaatattttgtgaagcattttcacacttttttttttttttaacttggaagcagagctaaaaatgtgttgattacatttgtttctgccaaaatagtttaaacatttttaaagaaattgtccttggaaacaaacatcttggcttggaaatatttgcctgtgttgacaaattcaatatggaatttgcttttgcttgactgtagtgtcaagtgatgtgaataaaagagttttagaaatataataccctcttacacgcctccattcactgtggggcaggcaccgttctcagccatgtgtgtgtacctcttagtctctcacactaagaaggttctattattatactcattttacaaaagaagaaactgaggcccagagaagtcacagggctagaaaatagtgggaacaggaactgaattccagttgctgccatccacagctttgcaccaatcttcctaccgatgttaaggttttactcttgcaataatgaaactcatcaggtaggagaagaatcctgagcatgacctttttgacttgctgctttcattcttactaatacctacactgtctcgaatagaatataatccttatttttatcttaatagaaacatataaagggattgaattttcatttgttaacgtttttgtatgtaaacctctgaatcaatagggatttgtgttctgcacagaagaacatttgactatcatttctacatccactgtgtgtcccacaagtcagtttctgcttctgtagaaggaggtggtccatggataggtatagctccctcagcagtgttacggggagtcacttagcttggcagagtaggggaggagaacttacaagatgttgagtcagaaggcttacattcaatgcaggtcttattattcccatccttaaaattggggtggtttcttgttttgaggattaaacgaggtcacgtatgtgaaaaagacttaggagactgtaaagtgctttataacttatatccttttgtcttctgtttctggagaaaagaggaaatactttgtgatcatcctttaagtagaaagaattctgtaagttttcaaaacttttaacgggacacttctttctctcctttagacacagagcattctgtataaccagagcaggctgccaccttccctcccgctgtgatcccaccttcattcatcctctcatttctttagcaaatatttactaagtatctattatgtgtcatacagtgtgctgactgtattcttcaaattccatagttagcttaaaactttgttagccttcttagataaggtagcatgaaactaaaacaaaaataaaaaacaaaacaacaacaatgaaaaccctgtcaatttgttggaatagaaataccttggaaggaaccatttaaaaaaatatttaagattcagtgggtacatgtgcaggtttgctacatgggtatattgcatgatcctgaggttagagcttccaatgatcctgtcatgtaatacttgataggtagtttttcaacccttctcccactcttatgatccccacttttggaatacccagtgtttattgttccgtctctgtatctgtgtgtactcaatgtttagctgtcactgataagtcagaaaatgtggtttttggtattctgttcctgtgttaattcacttagtgtaatggcttccagctgcatccgtgtttttgcaaaggacatgattttgctttttcattttatggctgtgtagtattctaaggtatggctgtatgtagcacattttctttatccagtccattgttgacagacacctaggttgattcccatgtctttgctattgtgactagtgctgtgataaacatacgagtgcagatgtctttttagaagaatgatttattttcatttggttatatacccagtaatgggactactgggttgaatgatagttctgcttttagtcctttgagaaatctccaaactgcattccacaggggctgaactatttgcatttccactaacagtgtataagcatccctttttctctgcaaccgcaccaacctgtgttacttttttgaattttttttaattttgatttttattttttttgagacagagtctcactctgttgcccaggctagaattcagtggcgtgatctctgctcttcaagtgattctcctgcctcagcctcacgagtagctgggattacagacatccaccaccacgcctggctaatttttgtgtttttagtagagacgaggtttcaccgtgttggccaggctgttctccagcccctgacctcaggtgatccacctgccttgccctccctaagtgctgggattacaggcataagccacccagccttgactttttaataatgaccattctgactggtgtgagatggtatctcattgtggttctgatttacatctctttaatgatcggtgatattgagcattttttcatatgtttgttggccgcttgtatgacttcttttgcgaagtatcaacatcattaaaaagcaggcaatggacatgaacagaagtgtcatgtgttttttccttgttgatttgtttaaggtccttatagattctgggtattagttctttttcagatgcatagtctgcaaatatttattccaggttaaaagtaggttgtctgtttactctgttgatagtttctttggctgtgcagaagctctttagtttacttaggtctggaaccaatttttgaagctcattttggttatttacacttcactagtacagatacatttcaaaagcgttattgagagtaactctgatatgagagaggaagagaacataatgccagaggcaaatctgctcttctgtgtggggtgggggggtgggtgggggctgttggttaaggaggtacaactggtctcgtgaggaaaatttttatggaccctgacatccagttcatgtgagagatccaggacggtatcttcctctgaaaatgtgtagtgttctgtgcatcagctcctttgccagtatagaagccgagaagctccagtgaaaagggtctgcctttaggagtgaggcaaagccaagggattccctttcatgacctatctatgtgcagccattttcctggcagtaggtgcactgagaggaagctggattactgtggctgctgaaacagaagaaaaattagtctgacttgtaaggatagatttcttttctaaacatgaaggagaaatgccattctcttgtaaattctgtaccagaatgtaggagacctgggcccataccctaggtctcctgctagcatgctgtgagaccctacgcaaatgacgtcacctcttttagtctaagcttgttcagtagtgagaggagggcatccgccaaatatctctgctttccttcagtttgaatccccatgatttcttaatcttcattatataactttctttaagttaaatatctctgttttcttaacttcagagatgttgctttttctactattgacataaattatttagattatttgataacactttaaattatacagttatttaaaaatgtttaaaaataaaaattgcattattttctttgtatggaataataaaatacatactttttaaaaaagtgaataagctttcagggaatatctaagtcaactttggagttggcagttcctgtgtactcagtgcatgccataaccatgacagcatctgtaaaaatagggtgcttctgttgcccagttgtctggtggcattgactttgctcataggactttcatgtttacagattcagctgactaacatgggtgaggctgttgcaattcatttagcagtaagtgggtcatttagtaataagctgtgaatgaaatcagtgtgctataagatgagataggttggcttgttttcttttattgaaaagacattttgaagctatatacgatgtaaagttcatgaaatttttttagataagtgattcagatgaagcttagctttcttgcttgacactaggttctcattgagtggtctcgaggcttgtgttccccattggacacttttgtgcattggtaagggcgttctgttattatcggaaagtgaggttaattggaaaccttttgattttctgaaatgacaaagtttacatggcagggttaaaactcattcatacaaaatgaaagcaggagacgtgtgtttctgatctttcatactttttctgtctttaatacttcctttgttgctgctctcttgagtctcctgctctccatttattcagtagagagttattgagcacctgatacgtgccatgtcacgttgagcatggggagaatgttccaagggtagaagtagcttgaacaaactaccgtaggagagaggaaacatatggttcatataacttgatattaatgtgatttgatcataggagagaagaggagaattgcttgaatctggattaccgcactggcacagtaaagaacacaccattttgggaatgagagtacaataatatttggtacagcaagactagttaggaggctgttactaatccagacacggaggcttagttccagaagaaggtagaagcccaatattattcgaggtgtatcacgaatgtgtttcaaaacatgttgttggtattgacattccagactagtggtaacaatctagactagagataatagttgccttgactcaagttgatagtgggaagagagaaaatggggatataagacccccttcttcctacagaaatcaatcttagaacagttaatatatccatattattaggtgtgtgaataaattgccattaaaagtaatggcaagaactgcaaatacttttgtactaacttaatatcttccttaggggcatgagaaactaacagttgagtgttttgtagaatgagccaacaaacataaggcagattcagaagagttgggttaactcatccttttatcatttgagagttccagcactggttgctttggttcccagactgcagagcaacatattctgcttggtctctcatatttattatgtccttttcagctgttttttgagactgtggctcacattgcctgaccatgctccatgaggcacttggtcagacttgcacagtgaaacaaaacttacgttgttttacatctctgactgaccatgagcaggcatatgtctggtgacagcactgttggaactatgtgaaatggggtcaagccttcttctttggtttgaactttgcctgtccaaattccctccttgcagattctcaaccgcaatcctctgcaccttcttttagttccagttattggtgtttcagtcattgactgttgtctcagctctctccagagggagaagggaaaacatggggtaaagtatcagtgttgtgtgtaagagtagaggtaatgacggaaaaagaaaagcagatgtaagaaagagtgtgagggttttttggttgttggtagtgatgttttttaggctgagcttagttttcaatatttttatgtcagtttttgagcttacttatgtgaagtgaaaaggtaaaataagccaggtacggtgcctcatgcctgtaatcccagcattctgggaggccgaggtgggaggattgcttgagcctgggggatcaacactgcagtgagccatgatggtgccattgcactccagtctgggtggcacagcaagactctgtctcaaaaacaaacatacgaagaagtaaaataaaagtgacgactttctgattgccaaggtccagaatgagttcacttggatttatgacataagatgttttatgtaggcatgttgacctccccgttacactctctttgaacttgtaggacaaacactaggttttggttatttttacatagtgccaaaataggttttttgaaaaatgttgtcagacatgtgttttgtattttgtaaataataagcaaacaaaacccatttggcttagtgacattttcataggtggattggttgggggctgcatgtccactgtaggtaataaagcctcttctccccagtgggaccttgaaatatatgataaagcagaagtgaccaagagaatcctggtctccttaatgaattaatgcagattttcaaggtgtccaactcaatcataaagtcatttgtccattggatatttactgagtatctgtaatgtgccaagcactgccctagctaggcattataacactaaggcaaataagacattatctttcaggatatactgctcacatattagagggctagaagatctaacaagagacaataatgacacacaagaggtactgctattataccagtatgagtggagtactttcaaaagcacagaagatggtcaggtcccttacacagacccctgaggcagaatcagctggggcttcctcaaggagaaggatgagtggaggagtagcacgggatgggaattggtgagggctttctctgggtagagagtggtacatataaatgcatagtatcttgtggaaatgcattcttattgaggaagtagaagtagttcactgtggctggagcacaaggagtgtttggggtgggtgtcagagggcagggaggagagatgaggctgcagaggactgtgttaccaattggatgtgggcacagaggttgaaaacgcatcaaggatgactccagcagcttcttttatttgggggcaactgggtaaatggtggggccattctctgagctaggaatgcaggaggaaatacaggaaggaaaatgagaaattaagttctcaatacattgagtttgaaggggctgtgagatatagcgcagtggttaagagtatcagctttgtagccagacagattcaagttcaaatttgacttctacctattagtaatttgggtgaacttgagcaggtcatattattactttatgtctctttgtcatttgtaaaatgatattgtatattgtaaagattataaggtaatttttatgaagagcttaagcacagtgtctggctcatttaagtggtcaatacatggttagttttactattgcaatagaagtgtatgatagggagatgggtttagggataaggtttgggatgggatatagggatgtgggagtcaaccctgtcaaggtggcagttaaagccattgtggtagagatgatccagggagagtgaggagagtggaggaaagaggcctgaggcctatgccctggggaataatgttaaaggttgggtaacagaggagcctctaatgaagactgagaaggaatggctagagaggccggaggaaagcctggaaggggtgacgttgtggaagccaaagaagaaagattgccagtgacagatgcctcagtgagatcaggattagaaaatggaaggatgggaaaacaacccttgagctcttctccatggtgtttctgtcattagactgtaagctccatgaggatggttgtataaccaatgcctgttaatggtacaagtggacatttatgagtgtttgctgaatgagtgagactgtgaaggaagaggtgatagatgatctctcacaatatctttcaactcatcagcatccccctacccatcacttctattatgttaacaatctaattttcttctttattggaaaaatagagttatgaacaagaattccctcactttgtctggtcacctttacttagttttagtggaatggtaagaaagaggccaaatcaaaacaggtagaggtgtgaagataatagagacaagaaaatacagaatacttttttaggtagctttcctaagaagagaatgggagagagatggtgttaagtaaagagggaattgagttcatgaagattatttttatttattttaggatggaagagatttggatattttaaatactgagagacccacgtgagagggaattattggtagaatgagatcgctaggaagttggaggtgaaaggatttaaactccaagagaaaaggaggtcatatgggagcaaagtttgtgggtagcaggacagaagggggttcttacttatgtagctattttctcaataaaggaggagaggaaatttgtttgctaaacataaaaacataaaagtagatgtggtagggtaggtagttttagacaagtagtgaagaatttttatttttggagatggagttttactttcaccaggctggagtgtagtggcatagtcatggctcactgcaaccttgacctcctgggcccaggtgatcctcccacctcaggggcccgaggaagcttggaccgcaggcacgtggcactgtacccagctaattttttttttttttttttttttaatgagacatagtcttcctatgttgcccaggctggtcttgaactcctgggctcaagtgatcctcttgccttggcctcccaaagtgttgggattacaggtgtgagccaccacacccagccaaatagtaaataactaaaagcaatattgtgaggggtgaaagagctggccagttaggacaccaagaagaattgccacatttctttgagtacctagctgaggttgcagacctggaatttgtggtggcaggagtccacatggtggtatgcttttctctggtagacatttatagcttagggtgaaagcagagaagacgtgcagctggattgatcaggattaaggtttggtggtggagtggttgcagagtaaggacaaagatgtgaaggacttacggatattagcaaggaagtggtggaaatgataaataatatagtacaagacaaacagagaaggatgtaaagatagaaggggcatctgtagaggaagaaaaataattttcttcaaccctcgtaagttagctggaatggatgcctacaacaaaagacagattgataagagaaagacagtttattaacatgtatgtttcatacatacatgggagagcccagggaatgagcagttctcagaggcagctttgaattccattttatatagtgtcttcaacaaagggcagtacatttttagagaaatgacaagagaaaagaaaaaaactttgagtctctggcggcagcaatttgtgggaagggaaagaaatggcagacaaaggcccgttagtaaagcttgttcatgtagataattttggtcccatctccaggcccataacagtctaaagttatctttattggttaatgtttttctctctggtagagggggacaggataccttttgtctttgtaaatctgtgtcctgcttttaggcaaatggagagtagagagctttcctgcatctgctgctacttaattgcctttagctcaacaagcttttattttgacatggcatcttctggtctcccacagcccaccctgtcccccaagtatatatgaaatatacatattataataataaactactcttcgtttttctctagttaatctatcttttgttacagggatctgttccaattaagaatttatgagagttgaagaaaaaattatgtttcttcctctaccgttcatagataggaagaaaattgggcatgtcaaggaatgtgagatgttgatgaagccagataattggtttagctagaattagcaaaggaaagtgctggaagaataggaaactacttttagaagttaaatacctgaggtagactagttctggttcaagatgatgagatccaggatgtaggtgtatgactggctgaaatgaagaaacaaagcactgatggtgggtgctacgtggagatggcatttgggtgtccaggcacacggccaggtgccacatctttgagggatgcgagcatcgtgtttaaggagaggaaggaggagagccagagagcaagactggcctacaatgtaaaaatgattttttttgtacttacaggtaatgatttgaaaaccactggttttgcatcactggaggagttagaattcacctgccccgcctgtgggcctagtggagtctgggacttggctgaattttagttattgccatgggggatacttggggttcagtaaaaagataaaagcagtttaaggtattgaagacatgagactttgtttaccatggggtagatatttttggaagtttgggaatggtagcaagctgggtcaggagagataaagcccagatcaaatatgggcaggagaggctcagtgacaggaagaacttgaatttgggcagtagccagcaatgaccaggatgtgaggcatgaaggcttcaagtttctgaaaggaactctggtataaagtattttgtttgttttggtgctacctgacagattggtgaaaagctttaggaagcaatactactgcagataataaaattatggtggggctaggtgctgtggttcatgcctataatcccagcactttgggaggccaatgtgggaggatcacttgaagccagcagttcgtggacaacaaaaagagacccctgtctcacagaaaatttaaaagaattagccagacatagtggcacatggtggtggtcctagctgtttgggaggctgaggtgggaggatcagttgagcccaggagtttgaggctgcagtgagctatgatcttgccactgcacttcagcctagcaacagagtgagaccccatctcagatagatggatagatagatggatggatggtacataagtagtggtgggagaaaatggatagatagataagtagtggtgggagaagctaacatttgtagaattttctatgtggcggcgctgtgataagcacttgatatgactgtttttatttaatctttagaaccaccaaaggaggatgttattatatttaagtttttttaaattgacaaataaaaattacatatatttatcatgtacaacatcttatgaaattcaagtaattaacatatacattacttcagtacttacatttttcaggtgaaaacacttaaaatctactcttttagaaattttaaagaatgcagtacatcgttactaactatagtcactatgttgtgtaagagaaatttattcctcttaactgaaattttgcatcctttgaccgatatcgccccaatcacttccaccccaaccaccccgcagcctctggtaaccaccgttctactctccccacttctatgagttcaacttttttagattctacatataagtgagatcattcaatatttgtctttatgtgcctgatttattttgcttaacattccctccagtttcatccatgttgttgttaataactacatttcctccttttttttttttttaaggctgatcagtactgtattgtttgtatatatcacatttttaaaattcattcttcagttgatggacacctagattgattccttaccttggccattgtgaataatgctgcattatacatgggagtgtatatctttgacatacagatttcccttggatatatatccaagtaataatcccagtaatgggattgctggattatatggtagttctatttttaattttttgggcacctctatactgttttccataatggttttactaacttacattcccaccaacagtgcaaaagttccctattctccacattcttaacaaaacttgctatcagctgggtgcagtggctcacgcctgtaatcccagcactttgggcagctgaggcaggtagatcacctgaggtcaggagttcaagaccagcctggccaatatggcaaaaccccgtctttactaaaaatacaaaaaattacccaggtgtggtggtgggcacctgtagtgccagttactcgggaggctaaggcaggagaattgcttgaacccaggaggtggagattgcagtgagctgagattgccccactgcactccagcctgggcgacagagcgagactccatctcaaacaaacaaacaaaaaccacttgttatctttccttttttttgagactagccattctaacaggtgtgaggtgatacctcattgtggttttaatttgcatttcttcgctgcttagtgatattgatcattttttcatatacctgttggccatttgtatgccttgttttgagaaatgtctattatgatatcctttctttattttaaattgaattatttgtttatttatttatttattgagatggagcattgctctctcaccaggctggagtgcagtggtgcaatctcagctcactgcaacctccgcctcctgggttcaagtggttcccctacctcagcctcccgagtagctgggattacaggcacgtgccaccatgcccagctaatgttttgtattttagtagagatggggtttcaccatgttggccagaatggtctcgatctcctgacctcatgatctgcctgccttggcctaccaaagtgctaggattacaggcgtgagccaccacatccggccaagttttttgttttcttattaccgagttgttttagttccttatatattttggatattaactcgttataagatgaatggtttgcacatattttctcccattctgtaatgtgtttctttgtttattgtttctttggctgtgcagaagctttttcatttgctgtaatctcatttttctgtctttgcttttcttacttgtgcttttggagtcatatccaaaaaatcattgcccagtccaaagtcaagaaacttttccttacattttctttagtagctttataatattaggtcttacgtgtaagtctttaatccagtttgagttgatttttgtatatggtgtgagataagggtctaatatcattcttctttatgtggatatccagtttttcagacatcatttattgaagagactgttctttctccattgtgtgttattggcatctttgtcaaatatcaattgaccataaatgcatggtttatttctgggctctctgttgttccactggtctgtctgttttcgtgtcagtaccatgctgtttttattactatagatttgtagtatattttgaagtcaggtggagtgtgacgcttccaggtttgttcattttgctcaagattgctttgactatttggggtcttttgtggttccattcaaattgaaggattgtttcttctatttctgtgcgaagtgtcatgagaattttgatagggattgcattgaatctgtagattgctttggctagtatggacattttaacagtgttaattcttcaaattcatgaatgaacatgggatatctatccatttattcatgactaatttctttcatcagtgttttcagtataaaggtcttttatctccttggttaaatttattactaagtcttttttttaagctattgttaatgggattgctttcttgatttctgttttggataggttgttgttattatgtaagttttaaagatgaagaaagtgaggccaggtgcggtggctcacgcctgtaatcccagcagtttgggaggccgaagcgggtgaatcacccgaggtcaggagttcaagaccagcctggccaacatggtgaaaccctgtctccactaaaaatacagaaattgccagatatgttagcacatgcctgtagtcccagctacttgggaggctgaggcaggagaatcacttgaacccgggaggtggaggttgcagtgagccgagatggtgccactgcactccatgctgagcgacagagtgagactccgtcttaaaaaaaaaaaaagaaagaaaatggattttaggagattatgtgagtagtctgggtcattcatttcattaactgttggaattaagatttaaactgaggcagcatgaattgaaaccctctctgattatcactacattgcctccgggttttgaagggaggtagcttgattactttctagaatctgacctgaatgtgaaaccattaacctgtcattggtggaagattcaggctgttctgctgaacacacagatttcagatcagggattatgaatgacaactgaagacttaaacaatttttagcatttaacttattttttattttaattttggttgcatagtatcatgaaaagtctgatatactagtggctaatggtaacagtattttaaaaaataccttaaattgctataagaggatgatgttcagtttattggaagtagcaggaaaagctgaaaatggaggagttagaattcacctgccctgcttgtgggcctagtggagtctggaacttggcttaatctttgatattttaaagcttggttcataacatttgcatatgcattgtaaaattatatgaatataccttggaatatgcattttaaaattatcgctttttaatagtgtgtgtatgtataacagtctgaaattgtatttgtaacaatctgaaattcatctattggaaacttatttaacaagaatacattattttctcttgacatttaggctattttcagacctctaaactcctttaacatccttcctctggtaaaactgtgtagcacttgaacctgttaagctggtatcttgtagttgaactttactgacttccctagttaacaggtaatgcttttgtaactgactggcatggaattagcagaaaacagtcccacacaaccccagctatctaccatttctatctgtcattatacatactatctaggtggctcttgaattgtaagggttccccaaaacagttgattttataatttttaaagggttatagagaccaagaggctcaactttttcttttcttttatttctttttttgttttgttttgttttgttttgtttttgattttaagggcctcactctgttgtccaggctggagcgcagtggcgtgatcatggctcactacagcctcaacctcctagactcaggcgatctgcctcggctagtagctgggactatatgggcacatgctattatgccaggctaattttttttttaatagagacagggtctcactatgttgcccagcctggtcttgaacacctaggctcaagtgatcctctcattttggcctcccaatgtgctgggattacaagcgtgagccaccgtgcctggcctcaactttttcattcacagtttcctagattagcttctctgaaccgttgcgatcgtagattttcattagtttaaggcagcaaatttaaaaaacttattcttttattcctctctatggggaagagagttaagaaaataataaagtcaaggttttacttctccctttttcagaaagaataacaataactacaacaataacatagctcatctgtattatgcatttgcggactatgggccaggcattacactgtgctaatgttgttgaattctcacaacatggtataattatcatcatcattttacaagtaagggaatgggcttaaagcagttaagtaacttgagcatgtaaatggtggacatgggacttaaactcttgggatgtgccagaaaggtactgtagcataattttggaccagaatatcattggaacttgggccaaagaatattggtaaattttatgctgttttttgtcacataaaaaaaaaagaaatttcttctatgtgtactatatgatgtgttcatgtgcagagttcttttccatgctctggagtttggcacagattcctggcaaagattattaaaattgagacagtttgttccgcttttaaatcctgaccatttgtcaagcagagtgtctcagactatggctgagagtgaagctccatggggcatggcagcctctgctgaacactggagaaggagtgtgtgaggccccccatcatttccaacaagtgaagtcaggggctgcgaggcctggcaagggctttcactgccacagccttcctgccccgggtccctggattggctgtgcctctggctctgtggcagctgggaggaataaagggcttcctgtctgagcctggcactaccacatgtaacaggttttctttggagtttttttttaattctctactttcagttgcttgactctgcctattgtgaccttctgtgttgtgtttatagtctgttagtaaaactttagactgaaaagggtcctaaacgttatctgcttctgcctcctcctcattttatagataaggaagttgacttacaaacatgaaatgaattattcaaacctatgagactaggaaccaggtctagaagcctgtctcatgactctggtcaagtgatattttccctgtgacagaatgatttgttcttcatatgccttgcttcccatctctgacttgctcattctgattctggcgtgcagcctgtcttgttgatcccttggctttgcgtcttgcactgattgagggaacagttgttggtggtgttaatctcagctttggaattactgtgtgacccctggtaaagtcactttgtgccttaatataattatcagcagattaagtaggacccttatcaaagagatgcttttgggagaatgtaaatcatggaaacttgtgacttgttttatcattattcagtggaagagacttttagaaaacttcatgaaaacaaaatacaggagaaaaaaatcagttgataaaggtttcaggttgagcaagccaagcaaggactcatgagaaaattagaacttctggccaaattgttatataggagagaatactatttctttcattgttctttacacagaatacctgttggatcaaattctgctctgcaggtggtagtatagagtaatttataggttttacctctgatctacttgaacttggaaaacacctccttaagttgtattaacaaatctgattaggaaagaagaacgtagaattttcaatactgtagagttttggtttagtaaaaagagaataaatgcttttaaattggacacaaatgagttaaatctgactttttcaatctgttgttaacctctttgaaactcagatttcctatatgtaaaatggataaaatttatttatttcctatatgtaaaatggggaaaatttataagggagaggtatgagggctaaataaaaataattatatagaatagctaatggtttgataactttctacatgtggcacattctcttaagtgctgtacacatgttatctcattcaaatctcttaacaatctcatgaagcgggaattgttattatcctaatcttagattttggaaagtgcttggcacatagtaggttcttaatctgagttagcttccttccttcctaaaggtttaacactttctgttatatctagatatctgatatccatgttactggagagtcagaggatatgtctgcaaaagagagattgctactctggacgcagcaggcaacagagggttatgctggaattcggtgtgaaaatttcactacctgctggagagatggaaaattatttaatgccatcattcataaatacaggtatggaatttgtgtattttttccttatacaactgtaagacacatttctttcatctctgaattttaaaattatcttttattattatagaagcaaaagcatggcaaaaaattagaaaatacagaaaaattaaaataaaaaattggccaggtgcagtggcccatgcctgtaatcccaggacttagggaagccaaagtgggtagattgcttgagcctgggagttcgagaacagccttggcaaaagggtaaaaccctctctctacaaaaaaatacaaaaaattagcttggcatggtggcaagcacctgtatttccagctactccggaggccaaggctgcggtgagctgtgatcatgtgactgcactgcagcctgagtcacagggtgagactctggcttaagaaaataaaaaaaaaaatttaaaaatcacatttccactacttagaggccatgattctgaattgtagcttatacacacacacacacacacacacacacacacacacacacacgcacgggcgctcgcacacacagctgtaatatgtcttcggatgttgtcagtaacttcgcagatagcagactttgattttgcctctaaagaactgctgagtttgaaggttagagtttagtttggacttgtagcccacaagtttccagttcatatctcctagtctaattactctagtgagtgggcttaacaattgccagttttggggtggtaaatagtttcctggtgagcattattaacagctaaatccacgctaatacttacatagcacttactaagtgccagacactgttctaagcagtttacatatattaattcattttctcctcacaacatccctattgtcatcccagtaaacagacagaaactgagacccagtaaatacttggcttgcagtcatacagccagcgagtggcagacttggaactcaaacctaggcaatctggctcttgagttcatgttcttattgccttataagaagctaaatccccggaaagtatttattgaaaattatatactactttttctttttttttttttttgagatgaagtcttgcactatcacccaggctagagtgcagtggcatgatctcagctcactgcagcctccacctcccaggttcaagcgattctcctgcctcagcctcctgagaagctgggactacaggcatatgccaccacacccggctaatttttgtatttttagtagagatggggtttcaccattttggccaggctggtcttgaactcctgacctcaggtgatcccctcaccttggcctcccaaagtgctaggattacaggctgaaaactatatatttctttacctcagtttttttttttttttttttggttttacaaatattatgtcaggttgttgaataacttgctatatttctaaagctatgacatcattaaattataaactatatataaactataaagtcattaaactaaccaatttatttgattacaataaaaataattatataggatagttaatggtttgattactttctcgttctcttaaatgctatactcgtgttctctcattcaaatctcctgacaatctcataaagcaggaattgttattatccagcttttacagataaggaaccttaggtttaccaagtttatactgctaataagttagagaattaagactcaaaaccagctctgtttgatttgacatcccgttctcttcctctctttcctctttcttccttcctttcacttctcttttctctccccttttctttctccctttttattttggaaatttcaatgtctaaaaactgtaatgaatcctccacatacacacactcaggagcccctatttttattttatttaattaattaattaattttttgagacggaattttgttcttgttgccccggctagagtgcaatggcatgatctcagctcactgcaacctctgcctcccaggttcaagtgattctcctgcctcagcctctcaagtagctgggattacaggtgcctgccaccactcccggctaatttttttaaattttttaaaatttttttttatttatttttagtagagacaggatttcaccatgtcagccaggctggtcttgaactccttacctcaggtgatccgcctacctcagcctcccagtgtgctaggattacaggcatgagccaccgtgcttggctgcgtgagccaccatgcctggcccctattttaaaatactataattgtatccttcctttgtggaacaacatttaaatagaggtgggtgtaggttgctgaatcgaaaagaaaaaccaggatcaacttgcctacacttgtttaaagcaccagatcttcttgagtgaaggtttagtggctgtagacacagccatcatcatattacactttccaggtgacttagaatgagaggccatgagaaggctgtgcagctggacacattctatacttggaatgatagaatctttgtggcctttaattaaaatatttcaattgtgatacctaaagtatttgtaacagtgcatctttgagggtgtgttctgctctctcctttgaagttttttaggcagaagcaaaatatgggatccagctattcttctaaaataacctacttttggcagggaggatgaggccggaggattgcttgaggccaggaatttgagaccaacctagacaatatagcaagaccccatctctaaaaaaataaaatagattagaaaaacccctacttttaaaaacaatggcctctggacattgtctctgtggtactcatgaataattataagtacaaattggtgtatgtgtgtgtgtgtgtgtatatatatatatatataatgcatttttctcctaagtacttaaatatttcattttgtgtgtcagagatcctaaaatttcctacaaaagcttgatgtcatagagctcttactgctttaggtgagaatttgagtctttgaattatttgttttgaacttttattttggcagaaatacctttttagaacaatgtttagctttaacttaggactttggttttcctagtttgctttattttcctttgttaaggttcgtggttaaaataccatatatcaggtttaaatgcttacaagatttctttgttgctgaaattctgtcgttgtcctgtggcttataaaatattattgtggtttctttcactagaagaaacttttcatctgtagaacttcgtttttagttgaagtcattgagcctttctttacttgaaaagaaaattaagtacttttcttccagcatatgaaaaaattaaatgaagagagttgaattgtgtgtatttctcactgttgaatgccttgatttattctaaaagaaaaaagagacaaaattataaacaatcaaaatatcaccatgagcaaattttttggtattggacaataataatcacatttagagagtaatgtcttggctgggtgccctggctcacgcctataatcccagcactttgggaagctgaggcaggaggattgctggagctcaggagttggagaccagcctgggcagcacaccaagaccccatctctacaaaaaatttaaaaattagccaggcatggtggcatacacctgtagagattttagaattagaatttagaattttctttggagtttttttttttaattctctactttcagttgcttgactctgcctattgtgacctctgacttctgtgttgtatttgtagtctgttagtacagctttagactaaaaagggtcctaaacgttacctgcttctgcctccacctcattttcttcttgggagtctgaggtgggtggatagcttgagtccaggaggtcgaggctgcagtgagttgtgactgtgtcactgcaccccagggtaggtgacagagcaagaccctgtctcaaaaaaaaaaaaaaaagagtagttttttacttaataattgtttttacttgataattattcccataagttttgtgctgtatttggatttgttgtggaaaatgtccattttattgggctttattttttgtatctagatcaaacatttatatggattttacttggctttgtcaataaaaattatctgaggtggcacagtgggtttggtttctgttggttgctgtagtggatgaaaagagggatgtggttatccctatgtagcaaatttgcatactcaagatagaataggaaatttttctccagagattagaaggaaaatatattttttacttaaaagcaaaccagtattatatgtgataggtgacttagtaagatttttggtgcatatcttctaaagatttagaaatattgatctgaaataggaacagagcaatagcatccttcacattttttattaatataaattatactgttataagttattaatcaaatatattaatttggattgtccagcacatttttattagtgtttccatatagaatatgactcttgaaaataaaaagaatgtttgttagccccataaagagtatttgttttactaacaattcagtatcctaaaattttccgtagaaaatataattttctaattgtcatgtttcttgagagaattaatatgtgaaataacagtgaagagaaatttttataataagtgtaatttatagatgttacagaataaaaatgatccatgaagttaaaaagtaagtaacagtcacaaagtagttacctaagaaatacatgtatcatgttggccatgtggcagtttctgtcctagctgttttttaatgtgttagcttttaaaattaccacaatcctgtgaaatagattgtgactccatttttaaaacaatttcaacttttattttagattctaggggtatatgtgcaggtttgttacttgggtatattgcatgatgctgaggtttagggtacaactggtcctgtcacccacgtagtgagcatcacacctaataagtagttttcagcccttgcccccaccccatagtagtccccagtgtctggttgttgccgtctttatggcatgacttcatttttatcaataaagaaactgaggctcaaagagtaactcatatttttgacatcacataccttttacataacggaggtggttgctctgaattctcatcttcatatacttccatgtaactacttacataatttcctttaggcaaactagatttaaagaaatggaactgttgatcagaacaactgtgatagcgcattcttgaagctcaatgatattttcagcaaagatatatgaaaattatcgatgaacttaagaaatgactaaatgaatagtgccatatacaactgacaactaaagtctttgccccttgtaagaaattaatgagggtttaatttagttgtttaactaattagttaccaaaattatttaaccttaattaatgagggtttaatgaagttgtttaacttagagttagccttagagtttaacttggaattagctacctatgaaaatagcatcagcaacaactcataacaacttaaggaaaattatggataatgaaagaacttaagatttttagaacgagtaagagcaaaatcacagcgaaattaagcagttttagtatgtcacattatcctaaagaggatgaagagcctggattatgtaatggggtagtaagaatgacaaagttatatgatttagtggaagagattgcaagggatagttctatagcttctatttaaataggtcactgataaatacattatgtctttctgttaaatctgtattaggaaattctgttcataattccttctaggaatttctgtgtgttatgttcagttttcagtggaaaagtttcaaataataaaaatactacatacctatactagtttctgcttgttctgtttgtatactttaactttttttagaatataatacaaccttattgctaaaaaccacaactggtaagatatcttgggtaaataagccttactattgcccctaaccttaccttaattttcaatcaaaagactaacaaagaatactggatttgatgaacttagatcaaaaggttgtcacaaaaacatctggtgtgtaaggagattaaaagcaagagaggataaagtagaattaaccaagagccaataggcaagggatcctaggagtatcctttaaacactagtggattaataagtcaccaagagttagggttgatatagaggaatgaaatcccagacagtagtgcttgttcctcagaggtaggtgttacaaacagagggttcagctctcctcttatttaagggtttgccgaggcatcacagtaaaattgacttctttttgagagaggtaaagctctgacttccagcttgaaatttagcctctgacttgtctggcttctctcattctctccaagtagatatctgccttagaacattaatgaaagccaaattccaaaacagcagtgcctaacattgctctgtgtgcaaacaagtctgcctgagcaggcatgaacatgaatatgtacctgaaggccagagagaacagtgcagaatgtgcaggagggctttgcaaatctgaggtggctctatggaaagacactaagtatgtcaagactaaaactagaggtgtgtgtgtttgaagagattatttctgcttactagtttctgcctgtcttatgcttgtttttaatttatctcattcatttatttaaattgcctttaaaaaataaaaataaaaaagctaaacataaataaataaataattttccttttaatgtccctggcagtcttttcataggtttgttttaaatatgttagccaattaagactcaaaattttgggaataggttgtatgcaggagcaaagcagtcaaatgttttctaattaagcagccaggaacttttcacttgtctgagtatgtagttggatagcaattattttgtccattgtttgcattttgaatgagaatataatagggccatcatatttcattatattaaagtttaaagatgctgtaattgtgaaggttagattgtaaagctgtggtcagagtcatcttgtttaatagcatgacctggaggccggtgattcagtcacatgcgtgaattcagtcacaccttagaagctaaactggattggactggtttaataccgggaggaggccctttagggtttgaaatgttcccataggaagttggcttagtgttgacttagccttcaggctgcagaatccagaggtatgagggtgtatgtatgtgtgtgcatacacatggccatgggctgtagtttggccacaagccagacacacacagagcctgaaagttatcaattaaaaagtagttaacagtatttcagcttgtgtagaaaaaatcaaattgcttatttaccttgccaagtgaactcaaaatgattgaactttgagaacagaaatggatgacttctaaccattatcacattttaaaattcttagagttaatgtacactgcttataatgtagtgcgtctgcatccaagtgaggtgtaagagttagtgtctacatctggtgaccatttttattgtatctatatggttttacctacagtttgggagatgtaatttggcatgtaatatttggaggaaatatctgaatatattactttctttttatgttcctggccttcttgcctagattaatttacagaaattctctgtaatatgaagcctcccattactgtgtgttttgttttgtttctttgttttgttttgttctgttttgttttgttttgagatggagtcttgctctgtcacccaggctggagtgcagtggtgcgatcttggctcactgcaacctccacctcccgggttcaagcaattctcctgcctcagcctcctgagtagttgggactacaggcatgacccccccgcccccatgcccaactaattttgttgtatttttagtagagacagggtttcaccattttggttgggctgttctcaaactcctgacctcaaatgatccacctgccttggcctcccaaagtgctgggattacaggcatcagccacctcgcccggccaaaaaagatctttatagatgtgatgtaaggtatagcccacattctcctacttccatttttgaagcagaaaactgaaaaagtgacacagccacggtaggaagatagctcatctggttgtcctcttcatgggagactggcaaacctagttgcaatttctacagcaggcacttgttaccacagtcctactttttcttgtatctgtgatttttaaaaaataccatatggtattctattgtatgtgtataacattttgtttagagtgccttattgatggatattatgttgttttttgcttttaaaactgttgtactgaactttgtatgtgtctttgtgaggcatgtgaatatatccataggataaggtcctggaagtggaattgctgggacaaagggtattacatttaaaattttgagacgtacttctgaattgtctgccaaaagagttgtactgatgcatacctcttctgcactgtttcccctccatgatgcctttgagaaagaaacacttcttaacttgttaattaccttttagcaggtctaagccccactcttttttttctattctttcttttactttgccctttcattcataaaattatttcttttcagcttttaaagatgtgcccgtgatgaaattgaaggcctatgtttcactcagtttgatgtgcaagctgttagtctaagcatgcatgtattacgagtttagggggaaaagtgacgaagtaagttgacaaatttcagtgatgtgatcatttaaaaagttagagggtcggccgggcgcggtgactcacacctgtaatcccagcactttgggaggccaaggcgggcggatcacccgaggtcaggagttcaagaccatcctggccaacatggagaaacggcggctctactaaaaatacaaaaagttagccaggcctggtggcaggtgcctgtaatcccagctactcaggaggctgaggcaggggaatcgcttgaacctgggaggcggaggttgcagtgagctgagatggcaccattgcactccagcctgggcaacaagagtgaaactcagcctcaaaaaaaaaaaaactgttagagtggggctgtcttgagttagcttatgagagtgcctatcactctcctagagatttaggaagtatgtaatcaacatgagtttcccctccccccgcatgctgccactgatccactaacaatagggctgtaaagcttgagggaagatgggttttgatcaaaactctccttacttagaaacttgacaagtcctgcctttgtcatgtttccctttagcattctcttacctttctctcacatgaagatttcttttacattacaggagcagccggtatatgtaactctatctgtttttctttgataggttcatctatttgttttaacacttcttgtattttgacttgattattcacattatcatcttagcctgtgatatgaagtagtttgagatttagttttctaccataataaaaataaattgattcccactaccccctttttggggagggtgtatttatccttattagtcactaaagtttacttaaattttccttttattcactaaaatataggtactggaggagttacttctctatcaacatcaataccattctctgtattcattaaaatttaggctgttaatgggattgattgttctttgtgaagtgagaaagtcataattcattagatatgttttaattattgaatttgttagactctaaccttgaagtactaactaagcttgctataaatatactgtttctcatctttgctgtctaccttgttgttaatggagagtcactttgtagaaaaaaatatactgtttctcatctttgctgtctaccttgttgttaatggagagtcactttgtagaaaaaaaaaaaagaatgtttgaaaaaactcaggcacctagttttgagaacaagggaaaattaccttcatagcttgttgctaatctgtgcccaaatatgagcatgaagggatgtctacactgagttacgcaggcctttttttttttttctttttttttttttggtgattgcaaggtgaggtgctttttgcaccaataagaacagtaaggacatgctaagtctgagcatgatttaatcgaaacagtcatcttcaggaatttgttacggtaacttctctgctatcataggataagtgaggcatatgatcttttgaaaagcagatgttaagtggcatatgtgtcttcagtcacctctgtgtgggttgttctgtagtatagagggtgttctaaaaatgatctttaggaatggagtgaggcttgtttttgtttttgttttgttttacacttccacacaatcccttttcaattccttgcaaactgctgagtatgtactattttgccagcaaaggctgagcctgtatgaacccagccatgtgctttgtctgtgcatgtccccacacaggaagcacaccagagaaagcgatacttcagggtagattgatttcattagaacttcattatcaccagcctcaaatggttctggccagcagtctttttctatctgtatgattaacccttctcttcctcacagcacctcctcccaccaccttttctcagtgttaacaggtgatctagactcctactctcagagaaaattgaagccaacaagtagaaagtcttttttgctaccaaagacacaaacctatcttcttctgcatccatcctcacccccgctgctgctgttcaacacaggagtcctctctccacctacccaaagcctgtcccctcctgctgtgccctggatcttatctctgtcattgccttagaaacctttcttgtatatattcatctttttccttcaatagatctttcttattggattttaagcatgttgcagcctcttctgttaataaaacaacaatcaacaaaaacactctcccttaactgcatgctttattccagctactaccttatatcattcctttccttcaaggccaaagtcctcagaagaggtggcaatatcctccatcatttcttcacttcatactcattcttcaacacatactaatctagtctcttaccccataattcattaaaacacttattcttgggtcatgggtgacttctgtatagctaaatccagtggatatttttcaggcctcctcttccttacattttagtatttcaccctattggccattcttttcttcttgaaatactctctcctttagcttttatgacactgtactcctggtttttctcccacttcttgtctgctcctgcttagttccctctgtaaacttggcctctttcacaaggccagtaaacactcgagtttttcaagattgcctgttggactttttcttttctctctgtgttgtctctcatccatgcttacagccctaattactataaccattgtcatataactgggttctgtagatttgactttctcaatatctcctgacttggccactttttatccactgctgccacattcttctgcaagccaccatagccacttaactggattctgtgggagttctttgaccatttaaatttttttctctgtccacccccagatctgatcatttaatctcttctaatcctccttaatgcattttgatggcttttcatagctattggggaaaaagtttacaatcctttaagacgttcatgagagtctgcattgtcttggccctttgccacacatccagagccatgtcttaccatgttcccctggctgctggctccccactcatgcactggtctccttgtagtcctgtgcccttcaaccacagacctatgcatgccttttttcatcacctgagtgctcttccaccaggttttctcctggtttactcctgagctccctttggagctctgagctctccatatgcacagtggctgttctcagtgccttacttcctggaacatggtaaatgcatattaaatattgagtgaatgaataaatgaatgaacttgctagttttttgactgggaagaattatttctatgtagcataccaaagcatcaggttgtcttctccgattacccttttatggtgttgtttttatgctgatagatacgttttggtaacctgcgcacattgccctttatactaagtttcacaactactttcacgtaaatctcttgagatcttgggtaaatcagttgagttctttgaaccttatgctataaccagcccataatgtcccccctcccatactcatacacatttccagatgctctgtacgtgatttttgttctaacttctgtaattcttgatactcattttctgcagaaagaactgagacacaggttgcaggatgtgtgtccaaagtcagagagcaaattaggactaaatcacaggacacctgactcacagctctgtgctttgtgtgtgtgttccacctcaatttaggcttttctctcaaatatgtaaaaactgttttttaaaaatttaaagaattcctagctactcgggaggctgggctgaggcaggaggatcgcttgaacccaggaggcgggggttgcagtgagccgagattgcgccactgcactccagcctggcgacagagtgagactccatgtcaaaaaaaaagaattacggccaggcgcagtgtctcatgcctataataccagcagttgggggggccgaggcgagtggatcacttgaggtcaggggttcgagaccagcctggccaacatggcgaaaccccgtctttactaaaaatacaaaaattagctgggcatggtggtaggtgcctgtaatcccaactacttgggaggctgaggcaggagaattgctagaacctgggaggctgaggttgcagtgagctgagattgcaccactgcactccagggtggatgacagagtgagactcttgtctcaaaaaaaataaataataaaaaaattagattgtgataaggtgcataaaatttaccatcttaatcagttttaagttgatagttaagtggcattaagtacatttactttgttgtacaaccatcaccgccatccatctccagagctcttttcatccagtgtaactgaagctgtgtacccgtgaaactctaattccccatttctctctccccccacccgttgacaaccaccattcttctttctgtcttgtctttcctttttaaattgaggaaggaaactgtggtccagtgttttttcaagtgatcagatatctcaagtcacaaagtttaggtgggttttttattctgattaaaaaaaatatatgtgaccaaatgctatcttttccaggcttcattattttacagtgtactccagagttgggcaaacataaaatgacatgcccaccctccctccttgctaacatttaaatgtgttcttttcttgtatatttaataaaaataaacactgaaaaagagttaaaaggttcactgtctcctgctgagggcataaggcagtagcatgtttctgcttgtgggtgcttttgtttgtgtcgttatataattgcctgatgacattgtggatgttttttccccaatacaaaatgcttataatcttgaaaagaaattaaataattattagaaagaagggtttttaacatggtttagttatcaaacttgcctgatacgaatcacctgagggaggggggagaaacttgttaaaatgcagataaccaggcctttctttctattcttaatctgtattaggacccaagtgtgggaaacattggtataggacacattgatgagttctgttttggtaataatctggaacttcagcatgtttcttatgatttattttttctgagtatgtcaatacacacacatacatatacatatacattattgtgtttctttatgggggttaccaatatcattatcattttgcccagtagtagaagtataatttgttctgtattttctttattatgtattctcagcttcatatggggtgttactgtttagttagttctcagtttatgataccaggatattgcagagaagaaatcaggctctgtagtcagacagacctgggttgaaaccctgactgccacttaccagatttgtgttcttggtcaagttatataacttccttatgctttggtgtttttccatctgtaaattcaggataataacacaacctactgcttagggtcaattgagatgattaagtgagataatgctttaagtcctttaatgcattgcctgccacatagtaggtatcagtatttattagtccctgttgttgttttgtgattgttattactttataaggtatcccaattggcaacattatcagaagctgaagctgagggcacatgagagcataagaagggaggagaacctagaagcagcaacatgtgctttttgaaacttttatacttcaccgctgtttgttgtcctcacttcgtgcctgctttccaaattgttttttaggagagacaaagcctttaggaaacctcgaaagggtgtgtgcttgtttaggattatggggaagctatgacattgtaccctggtccatgtggatttcgataaggattctaaaacttggctggaagccatagatggtggttttgtcagtagaaattagtgaaaagaaaaggaacaagcctaggatggaacatatctccaggaatttgaaacactgatatgtcccagtccccatagctcatgtttttctttattatttatttaatcctcaaaagttaatgttttaagcattatgctagatattgaggatataaacatggacaaaacacaggctctgccttcaggaagcccatggttcaatatgagagataggcagatatatagttatgaaaaatgtggtaaatacagaaatgaagataacagacggcatttgggaacagaggaaagtacttcctggaggaaatggtggtggaaccgagtctgctgaaagaattcgagttggccaggtaatgtcatgtacgggggtgaggtatgcagtggacatttcttgagcaaataaaagagtcaggaaaaacctgacatatttctgtttttgtactgggaaatgggctttgctcttctccttacccccaagacttatgaaagggaaatttctcaaatataggaaagcagatgcagggtagccagaaccttactgtttgtatccacataaataattattgagtgccagctgaaagccagcacaaccagcagactctgaatttaagtcactttattttttcatccttaaaaaaatcccgatttggactgtggccattgatatttcccatatgtgtcttttcagctattgtcacatttttggttcaggatttggtaatgttgtgtctgcactaaagcactcttctcttagctggcatttttctttctcttagttaactttaattagtgtcctctctgccatgtttctaagtacttcctttccaagtactttgatgttgtttcatgctccttgcagttgagtgtattggtgtttgccatgatatattgtggaagccttcagtggtctgttgtgctaatctttttttttttttttttttttttgaggcaaagtctcgctctgtcacccaggctgggatgcaatggcgcgatctcggctcactgcaacctccgcctcctgggttccagtgattctcctgcctcaccctcccgagtagctggggttacaggcacccgacaccatgcctggctaagttttgtatttttagtggagacagggtttcaccatattggccaggctggtctggaattcctgacctcaggtgatcctcccatctcggcctccaaaagtgctgggattacaggcatgagccactgcgcccagcctgatctttagccatttatatcactgtagaagtcatatgttcctgcagaatcctatctaattctcatgtgagctaatgtattaataaagttttggagtactgaaatgttaccttggaggtatctatgccaaaaaaatctctcatgcaatttttatgttcagctagctttggctacctgttaatgtaggtggtgatatccttatactatatccatatatctatctatctatacataaatgccaacatacctgtatatgtatatatacgtgtggagatatatatatatatatatagcctaggggagattgctcttttaagatgggtgttgtatgaaagataaacattacttttatccaaaattattttgtattatgacaatagcatttttctatacctctctgccctatatttttaaacaaattcagggcaccaagcttgcatataagtgatttgcaatttttagtctcacttccaatttcattttaaggccttttcttggttttatacttctaatttaaagtttatgctatcttgtattttctttgtaagctacttttaattgcttatgaaagaaaagctgggataaagctgggatataaacatgtttaaagattataatgtatgataattgggtcattttgaaacattaacattatcatagaataataaaaaaaataagagaatggcctttttttccataaaaagactagcatttattactttaagtggcaaaggatcacattatatgattttgaaaggtttccataaaacaggcaagttacaatagttaatgttcaactatctaaaatataacatgagaacatggtcactataatatagtctaatgctctttggttagtcaaacctaagatggaaatgacatttcctgttaacattccacaaaaagatgttacgaagaaatgaaacctttagaatgaaagtaagtatcttctatgtgtgaaaaataaatgaagtttttaaaggttgtgttatcccagtgagactatgaagaaagaaggtggtggacaggacacacacagcacaggcgtcttctggatgcttcaggcaggtagaggaaagacagatttgaaagacaaagggaccaccactctgttaggatatgagctaagggaggaatagcattttaaattttataggctattactttttcatagtggttttttgtgtttttttgagatggagtttcgctcttgttgtccaggctggagtgcagtggcatgatctcggctcactgcaacctctgcctcctgggttcaagtgatcctcctgcctcagcctcccgagtagctgggattacaggcgcctgccatcacgcctggctaatttttgcatttttagtagagacagggtttcgccatgttggtcaggctggtgtcaaactccagacctcaggtgatctgccctcttcagcctcccaaatgctgggattataggtatgagccaccgcacccagctttgtagtggtttttaaagttttcccttttcccattttttgtttaactaattttctttatctgctgtcttttagtggaggaaaaccatttcagtttttgttccattaaagtgttaaacatcatgataaaagagatgacttactcagactcattgtattctacagctgcttttgtgttgaaatgactatgtcattctgaaggaagttttatgttttattctcttagctgaaaaacttgattcttcaatgactttattcattccctctaggattactcagtgtttactttctttgctaatggcagggttctcataataacatgccatgtcttgttctgagatttggcagacttacaaagtctgttttttatttccctaaaaggtgcaaattttacggaaacaaaacgattttttattgaaagaacttcagatatttgtttttgtctagactgctatacatacctgtttactaatcttgaggttggcagattcttcagatgtttctatgtgaataaaaaatgttacttttggaggtctgttatttacttccatagttgtcaatggatttattgttcctataataattgtagggtcacttttaaaagagtggtcatattggtggcaggttgaaaacattaaaggatttcctaataatttcctggaatatgagcatgtaggtgatggtaaccacattcccaggttatgaacagtgcaaagtgatataaaagtataagattttcttgaaaggtctgttttctcaccataaaagagtacaaattgccacttagctttctaatattaatgatatattttcaaacagcttttcatataagcagcctgccaagtagtatacaaaataatctgcatttcatttctcccacactacctttgagccctcccactctttctgtggtttcccaaatgattattttgagcaaacaggaatgcttgtggagcttgtagagagcctttctttgtaagctatcaacaggttcttactcagtgatttttttgggtggtgagtaccactctttgaaggctttcctgtttccacattgttccggtagtctttcaatgctttgtttttgagatccaagtttcctgactggcttctagccttgagtgaagtctccaatgtccatattttgccactttctctacaagaagcatttgaagaatcttttcctctctcatgtagatagagctagcttcaaagtttctgcatggtttagggtgttacgtaaatctcacaaattataaagatatgaagtctgggatgtgtgactgtgtgtgtgtgtaggggggcacatgcacacatgtgtgctcatgaaaacataaactattgcttattatagacattcatttatgattcagattactaaggaaccaacctacttaccaacttatcagtagatatttgttgagggtgtactatatatcattctttattacagcagaaggataaaatacaaaattttcttaatacatagtacttgctatcttggagttgacggtttgggagaaacaacatatacatgtacacgaaccagtgaattaatagggcaaggagtctaagattatcctaagtgccatatcgtggggtgcaggctggaagtatgagttcaggaaacagagacagaaataagggctaggaagatcagccaggctccatagaggaggtggagcttgatctctccttggaagaatgactaggattatagaagacaaagatgatgtgaaagggtatggtgcaatggggaggccatggacacagcactgaattaagctacaagctttttgtcttagaggaaaaacattgacaggatgctggttggattggaaagatgctgttggagtagcgtagcttaaatcagttgaataggacaaatactcatatatattctgactatgatatatttgtagactttgttgaaatttatatatgttcaaattgttatattttcattgttatatttgctttcgatacagaagtttctgagataagtgagcaatgttaaatgtttgatgaaagtctctgcattttaacgcaggcttggtgttaatattagcagatgttgttatgtaaatggaaacctatataattatataatgttgaattggcacatgagaaaacctaattaacacagtgaattttttcctaggccggacctgatagatatgaatactgttgctgttcaaagcaaccttgcaaatttagagcatgctttttacgtagcagaaaaaattggtgttataagacttctggaccctgaaggtgagttattttcttgattatatgtggactggcatgaaagtctgatcaaaagtaatttatcaacattgtgaaataattaatttatgttgctgtttttagatgtcgatgtctcctcacctgatgaaaaatcagtaataacttacgtgtcatctctctatgatgcatttcctaaagtccctgaaggtggggaaggcattggtgcaaatgtgagtattgatttttccacaccggaagctgttgattcagtaatgaccaattgactgcatttattgataatgatttttgcagtttttgaatgttgaatatattttaaagaatttgagttaatatgctgtttgatgaattgatattctatgtatttcatgacattattctaccattaaatttaaagtataactcattaaaacttttgtgtcataaataaaagaggctatttatagttaccgatcatcttataaataaaaggtttaactttctgaaatttagagttttccatttttagctggctgccgttttacattgctgtatttgctattcttttgtatgtatagaatatctcagttttgaaaacaatttcaaatttgttacttcatacgattctatgaaataagttggcttgataacatttttgtgatttaaaggaggactccagaggaaaattattggatttggccaaattagcagagccacttagtaagcagggaaaggtctctgacacatagctttgggctgtttattagtctactatttcttaaaggtttgtgtaactcacttcagtgatgctttttttttttttttttttttttgggtggttatgctaacaagtgcttatgcatttctgaagagaacaggaagcccagtatgtgtcacatatttggggatgatccccttcacttggatttctgccttcctctttgcagacaccttttttcccctacattactttgaagatttaggagctcatctttgattagctcccctggattaggagctcccttttctgattgcttctgtcagttctctgtgctgtttctagacctgtttccatattcttcctcaggttcttcttttcaaaggcttcatgctctttgatccctgagtagcctgttcccatgctcacccctgatgattcaatgttgagcgttgcttcagaatgtttctttggccatctcttgctgctgcttctcccaaccttcatgctgatcctgctgcctattactgcagaactaggccgatagctttcctacagctttctgtctccattttgttcttcttcccactgcctcggcacactgttgccaaattaatctgtctaaaacctgatgtctttggcttgaaaattttcagtgtctacatattccttgcaaagttaaatgcaatctagatattctgacatttaaaactgcaaatatttattctgtttacctacatgttttagctatgatttcccaatatgaactgtttactggtagccaggacatttccatgtcaatgtcctgactcacttgggactccccttttatccactctttcagcacccccactcacctccccccatcaataattacttactggtcattgcagaacatctcagatactgcctttcccaagaagcctttagaaactattttaaggcacagatatgcttgcctgattcttatctcaactagcatgtactacccgttttagttatttcaacatttcaacacttaattaaatactgctcttcattttgcctgtttatattatgtatctctcttgcctctgcatttagacagtaactccttgacaataggtattatatcttaaagtatttttttattataacactcaacacaacctttgaacataataataagcactcatcaaatacttaaacagagcagttggcagccttccaagtttcctccatttttaaagagtttgcctactgagtacttggataatcccaccatatacatttcctgtagtttgtgtacatatctggtttcctatatattgggtaagtcttttgagtttgagatacatagtagatttagatctaaaatagttggcaaagatggcaactaacttggcttatgcaagttgttactgcccaatcttgagccctggtaaacaccccaaattgactttggatttttttctgctgtgcttagattgagccccaaaagccttctaaatacaataccccaggcagccactttctttggatcagaattggcactcataaggctagtgttagtggccaaatgttgatagcaaattttacaggtgtttatgtgacagggattggggctgggtgaaagtaagaaaacatttagctggttctgtctgtcaggcttcaaatacatacatttacagaatgacttctgactaaattgtcttagatatgaatgttattatctacagatgtgaaccttttctatcatttgattgttctaggatgttgaagtcaaatggattgaataccagaatatggtgaactacctcatccaatggattagacaccatgtgaccacaatgtctgagagaacatttcctaataatcctgtagaactgaaggttagtgtcactgtagaaattacataggattgattcaattgtaaacccttaagtaatgctataataattctgtaattttagaagttcaacaaaagttgcccttggaaagccattaataagtaggcaaaatttgtattactcatttctcttattatacagagaaaatggaggtaaaacattaacaattaaaacagattagctgtagtcactcagctttggttgagaggttaaaggtttaatttgagagagtctctgaaactgacattgtcagattgattttagtacatgggaaatgcttgcagcccccgagatggcttgaggtagaagggaccctgggaagtacatacaagtgtggcactggattgggggtgtgcctgtggttgagccctgttaaaaactgcttcttttgtgcaggaagcatcttttgtgcaggaagaggtacacagtatttcaccatgaatttgaaaatacatgtctgacttccagtataagtgaattcatggtttagtaaaacatttgctaatactgaaaaacttagggcaagcttttgaggcaaagacattgcagatataaaagccattataggccgggtgcggtgggtcacacccgtaatcccagcactttgggaggccaagatgggtggatcacctgaggtcaggagtttgagaccagcctggctaacatggtgaaaccccatctctattaaaaatacaaaaatcagcctggcgtggtggcacacacttgtaatcccagttactcaggaggctgaggcaggagaatcgcttgaacctgggaggtggaggttgcagtaagccgagatcgcatcactgcactccatcctgggcgagagagcaagactccgtctcaaaaaaaaaaaaaaacattacaaaaagccattacaaatatgtaaacttattaaagagtaagttgtctcatttgtatatttggttttataatagcaaagtggtctactttatttctagaagctgataatgcgaatattgccgacaaagccttaattctttggtttgtaagctttattttcatgatcaaactgggatagaaaaaactgtaataacctagggtgagctccattagagttattcattgtgctcctgcatccgtacagaatatctgtagaacagctttcattctcattgccacggggagtttgtccttggcacgaaattacttggcatctgatgatatgatactttttaagtgttctcaagctgtttgtgtgatgtttccctacatggacatgtaattttccagggcaggaaaacttttccctacaacgaccatgtggtgccatgaacagtgtttagcacacaggagtattcggtgcttaatgaccaacagacgtcctgaaacattgcattctgatttcaaaaccattttcagatttcatgttcaaatacacttatttccaaatggatttccattgtccagacccttggatgaattgtactggcttctggttagtgtagattcttagttatagaagaagtgatcagagtacttgctgatgactagaacaagacatagattaggaaagaaaatacatcatggggaaatgccagataattgcattagcagaactttgaatggaatccttcagaaatgtgtcatcctaaagatttacagggtcttgttttgtagctgcatgaattacaatgaagtaattagtacatacctattaaatatggagatacattatctacataatttttatgaaggtcccttttaataaatacactgtatttaagaggttcccaaattaatgtatacaaactagatagtaacttaattacacggttgaaacttctgtaataatagccccatcaactaatagcatctaccttcatttgttcaaaaaatctgtttaaatttgccagtgggacattgaaactaaattttagccctttctgctaagaagttttttttttttgaaggatagaaccatgcaatagaagagagtttttttattgctttctttatgggaattgcttcaaattatttttccaaagactgaaagctaaagtgcagcatttgggaagtgcatcttttaaagggtatgttttcttgtttggaggatgagagatttttagtagagcactagtaaacactgaatggtttattattatccagatccccctgtggcactaaatcatggctcacatcaataattacaccctcatcaaattttagataacccacgtcaccagctggctggaaattggtattgtctttgagtgtcggtttaacaaaggaattccactgactgcatatgatacagtacataacacttgaagtggtggcttagtgagatcatgaaaacagatcttttaagtttggtccttaatttcttgtcctttttattttaggcactttataatcagtatttacagtttaaagaaacagaaattccaccaaaggagacagaaaaatcaaaaattaaacgtctatataaattattagaggtaagctcaaatttgctttgtattgtcaagcatagtctttgttttgttttgttttcatttttgcttcacattaaagttttttgttttctcaagatttggatagaatttggacgcatcaagctccttcaaggttatcatccaaatgacatagaaaaagagtgggggaaactcattattgccatgctagagagagagaaggcccttcgtccagaagtagaaaggtaggccagaggtgttttctgccatgaatatcaagtggggagggggcctttgtgttcttgtgaaagaacttaagttaaacctctgtttacttggccttggataagtctcttaatccttttgatcctccattttcttacctagaaactcttctaagagattttaaggaggcaatcagtgaagtaatgtatataaatgaccggctaggctggattggtatgtgaagtctcatctaataaggctttacagttttaaaaccagtcaaaattacttgtaatttctcatattgaccttaagtcaccagggcctggatctaaaagcttataggacaacagctgattttatttcttattacatttttttgctatagttctctttccaaggggcattggaaaccaaaatctagcttgccttcatttaaagggtgttggatggcgtctagaacacactcagtaaatgttagttcaggttccctttctgccacgcttctacaagtggatttactccatgaaatcatcactagttctctgtcattttgtctctcactacatccagttgcccaggaaggtaccatttagtcttcaggaaatgcttgttggatgaatttgtctcccttacagtcttaacctggtacctgggaattgtgatctgtgttcctcattagccatgaagtctataggacctagaccttgcagggtgtattagtccattctcacgctgctaataaagacatatctgagactgggtaatttataaaggaaagaggtttaattgactcacagttacatatgactggagaggcctcacaatcatggtggaaggcgaatgaggagcaaagtcacatcttacatgtcagcaggcaagagcttgtgcaggggaactcccatttacaaaaccgtcagatctcttgagacttattcattaccatgagaacagtatgggggaaatcgcccccgtgattcagttatctccacctggccccacacttgacacatgaggattattacaattcaagatgagatttgggtggggacacaggcaaaccatattacagggtaaggcctgtgtggccagacacacctctccagcccccttgctctctgcacagtagccacactggctgccttacacctaaacattctcagatctcagctccaacattattttctcgagaaactttccatggttccctaggctagttcagatatcttgcttagaactctcatgtttccatgtattgttccttcatagtgcttatcttggttgtatttttatatttatttcggtgattgcttaagtcttgcctattccacagatatgagctccaagaatgtggagagaaacccttgttttttttctgtcccttgcgttgccagtgctttacacagcgcctgacacaacattagaggtgctcagtattgtcatgttctctgtgccttacacattgacttcaggattcaacgttgtgaaataatgcataaaataaatatatgagagcatgtctaacctgtcagtcctttattaaattactgattacatttatgttaaagtataataatatgtgtacataactggattattaaaaccaaaacaagccataaatatacaggatgcagcttttacggaaaaggtaatttgagtgattgaaatgagatactatgttaatcatttgaaataatggaaaagtattccagaggatacagagtagatttttagtcatcagaacagtagctgaattttaagatatgttcataaaagaaagcagagagtggttgagagttcagggcctagaagccactcaattttaaattagattattagctcagcctgcaaagttgtatgatgttagacaagttctttaaccgtctaagcctcagtttcttcatttgtaaacaggatgtaatagtgcctactacattgggtggttatgagtatgagatgagttatgtatctaaaatgattaatttcttgcacataataattacttaataaatgccaggtgccactgttattgttttgagctattctgttcactcactatatttgatgtggcactctcacacttgatcttagccaaaaggccaagaagcaattggtgtggcactctcaaatttcccctttcttgacccctgaaaagaaaaatatctattcttagagtggagaagtaacagtattattggaggtaggaaaatatttaggaggctggttggataaatgccttcatgtttcttcatgcgaattttttggcattgtctatgtattgcgagtaatagctatgtggcatggaagtgtatgaaaaacaaatgggaaagagccagtgttcttatgccatgtaatatcctatagaatggaaaaacaagcacagacaaattaaatttgtaagcattgcatcagtattctacttggcactttatagtaggtttagaagtaacattactgggagcgtgtcatataaagaaaggtaaatggatactttttccattaatttaacctaataaacaaatgacatggtggttaaaatggaagcgtactttgcttctcatcaaattcatttgtttataggtacttcataatttctagctgtttgccttccttacattattcagcacagacctggtcttttgcagaagtcagactatgattggatatttgtgttcttttagctaatgattggtattgccagaataatctttactagttgtcctggacatctgtgaggcatctgagttgttttttaggtggttgcaattggatgactcttagtgcaaatatttggcatatcctttccagtgacgcccaatctgcctgctttgttcatacttgtagggttttaatacaagctacaaaaggcaaacctcagctagcaaacgaatggctttaggctagattcttttgaatagttatcagcatattatttgctgtgtgttgcatatgcatgttgaagcatatttaaggagccactaaaagctgtaatattcagctgccacttttcaccgttagaagtagagctttttccagacctcctaccttttagtctactttgaaaggtgaaagaaagaacatcgtttcaggaataaaaatgcacagtagtagttatagttaccgtagcagtgattctgtgtttagtaacactaccagcactcgaaccagtcttgattcaaatgaaaatcttctcttggttcattgtggtccaacactgatcaactcttgcattagcttcggcagtgaatcctttgatggacacaggtattgaatcattggtgtgggattgtgttttactttttgatgggcagcacttttcaggaatggtgagctctttgacttcaaagggagaagctttattttattttgtctcatcttttaggttagaaatgttgcaacagattgccaacagagttcagagggacagtgtcatctgtgaagacaaactgattcttgctggaaatgctcttcagtctgtaagttaattttaggagccattggggttgtggtagaggagtcactgtgcgtttggatgaactaaaacttttacataatgtttggttgattcttcgtaatactctccactgaaacttaaagtttgttaaagattatgattggtgtttgctctcttgagagacaagaagagggaaaacatatttttgaaccaacaaggaaaactaaagaaagcccaagtaggcttctgttccaatatttgatgttttatatttcaggttgttttgaaacttgtttcacagaattaatactgagttcttttaaaatacaggattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagaggtaagagtgctacttattctttctctgtcctttttttgtgtaactgtttcatgggcatttgaaataggaatgtagagtatgaaaattttatgaaatatatttctttgctgttttttagttgaaaatgtgtgtcacatttttatatattttggtgtttaagtaggtacttgtcttttaaagattagcaatagaaaaaatattttatggtgcgtataatactgctgcagtaactaactcgttaaaatgaataccctagatatagatgtaagttacatgcatacatttacatacatttaaagtattcatgggatgtttgaaagagaaaaaaatctaagaaaagtgtctgttttttgttctttgagatgcagttttgctctctcacccaggctggagtgcagtggtgtgatctcggctcactgcagcctctgcctcctgggttcaggcgattctcatgtctcagcctccctagtagctgggattacaggcacccgccaccacacctggctaattttttgtatttttagtggaggcagggttttgccatgtttgccaggctggtcttgtactcctgaccttaagtgatccacctgcctcagcctcccaaaatgctgtgattataggcatgagccaccatgcctggccaaaaagtgtcatttttaattcagctttttagttttctgtttatcctattatgaaaatgttcataacaaaatcttgaaagaaaatacgtgtataaaaacctttatcactgagaagtgtgtgtatgggggtaagtatggaatatttcaggctataacctctctctctctctctctctctctctctctctctgtgcataaatatgtaaatgcaaaaattttaaatgatcctttgactcagtaatttcacctttaggaatctatagtaattctaaatatgaaaaatatatacataaatgtaaaaatgatcatattatgctatagtaattgtattcattataaatcatagttataaagacaaataagattgaaagtcctcatagtacaatgctcattgaaaaaaatcatgatgcaaaattttagcaatgtgatttcaattgcctcctcattttgcttgtttgtatttttgagccgtttaggcatactgaaaaattgagtgaaaaatacagagttcccatatgctcccttatacctccctcttcccctgttatttacatcttgcattagtgtggcacatttgctaaaactgataagccaacattgatacatcattattaactaaaacctataattaacattagagttcactctttgttacaagtgcctttatatttcaccttatccctttggattttcttttcagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtaaaaaaatgtttactttacctgagtgtttcagtctttattgttatcaatttcttttttaaacttagtattttactgtctgaaggtacaactggaccgcactgagtggggctcagatttgccaagtgttgaaagccatttagaaaatcataaaaatgttcatagagctattgaagaatttgaatctagtctcaaagaagctaaaatcagtgaggtatgtgaatttaaaatttgtatatatttcattttagtttactcttgttttgctttttacatgaagaccctgtaaatcaataatagatacattaagtgtgagtcagaattccttcagattcctgactggagtgtctttttaatctcatgttatagattcaaatgacagcacctcttaaactgacttatgcagaaaagttgcacagattagagagtcagtatgcaaaactcttggtaagtttttttttttaaaccttctgtttcccttatctatatttggcaaaaacatgattcttatgatgattttccttactaaagaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgtaagtacaccctttgtacttgcatactagggttgcattttaggtttatatatttttctaacacacttcttaattatttcttgaaggaattaatgagagaacttgatcaaaaggaagaaaatattaaatcagttcaggagatagcagagcagctacttctagaaaatcatccagcccggttaactattgaggtaaagctggaaagtgtaatggtgttggttgaatattgatatgattatttcccttcagattcttttattgctgagaagttgaaaattacaagccatctaacttttattaaaacctggctcagaaatgtttctgacaaattgtactgattgccttcagttctctggctctaagtatgtcacccatcacttagaataaaagtacccttgtcagcctctgtggctgagaagatgtattgctgtaaatatgaagtaccttctctgtgtaagcattgccatattatttatttctgattgtgtaacattgcacaagtgacatagtattgccaagcctcattttcctaccaagaatgggagagattacctctaatccatagagttgtgatgagaataagaaggaaataatttactcttactgcttagtatagtttttggtacattatttgttctcaaaaaaataccagctgttatgattcaatttaatacttttatttatgctctggttttgtgaggtgtattgggacagcatcctgacaaggctttataatgtgcagtgaacatttcaaattcagaagtggaaaattgagatgggatttatcaggttgcctatgcagttgggacaatgttttaaattgtatattagacagagttagtgactttctgaatggagaatagggggattatgtaagaaagtagggattgtcacacatgggcagtcagatgtgatattttgccagaggaaaaaaaatgatgctggtcctgaaagttgtcatgcttcaaactcacaattgaggaaaggaatctgatagattcactgaaatcataataactcaaaagattagtacaattctaggctcatcaggaagttttagggatgttatgtatgatcttttatataaaatacggttttgtgtctacatgaaatgtcacatatgaatgttaaaaacgtagaagagtagggaatctttagggaaaggagagtaatggagggcctgggatgtggttttgtacactaatacactaaaaagagtatttcttagggtggagagatgaaaactgttaggaaatactattatgggccaagaattttgatgggaatggaacatgtgaatgtcactctgatcacttttatgtaaaaattataatttaattaataaaaaatttcttaagaagtaaaatgaaaccttagtcatctttatgatcccatcggcctgtcctgtgtcttgtttgggtacatggataatatttagttaattatcaatactgtttcatattttatatgaaaaaaatatgatacatcttttatagccaatttactgaaagtagcttaatttgaggtagaatatgatcatgatatgttgccagatattcaatgctgcatcatacattccattcggaagtcctgcctaagtatagctcagcaggaatgaacttttccaaaaggagggaaaatgacaggcttacttaaaatagtcattaaagcatctcgagtgccctcttctggaaatcaatgaattgcaccttaaatagaaaagagtatttcatgtttccttgaggaaggaggtatcctttgtacaatattgtttaccctcatgaaagatacactctctattaaattagaagttcaagaaacacatttttaaaataaaaattcctagtattatcatcattataattccagaattacaccaatttgggagtacacacattttcttttccaccctccccaaacctcatcccagcaaaaacaaagagaaaccgacataaccatatatttctgtgttagaaggtatattttatgatctagcaccgtaaaaattcagagaaaggagagatgaatgtgccacgaaagaaaacatatcggaggattccacaaagcagatgtaagagttggtggcaaaggagtcaagtgttggttttgtaaacaggagggatagcttgcatttattttagtttttaaatattttttcccgtagccagagataatttttttcttatattttaataagaaatttcaagaagtttaaaattgaaaagaaatcaactggagtggtttaagaatttatatttaaactttaggactgactttgtacaagtgagaagtcttagataagaggaaaattttactgccctgattttcttgttttttttttgtttgtttgtttgtttttgttttttgaggtggagtttcactcttgttccccaggctggagtgcgatggcgcaattttggctcactgtaacctccgcctcctgggttcaagcaattctcctgccttggcctcctgagtagctgggatcacaggcgcgtgccaccatacctggctaatttttgtattttttagtggagatggggtttcaccatgttggccaggctggtcttgaactcctgacctcaggtgatctgcctgccttggcctcccaaagtgttgggactacaggcgtgagccaccatgcccagccactgccctaatttccaagtcttattctgccaaaacaattggtcatctatttagatagtagagttagcatttagaagcatcgatatcaaaaggtatgtgtgccttatttctccccagtcagttatgatggctctgttttatctttaaggcctacagagcggcaatgcagacgcagtggagctggatcttacagctctgccagtgtgtggagcagcacataaaggagaacacagcgtatttcgaggtatgtgagtagaatcataacttcaatagatggtattgtgattttggctaacttgcaggaatctttttcataatttattgttaggataacaatgtgtttctgtgtatatatatacacacatatatatatacacatatatgtgtgtatatatatacacacatacgtatacacatatatgtgtgtatatatatacacacacatatatatacacatacatatacatatatacacatatatacacacactgttatatatgtatatatgtatatgtgtgtgtgtgtgtgtgtttgtgtgtgtgtgtatatatatatatatatatatgtgaattgttttctttgtaggccgaaagagttggttttatgtcctatgagatagattgaagtattctgttaatgcaggaatcctttaaaaattcttaagatatcataaaatctttattctattctacaaatgtgtctcttatttaggaactgttttcatatagagaatcaaccatctataaccatttaacttctaaaaccatagaagtttttaagtattcttggaatttcactcctacttaaaaattgtttaaatcctaatttaaaatggaccttcagccaaaataatagagagccaaaacatcatataagctttggacacttagtatgttcattcataactattcaacttcaagggttattctttggtccaaggaaagatgtgactattaagctatcttgtgcttttattctcttctcacttatgaggggtacacataggaccttggtattggagtgtgacaactgtgtgctttgctggtatttaacatactttaacttccaggtttcatctttccttagtttttcaatgatgccaaagaagctactgattacttaaggaatctaaaagatgccattcagcggaagtacagctgtgatagatcaagcagcattcacaagctagaagaccttgttcaggaatcaatggtactaatacaaaacctatgcattttataagtatgcataagtgattagattagtgttttatatgagcagaactttgtattttattggcactcttgatatttcccactaattcaattacacatttgcacattcagttttagtattcttttggcaacaaatacaacagaagtgtttttttaatgtgatagctttgatattttaagatggtttttagtgtcgtgtgtgtgtgtgtgcacgtgtgtgtttagttattcattttgcaaatactttttaagttcttaatatatcctgggcactgttttaggttctagagctacagcagtgaacaaagcagacaagaatctctacctttgtggtgcttacatgctagagagggagttagacaataaacagaataaataagtaaaatttgtatagtatgttaggtagtgtaaatgccaaagaggaaaaagaaaaccaaacaaaccaaagaaaggaagagggatacaagatggggtggaggaggaaagattgaaaatttagactaggtagtcagagagaagacttttctgatgaagtttaatttgtgtaaagtgctgaaggcatggagagtacaagtcttttacttcttaaaattcactgtatttattacttaggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgaggtacttgtaactcctagaaacagaccagtttctgtcattattcatatattttgtaaatgagatcatattgctaactagtgatcaagatttcccgcctcataaaacaaaaaaaatcccaggattgagtatggaaaacagttaacagtgacctcattgagttattctgctctttattttaaaccagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacaggtttgtatatattagctaaaaatgttgagctagttttgggggccctctgaaggttgaaggaacaatcaatactttgtcaaggccccacaggatcaaaagtctctagaactcatccgtggaatatttcacacaaaaagaaaaattgcagtgtgttttcagagggagtaaaaacattaatctgagttctctttcatgtatttcagaattgagcaacagtatcagaatgtcctgactctttggcatgagtctcacataaacatgaagagtgtagtatcctggcattatctcatcaatgaaattgatagaattcgagctagcaatgtggcttcagtaagtatgaatctgtatgtcaactcgatatgtccaaaaatgtgcatgccttttcatatgtgtcgtagagtttgtatttgctttagaataggatggagtccggcaaatccatgctaatattcatttattcaatgaatatttgttatatgcccatagcatataaggcactttttaagaactgaggaaatctggagatcacaaatttcattcagaacttactgtgagatagggaggcagaatgtagttgttggatatacgatgatgggtacagttgatttcatttgagtttcgtagacttgtttttctttgtcgttaaaacctaaaattgttggctgggcgcggtggctcacgcctgtaatcccaggactttgggaggccgaggcaggtggatcacctaagaggtctggagttcgagaccagcctgaccaacgtggagaaaccctgtctctactaaaaatacaaaactagccaggtgtggtggtgcatgcctgtaatcttagctactcgggaggctgaggcaggagaattgcttggacctggggggcagaggttgcagtgagctgagatcgcgctccagcctgggcaataagagtgaaactccgtctcggccgggcgcggtggctcacacctgtaatcccagcactttgggaggccgaggcgggcggatcacgaggtcaggagatcgagaccatcccggctaaaacggtgaaaccccgtctctactaaaaatacaaaaaattagccgggcgtagtggcaggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaagagtgaaactccgtctcaaaacaaaaaacaaaaaaaaaccacctaaaattgttaatgaaaaagacagttaatttcaaatgttcctatttatgattattcgtttagattggcatataccacacgaccagtttgaagtgtctcccattcaaatctatgagtaatagaatgaattacatgggtctttggtcttctttagataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagaggtaaagcatggggatccctgtctttttttccccataggtgtttagttctggctattttttgctctcaatgggaatctcaatcttaggtatattgtatcacccagcctatgatatgtagacacaattggtggaacggtaaaagcatgtttgaggtaggaagactcaagaagggattaatttgtttccaaatgataaattaatgaaaggtgccaaccaactggttggacaaacaacgaattcttacttttcaacgttttcactattttgcaatccttcagtttcagaaaagattcaattattttcccatttaccaaacttggattttatacaaggattaaagcaaaaggtttttgcctagttaacttttgttaaatacagattttattctgaactttaaaaattttaattagagacaattttattagtaatattctattttttaaaaatcttaaacattaaatattatttacctaatatttacttttaaggatttttatttgatttttgtaattaatttttgcagctaatataattcacatttttgtgaacataaaatagcaacgtattactttggacagcatttaatcggaaattggtacttcaaatggcatttgggaaattttattaattcttcttaaattttaagatttatgttttaagatttatatccttagaatgggtttgtgatgaaaacaggaatcatttgcttgactagctgtgtcccagtaatataaaattctcatattaaaacataaacagaagcttctaagagatagaaaacaaggtattttctaaacatatttattttcacagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggaggtgagagctataaatatgttgggaaaaaaactaactctcttaatgaccttatgtatcaactcttgtgacttcttaatgttcagttttgcacactcacactagccagtctagtgtgaggtgaggtctgattgtgtaattattgctgattataaactaggattcagtctacctctgactcaggtaaacatgagaatatgtacacgctcaccttcattgtgatgaaggatataaggacttgtaataaaagtcattatacacctgctgtgtgcaaaagtactaagttagatgttgaggctaaggagatgaacagtaagggaattattgattgtaaaacttgaatgctatgatgtagtttctttgataacaaacaaagaatatgtagatttctaagtcattggttcttaatgtgaaatgtgtgtttttcaactagtttaagaaaaacacctcatcacaggtgatggcctgatacctttgtttgttctctgttttatagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagtatgtaactgctatctcaatatataaattgcttcatacaactctcatttttatttactattaatttaaaattttatttttattaatataaatattaacttttattttgtcttaagaaatacattattggctgggcgtggtggctcatgccggtaatcccagcactttgggaggccaaggcaggtgaatcacctgaggtcaggagttcggtaccagcttggccaacatggtggaaccccatctctataaaaaataccaaagttagccaggcatggtggtaagcgtctgtagtcccagctactcgggaagctgaggcaggagaatcacttgaacccgggaggtggaggttgcagtgagccgatatcgcgccactgcactccagcctgggtgacagaggaagactccatttcaaaaaaaaaaaaaaagaaatacattatttttatggattgatgacacttctctatgttgatagtggatgtgcttcagagatgagtgtgtaatgtatggtcctcccacattttgcatgtaatttgggtagctcagcagttgtagccaatgaattttcatctcatacttaaacaaagttagaaagaaaccatcttatgttgcagtctcttgctgaataccacttgtggggcaggggatgggttggagcacatactctctattaagaagaaagccagaaaaatgtcagtttcatagtaaatgtatcagtgttccaaggtgaagaacatgttatgtcatgtgtcataatggtgcttcaggactacattatgcaaaaataaacatttaaccataggtggctattgtttaatttcctttttaaggttgaaaactgttaacttggtgttaaaaaacactcaagctgcagaagccctcgtaaaactctatgaaactaaactgtgtgaagaagaagcagttatagctgacaagaataatattgagaatctaataagtactttaaaggtatgagactcacttttggatatttttaaatatcgtattctacaagtatttctctagcacttagatcttcaaacatcaagtgttaaatatcttggatttttgaatggatttattccatttgtgtctctgtgatctcacagtttactctaagtatgttcagtcattttagtttgaggagagttctcatttgaagtttgaacccttttgacagtagcttttgatagtcaattcatgttggcagcaggaggagtcgaagctaaaaattaaattatttgtaatagattaacttgctgaaaaagaagttaatttaagatatcaaggaggtaaatagagaagttaatctgagaaaggaaaaagacttgtagttcaactcatctatgtgtatttctttagcaagtggtgaaactattgcaaagcaatttttaaaagttatctcagtgatttttaatgcatgtatttctttttaacagtgggattagtaggcacttaaaagcagacaatgaaaaagacatattttattaatggaggtagcaaacttgcttatggaatatattttattttgttgatatgcaaattttattaggctgaacgttataaaattgtcattaaaaaatcagagtacaaatattgaaaatttcataaggtttgaactaatataatattgtgcatatgaaagatattctttcctttatcttattttctacctgtcatttgtaaataaattgtaaaattaggtaaataatatatttacccagtgagtggttaacatttttataacttttaccaattaatgtattttagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttagtatccttttttgttcagttttagcacagatttaatgtctatctatggtaaatgagtaaaatctacacatatgaggctatttttttacttccatagttaatttgttaattacaatacctctacttagccatatttctttcttacttggaggactttagtaagacatttaacttaaaataagcattttttcaactctgttactattcatgtattctagcatttatatagttaatctgcttgccttttctgaaggaaaaaacaatgtagttctctaattattaccaacttataatattcaaataaccatgacttagtaagagcatgaagcatgcatgtgatagggctgtgtgtagcttctatactggacttaagaaatgtaaataaatggaaatgccctgatgttcattttaattgaagatacaagaaagtcaaaattctcagttactgaattaaaaaaggttttagggttcatcttaaaataaatgaattcgtgtcctttctcattcactttcgtgcttatattaatgcaaataaaatgcttttatgatacagtgccattctccaaaagtaaaattatgttcaaatatgtgttatctctgtaacaaatatgatacataggtttaatgtggtggttttttaaatcatagagacaggtatgtaatcacagctcctggaaaatactctctgagaccatgttgaaccattcattggactaccttatcgttatttcaaaactgaactgccatttgatgcaagccttactattcaagacactgtaattgataataattaaggttaagcttccacttttcttgctttttaagtttagcttcttgggcttgtccctagaataatcactgtcactaaattgcacaactcagggagcagaatgtttatattcaacccaataaggaatgcccttgggggtgtgcctcagggtgctgcagccttgagttctttatacatacccgtcttgtgcttagttcattgcagtccaattattttgtctctcccatctctacatcttccaccctcctgatggatatcgctggacaccgtgactattcggttactattctcttaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaaggtatgtaaaaataattccctctactgaggttatgtctgcatttggtcagtcatgctcctcatcttcctttcctatgttaaatgaaaaagtcaccaactctttagaggaaggtggagagtatataaaaaatattaaaatcttgcaacccaaacctacatacatgacttatttttatttcttggaagtaatttttgaaagcatgggtaatcagaaagtggagagtgttgggatacttttcaaattcctaatgataatttatttaatcataggtatagaaatctctttgacactttgctggcctcaatagttttctaggttcctaaataagtaaaaatggttagcaatggaaaattaaataccacatttgacagaaagttgaatgctttgagatttttgttctatcttaggggccaatcatctctagctctattttcttcagaaataggtggtggccaagggcatcaagtctgcttttggataattcctaaggagtttagtaatttctgctttgaaaaccacatggggtgggtcacttctgtggcttaatctgaaagtttgtaattttcccataaggcaagttgtgtattaagtgcaaagggctaaggagctgtactgtgaagtgatgtagatatgtcttagttactgagcatcttatgtagtagaatagctgaattccttgtcatttttgttctaaactgtgtatatttatagatgctggtgtccgaaatagaaatgaaacagagcaaaatggacgagtgtcaaaaatatgcagaacagtactcagctacagtgaaggtaggaagattcattaactttagtaaaatttaatattcaggtttgtgattctacatgtactgttaaagccatgcaagtcatttcactcagtgtttaaaagaatcttcatttgaacttttttgacacttatctaataattctttgtgaaattagtcacatgacagccccccagttcattcgtcttcttctctctcacatatgtacacccctgccactcccagccaccagaatacatagctctgtagttggtttcttatcacttttctttcttttttctttaacattgttagggtatttcatgggagagcttctaactttctcacttagggggacacttttcatgcttttcaagttgtcattgacaacttttcagttttagccctccagatccatagttccattgcttagctggaggaaaggggggctgcatagggctacactattgttacatatattttcatgagcttctaaacagacttggaaattacccgaccaccctacatgtttctgattttgtccccatcttggaagcatctccaggattggatagattcctaaaaatgtaattttgctctacagtcatgtgttgtttagcaaaggggatatattccgagaaatgcgttgttaggtgattttttcattgtgcgaacattgtagagtgtactcacataaacctacatgttacagctttctacacacttaggcatatggtacagcctcttgctcctagactataaacctgtacagcatgttactgtactgaatagtgtaggcaactgtaacataatggtatctatttgtgtatctaaacatattaaaggtataataaaaatagggaataaaatacaaaacatggtacacttgtatagagcacctaccatgaatggagcttgcaggactagaagttgctttggtgagttagtgagtgagctctgagtgaaggtagaggcctaggacattactgtacacctctgtagaatttataaacactgtacacttagactacactagcttataaaaaaatttcttcaataataaattgacattaacttactgtaacttttttacattataaacttgtaatttttttaaccttttgactcttttctcatagcacttagcttaaaacaacgaacacattgtacagccatacaaaagcatcttctttctttatactttattctgtaagcttttttctatttttaatttttggttttttttttttttttttactttttaaacttctttgttaaagcctaagagacaaacatacacattaacttaggcctatatagagtcaagatcatcaatatcattgtcttacacctccaaatcccatgggaaggtcttcaggggcaatcacatgtatggagctgtcttctcctatgataacaatgcctttttctggaatactttctgaaggacctatctgagtctgttttacagttaactttttttttttttttaaataagtaggagtacactctaaaacaacaactaaaagtatagtgtggtaaatatatagaccagtaacatagtcatttattaccaagtattacatactgaacataattgtgtgtgctatacttttgtgtgacgggcagcacagtaagtttgtttacaccagcatcaccacaaacgtgagtaatgcattgtgccacgacatcactaggcgataggtatttttcagctccattataattttatggggctaccatcatgtatacggtctgtctttgactgaaatgtttcatgtgaaacacgactatattttctttatttaaacttaatttaatgaatctaggttctaatgatctgtgtcaaatcactaaagttattttagtgaatctaggttctaattatctgtgttaaattattgtagaatgaaactctagtactttgcttcaattcattttatcttattgactcctttatacaggactatgaattacaaacaatgacctaccgggccatggtagattcacaacaaaaatctccagtgaaacgccgaagaatgcagagttcagcagatctcattattcaagaggtaataaaagtatgagagaaagaggggaaggggcataaaagaaagaacacttactttttaaattttattttttgttgtggtaaaatatacatagtataaaacttactattttaacaattttaaatgtacagtttaatgacattgcagtatatcacaatattgtgcaactggtaccactgtttatttccagaaccttttcgtcatcccaaagagaaagtctacacccagaacaatacattctattaagggtttttaaaaaccctttaaaaatgtttattcaagattaattattaactatggagataaataaatgtacttatgtacttcatggtgaaatttagaagagaattatcatttgccatgatttgcataatagtaataataagctcattcttatcatttattatggggggagttgtgtgctttgctgtctgaaggcctagttaatgtaattattattcaaaattcattcaacttagtaagagtaactggaggtaatgcttttattatttttttccttacttgcagttcatggacctaaggactcgatatactgccctggtcactctcatgacacaatatattaaatttgctggtgattcattgaagaggctggaagaggaggaggtaatcattaacagtgagcaccctgtaaatataaaggagctagagatgagcagtaactacagtgtagtttgggaaagcaaaacatgtttcatgataaatttatgtggccggtagcagatgtacaaataaatattgaattataaaattacaatgaaaatgactgaaggcctaagatttttgtttgtctttaagattcattcaaatagaaagtcatttcacttcatgactttacattttcacttcaggactctaatatggtggggttaatgtcttaaataaattacgaaattttggcagtttggcagaatatttttcggctttctcacagctgagaggtatacttctttgaagtatagttactgctggtatgatgtctacaggaataccacacgaacacatttgtcttatgcattttaaattaatttgtatctcaagaagttaaaattattatacataatgtaaagatgctaacttagaagtagtagacgtttttacaaaatgatactttttaagaattttggagttttttgttgttttttttttgcaaaaagatatagcacatggcatttaaaaaggctatttaaatgccactctgatttggagaacttctgcagctttgattctgcatttaaaaatcatatttctgcatttataaatcatatatttaaaaatcatataggaagagtaaggacttatttataaagatcagtggtcaccaaaggctcttgtatgtaatctaaaagggagtatgctatgctttgttatcttgatgtactttctattccccagaacagacaaaaatagtagaatgaatgttgaaataaataaattgtgggccattagctattttaaattggactgttgttgaaattctaaaggtgattatgcttaatgtaactccatatgagagctgaaacagcagtaaacatctattggatgttactttctcagtttcctaaaaatgtgaccacttttataaactgttttagtctgttcagagttaacagttttctgcagctaaatcactaacatagctaattgcaagactttataaccctcttcctttgtgcttaggagaaccaggatatttgtgaccatcttaaatgcatgcatctctcatctatgaaagaacatccataattttcttatatttttagtttttgagagatcttattccattttaaatggtatacagatcttttaaattgaatatgcagtagttaaatataaaataaaataacttaagttcttttctcatagtatgtatctgattatacatatatgggccacttactcgatttatctgatgaggcagaatgctaacaattgatagaaacaaaaaatattttagaaggccttaattgaatgcaagttattattgtccttaaaaatgtcaaagatttgtagttaattgaaaccagcaaatacagttatggaagaacaagcgaaggctataatttaaaataggttaaaaaaaactaccacttaacattacgttaatggaatgtcgtgtaaaagatacatagcttaatttttagactcaaaagattggtgtttctgcaactgaggtttgaagacccacatgaaaaaccttggtctaaagcagaattttccataataaacataaaatcaaagatggatgcaagttaatttcagaagtaatactgatttagttaaaagaaatgttactaaaatatctgtaatagatattagatattagagagagatgctttagtctgtgctgagaacaaaatatgctaagtattaatcaccgtgattaaagggcaagattgaggaagatttagagaaaagttaaggaagttatttttatgcaaataagtttgagatccacaagaaagcaagtcagcaattggactaaattatttctagtaatttttctcacatttgctaaaaaagtcaagagacaacatgatttttttttttttttttttttttttttgagacggatctctgttgcccaggctggagtgcagtggcgtgatctcggctcactgcaacctctgcctcctgggttcaagtaattcactgcctcagccttccgagtagctgggattacaggcgcctgccgcctgccaccacgccgggctaatttttctatttttagtagagacggggtttcaccatgttggccaagctggtcttgaactcctgacctcatgatccacccgccttgggttcccaaagtgctgggattacaggcatgagccaccgtgcccagccgagattcttaacaaatcactgcattgcctaaggcattgagggttcaacaacagatatttttttctgagggaatttttagtttttctaaatctgagcatgagaaatagctcagaatttcttagcaatagctaagttttaaaggaggtttgataagcaactgagactgtcttagaaataacctcctcaagaaatactgaaaacttagtatttaaatagataaaatgctcatgtgtcacaggattgaccctgatactaaaataaagaaaatagagtgctgaagataacagattatgagatttgtttctgtatgaattattattagaaaccttatttaggttagcaaagaaaacaactgaaattctcatcaaaattattggagatcaagaaattagaggaagcaaaataagatgtatggtctgtaatagaaattaaattcttgaaattcaccaaagcttctcaatgaaaacaaatctgtctaaaataatttctgtattcctgtttaaattattttatggtgatcttgagttgatgatacaaaactaacacactagaatattaataaagagaaattaaattgtaattataaactaatcctgatcatgtagttctataatcaatgtaaagcatactcctcccagctgacattgattctgtccctagtagagtaaaaattttttcttataattttttctatacattggagctgaatccctaagtatatatttaaaagctattatacttaacaaatatctttatatttatggagtatttaaaggtgcttgtcaaagtgattcatatgaggcatgttattaacaacagcaacaaaatctgtgagtatatgaagcgcatcttttccagagccatcaggactgtagctgcctttgcattagcaattctgattattataattgtcataatatggcaagtataaacaaataagggatctgactttagaaatttcaagtttttgtataattttccttcttccccatgttatttcctaatttggctctctgttctaaagttctgtgctttgtttttttaaccataagacatgggaatataagtatcatttttaatttctattaggttagaaaactaaattctttagcatcatttggttcctatgtgttgggtgttcttcctacctcttaggattatgttgcatgcaagagaagaaagggcaccgtcgtgagagttttatttcccactttgtcactcacccaatgtgagtttgcaaaaatatctgtcctcctcgtttctccctttcctcatctgttgtaaattcccttcttgctataaaattctaagctagctaatttttaaaataaaattattcctgaggggcaaaaagatattcttcagaaaacctgtcgtgaagggttttttgtcctcttctgctgactttctgaggcttcctctctgaagaaggtgatgctgctggtggtggtgatagcgcttgttctgcatttgagttcacttggttttgtaagtacttttatgaacattgattcatacgttgtaagatattttgaacagaacaggcttgacactttcaaaatgtcttttgtagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcagaaagcagaagaactcaaacagcaggtagatgaactaacagctgccaatagaaaggctgaacaagacatgagagagctgacatatgaacttaatgccctccagcttgaaaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagaggtatactctgtgttctgagaccttatcagctacctaatgtcaagtttcctcatttgtttcctttctctcctagactaaatttttaaaacaattttgaatgtgattggctcattgtagttctgacaggaaaataatgctatactctttctggtaacttacttgaatctttatcataaattaactttaatttttgaatgtttgagattaaacatacagatgtaatagatatactgttatatctgtggagatacattctgaaaaatgtgagtatcaaaaaagctagaagaaccaagcagttagctttaacttctaacatattctgtggctagactttgtcttagtcttttttaaagatataattttaatacctttaattgtcatctaagataaaattcagactctgaaaataatataatacttattcctgaaccctccttggtttgaaatttttcttcttttcactaatcttgtctttgtaattcaaagaattatgtttggattgagaatggataaagtgacataatgttcttgaggtgacttttaacattttataaattcctgttacagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattccaagggcttaggcacactgtgactgccaggcagttggtggaagctaagcttctggacatgagaacaattgagcagctgcgactcggtcttaagactgttgaagaagttcagaaaactcttaacaagtttctgacgaaagccacctcaattgcagggctttacctagaatctacaaaagaaaagatttcatttgcctcagcggccgagagaatcataatagacaaaatggtggctttggcatttttagaagctcaggctgcaacaggttttataattgatcccatttcaggtcagacatattctgttgaagatgcagttcttaaaggagttgttgaccccgaattcagaattaggcttcttgaggcagagaaggcagctgtgggatattcttattcttctaagacattgtcagtgtttcaagctatggaaaatagaatgcttgacagacaaaaaggtaaacatatcttggaagcccagattgccagtgggggtgtcattgaccctgtgagaggcattcgtgttcctccagaaattgctctgcagcaggggttgttgaataatgccatcttacagtttttacatgagccatccagcaacacaagagttttccctaatcccaataacaagcaagctctgtattactcagaattactgcgaatgtgtgtatttgatgtagagtcccaatgctttctgtttccatttggggagaggaacatttccaatctcaatgtcaagaaaacacatagaatttctgtagtagatactaaaacaggatcagaattgaccgtgtatgaggctttccagagaaacctgattgagaaaagtatatatcttgaactttcagggcagcaatatcagtggaaggaagctatgttttttgaatcctatgggcattcttctcatatgctgactgatactaaaacaggattacacttcaatattaatgaggctatagagcagggaacaattgacaaagccttggtcaaaaagtatcaggaaggcctcatcacacttacagaacttgctgattctttgctgagccggttagtccccaagaaagatttgcacagtcctgttgcagggtattggctgactgctagtggggaaaggatctctgtactaaaagcctcccgtagaaatttggttgatcggattactgccctccgatgccttgaagcccaagtcagtacagggggcataattgatcctcttactggcaaaaagtaccgggtggccgaagctttgcatagaggcctggttgatgaggggtttgcccagcagctgcgacagtgtgaattagtaatcacagggattggccatcccatcactaacaaaatgatgtcagtggtggaagctgtgaatgcaaatattataaataaggaaatgggaatccgatgtttggaatttcagtacttgacaggagggttgatagagccacaggttcactctcggttatcaatagaagaggctctccaagtaggtattatagatgtcctcattgccacaaaactcaaagatcaaaagtcatatgtcagaaatataatatgccctcagacaaaaagaaagttgacatataaagaagccttagaaaaagctgattttgatttccacacaggacttaaactgttagaagtatctgagcccctgatgacaggaatttctagcctctactattcttcctaatgggacatgtttaaataactgtgcaaggggtgatgcaggctggttcatgccactttttcagagtatgatgatatcggctacatatgcagtctgtgaattatgtaacatactctatttcttgagggctgcaaattgctaagtgctcaaaatagagtaagttttaaattgaaaattacataagatttaatgcccttcaaatggtttcatttagccttgagaatggttttttgaaacttggccacactaaaatgtttttttttttacgtagaatgtgggataaacttgatgaactccaagttcacagtgtcatttcttcagaactccccttcattgaatagtgatcatttattaaatgataaattgcactcgctgaaagagcacgtcatgaagcaccatggaatcaaagagaaagatataaattcgttcccacagccttcaagctgcagtgttttagattgcttcaaaaaatgaaaaagttttgcctttttctgtatatagtgaccttctttgcatattaaaatgtttaccacaatgtcccatttctagttaagtcttcgcacttgaaagctaacattatgaatattatgtgttggaggaggggaaggattttcttcattctgtgtattttccttacatgtacagtagacgttctctattctatcagccttctatggtacctttttgtcaggacaattaggattgtaatgctaatgcaaaggcagcaattcaaagatcttctagtgcctcatgaataaagttgagatttaaaatttgtaacattgatggaacagctgggaggttagaccaatcattaaggaatgtatgccatagctttctttgctaccataaacattttggaggtgcatctgctatgtgacatggtaaatatggttaagtgaatgaataaaatgttttagtaacctgtgtgtgatgaaaaaaaatttttacattcttgtttgctatggagaggtcagtttaatagctaagtcatttaatgcagtgtatatttttcttaccgctcacaactgtcagaagtcactggaagaagaaaagaaagaacatgttgaaaaagccaaagaattgcaaaaatgggtatcaaatatcagcaagacattgaaagatgcagagaaggctggaaaacctcccttctctaagcaaaaggtattcacagaagtcctggtttaataataataataatagcagggacgttaactgagttgacacagtttacctagcacaatgtttaatttttaccttaattttcccattgttatagcccaatataatgcaaatcagaaagattaaataacttgcccaaagaatcaaagttagtgtgtggcagaagaagctgtttaattccaaagcctgaacgttatatattgttcttatttttagtaaacgaatacagtatgctgcttttcctaataattaggtctgcttcctgattattacaataagaatagctgaagagcagagtcattctgttttatgtctagagtagatccatgcactccatgtcataaagatatgccgtcttattcttacagatgtaaacataaaaagtttcaagaacaatgaagatacaaaccaggatattaacattcttgattattgactttagttgtgcttttctgggtcttttctatctcataaggaagtgtctacagtcaatcactggaaattctagatactatcccttatcctagtgaattctttagtcttaacgggctatcttctgtatcccaactgcttaggattagttggatggccgcagcttgggagatgtccttggactgcaccacttaaagctcttaggatgttggtagttggggtgtacattttagtattgctgccgctggtgatagcagtgggattgctgctgtattaaaaaaataaatttccgctaagataagaagcgtttttctcaaggaatactttcctacactgccctcctgctcttgtctgacgtttagaaatttcaaggctatcatccaatcttaatgtttagctcccacttctagctctgcatcagtactcacttgtcatctattaaaatagacattgttgacatgactaaataggggagaacaccagtgccttgtcttacttggctgtgatatgaggcaagtgttccttatttgaggttctttcttggagaagtttacagaccagagtatatacttgaaaagttgttcagttgaagtgaagtattcagtcatagtcttacatactatatatgtgggatgtgggagatgtgggaaagcacttgcatttggtgctttataccaaaaagcttcaagtaattttaatatatatatttcatgtaaaatatccttctcccccctcattaaataggaagacaactaaaatggggacataaagcttaacaaagattccttgggagagttagtttcttttgagaaattttgattataaacccttggtatttttatattctgtagtttcatgtgtatatatatatatttttgagacagggtcttgctctgtcacccaggttggagtgcagtggcatgatcacagctcactggagccgcaacctcccaagctcaagtgatcctcctgcctcagcctcctgagtagctggactgcagacacatgccaccacacctggctaattaaaaaaaatttttttgtagacattctttagttttaaattctctaaaacattactaagtcagatttagacctagtaccctagatacattcttaatgcagataatggcgttaattataactgtctaagaacagctgatggtcgttctgttaaaggaaattttagttaatataagtatgtccttcaaaaatcaatgcagcctcatgattatagtcatgaaaaataaactttaaattgactctaaatagacttcatgggggaaaatatatcttttcattggcccattatttcctcttatttctgctaatttaaaagaatggcaattaatttctgaaataagggatttggaaatgatacactgaggaattaggagaaagtgtgtgacctcttgcttttccccaaacagatcaattttatttctctgacagatgacagtcacagatgacttttacaaagtgggtcttagcattagaaattatttgttctttttttcaatagttaaaaagtttcttttagataggatcttactctgtcgcccatgtgggagtgcagtggcacgacctcagctcactgtaacctccctttcccacactcaagcaattctgtctcagcctcccgagtagcttggactacaggcatgagccaccaatacttggatactttttgtatttttcatagagacaatatttcaccatgttgctcaggctggtctcaaacgcctgagctcaaaacaatctgcctgctttggcctcccaaagtgctgggattacaggcatgagccactgctctcagctagaaattctttattctgggtctgcatacctacagattattactttcaccataattttttcaaaaggaacattgtgtctaggagcttggcagaaggaagatgccctttggaagtagtgtcccacagtcatgtgtctttttgaggactgcagtgcgcaaggatgacactgggccagtgctgagtgcccacctgcgggtggaggccacctttatccacggctggactaggacagatgcaggaaacgtataatgtattattttctcttgaaaatgacggcattaaggatagagagaggagctttccttacggattctaaataaaatactcttatctagctctatagactgctaataactgataggttattcacttgggtcacccagaaaatagacttgggtcttgactaaagcttgattaatttcttttttttaaaaaaaatactgtttactccttttggaggaagagtttgaatgtgccttctttaccttacagatttccagtgaggaaatatcaaccaagaaggaacaattatcggaagcacttcaaactatacagctttttttggcaaaacatggagacaagtatgttggttgtagttagctcttttattttaagtggggaagtattcttaaaagctttcagcaaaacagaggtggtaaattttaattgcaatgttaaatatgggactcaaactaatcacaattaatatagtaatgtaaagagtatcaacttagtaatttaattgtcaattttagtctttattacaactttgaaatattcttattatccccatgtattaccgataaggaaacaggctcagagaggtaagaattaatagcaagtgagaggtagagtgcagactccgagtcaagtcttaaatctaagtagtactctgtgagacttattctttggaaaatatgtataaatatggtcttcattttcttagctgagacctatggcagcctcgtttctcatattttgtccctactttttgcagcaaagcactttatatatttcagtcagtgtttcactcagggaaggaatccacctttttcttaaattctttttggatgtcctcctaggattatttcataatgactttatagtataccttagcaaattaggttaatccccttataaatttcctctttgtttgtgctttagtctaaacaagtttcatcttgagaaatggtaccttattgtcccttttccatgttgggattaacaatgagaccttaccctctgtcagatagcagcaattgttattttggaattttgtatgttaaataagggtcaatacattagtttacaccctttccttcagtccttttctcaggcaagggaaagatccttagatattttaaggccattcttaattttcatatacagtcatactgagacctgagcaatatgtatgtgaggctatattttattttaccatcatatgacaaaattattgaacctaatacatctttatctcttgaggacgacttgcattagtctttttatcatttctggttatttagaatgacagatgaagaaagaaatgaattggaaaaacaagtgaaaactcttcaggaaagttataatttattattcagtgaatctctgaaacagctacaagaatcacaaacctcaggagatgtaaaggtagaggagaaggtaatattatttatttaaacatgaggctgtttcaagaagcttagtttgattgcatggctctggaaatctatgtcaataataaagaaatgaccttgaattttgtacgtagttaaaatagggattgagtttatttaaatgtttggagattccagtgttgtttattaaatgcaatcttacacatgctgaccatcagtttctgtgacatcttaatctctgccttgcatggtaaaagaaaagtatcattcattcttctaactcttctctttaaaagccattcttctagtatagtaggtattttattatattataggctataaaagagcctgtgggtcatctctaaaggtggcattgatgtgttagagattgtttgactttcagagatatccatgagacttatttgagtaatacaaggccatacattatagtgaggatgccctagcatcttcttaaagtataaatcatttaaaatttggctggtacttaaacttttaaaacttgacagtgtatatcaacaggcctaacataatattcaatattcaaaaagttatctttatatttaattccttactcctgggaatactttccacataatttgtcacattttgggggtatgtaacaatttttccagtttcttagtttttgactatctttgaagaagtctgtatgctgtaaacatcaatagcatggggtttgatactctctttcctgccactagactctaatctcacctaaatgcagaaagcatggtttgccttctagatatgtgttctgttttctcactatcatcatctactctgttgtgtcctcactaaccttgtcaatatacacgatatcaagttttcaattcacagatgcatgttgttttcaaagcttttatcacatcctgtgctgttgaatagatcactgacatagatcacttgtgcatttgaactgcctaacattcacagcattgctgcgccttggtaagtagaggatttttatgttgaaatgtattatttattttttaaaaaacctaagttgcatgaaactccgcccacccttgtgtaacagagtgacctgagatttttgcattttcctttcagctggataaagtgattgcaggcaccattgatcagacaactggagaagtcctttcagtctttcaagcagttttaagaggcctcattgactatgacacaggaattaggttgcttgagacacagctaatgatttctggtctaatttcaccagaattaagaaagtgctttgaccttaaagatgccaaaagtcatggccttattgatgaacaaattctgtgccaactcaaagaactaagtaaagctaaggagattatttctgctgcgtcacctaccacaattccagtactggatgctctagctcaaagcatgataacagaatccatggccatcaaagttcttgagatactgctttctacaggctctctggttattccagccacaggagaacagttgaccctacagaaggctttccaacagaacttggtttcctcagcattattttctaaagttctggaaaggcaaaatatgtgcaaagatcttattgacccctgcacctctgagaaggtttctttaatagatatggtacaaagaagtactttacaggaaaacacagggatgtggcttctacctgtgagaccacaagaaggaggtagaataacattaaaatgtggaagaaacataagcattttaagagcagctcatgaaggtctcatagaccgtgaaaccatgtttaggttgttaagtgcacagcttctttctggaggtctgatcaattccaactctggccaaagaatgactgttgaagaagctgtcagagaaggggtgattgacagggacactgctagcagtatcctcacatatcaggttcaaactggtggaatcatccagtcaaaccctgccaagcgtttaactgtagacgaagcagtacagtgtgatttaataacttccagcagtgctcttctggtcctggaagctcagcgaggctatgttggactcatttggccccattctggtgaaatatttcccacatcatcttccttgcagcaagaattgattacaaatgaattggcctacaaaatcctgaatggcagacaaaaaatagctgctctttatattccagaaagttctcaagtcattggtttggatgctgctaaacagctaggaattatagacaacaacacagcatcaattttaaaaaatataacactgcctgataaaatgccagatttaggagatttagaagcttgtaaaaatgccagaagatggctctctttttgtaaatttcaaccctccacagttcatgattacagacaagaagaggatgtttttgatggagaagaacctgtcactactcagacctcagaagaaactaaaaaattatttctatcttatttaatgataaatagctatatggatgcaaacacagggcaaaggcttttgctgtacgatggagacttggatgaggctgttggcatgctactggaaggctgtcatgcagaatttgatggaaacacagccataaaagaatgtctcgatgtcttaagctcatctggtgtatttcttaataatgcttcaggtagagaaaaggatgaatgtacagctacaccaagtagtttcaataaatgtcactgtggagaacctgaacatgaagagactcctgaaaatagaaagtgtgctatagatgaagaatttaatgaaatgagaaatactgttatcaatagtgaattttctcagtcaggaaaactggcaagtacaatatcaattgatcctaaagttaacagttcacccagtgtgtgtgttcccagtctcatatcatatttaacacagactgaacttgcagacattagcatgcttagaagtgactctgaaaacatacttacaaactatgaaaatcaaagccgagtggaaacaaatgaacgtgcaaatgaatgtagtcattctaaaaacattcaaaactttccaagtgatttaatagaaaatcctattatgaaatcaaaaatgagtaaattctgtggtgtgaatgaaacagagaatgaagataatacaaacagggattcacctatctttgactattcccccaggctaagtgccttgttaagtcatgataaattgatgcacagtcagggaagttttaatgatacacacaccccagagagcaatggaaataagtgtgaagccccagccttatcattcagtgacaaaaccatgttgtcaggtcaaagaataggagaaaaatttcaagaccagtttctgggaattgcagctattaacatcagtttaccaggagagcagtatggacagaaatctttaaatatgatttctagtaatcctcaagtacaatatcacaatgataaatacatttcaaatacttctggtgaggatgaaaaaacacatccaggttttcagcagatgcctgaagacaaggaagatgagtctgaaatagaagagtattcctgtgctgtgactccagggggtgatactgataatgccattgtgtctcttacttgtgctacaccattgcttgatgaaaccatcagtgctagtgactatgaaacgtcactgctgaatgatcagcagaataacacaggaacagacactgatagtgatgatgatttttatgatactcccttgtttgaagatgatgaccatgattctttgcttcttgatggtgatgatcgtgattgcctgcaccctgaggactacgacacactgcaagaggaaaatgatgagacggcttctcctgctgatgttttttatgatgtctcaaaagagaatgaaaattccatggttccccagggggcaccagttggtagcttaagtgtgaagaacaaagcacattgtcttcaggatttccttatggatgttgagaaagatgaattagattctggtgaaaaaatacatttaaatcctgttggctcagataaggtgaatggacagtcactggaaactggatcagaaagggaatgcacaaatatccttgaaggtgatgaatctgactcattgactgattatgatattgtaggaggaaaagagagcttcactgcatcattaaaatttgatgacagtggcagttggagaggaagaaaggaagagtatgtaactggacaggaatttcactccgatactgatcatttagattctatgcaaagtgaagaaagttatggggattatatatatgacagtaatgatcaggatgacgatgatgatgatggcattgatgaagaaggaggaggtataagagatgagaatggaaagcccaggtgccaaaatgtggctgaagatatggatatccagttgtgtgcctctattttaaatgaaaacagtgatgaaaatgaaaatattaatacaatgattcttctggataaaatgcacagttgtagctctttagaaaaacagcaaagggtaaatgttgtacagctagcatcacctagtgaaaataacttagttactgaaaaaagcaaccttccagaatatacaactgagattgctggaaaaagcaaagaaaatctgttgaaccatgagatggtacttaaggatgtattgccgcctatcattaaagacactgaatctgaaaaaacttttggccctgcaagtatttcacatgataataataatatcagttcaacttctgaattaggtactgatctagcaaacacaaaggttaagttgattcaagggtcagaattgccagaattgactgattctgtgaaaggtaaagatgaatattttaagaatatgacaccaaaagttgactcatctcttgatcacatcatttgtactgagcctgatttaataggaaaacctgctgaggaaagccatttgtcattgatagcctctgtaactgacaaagatcctcaaggaaatggaagcgatctcattaaagggagagatggcaaaagtgatattctaatagaagatgaaacatcaattcagaaaatgtacttgggtgaaggagaagtgcttgtagaaggtctagtagaagaagaaaataggcatctcaaacttttgcctggtaaaaatacaagggatagtttcaagttaattaatagtcagtttccatttccacaaatcacaaacaatgaagaacttaatcagaaaggaagccttaaaaaagcaactgtaactcttaaagatgaaccaaataatctacaaataatagttagtaaaagtcctgttcagtttgagaatcttgaagaaatttttgacacatcagtttccaaagagattagtgatgacattacttcagacattacatcgtgggaagggaatacacattttgaggagtcattcactgatggacctgagaaagagcttgatctgtttacttacttaaaacattgtgctaaaaatataaaagcaaaagatgtagccaaaccaaatgaagatgtcccaagccatgttttaataactgcccctcccatgaaagaacatttacaattaggagttaataatacaaaagagaagtccactagtacccaaaaagactcacctcttaatgacatgatccaaagcaatgatctttgtagtaaagaaagcatctcaggaggaggaacagaaatttctcagttcacaccagaaagtattgaagccacactttcaatattatctcgtaaacatgtagaagatgttgggaaaaatgattttctgcagtcggagcggtgtgcaaatggattaggaaatgataactccagtaacactttaaatactgactattcattcttagaaattaataataagaaagaaagaattgagcaacagctaccaaaagaacaagccttgtctccaagatcccaagaaaaggaggttcagattcctgaattgtctcaggtatttgtggaggatgtaaaggatatcttaaaaagcaggttgaaagaaggtcatatgaaccctcaagaggttgaagaaccttcagcctgtgcagacactaaaattttaattcaaaatttaattaaaaggattaccacatcacagttggtaaatgaggcatctactgtgcccagcgactctcaaatgagtgactcttctggagtttcccccatgactaactcatcagaactaaagccagaaagtagagatgatcctttctgtattggaaatcttaagtctgagcttctccttaatatattgaagcaagatcaacatagccaaaaaattacaggagtatttgaattgatgagagaattaactcatatggagtatgacctagagaaaagaggcattacgtctaaagtacttccactgcagcttgaaaatattttctacaaactgcttgctgatggatattcagagaaaatagaacatgttggagactttaatcaaaaagcatgttctacatctgagatgatggaagaaaagccacatattcttggtgatattaaaagcaaagaaggaaactactattctcctaatttagaaactgtaaaagaaattggactagaaagctctactgtgtgggcatcaacattgccaagagatgagaagctcaaggatctgtgtaatgatttcccaagccatttggaatgtacttcagggtctaaagagatggcttctggagatagctcaaccgaacaagtaagttgacctatacattttatacagaaaaagctgcatgaaccatgtgagaataatcccatacatttgctttaaacatctgcataaaggttattgaattaaaatgtccaactttgtttttagttttccagtgaattacagcagtgtttacagcacactgaaaaaatgcatgagtatttgacattgcttcaagatatgaaaccccccttagacaaccaggaatctctggataacaacttggaagctttgaagaatcaacttagacagttggaggtaagaattgtctactgcctctttatggatggtagtcagctgatgtatgactgggaaaaagaagcagaacacttctatgtttcatgtttatatttgggtttttcactaaatagtaaataggtccgggatatatttctttgcagacatttgaattgggattagctccaattgctgttattttaagaaaagatatgaagttggcagaagagtttttaaagtctcttcccagtgactttcccagaggccatgttgaagaattgagtattagccaccagagtttgaagaccgccttctcttccctcagcaacgtgtcttcagaaagaacgaaacagatcatgcttgcgatcgactctgaaatggtaggcataaaatgtcaaaattttgatttatgaagaaaattttattatttgaggatttagtcataagctggagtattttagttttagagtgctaactcttaaaccacagtcattatttgtaagaatttgacattttggggaaagataactgaatgcacaatttttttttctagtctaaactagcagtttcccatgaagaatttctgcataaacttaagtcattctcagattgggtatcagagaagagcaaatctgtgaaggatattgagattgtgaatgttcaagattctgagtatgtaaagaaacgtttggagtttctcaaggcaagtatcaaaacaaagatgacaaaatatatttcaaaaactatgactttaatatataacaagtgtttagaaaatatgactttgctaaggctacaaaggattatttcctttctttgtctctagagatgtctttattcatagttgacacaactataaaataatcacaactttaagggtatcattctgatgctatcccaaaagccttatcatactcttacaccactgacatgttgagatttttatttatatatttatttatgtgttagtcacataaatatataatagtatgaattagccatataaaaatcatcatgtaaatacataataatatttgtagtacagtcatgcatcacttaatgatggagttacattctgagaaatgcattgttaggtgattttgtgttttgcaaacaacaaggagtgtacttacacagacctagatggcatcctttactgcacacctaggctatatgatatacctgttgctcctaggctacaaacctctacagcatgttactgtactgactactgtaggcaattgtgacacagtggtttttgtgtatctaaacatagaaaacgacaggaaaaataaggcattgtaatcttatgggaccaacattttatatgtgacctgtcgtatgtggctcatgactgtgtttatatgttgtcacttttggcatactttttttttttttttctaagttcttaatttcaacagcattcctcatgaacaatgattaggcttctggcctgagagtcagaaaactgaaattctggcatatttcattcatatttcaaatccctcaaagtattatttatatcttaccacaattacatggatgttgtaaatgttagcaagtcatattttaaggtagatgtttctcttcagtgtgctaaatatacctaagttaggtctttgccttttgtcagagttatattttaagtgcaatgtgacaggtaaagataaaacatttttagagggattatttgtctttttatataatactaactaccatggtatttaaataattaatttatcatttattactagatgataaatagatttttgatgaatagcaaaaaaattcataaaacttccattccctgatgtgagaaatgtatttacaaaacataaatattattgttaatataaattttatcatggcttaactttctactgatagcttgtactacttttttaacagaatgtattaaaagaccttggacataccaaaatgcagctggagactactgcctttgatgtgcagttcttcatttctgaatatgcacaggatctgtctcccaaccaaagcaaacaactgctgaggctcttaaatacaactcagaagtgttttcttgatgtacaggagtcagtaactacccaggtggaacgtttagagactcagttacatctagaacaagatcttgatgatcagaaggtttgcctttcttcgtggagttggcattcattgtttttagtgtgaaaccataatgtagatacccaaggagtatagtgtgacaggaaagattttctggaaaggcattaatggataagatacagtgtacatacaaatcctacagtgtataacaatattgttttcactaatgatgctataatttagttgatttgaatttttgtgactcccaaaaatacttaacttcaagtgagagtcttgattgcctcccaccccaagactaggaaatttgaatgcacttagaaatttaacacattgaggaacatatgactaaagaaggttaagagtttcgttttcctctgggaaccaatacagcacagcaattcagatcatgggctctggagctagattgcctgatttcacatcccagctgcactactcattcattctgtgaactagggcaagttacttaacctcagtttaatcattggtagattggaaataacaatagcgcttacctgctagtgttgtgagcattgataaaaagaatgtatgtaaaacatttagtaccttgcctagcatgtgttaggctcttagtaaacgtgatctatggctataagatgaataattagtgtatacatagtaggaaaatgaaaggtgcaagtaattagtgttgacttcttaatcttttagaagatttaatgaattatatgagtgctatatctaatagcaataacgagcaaagaggtgagaatgcacttagacatagtgattaagtaaaaatattgcatgcaatgttccttttattatttcttgaagcaccagacattgtctctagcatgataacctatatacacatatcaaatatgttaacctacaaatcacaactaacttctcttttgatgtccttttgcagaattaattctatgtgtcgcaggtttcaacagcttaagaaaatgggatgtttcttcctgttggtcagaagttccatctcttacaaatatgcatggccagtattctcttgagcagtttcatctaaacatgatcactttctttgtatatgggatatgctcatattttctgtctcaccttgctcagtttgtaccctactgctatcatgtttacagcatacttataaaagcttattagacaaaacttggaaaatgtgttctaataagaagctatcacaatagcgattttgtgaccaccatacatttaagatgttttgggttttcttcactttagattgtagcagagcgtcagcaggagtataaagagaaactccaagggatatgtgatcttcttacccaaactgaaaaccgcctaattggtcaccaagaagccttcatgattggagatggcacagttgagttaaagaaatatcagtccaagcaagaggtagaatttggttttctatcagcagatctatgttgatgttatgttcgattactatcatttggaagtcagtgaagattattgaaaataccagtaattttagctttttagaagcaaggcatacccaagacgccctgggcttgagctttaaactttatactaaaagttagatttccaacttcaagcaagctaggtaatttttttgactttttttggtaagagatattgagtggaggaaatattaaaggggatttgataatgaaaataccttgtgtgatgaattagaatttggattcatttaaggccaacctacttactacttgcaaatcagaggaaatagccatcactttgggttctttctctttcttagctccttcttactccttctttcttgtgatttgttcctttttattgaaggaaagggcaaaaataacagtaacaacagataaagatatctttattttggtgtcaggacagagaacattttcattgtaagtagatagctcctggttcagattccagactctatacattgttagctttataacagtctgtcacagcctcagtttcttcataggtcacactttgttacattattataaaagttaagtaaatattgtgtaagtcactagcacagttaaggtcacatagtcatggctcaattaataggatttctttcaattcaaatacttctaagacaaatttgaagaagattaaaataaagtatggaaaaaataatattaaaactcagtatcatatagagaatgaaaatgcatgataaaggaggaaaagaagaggaaaaactacatggaaaaatctagacataggaaagctataactactaaggagagatcttaatcttgaggtacctagcagctaggcaaagaagcaaacattacatattacagattctggtgtttagaaaaggaaagtatcttagttcactgggaaaattagttcatttttatcctgagtgataaacacattaaaaaataaaagtttagaaacaataaatattagcatatatttacaagcctttgtacatgtgctcatataatattaaaaaatctggtgtgtgcaaatttatatagatcatatactgaatacttatgtgttttcagtgtttcactgactgcattctttcgttaaacatgaaaattcatgcttttctttaatattgtttgagtttcaaattatattaagtattgtgattgaaactcaaattaacatactcaatatgtttattcaagctacatatactagactctctctgtactcactctgtcttttagaattacaactctggaagaactaaataggtaataatttaataaaatatattttttccttttgtgttataaggaattacagaaagatatgcaaggaagtgcacaggcattggctgaagtagtgaaaaacacagagaacttcttaaaagagaatggtgaaaagctgtcacaggaagataaggctttgattgaacagaaacttaatgaagctaagataaagtgtgaacagcttaatttaaaagcagaacagtctaaaaaggagctggataaagttgtgacaacagcaatcaaggaagaaactgaaaaggtccttattcaaatatgtggtgcactattgctatgtcaaaaagcttaacagctacttgatttattattaatatccagtggtagtaaataaggattatcactaaggattattatgggattctgggtttccaggtacataattgaccaagtactacaaaaggtttgaagagttggctttgcttaactttttcttaatatttaagtgaggttgtgaaactttcttcttgtgaaatgtgtgatcactcatcaattatagttaaaattttggaatgtatttttaagaacaggggaaacttcaaagtaactgcctgttgctctgaggtttaatttcagttgttaagttttcaattgtgtcagtttttagtaccctcattctaatttaaaatgttctaagtatttacttttggaatgtcttaaaactatgccttggcccacgttctgaattcctcctgtgaactttcccttcccaggtagcagcagtgaagcagctggaagagagcaaaaccaaaatagaaaaccttttggactggttgtcaaatgttgacaaagactcagaaagggcagggacaaaacacaaacaggtaatcgaacagaacgggacccattttcaagaaggtgatggcaagtcagcaattggagaagaggatgaagttaatggtaacctgttggagactgatgttgatgggcaagttggaaccactcaggagaatctgaatcagcaatatcagaaagttaaggtgtgttgttataaacatatgatatcgttcaattctatttccaggttggtaaagagagaaataacctagcacatgagttcttttcaaaccttactgacaaaagaggtttttttctgtgttcatcatgtcagatataaattattatgagagttctaagcaagtcaaaaaataatgagaaataaattgtagagttggcattctccatgtaagtgaagtagaattattataaagatttaataataatagttaacatttataggacagttaaagtgggcactcttctaagttctttccattttaactcattttgtcttcccagttactccttggggtttttattttcatcttacagatgaggaaactgtaactgacagtattaaagtagctttctcaagttacatatctagaaagggctggaatttggatttaaaactaggccatatgttcactctgctaagtctgaatctgtgttctaagagaacaatcttttttttttttttgagacaaggtctcaccctgtcgcccaggttagagtgcagtgaaacaagcatggctcactgcagcctcaaactccctggcccaattgatcctcccacctcagcctcctgagtagctgggactacaggtctgtgctgccatgcctggctaatttttgtattttttgtagtgatgaggtctctctatgttgcccaggctgctctcgaagtcctgggctcaagcattccgcccacatcctcccaaagtggtgagattacaggcatgagccactgtgtccaggctaagttgagctcacttaagttctttctgagctcagctcacctattcagttaaggctattgttgagaagagatataaaagcccttctaccaatttactccatgacataaattaaagctaacattaatgctactataagagcaaaggcgacttctgtagaactacttttaaagtgtcactcattttatttcaatatttggcttttgacagacggtttctggacctcagaaacttttgcaggtctatttattttgttcctacccttcatatttggaatctttggaatagggtactccctgtgaggttcttatagaaaatacaaattaaaccagaagaagaatgggagtatttactgctcacaattttaacgggctattataggaccttattatgaaaaataaagtctcttaaaatgaaaaatctagtgaattcctaaaggaacattgtgagtcagttacaaagaagtcaggaaaagttagtaagttgaccaaagtagtgagaaatactggtgggtagacttaaacataaagatatcacacaggaaagcccttggttttaggcacagtgtggcatttcccatctgatcattttacctcaaagaatatgggaatctgtgctttagaaaatcctaatctgggccaggcgtggtggctcatgcctgtaatcccagcactttgggaggctgaggcgggtggatcacaaggtcaggagattgagaccatcctggccaacatggtgaagccctgtctctactaaaaatacaaaaattagctgggtgtggtggtgcgtgcctgtaatcccagctacttgggagactgaggcaggagaatcgctggaacccagaaaacagaggttgcaatgagccaagattgtgccactgccctctggcctggcgacagagcgagactccatctcaaaataaataaataaataaataagtaaataaataaataaaagaaagaaagtcctaatctggcagcatggagagagggccaaagcacctgagccaggaacgtctagctttcagtagttgtcccatatgtcctgggccaagccattctcttccttcagcctaagagtcctcatctgtaggaggaaggggatggatctgatcatttatatggtgttgcatatgtctgtccatgctattttgtgcaaagcccttctcggggtggggtgggggtagcatatgaatgtatttcaaataccaaaaacacaagtctgtgggaaagaagttagttaaaaatatttactatgtgcccactaggtggcgggcactgttatagacagtgaggataccagtgttaatgagccagttctgagctgactaattgggatcagacttacaagtgaacggctgccccatagcagtgcttctaaggaagtccttttcacagcatagagttattcttactcagctcctgtgtgccagcactgttctaagtacttgggattacacagtgagcaaaataaattccctgtgccccccttgcacactagttagtgagaatgttacagtagacaataactaagttatatggtaggttagaaggcagtgagtactaagggagaaaaggagttaggtaagggtggttgagtgtggggtgggggaccagttttcagcatttaaacgggactcaatggagatgggtgcaattagccaagcagatatctgatgaaagagctgtaactagacaacaacaggagaaaaagctcctaaagtgtttaccagggtggggatggaggtaagggtgggagcagcaaagaatctggaggtaataaaaggggctctggggtaatgggagcgggtcatttggctccatgtaagccattataagaaatgtgggaaattgcccagaaggattagtatcctttttgccacacttgtatggcaaattggggtgaatggaagaagatgcttatggctggagggaaagggacttcacctacctgatgcctccctgcttccctgaagactgaggggatcagtagctctgcacacctgtgacttgcctgcagcacacctgcctgggagccctgccttcctgccttcagagtggatttgaatttctggcacatgcccagctctgcaggaagtgctctacatatgtgatctcatgtactccttaacagcaacctgtgatgtgtaggagttattgtctccattttcacatgcaggaaactgaggcccagtgaagctgagtagctccaggattctcttttattatatctgcttctctaatgtccattgggcttctctgaatgtacagtgttcttgcttagttatttttgaaacctttttaaagcttaaagttacagattctttttccctatttaaaagtttttccaggatcatttcgtaataaaaaatattatacttgtttgtccaaaaattaggtaaagacattcttttttgggtagttgtgagaaagcagggaataaaatgagatcagattatagacacttattttaaaattggaatagaaattggtttttctaaacttctgaaaaatggtgtctgtcctatctgattaagtacatagagaagattggaaattttctttaaaataagattagcatgctcaaaatgccttgttattctgaaatccaccaataaaagggagtacggtatagcttgaaaaggggaatgagaagcaagttgtagccctgtagatcattgaaacctgtcagtcttgaggcggcaaggagctccctgcaggtgttaccccgttactgcttgaagattatgatcaatttgttttcacataggcccaacacgagaagatcatctctcagcaccaagcagtgatcatagccactcagtctgcacaagtgttgcttgagaaacagggtcagtatctctctcctgaagaaaaagagaaactgcaaaagaacatgaaggaactgaaagtgcattatgaaactgcactggctgagtcagagaagaaaatgaagttaactcactctctgcaggaagaattagaaaagtttgatgctgactataccgagtttgagcactggctacagcagtcagaacaagaacttgaaaacctggaggcaggtgcagatgacatcaatggtttaatgaccaaattgaagaggcagaagagtttctcagaagacgttatttctcacaaaggtgacttgagatacatcacaatttctggaaacagagtgttggaagctgccaaatcttgcagcaagagagacggtggcaaggttgatacttctgcaacccacagagaagtgcagcgcaagttggatcatgctactgatcggttcaggtctctctactctaaggtaatgttattttgattttttaagggaaaagtcaatctgcaattatagttttcaattatagttttggaacaagaggcaagaaacctaaaatccaaaacaggaggaaaaggtagctttagcctacttctatttttttttttttttttgagaaggagtctcactctgtcgcccaggctggagtgcagtggcgtgatctcggctcactgcaacctctgcctcccaggttcaagcaattctcctgcctcagcctcccgactagctgggactacaggcatgtacccccacgcccgtctaattttttttctgtttttagtagagatggggtttcactgtattagccaggatggtctcgatctcctgacctcgtgatccgctcacctcggcttcccaaagtgctgggattgcaggcatgagccacagtgcccagccttctctctatcttattcacctgctttacttctgaacaatgtatttaaatatgagaaacttaaagttactttagtttttgagagcatgatttccagaagtcccagctctcaaatgctctaatatccagtgtgaccacaagatggcggttgtgcattgactctaagcaaaaacagatgcttgcagcctctcaagcttgggaactggtttcatctcagattatcctcttcacaaacactgcaggtgtttgtcttgtatatttgatcagtatgttattttaatacttaatgaataaaagactgttttgcttgttttacttctgtggtcaagtaaaaggttttttttgaaaaaaaaaaatctaagaaaatatttactggtttgtaatataatctgaacagacttgccaagttgcataaatgatttaaagaccatcactggctcttggactttgctccattctaatatagactctttgtcttccttttgttaattaacttgtgcaacatatagaaatttattaagcacctttaaaacccttccatcaaatcgatatctatacacatggtgtatcaaaatctccttcctctgatgattgatgtctttatcttttattctatgttaagactcagctcttgtaaatatgtttttgaattggtataaatccagaactatctctttattttatggttactttttggcttcttatagggtacctcttcatataaaggaggaaatcttagcccaacagagtttttattaactttggtggaagtctggttttttttccaagttacatattttataggtcctaagattatttgatgcatatgaaaatagtgggttttaatctcctaccccttttctcttttgattgttagtgcaatgttcttggaaataatcttaaagatctggtggataaatatcaacactatgaagatgcttcatgtggacttcttgctggactccaggcctgtgaggccacagcgagcaaacacttatctgaacctattgcggtggaccccaaaaatcttcaaaggcaattagaagagaccaaggtaaaaagcgagagaaagatccacatttccagtagtcttactgaaaggcttccaatttctcacacttttgtgatagtttcagctaagagaggggaacaaatgatgtgaaaagtatacttctgcctccagaggtagttttgactctatttctccacagtacattctttttttttccgaattttttttttttttttttttttgagatggagtctcactccatcgtgtaggctggagtgcagtagtgtgatctcagctcacggcaactgccgcctcctgggttcaagtgattctcctgcctcagcctcccaagtagctgggactacaggcgcccgccaccagctgggactacaggcgctaatttttgtatttttagtagagacggggtttcgccatgttggctgggctggtcttgaactcctgacctcaggtaatccacctgcctcagcctcccaaagtgctgggattacaggtgtgaaccaccgcgcccagccttcctgatgttttcttaacaggtttgacattgctgttatggcttgtgacgtgcccctccatccccaaacaaaactcagtattttcctggccacttatttatctttatacttacttatcttgttcactgttttttcctccattagaattaagctccacaagaacacgtgtctttgtctgctttattcattgctgtattcacagcacctagaatattacctggcccaaagttggtactcaataaatatttgttaaggaatggacagttggaagggaagaagggatgctaccatcatattcagcggttctaaggaccaggattagggttcttactgaatatcttcatgattcatagagatacaaacttgaataattactcaatacagttctcaaaaagtccacctgctctttcagaaatacaggcttggtgtcaaaactgcataacagtgcgattctcagtcatacagtggtggagagttcttaaatctatttttataatgtaaaacttattttaaaattctaaagtaaaggatgagaactaatgtgaccaataattttgagtttaaaagtttcattccatcaatctattatatgattccatttcacaggttaataatagtaggttattactgctacagctagaaaataaacacaggattgccagttagacagctgtctttcagaagttaattgcatattatttacagagtcgaaaaattgtgctgttagcacgggaaacaggtaccctgctgggcaagcttaaagttaggtattgcctgagattgacaactctggaaagctaagtcatacccgggtgaaatgtggcaggttaatatcaggcagagagaaggcccgtgaaggggtgggaagcataggatgagagcagggaaggaggtcaagctgggaggtcaagagggtggagggcactgcttctttcccaggctgaagagtttatccagcccttcactggacactagggagatgatgtgggccaggtcagcatccccagatccatgcagcctcctcagggttgcttccttttttccaatgtgcattttcagtcctgtttttttttctttctcctttccacaggtacaagaacaaatctatcttaattaagtttttatatccccatgtattgtatattcaaggacaagatatgtggtgggggtagaggagatactgtgacattaaggtcattattttagtaggaaatacgtatcatttaaaataattattgattgcatatattacatttaattaggaagttattttaagtatagaaaatgcataaaatagaaataacacattttaagttagatctatattagtaaacagattatactgcatataaaagtaatttttatataactagagcagaaaaagaataaaacccaaagaatgtgatggttttttaattaaacagatatgtggataaattttaaaacggaaaaacctatttagtaattgctgcagaagactcttacagtcctaagacagttaaagaaatatgaaaaagaaagagatctcaaaggagaatgaattctaattaagtcatagcgtaatttgaaaaattaaatgtacaattaaagttgttgctgataatgcacatatttttctctcagaagatttcagaatgtatcaaggataaatttttatgaggattaggtggcctccatttctttgatgtttattaacattttacaattacttttaacaataatataaacccatgagactactacaaaaaatcgatctttctacatgtagcatactatcttctacttatattctgatgaatcataaatgtaatttttggggcatccaatttgttcatttcatttgaaatgcttttggccaatagcatgttgttattagcattattattcaaagaactgtgaactgtgttgtcaacaatctgatactactaggccataataacactcctcaagatccccttccagggaaattagtggataaaacaagattttagccccataagaggtgcagaaaacaggattttgggaccagtctcaaggcctgggtgtggaaccagcaatggggattgcattgactgacaatgtcagccttccagacttgcgctaatctttggggtggtgttaagtcaggaaacttttatgaattgtacaaatgcccagaagtgtatagacttcgctgtcttctggtcccaacaggtattctcttgtcacagatccttctttcatgtcttaatttccttgaaatccattcaaaacaatataaggtacccatttgaatactgtaattaacagttttttttccaaaatagcactataaacaactattattgttaaattaggaccttgatacttgctaggaattaaaaatgattaactctcctgaatataattgtcaagagtaaaggcatgtgatgttttgagaagaagaggtgaagaagacatgcttcttttataatgcacttctaagttttaagctggtagtcagggccatctttggtattggatattctaatagaaccatgatcacttttagatgtatttattcattcagtaaatgtttgtatgctgagtttcatgaaggcacaaagatgttaaaaccctgtctctgcccttggtgaactcacaatctaaaaaaaattttcggagggtacccttcacttacttcatctcctaaataaccatgttatatgaataaactgtccctgtggtctagattcagtgtggtcacaggtaaaaagttcatgtcttgagggatttttttttacacttcccgtaattaaactgctaggagaatttttcaaacagatccactctgatgaggattctttggcatcttgaaacaactgtaggttgtggtattctagatcctatgttggtcgtggtttggtgggccttttgacatatgcacagactgcctgtatgtcatctcagtttcttggatatgaagattagttgaggaaatttttgccattagctttaggcatttaagtaatgataataaataatgctgaaatagaagaaaacctttttaggtcttacatctgatatgttcatttatttacttagttgctgatttattcctgaaaaaaatttttggagcctgctatgtgtcaagcactgatctaggcactagtaatagaaagccaaaagggatgacttcctagttctcaagaaggctatagtttgatagaagacacagaaaaatccaataatagtcacagggtatttatgggatttcctgtaaggagtacttactaaagctaggagtgaggagagacttagggaaggttttccagctgagtattaaaaggtgaagaagagccaagttcaggatggcgggggtaggttgcatgaaaaagttggtatgtagagtttctaagacattgggtccagcatgaataaatagctaagaaatagctgtgttagacatttctggaacagaaagttgagattgaaggtagaattagggaatagatttcattggaccttttagactatagcatgctcaagtcttggcctttttgtcaagggagactactaagagattttaacagggttatttggctgttcttgtgttgctataaagaaatacttgattggagcatttagtccatttacatttaaagttaatattgttatgtgtgaatttgatcctgtcattatgatgttagctggttattttgctcgttagttgatgcagttgcttcctagtctcgatggtctttacattttggcgtgattttgcagtggctggtaccggttgttcctttccatgtttagtgcttccttcaggcgctcttttagggcaggcgtggtggtgacaaaatctctcagcattggcttgtctgtaaagtattttatttctccttcacttatgaagcttagtttggctggatatgaaattctgggttgaaaattcttttctttaagaatgttgaatattggcccccactctcttctggcttgtagagtttctgccgagagatctgctgttagtctgatgggcttccctttgtgggtaactcgacctttctctctggctgccctttacattttttccttcatttcaactttggtgaatctgacaattatgtgtcttggagttgctcctctcgaggagtatctttgtggcattctctgtatttcctgaatctgaatgttggcctgccttgctagattggggaagttctcctggataatatcctgcagagtgttttccaacttggttccattctccccatcactttcaggtacactgatcagatgcagatttggtcttttcacatagtcccatatttcttggaggctttgttcgtttctttttattcttttttctctgaacttcccttcttgcttcatttcattcgtttcatcttccatcgctgataccctttcttccagttgatcgcatcggctcctgaggcttctgcattcttcacgtagttctcgagccttggctttcagctccatcagctcctttaagcacttctctgtattggttattctagttatacattcgtctaaatttttttcaaagttttcaacttctttgcctttggtttgaatttcctcctgtagctcggagtagtttgatcgtctgaagccttcttctctcaactcgtcaaagtcattctccgtccagctttgttccgttgctggtgaggaactgtgttcctttggaggaggagaggcactccactttttagagtttccagtttttctgctctgttttttccccatctttgtggttttatctacttttggtctttgatgatggtgatgtacagatgggtttttggtgtggatgtcctttctgtttgttagttttccttgtaacggacaggactctcagctgcaggtctgttggagtttgctagaggtccactccagaccctgtttgcctgggtatcagcagcggtgtctgcagaagagcggattttcgtgaaccgcgaatgctgctgtctgatcattcctctggaagttttgtctcagaggagtacctggccgtgtgaggtgtcagtctgcccctactggggggtgcctcccagttaggctgctcgggggtcaggggtcagggacccacttgaggaggcaatctgcccgttctctaaatgctccaattaaaagacacagactggcaaattggatcaagagtcaagacccatcagtgtgctgtattcaggaaacccatctcacatgcagagacacacataggctcaaaataaaaggatggaggaagatctaccaagcaaatggaaaacaaaaaaaggcaggggttgcaatcctagtctctgataaaacagactttaaaccaacaaagatcaaaagagacaaagaaggccattacataatggtaaagggatcaattcaaccagaagagctaactatcctaaatatatatgcacccaatacaggagcacccagattcataaagcaagtcctgagtgacctacaaagagacttagactcccacacaataataatgggagactttaacaccccactgtcaacattagacagatcaacgagacagaaagttaacaaggatacccaggaattgaactcagctctacaccaagcagacctaatagacatctgcagaactctccaccccaaatcaacagaatatacattttttttcagcaccacaccacacctattccaaaactgaccacatagttggaagtaaagctctcctcagcaaatgtaaaagaacagaaattataacaaactgtctctcagaccacagtgcaatcaaactagagctcaggattaagaaactcactcaaaacctctcaactgcatggaaactgaacaacctgctcctgaatgactactgggtacctaacgaaatgaaggcagaaataaagatgttctttgaaaccaacgagaacaaagacacaacataccagaatctctgggacacattcaaagcagtgtgtagagggaaatttatagcactaaatgcccacaagagaaaggaggaaagatccaaaattgacaccctaacatcacaattaaaagaactagaaaagcaagagcaaacacattcaaaagctagcagaaggcaagaaataacgaaagtcagagcagaactgaaggaaatagagacacaaagaacccttcaaaagatcaatgaatccaggagctggttttttgaaaggatcaacaaaattgatagactgctagcaagactaataaagaaaaaaagagagaagaatcaaatagacgcaataaaaaatgataaaggggatatcaccaccaatcccacagaaatacaaactaccatcagagaatactacaaacacctctacgcaaatacactagaaaatctagaagaaatggataaattcctcgacacatacactctcccaagactaaaccaggaagaagttgaatctctgaatagaccaataacaggctctgaaattgtggcaataatcaatagcttaccaacgaaaaagagtccaggaccagatggattcacagccaaattctaccagaggtacaaggaggaactggtaccattccttctgaaactagtccaatcaatagaaaaagagggaatcctccctaactcattttatgaggccagcatcatcctgatcccaaagccgggcagagacacaaccaaaaaagagaattttagaccaatatccttgatgaacattgatgcaaaaatcctcaataaaatactggcaaaccgaatccagcagcacatcaaaaagcttatccaccatgatcaagtgggcttcatccctgggatgcaaggctggttcaatatacacaaatcaataaatgtaatgcagcatataaacagaaccaaagacaaaaaccacatgattatctcaatagatgcagaaaaggcctttgacaaaattcaacaacccttcatgctaaaaactgtcaataaattaggtattgatgggacgtatctcaaaataataagagctatctatgacagacccacagccaatatcatactgaatgggcaaaaacgggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcaggcaacatgattgtatatctagaaaaccccatggcctcagccccaaatctccttaagctgataggcaacttcagcaaagtctcaggatacaaaatcaatgtacaaaaatcacaagcattcctatacacccataacagacaaacagagagccaaatcatgagtgaactcccattcacagttgcttccaagagaataaaatacttaggaatccaacttacaagggacgtgaaggacctcttcaaggagaaatacaaaccactgctcaatgaaataaaagaggatacaaacaaatggaagaacattccatgctcatgggtaagaagaatcaatatcgtgaaaatggccatactgcccaagataatttatagattcagtgccatccccatcaagctaccaatgactttcttcacagaattggaaaaaactactttaaagttcatatggaaccaaaaaagagcccgcatcgccaagtcaatcctaagccaaaagaacaaagctggaggcatcaagctacctgacttcaaactatactacaaggctacagtaaccaaaacagcatggtactggtaccaaaacagagatatagatcaatggaacagaacagagccctcagaaataacaccgcgtatctacaactatccgatctttgataaacctgacaaaagcaatggggaaaggattccctatttaataaatggtgctgggaaaaccagctagccatatgtagaaagctgaaactggatcccttccttacaccttatacaaaaattaattcaagatggattaaatacttaaatgttagacctaaaaccataaaaaccctagaagaaaacctaggcattaccattcaggacataggcatgggcaaggacttcatgtctaaagcaccaaaagcaatggcaacaaaagccaaaattgacaaatgggatctaattaaactaaagagcttctgcacagcaaaagaaactaccatcagagtgaacaggcaacctacaaaatgggagaaaattttcgtaacctactcatctgacaaggggctaatatccagaatctacaatgaactccaacaaatttacgggaaaaaaacaaacaaccccatcaaaaagtgggcaaaggatatgaacagacacttctcaaaagaagacatttatgcagccaaaagacacatgaaaaaacgctcatcatcactggccatcagagaaatgcaaatcaaaaccacaatgagataccatctcacaccagtgagaatggcgatcattaaaaagtcaggaaacaacaggtgctggagaggctgtggagaaataggaacacttttacactgttggtgggactgtaaactagttcaaccattgtggaagtcagtgtggcaattcctcagggatctagaactagaaatactatttgacccagccatcccattactgggtatatacccaaaggtctgtaaatcatgctgctataaagacacatgcacccatatgtttattgcagcactattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaatcatcattctcagtaaactatcacaaggccaaaaaaccaaacaccgcatgttctcactcataggtgggaattgaacaatgagaacacatggacacaggacggggatcatcacactctggggcctgttgtggggtgggggtaggggggagagatagcattaggagatatacctaatgctaaatgacgagttaatgggtgcagcacaccagcatggcacatgtatacatatgtaactaacctgcacattgtgcacacgtaccctaaaactttaataaaaaaaaaaaagaaaagaaatacttgagactgggtaatttataaagaaaagaagtttagttggctcacgattctacagggtctacaagcatggcactgacatcactcagcttctggggaagcctcagggaacttttactcatggtgcaaggcaaagcaggagcaggcatgtgacatggcaaaagcagaagcaagtgagagagagagagagggagagaggtggggaggtggggaagtgctacatacttttaaatgaccagatcttgctagaattcactcactgtcgaggacagcaccaagatgatgatggtaaaccattcatgagaaatcatctcccaccaggttctcccttgaacattgaggattgcatttcaatgtgagatttgggcggggacaaatatccaaactatatcaggggtgatatgtggtcagatgtatattttaggtagaacacattaggagctatattagagaagtgattggaggcaggatctaacacagttaggattcttttttcaacaatccaagagagagattatcctggaatgatccagaaatatggagcaaaagttgacttttaaaaaatattaagcaggtaaaattgttgattgatttgcacgtgtggaaaaaaaaagctttaaatggttgatttgcatgtggaaaataagccttaggatggaatctaggaggaacttcaggttgactatttgggtagttagatataccccaggagaaagtataggtacagagaatgagatgatgagttcagattcagcttttttgagttggaggtgactgcatacatccagatggaaatactcaagaggcagttggaaagctaggcccatggccaaggatgagttcacatctacaactggacattgggggctttgaaatccaaatgcaggagtagaagaggagcatgagttgcttaagataaattaaagctgggaataggcctgtgtggccaggcagcccacttttgcagaaatctgtaagagctgttagaaatgcagggtcaaacttctggaagacgtatctatggctcctgcttccacctttttttcctccttcccattgttgagccacatctgttcactcagagatacgcggggactgctactcattaaattcaaggactcattagtctttcagtttacattatcctttccgaagcagttgacactgttaaccttttccacttctctcttcctttaatctttggggacagagttattctgggcccatttccaccccatcaattacatgtgttcttttttttcttctctccccatcacttatatataaatattctccatgattctttagaatctccttctctggcattcctgtgctttcttgtttaggagtcacattgtgtatcttgacttccaattctctatgtctgtttccagtttgggttccaactctcttccatttccagtttttgctgtttccttctggaggagggtcccaaaagcactttgaaatcatgaattccaaaacaggcattcctttactcttagcttgctctcactttttttttttttttttttttttttaataaatgccactaattggctgggagccttggctcattcctgtaatcccagcactttggacggccgaggtgggaggattgcttgagcccaggagtttgagaccagcctgtgcaatgtggcaaaaccctggctctacaaaaaatacaaaaaaattagctgggcatggtggcatgcacctgtggttctagctaattgggaggctcaggtgggaggatcacctgagcttgtgaggtcaaggcttcagtgagccaagactgtaccagtgcactccagcctgggcaacagagtgagacgctgcccccccaaccaaaaaaaaaaaaaaaaaagaaaaagtaaattccgctaattacctaggctcaaaatctttggacacttctactcttgtctcctcttgtcctttgttcctgccctctccagcagtgctgtctactagaacattctgtaattatgaaatttatttttttaaatttttatttatttatttatttatttattttaagaaagtaggaatatcactctgtcacccaggctggaattaacagtagcatgatcatagcccactgcagcctcaaattcctgggctcatgcggtcttcctgactcagctcctgagtaattgagactacaggcacagactaccgtgcccggctaattttttaatttttttttgtaaagacaaggtctcactttattacccaggctggtcttgaactcctggcctcaagtgatcctcccaagttggcctcccaaaaagcgttgggattacaagtgagccaccgcaccagctggaaatactttacttatattttgctctgttcaattggtagccactagccacagtgactacttagcacttgaaatgtggctactgtaaccaaggaatggaatttttaattgtttaaaatttcaattaatttaaattttaaaagctacctgtagttggtagctaccatagtggcagcacagctttgcatagtgttaccaagtcctttggactcttcccaactctaactaattccaccttctcagtccaaacagaccgaacggtggaattgtcttcagcccttggccttcagtagtcctcactgctttgttactgctgaagttgtccccagctggtatctctcctttatttcgtttccattggacttttcccatgcagtgctacaaatttagccttcctataggacagccctgagcatctcaaccccttacccaaaagccctgcataactccccattgctatgggataaaatgtaaactccttagcctgatgtttgaagcctttccaggcctatttctatttactcacccataagcattgtcaaactggatgggactctccccttctcctgtgattcttctgtcctcatctttgtgtcttctgtttgttctgcagggagtggttctcccaaatccacactttcttaaggagccatctcagtgtcattaccattgaggtggccctcatttccctcccatttttttcctgttaacttccagcagcattttttcagactcacctgtggcacttaccacttcctgcctcgaaccataaaatccctgaaagtaagctttgtgtctgtttttatttttgtatattcacaaaatgtagcaaggctttttgaatttgttagatgttcagtaacttttattgaattaacagaaataaacatgactcagtattgagtcaggatctactgatttgggcgagcttatttatctcctttcctggagtcagaagtggtctcaaattttggttgttgtttgttttagtagtagttggggtattgtacaaagcctagaagtaggggttaagggtataaagttagagggttgtatgatcaggaaccagggaaattattatgaacatatgctcaaaggtttatttcaaaacttaatttgtgttatccagactggctgatgcttttgctaatgctgctttataactggccttattcgaagaactctggagtaagttgatgatgaaagttggtatgatgaaaagtttattctgtccaattttactttatcttattagaaatcattttttccacattagaaatctattatttagtcctgctgagtataattgaaaagcgtttaatcctacaggctttgcaaggacagatatcaagtcagcaggttgctgtagagaaactgaagaaaacggctgaagtgcttttagatgccaggggatctttacttccagccaagaatgatatccagaaaacacttggtaagatattcatgtccttgcttcctgtctcacaggtaaattctaaagaaaggtgtcctaatagatatggagaaaaatgttcactagttatagattgtgttctatgtgctctttctctgtgaaatggtgttcctgcatctgggaaaaggcatgccttctttggcaggtatattagaatcttagaggcgggggctatgtgtcttgaaaagagtatatttaaatttaaatttgatatttagaaaacataacaggaactcgctatgtaatgtccaccacaggaagtagaacttcacaaaattctcttggttgatgggattgggcagagttaggccttcaacttaaggccaaagtagaatctctgagggtctttatcaatagtgggaacgtgggtttaagaggttgagaaatgtgcttaattgaattgaattgaatttatttttagagacaggggttactttattgcccaggctgagtgcagtggcacaatcatgtctcactgcagccttgacttcctgggctcaagcagtcttcctcatctcagcctcctgagaagtaaggactacaggaatgctctgtcatgtgcagctaattttttaaattttttttgtagagatggggtctcactgtattgtccaggctagtctcaaactcttgggcttaaatgatcctccccaaatgttttgtgcacaaaagtagcactacagctgtaatcaagtttctagtatcactaaagaattggtgtaactgagctctcaatttgagtgaggccactaaaaaacttctagaacacagagaagtgggaagacttctcaaagcacatctctcaggccgggtgcaaaagctgacacctgtaatcccaacatttggggaggatcatttaagcccaagagtttgtgattaatgtgtttcttgagaaaagagctattgtatattatctttctatctaaccacagtatttagtttataccaaatgtgcagtggattatcaatacatattttttactatcttacatatgtattttttgttttcactgccctgcttttcacaatatttaatgttattgtgtatttctgtgtgtgaatatgtgaagtaaaaatattccacaacagatgattagacatatgttttaccctaaatagagcatgaattaaaatctgagtcaaaattttatttgaagagaagaatggaacttagctcttttaagatcactgtgtaaaagggaaatcctgtctttcattcttacatgtatccagatgttttttattatgtacccctgtcaaaaatgatcttcagcctgcatccccatatatgcagatgtatgtataagtcatgtgaacatattactgtattattctatgtgttataattataaaacacaaaaatatagagttttaaagtataaaatgaaaatatgaatggaagttctaacattttgttcctctgtcccaatgcagcatctcatatatccacattagataccattgctgtgaggacttgggtataaggatatgaaggagaaagaaagactatcttatttgtatttatgttactcgaagaggcattttgacatttttttcttattgttaagtgtacatagtttcacttttagttgcttaaaattcatttgttacattattttaaaactaaaacttctggcataattttctaggaaatatgtgaaactatttaaggtatagaggagtttctctaagatctttctgacttctaagaaaaccaatgatttaaaaaaataacattcttacagtagatttttgtacctttttctaaaatattttttagtttactaaaatgaagaatttacttcagtgacaatattttatcactaagaagtgcaaactaaacagtgtcttcgtttagcccactatgacaaaaatagcatcggctgggtagcttaaacaacatacatttatttccaatagttctggaggctggaaatcagagaacaggctgccagtatggtcgggttctggtgagggcccttttcctggcttacagatggccactatcttgctggtagagagtggtggagagacatcatttctctcctgtttcttcttctaagggcgctaatcccattcacacgggctctaccctcatgacctaattacctcctcagagagagaggaaacctgattctttttgctactcactctcatacaccattgaacatgacacagaacacttctgtgaccagatgtgtgtgtatttctccccatacaccaaacaattctccaacagataccagctggatgtcctataattcaattcagttcaattcaattctgacactgtctacctggaattagcttcagaccccacaggttaaggggtcagtctcataatgctgccccccacttcagataccaatcacaagtcccaaattgtgatccgtatttcagactgatcagctataaattaggattcccatgacccttctcacgttcaattaattgctagagtgactcacagaactcagagaaagactttacttacatttacccacttactataaagaatattacaaaggatacagatgaacagccagatggaagagatacacagggtgaggtatgggagaaggggagcagaatttctgtgccctctatgggcatgccatgctcaggactccatgtgttcagctattcagaagctccccagacgaatcctattgggtttttatggcagcttcattacataagcatgattgattacatcattggccattggtagcagctcaatcttcagcccctcttccctcctcagaggttgacagggtgacagttccaactgtctaatcacatggttgattccctggcaacatctgccactgtcccctgctccccctaccctaagactatccaggaggccaccaggcgtcacctcattcaaacaaaagatgcccctcatgaaggaattccaagggacttaggagctctgccatacactcctgtcacttaggaaatcacaaaggtcttaggagctctatgtcaggaactgaggtcaacgaccaaatatcagaacaaaagattctcttagtgtctgtattactgaggaaatcagaagggttttaggaactctatgtcaagagctatggccagagaccaaatatttcttattatatgataatatcacatcttccaaaggccccagcacccaacactatcacattgggactttggccccaatatatgaattttgggggacacatttagtctatagcaaactaacactcaaatctgttaattatatgaaaatagctggctttccttcgaaagtcacttattatggctgaacaggtcactcattttacttaccctgttgatgcagttgcccaattaagaagtcgctaacctgccaacttcaagctgccattcagagcatgtgctcttgtgagtttccaaattagagctcattttttttcttcaacttttattttagaatcagagggtacatatgcaggtttgttagaaaggtatattgtatgatgctgaggtttggcatatgatcgaacccatcacccaagtaatgagcatagtctccaacaggtagtttttcagcccttaccttcccacccctctcccccaactagtagtttccagcatctattgttgagagcttatttttgaacccactgcttgtttcctctgccgatggcattttcgtgcatattaaatgctgtctccctccccactcagtatgctgatgggcttcattgagttttagtaagaggagcatgattttctctttaaatcatccaaacttaacctctcactccagtgaaaattttcaagatgttttctcatgttgtagcattagaacaattatattattttgttgtatagattatgtttcatgggccaaatacaagtcagtaagatgttagagatgtttcaggacacagcttgtccctactgaagcgttctacaatgtataagactaaagcattcagaaataattaaaatatttttcaaattctcggacaataagtgataaataaatttaaaacatcattttccagagagaaagagatgaatacattaaaaaccattgttcaaacttttcattggtctacaatatagaatgtaggatgttaacatgtagggctttagtcaagtgaaaactggacgagaaagggtttttttttttagcatcttgaatctttagaattgaagataaagtttatcctcatatgagataggttagcctgtttatttttctcttttgtctgctgttaaacttttaaataaattcaattagtgtatattttagaagcataatcttaactttaaatggattttcattgttgcctgttttcttaattacttgcatctgccagtttctgtgcatttgagtgatttgcttaagttgtgaagtatgacaaaagcttagcatgcgtgtgtatgaaggagggagatagggtgataatttttatatgtaaaagttaattcttcagaaatctttgtaactgtgtattgtcttgagaatggctgtgtgtgactcacctttttttcctccgaaagtaattttcaataagtatggctaatgtgaaatgtcagattgagaaccagtatttatttcaaagatttgctgttcggactactcttttgtctctctgtgacaattcaaatgtttatgcatccaaaaaaatctcttttcaaatgcagatgggatatatattaacttttaaaaaaagatttcaattttcagtatccattgggctcttttctttctttatattttaacattttaggtggtgttctgattatgcattaggaatttatcattgaactttttattttttaaattttttgtgtggaaattgtatgattcaccttcatgtgtttttgaaaagggatagggcaaagagaactttgtggttaatattcctgatctgtttggagtagatgacattgttgggagatatgaggatctgtccaagtctgttaatgaacgaaatgaaaaactccagataaccttgacccgttcactgagtgtgcaggatggcttggatgaaatgctggactggatgggaaatgtggaaagttctctgaaagaacaaggtcaagtgcctttaaactctactgctcttcaggatattatcagtaaaaacattgtaagtgactttaaaaaaaagtcccattttcagttttttaaaaaaacagttttataagctcaaagtgtagttagatttaagataaacttaaggacacaaaaaagagacatttactgaatatgagtgtggaaagtaatgcttgcacaaaatcaagtgtgtaaaatggtttatctgtgaagaagtgtaggaaggactttgtgtactttttcttgaatattattcattatagagggcttatgcatacattgagtcttatcttgtttatcattgtttcagccagctgcacatgaggttaatcagatcagtcttgtctagtcttttaagaattaggaccatggctaatccccaggctccattagattctaggggttgctgagtagcagcagcctcctgcctctttcgaccaactagccagctgttcttcactctctcagagagatttaagatggcattcctcaagggacagaccaaacttgtcattcagtttcaactgttaaccttcctaggcacaggttgtgcaagcttatgttgttaggaatagtcatttaaaaaaattctgtcacattatttataagcatcataataaaagatatgcaatatttggtttattttagatgttggaacaggatattgcaggtcgtcagagcagtataaatgccatgaatgaaaaagtgaagaaatttatggaaacaacagatccatccactgcatcctcactgcaagccaaaatgaaagacttgtctgctcggttttcagaagcaagtcataaacacaaagaaactcttgccaaaatggaggagctaaaaaccaaagtagaactgtttgagaacctctcagaaaagctccagacatttttagaaacaaaaactcaggctcttactgaagtagatgtgccaggaaaagatgttactgaattgtctcagtatatgcaggtatgcctcccttactactcaggaggctaatcagatagattaatagttagggcaaactcatatacttagtgccagaattataattggcaatcattttaattgcttatagattagtaaagatctatgttttactcctttaagaatttcaaaccttatcttttccttgaagcctttgctgattgattggaaataaatatcatttatcacatgtatcataggtagtataagtatcatcttacgtaccagaagccacaaagagacaaaatatagaatgcattttaaattaaataaggtttactgtgttccctttcaaatagcctatatgcatgtttattatatttagaatactggccataggcagactcattcttatgtgaaattatgaatagagccattctgatcccgcacagacctctggatggaatgccatttgaagatctagcaacatttatattgactgaatatcttaatgctttgtaggaatcaacttctgaatttttagaacacaagaaacatcttgaagttttgcatagtctcttgaaggagatatccagccatggcttaccaagtgataaggctttggtccttgaaaaaacaaataatttgtcaaagaaattcaaggaaatggaggataccatcaaagaaaagtaagtaccactttaaaaattatattttattctatttatattaattagagtgagatacttgtatttacttatatagataactgaaacaattttgaaaacttgagaataagcatagggctactttatagatgtttttatattttgatcattttttgctattaaagttaactgcattatttggtttaacatttagaaggaaaattcaatacttcttacataaaagtggaaaatgttgcataagaaaaacgatggcggtggtatattactgaaaatgatctaaacttgctgtagtctctgaagcctagggcaaatatcacatttttatttgcaaaggcagaaataaccttgaacaacagctcgtggttctttgctttctgagctcaactcagaaacgatgtgcaatttcaatatggcctttttaatataatagtttactttttaaagagcagtagatgagatatgaacctgtgaaaaaacactattagaaacaagtgaatgaacctaagttgagctaaaaagctgtacagggccttgtgattgagcttttgtgtttctgatctcacgttagtttagaatatacatcggattttgctaaagtttatgtagaaaagcctcagaacatagaaaagtcatttctcttccaactactgttctttatttcttcagaattctctacctaaaatgtttgagtgctgcctttacttctcacagagctatatgttccatcctgtcatatggtatttaattcacattgcgtagaagaaatgttcttggttttcttaggtgatctctaggttgtttcttctttcaaatgggtccaactttaaaataatgtagttatcagtattagtccagctgcagtgcattcttatctgccagtattctgcacgcttgcatatatgtacgtgtcatccacatgccagatgtaactgtcctcacagttgttcatgtgctgggcatgtgcactgcctccgtggtgcagagcatacagaacgacccatacagttcaccagggagtttcctgagtctctgtaggggaggcacacatgaaaattctctagtcactaggtttcaactcattttgggagacttgaatctggactacctgcagcagtttatccatccataaacgtgactgtagtatagtgtagaaaccagtaggtggcattatgttttcctcatgtcagtgattgtcaacctttcccttctggttctgtgcctgccggcattcagcatcacataaaggggacagatcaaagctcattgaatgtaaataatgttcaaactgtttgtgtattcttagagtttatgtagcattatagagagtgccattacatatgggctacagatttcttgaatactcctatctttatcaatgaaccttgcctgaaaaatagaccaacagttatttagctcaggggtcccctaacccctgaggtatctactggtctatggcctattatgaactgggctgcacagtaggaggtgagtggtggcagcaaagcttcatctgtatttacagctgctctccatctctcacattgctgcctgagctctgcctcctgtcagatcgtcagaggcattagattctcataggaccaggaaccctattgtgaactgcatgcaagggatctagggtgcatgctccttatgagaatctaatgcctgatgatctgccaccatctcccatcacccccagatgggactgcctagtttcaggaaaacaagctcaggctcccattgattctacattatggcgagttgcataattattttaatatatattacaatgtaaatataatagaaataaagcacacaataaatgtaatgcatttaatcatcccaaaaccatcccccctccctggcctgtggaaaaaattatcttctacgaaactggtccctggtacctgaaaggctggggactactgatttagctgatttcagttgtcacctatgaaacctttcctcctgtatcaaagggttagagtacatggaagatggtttcttaacattgtgtgacatgagaataataatttatttattcttctttctgtgacttaaattcttgtatgatttttgttatgtagaaaagaagctgtaacttcttgtcaagaacagttggatgctttccaagttcttgttaaatcattgaagtcatggataaaagaaacaacaaaaaaagttcccattgtacagccttcttttggtgcagaggatttaggaaaatctttggaagacactaaggtgaatcattgttatctaatactaaatttccatttgtgtcaataatgaaagattaaaagactaatggtagttttctttgatctaatatcatctaagttttatcctcatatatgtactgtatattttgttgacctttggaaatcatggcatggggcttaactaattcttttggaaaaggacataaattttcagtggatttgcttttttaaaaaaaggtgaattaatgagttgctgactattctagtaatcaagtttcctttcctaccaaatctctacttagtttcagtaattttttataccacttctcataatattaagcaaaacatcctcttcactcagcattttactctagcttgtatatattactataaagagtatttggaaagagaagttatttgaatctcctgcataaatagtgcacaagtcttttgtcttctgactcaaggcttatgccttgaccaatatggcattttttttcccccattccaaatttgtggatgtgtgtgtgtgtttttgttttttttttttttcgagacagagtcttgctcttttgcccaggctggagtgcagtggtgtgatcttggctcactgcaagctctgcctcctgggttcacgccattctcctgcctcagcctccctagtagctgggactacaggtggctgccaccacgcccagctaattttttgtattttttttagtagagacagggtttcatcatgttagccaggatggtctcgatctcctgacctcatgatccacctgccttggccttccaaagtgctaggattacaggtgtgagccacctcgcccgaccgtgtgtgtgtttttaaaagtaattgaaatttttaggattaaaatatgctgtaaaatgaagttctgaattcctatttatttttattgttcctagtaccttttatttgtgactggtctcttacctagtacagttttacagacttacagttgacagttattttggaacccatagcagccaggaatagcctgactcccactttggctaggattttacttgccacttctgaaacctttgaaggcagaatgggccatacatacccaaccgttaactgagataacagtcacctgggctgtgggaacaaataggtgcctttttctttcatcgactccctcacaaatcagggtctacaattattactactttaagatatgtttaagaaactgaattataatgtgcaactctgaaaatattaagatggaaaaataatgtgtttttatatctcaagaaattacaagaaaagtggagtttaaaaacaccagagattcagaaagtaaacaacagtgggatctcactatgtaacttaataagtgctgtgaccacccctgcaaaggcaatagcagcagttaaatcaggtatgagctttatttacatttatggcaaaaactaagaatcaggtttactcatgtcaattttgtgtatgttattttttaaattaatgcataaaataacctcagaaatacaaagtgaaagtgacaagaaacatggcatctgtaagcacactgtgctgggaatgtatctgtactaatcaaatttcaaatccttcttatgttttattttattagactgtatttaaaatgtagctaaattaatatgtaagaataaggaatgttatattggggaagggaacagatcatattcaaatttgtttgctttttaccttaattaaatggagatattgaaattctatttaaaatatttaattataatatttgataaagaaatgagtctgggcagctgggaaagaagtgagggaaggaaataggcccttttctatagcgtgggcactctgttattttattcctgcgtattttattctgtacatcattcccaaagaaaacaattatgcagtatgtgagccggcatatctgtatcgcaatctaagtcatggttgagccacctttctcaataaaatgggagattcatgtgtaaatattgattctaaaattaatttaagcaagttatgggtatagtttttagtttgaaacatacagtaacaagtttttttaaaaaaataatgggcagaaggcagctctgatatcttttttctgagagttctgagtatcctctgtggggtatctagtctgaccagcccccagctgtccctattgtgatactgatgttccagctgggcccttctcagccaaccatttattccactctattaatcctatttcagggactacccatattataatggtgtgatgatttctcctttttcttctaatcagatttcctgaagtgtgaagttttgttgttttttttttaagaagaggaattctactgtgctttatttattttagctcttcatgtcccctttatatttgccataaatatcaagtgttttttttgttgttgttgctgttgctttgggatttttttttttttttttttactcttggtaactaccaagcatggtaggaattagtagtgagcatctacaggatattttcacttccatctgaaatcccatcatgtttaattttttttaaagggacaaagttaagattcagatattttaatgtttctgtttagacttgttattatgtttttgatctgagaaatgtctttgtgttttggatacatagccgatagatactagtatgagaaagtctaactgatattttaatattctgattatgaaaaagtaccaatgctagattgttatgtaataaaagtgaactgttagtttactgcttactgactagtttctacttgctaagcaatggacctttggttcccacagtggtgtttggttcccacagttaggtattattattcccatcagtttggctgattgatttgtccagtcacctggctagtaattagtgaggctggggcttaaatttaggtaagttatacagcaagacctaggtactcctaaccaccatgctctctcttagtgttgacgtaatatgagtttaataatcgatttattttctttttcactttcaacttcttttttatgtatttaaaaaaattattctgcctccattaagcccatgataacaccatgtaactgcaccagacaattttcaatctttaagtaaggcagatgctcttttgtcagtcatgtatgcattgttcaacacacttatatactgagcaccttctgagcttcaggacctttatcattaagataattttaacagtaaagtgagaggtggctggcaagatggctgaataggaacagctccagtctgcagctcccagtgaaatcaatgcagaaggcgggtgatttctgcatttccaactgaggtacccagctcatctcattgggactggttagacagtgggtgcagcccacggagggcgagcagaagcagggtggggtgttgcctcacctcggaagcacaaggggtcggaaaacttccctgcctagccaagggaagctgtgagggactgtgccatgaggaatggtgcattctggcccagatactacacttttcctatggtcttcgcaactcacagaccaggagattccctcgggtgcctgcaccaccagggctctgggtttcaagcacaaaactgggtggccatttgggcggacaccaagctagctgcaggagtttttttttctatactgcagtggcacctggaacaccagtgagacagaaccattcactcccctggaaagggggctgaagccatggagctaagtggtctagctcagcagatccaacccctacggagcccagcaagctaggatccactggcttgaaattctcactgccagcacagcagtctgcagtcgacctgggatgcttgagcttggtgaggggaggggtgtccaccattactgaggcttgagtaggtggttttcccctcacagtgtaaacaaactgccagggaagttcgaactgggcagagcccaccgcagctcagtaaagctgctgtagccagactgcctctctagattcctcctctttgggcaggacatctctgaaaaggcagcagcaccagtcagggtcttatagataaaacccccatctccctgggacagagcacctgggggaaggggtggctgtgggagcagcttcagcagacttaaacatccctgcctgctggctctgaagagagcagcggatctcccagcacagtgctcaagctctgctaaggaacagactgccatctcaagtgggttcctgacgcctgtgcctcctgactggaagacacctcccagcaggggtcgacagacatctcatacaggagagctccagctggcatctagcagatgcctgagtaaaccaataagttctgaaattgaggtagtaattaatagcctatcaaccaaaaaaagcccaggaccagacagattcacagctgaattctagcagaggtacaaagaggagctggtatcattccttccgaaactattccaaacaatagaaaaagagggactcttagccgggcgtggtggctgatgcctgtaatcccagcacttttggaggccaaggcgagcggatcacaagatcaggagattgagaccatcgtggttaacacggtgaaaccccatctctactaaaaatacaaaaattaactgggcttggtggtgggtgcctgtagtcccagctactcaggaggttgatgtgggagaatggcgtgaacccaggagatggagcttgcggtgagccgagattgtgccactgcactccagcctgggtgacagagcaatactccgtcacaaaaaaaaaaaaagaaaaaaaaaaaagaaaagagaaagagggactcctccctaactcattttatgaggccagcatcattctgataccaaaacctggcagagacacaaaaacagaaaatttcaggccaagatccctgatgaacatcgatgcaaaaatcctcagtaaaatactggcaaactgaatccagcagcacatcaaaaagcttatccaccacgataaaatcggctttatccctgggaagcaaggctggttcatacccaatcaataaacgtaatccatcacataaacagaaccaacaacaaaacccacattattatctcaatagatgcagaaaaggccttcgataacattcaaccctccatgctaaaaactcttaataaactaggtatcgatggaatgtatctcaaaacaataagagttatttgtgacaaacccacagccaatatcatagtgaatgggcaaaagctggaagcgttccctttgaaaactggcacaagacaaggatgccctctctcaccagtcctattcagcatagtattggaagttctgaccaggcaatcaggtaagagaaagtaataaaggatattcagacaggaagagaggaagtcaaattgtctctatttgaggatgacataattatatatttagaaaaccccatcatctcagcccaaaatctccttaagctgttaagcaacttcagcaaagtctcaggatacaaaaccaatgtgcaaaaatcacaagcattcctgtacacaaataatagacaaacagccaaaccatgagtgaactcccattcacaatcgctacaaagagaataaaatacctaggaatagaacttacaagggatgcgaaggacctcttcaaggagaactacaaaccactgctcaaggaaataagagaggatacaaacaaatagaaaaacattccatgctcatgggtaggaagaatcaatatcgtgaaaatggtcacactacccaaagtaatttgtagattcagtgctatcgccatcaagctaccattgactttcttcacagaattagaaaaaactactttaaatttcatatggaaccaaaaaagagcccgtatagccgagacaatcctaagcaaaaagaacaaagctggaggcatcatgctacctgacttcaaactatactacaaggctacagtaaccaaaacagcatggtactggtaccaaaacagacatatagaccaacagaacagaacagaggcctcagaaataacaccacacatccgcaactatctgatctttgacaaatctgacaaaagcaatgggggaaggattccctatttaataaatgatgttgggaaaactagctagccatatgcagaaaactgaaactggaccccttccttacaccttatacaaaaactaactgaaaatggattaaagacgtaaacgtaaggcctaaaaccataaaaatcctagaagaaaacctaggcaaataccattcaggacataggcatgggcaaagacttcatgactaaaacaccaaaagcaatggcaacaaaagccaaaattgacaaatgggatctaattaaagagcttctgcacagcataagaaactatcatcagagtgaacaggcaacctacagaatgggagacaaattttgcaacctatccacctgacaaatggctgataccagaatctacaaggaacttatacaaatttacaagaaaaaaaacaaccccatcaaaaagtgggcgaaggatatgaacagacacttctcaaaagaagacatttatgcagccaacagacacatgaaaaaatgctcatcatcactggtcattagagaaacgcagatcaaaaccacaatgaggtaccatctcacactagttagaatggcaatcattaaaaagtcaggaaacaacagatgccggagaggatgtggagaaataggaacacttttacactgttgatgggagtgtaaattagttcaaccattgtggaagacagtgtggcaattcctcaaggatctagaaccagaaataccatttgacccagcaatcctattactgggtatatatccaaaggactataaatcattctaataaagacacacacacacctatgtttatcgcagcactattcacaatagcaaagacttggaacccacccaaatgcccatcaatgatagactggataaagaaaatgtggtacatatataccatggaatactatgcagccataaaaaaggatatgttcatgtcctttcctgggatatggatgaagctggaaactatcattctcagcaaactaacacaggaacagaaaaccaaacaccgcatgttctcactcataagtgggagttaaacaatgagaacacatggatacggggatgggaacattacacaccggggcctgtcagggggtggggggcctggggggtggatagcattaggagaaataatgtagataatgggttgacgggtgcagcaaacctccatggcatgtgtatacctatgtaacaaacctgtacattctgcacatgtatcccagaacttaaaatataataaaataaataaataaaaataaatacaaattaaaaaaaaactaaagctccacttactgctctaaaatacaatttaataaatatgattcttcctagaataaaggaatttattggataaaacacaaagcaacttcacaaaaatttttatgaattaatatttaatgattaatttatataatataaacatactgaaatggtagtgtttaagacaatactttaagaataaattttacatagaagagaggatattgtttgatatttacattttggaccttcatttgattttgaagttgagtcagtgttttatgtgtgattactgttgatggggtttgatttaatgccatctactgttaatgtatagaaatactatgaaactgtgattattttagtgttactatttttgcaggtggagcagtattaaatggtgaaggaacagccacaaatactgaggaattttgggcaaataaaggtgagtattaattttaatttgttactgattaatgtaatttgatgtttttttaataagagaaaatcttagaggcaaacagtagttatattgaaatttcaagcctgaattacaatggtatttaatctaatagtcacaatctccataaaaattatatttatataacattttttgcagttttgtgtatctgaaataagtaaaatcaagttgttcagtttgacacttggttttgttgctttctttttggttaatttgagatattttgtcacttgggataacgttatttgacctaatttattgagtttggtgcttgagatattgctaagtaacattttgtggtttgttttttgttacatttaaaatgtcttttttatttcacttgttatgcaattttcttgaattatttgtgactaaatagcattataagatgatccaaacttttatttctgaaaagcttatgactttatctactaggcttaataatgacaagctagaagtgacaaaataccatgtaaaacaaacttttatttctagacctctgctccaaatgtcctgaaaatgtgtcagtatagttgtttttcttactcctaggtttaacatccattaaaaaggacatgactgacataagtcatggttatgaagatcttggcctcttactcaaggacaaaatagcggaactgaacactaaactctccaaattgcaaaaggctcaggaagaatcaagtgcaatgatgcagtggttacagaaaatgaacaaaactgcaacaaaatggcagcagacacctgcacctacagatactgaagctgtgaagactcaagttgagcagaataaggtatattctgtgggtgcacctatggaagacatgaaagagaatggattagcagttggaacggagctctggtagtcagaagctctgctctgttttcttttctagctctgtaacctttagcacataattgacagttttgtttaatgtgcctttctataaagattgataataatagttacttttttttaaatttttggcacagccatgtcataggttagcaaactgttgggtgtaagccactttgccacctttaaatcagtttaagtctaggatgttaaccagtcaactactggaaaagatttatttaagggctaaatgtatgaaggatctgttctctgtagtataaaaatagggtagctaataccttccttttctttaatagagggtatttctttctacagctgccaaggttgggaaaatggctttatatggtagcagtgatggcaagatttctacaaattaccaacctacatttgaattctataatgtgttgcccaaaaaaagtgtttattcacatgtagattctccacttctggcagcctttattaagactgattttcttatttattataattttactgatatcatcttgctttattccagagtggcttgtttgaatatatgaaattctttctcactaatggggacaagagtcattatcttcatagtcatagtgttcctctgtggggattcctgtatcacacaattgaacactagctaagaagaggaaaggaaaataattgcaaaatccaggccctcacccaccacaacatttaacagtagattttttcctcttttcattattctagagaaaaataatgctctatcattattgtatttttgtcttttgctgtacacatgatttattattatttttcccttgttagtcgtttgaggcagaactgaagcagaatgtaaacaaagtacaggagttgaaagacaaattgacagagctgttggaggagaacccagatactcctgaggcccccagatggaaacagatgttgacagaaataggtatgttgcgttacttagatgaatgcctatgaagaaaagtgcaatcatttttcatgtttatcatgatctttatcagaaaacattcaacagtcacttatttttggatttgctttaatgtttcagaatctattttttgcataaagtgtcatttcaaattatattgtgcagaaaattggcatatcttatgttttttatggtaaacacagtaattaaatctatttttatgaagaaggtagatactagttaatgaagtgctgtgcatggagtacctgttttcattaatgtttctttttcctagcttttggtgctttattatgctttatatatttttaagctgtattatattgtaaatatttctttcattcatctggaaaagctgtgctcccttctccttcatggagttacttctgggacccctcctgctccatactttatgctcttatgctcttccccaatcaattttttcatccaaagttatcctcctacccacatcctgtccctgtgtaaacagaggagtatacactgctcctcggaggtacagaattttctttacaagccctattgtcttaccaatttttattactataatgatgtagaaaatgagtgtaaagggggtagaaaaaaagaaaatgagtgtaagagaacggtaataattttccccacttcatagtttcatttggagaacccaataagttaatgtgtatatggctcaaacaaatagtacctggcacatatcaagtgctatataagtatatactatgattataataattattttactttcaatggttccattactaaatattgtccttcctttagagtcaggtatgctatgataaatgtagaaatctctaagtatattttagtttgaaaaaggttaccctaagggatcttcatgttcaaagatatatttaatccaactatagagattcctgtcaagttgtaattaatttgacactcattcagtgactctcttctaggatctcagaattacttggggagagtattagcaagacattttagaataggagtgggaatgaggaatatgtagttcaaaaaaccttctggatgagtttttctatttttccttcctgatttattgctttaatggcattattttgttgccagattgtgtttgactggaaaatgtcatgtagaatgatgttattaggtaaggtttcagtgattgtgttctattaaagtcatccctttagtgtgttatgctaaatgaaaactctctcaagtcaagtgatcacaccatcaatgaatatttatcgagtgactgtgttgaagtgctgaaagaagtgctctgatcagtaacccttgactgcagggagcatactgtcttgaggatggagaaaacagaaaaggcttcctagcagagggtaaatccaatggaatgtaaaggaaggatagggttgggatatatagagaggaggtatagcatctcaggcacaggacctgtgtgagcaaaagcctgtttggattataaggatgaaatcagcagggatagattagaggatcgtctcagagtacaaaccttcaaagattgtgggaggccttgaatgtcaggcaatggtcttcagattttatcgtctaggtaacgaggagttagttattgaaggatttgagcagtgaagtgacagttttaaaagtgacattttttttagggaaattgtattagaaacaagtggcttgcagctgagaaacattaatagcagggatactagttagaagactgctagactaggtcattagttctccaagtgtgctcctgggatcagcagcaacagcatcatctgggaattatttagaaatgcagaatttcagatactactccagacctactgaatcaaaaactcagggtagagcccagaaatctctgttaaagatgcctccaggtgattcttaatgcagctgaagtgtgagaactactggtcaaggtaaaacatgatgatgttagctcatcacctggatggattgtgttaaattatcacatgcactctaaaaatacatatctactatatatcaatgtaaaaaatacaaataattttaaaaaacacatgatgaaggccaaaatggagttatggcattgagaatgtaaaggagggctttaaggttttatgatcgagggtataatagagttaggaagctcataaaagaattttctgaattattgcatctttatgacatgggagaaaagataacctttgaaagaaatctaaaagtcttaaaagtccaccagttttgagaggaatataatgagttttattttttaatgttgagtttaattggtgagacttcctacgggaactttccagcagctggttgttaatgtgtaatttgaatgggaaagaataattggggatagatatacaaatttgggagcaatttgcctagaacggataagtgaagatttgatattaaaaggattattgttcattgttctagtaagtcatagtttaataacacactctataggacttatagaaggaatgagagatcccagaatgctgtctgctttaatgaatattcgatattctacgatatcttctaaagtcagattcaaaattttttccctatactttagttgacatacaaccatcagacctataaaatcgtaggttagtcctttaagtaactatgtaacaagagtcataaaaatgggattatagccattatatatcattttaaatcataccatacagtcctcatagacatagtcatgttaaatgcaaaaaatgtcaaacaccagtttcattttttttcttttagattctaagtggcaagaactcaatcaattaacaattgatagacaacaaaaactggaagaatcctccaataatctaacccagttccagactgtagaggcccaattgaaacagtggcttgtggaaaaagaacttatggtcagtgttcttgggcccttgtcaattgacccaaatatgctaaacacacaaaggcagcaggtgcaggtgagtattacctaataacctgtctctcgtgcatagcaatttgacttactgagaccaatgttttcattataaatatattaactttggtcagtaggtgttttatttaactgctttgaagtatatatgtaatgtttcagatgcccataagatactgtcctgatattagtgggaatccccaaagaactaaagctataaggcatcttagaggcctcctttgaatcccatgaatgggccaagtctcctgattatttcagtcatattgtgggtggtacagatctggttaaaagggccttctttgaagtattaatgcaattaagtaatatctttatgagaggctagtctatactttttactgtttagaaattactcctttgaggttttatttattttgattgtggtagtagataatgaaacttgtaaaactcatgcatttgagtcctgatggaggagagagagaatgagaagaggacaaagaataagggaagcagagagggaaccctgaaacccagggtgttagttagactagtctagttacaaagcagataaatccacaagggaaaaaaatccaaaaaaatgagttttatttttaatgtttaatgttttacagtcaggcataatagcagaagctctgtggtgatttcagttagttttttaatgtctgagtactggctttagagcagggaggctgttttataagctgaaaattcaaataagtttttgtaaaagtcagatgtttgaattcatatctgttcataatccaaagacaatgaaaacaaaagataaaagtaaatatctggggagaaataattgcctctagtcttggtagtctcccagagatagatagataaataaaatatagataaaagtataaaagatagataaaatatgatactaaaagaatgagatttttggatcattaattttatgagtcaagttgagcctatacattctgagcagcatgatttgttgactaaaacctttataataaagactgtaaacatcaataaattttatgttacaaaaacctttgcaactcaatgcatcatgagttaatatattctaacacctttatcactgtgcattttctttaatataaaattctatagggtattccaaaaatcctacgaagacaaaaacatgagtgggtaaaaacaaatttggtgtaagtgcagtgtgaacttgtttaacagcagtgtttctctttttatatgaaaatttacacatgaatttttgttcattttgtccatatttttcctttagggggatgggattagtttagacaggatatctctgtgaagcactgtggctcttcggatttaagagaattgtactgccctttaagtaaaaagtaggaaagtgataactaaaaaacaaaaactggagaaataattaccatttctgtctgtttggacaccaaatctgtgttttctacaatcaattatataataatttgcgtttgtttacccttgttaccttagattttgctgcaagaattcgccactcggaaacctcaatatgaacagctgacagcagctggtcagggcattctgagcaggcctggagaagacccttctttacgtgggattgtgaaagagcaactggcagctgtgacccaaaaatgggatagcctaacagggcaattgagtgacagatgtgactggattgaccaagccattgttaaaagcacacagtatcaaagcctgctgagaagcctttctgataaactgagtgacttggataataaactcagcagcagtctggctgtgagcacgcaccctgatgctatgaaccaacagttggaaacagcccaaaaaatgaagcaggagatacagcaggaaaagaagcagataaaagtggcccaggcactctgtgaggatttgtcagcactggttaaagaagagtacttgaaagcagaacttagtaggcaactagaaggcatcttaaaatcatttaaggatgttgaacagaaagcaggtttgtctacttttaatacatatatttcctggtcagaaataaatgtcatatattgcctatttccaagatgttgccaataatccaggaccccaaagagactctgccccactgttaacatcagtgaagaggaggatgaatacaggagctcagagagcagttttgtgttcataggcacatggaatgttagggtcattctacacacataatctgttggcaaaattggcttcctgaaggcctattaaaatctcaggtaccccaaactggtttttaaaaaatgtaaatgttttttgctgtatgaaagtcttatttagccagaaaaaaacatgaatagttagtaaaaggctttgcatcatcttctcatctgctgttactttatctattctgtcatagaaaacttttctagagaaatgtgcgaaagagaggcatttgtcactattttcctctctcactgtggctataattctgtggcatatgtgatgatatttgtcagaggtagcagtgaattattagaattcacttcatcagaaagccctgatgaagaaagacacattttgttgttaagtttgttctgtttgaaaagtttctagtttcttgcacctagtagatactcaagttatgctttttaattgattggatttactgatcacagcaactgtttcagacttattcctttatttgacatgacattaacaatagtaaatatcagctattatcattattattcttaatggtatgaacagttatgtgataggtattaaactaaaagctttacatgtactgtaatttaatctgtatacctactattaatattgtcaatttacagtgggagaaattaggcttaaaggtttaatcatttgcctggggtcttccaactctgaagaggttaaaccaagatacaaactcatgtagtttttatgtgctacattatgttgcctccataatatgtaaaagtcatagacgtggccaggagcggtggctcacacctgtaatcccagcactttgggaggccgaggccggcggatcacgaggtcaggagatcgagaccatcctggctaacacggtgaaaccctgtctctactaaaaatacaaaaaattagccgggcgtggtggcgggtgcctgtagtcccagctactcaggaggctgaggcaggagaatggtgtgaacccaggaggaggagcttgcagtgagctgagatagcgcctcaacactccagtctgggtgacagagcgagactctgcctcaaaaaaaaaaaaaaaaaaaaaaaaaaaaagtcatagacgcgaaaaagtcatatttaataagagatggattatttatcaacataattaagaactttgccatcatcacttctccatactggaatagagaagacaccagcacagcaggcgatgtgtggcatggccactccctgcaccttgatgcatttttacttatttccttattctttgttttcccctctcatctgtatcctgcatcttttcttgattgtgtattttcttctgcctacttcttgcttcttttcccctttgtcaataacttaagttcacttgtagttcttatagtcaatgctaaaagcccttgcttttcaacaattctatatattcattcagagatttttattttggcttttcatagattaaattaacattttgatgtaaaataaacatatcttgtaattttatttctagagaatcatgtccagcaccttcagtcggcctgtgcaagctctcatcaatttcagcaaatgtctagagattttcaggcttggctggatacaaagaaagaagagcaaaacaaatctcatccaatatctgccaaactcgatgtcttggagtcattaattaaagatcataaagactttagtaaaactttgaccgctcagtctcatatgtatgaaaaaaccattgcagaaggtgaaaatctgttattaaaaacacaagggtctgagaaggcagccttacagttacagcttaatacaattaaaaccaattgggatacatttaataagcaggtgaaagaaagagaaaacaagttaaaagagtcattggaaaaagcccttaagtataaagagcaagtagagactctctggccatggatagacaaatgccaaaacaacctggaggaaataaaattttgcttggatcctgctgaaggagagaattctattgccaagttaaagtctctgcagaaggaaatggaccaacactttggtatggtagaattactgaacaacacagccaatagcttgctcagtgtctgtgagatagataaagaagttgttacagatgagaataagtcactgatccagaaggtggacatggtcactgaacaacttcacagtaagaaattctgtctggagaacatgactcagaagtttaaagaatttcaagaagtttccaaagaatctaaaaggcagcttcagtgtgcaaaggagcagctagatatccatgattcgctgggatcccaggcttacagtaacaaatacctgaccatgttgcaaactcagcagaaatcacttcaggccttgaagcatcaggtagatttggctaaaagacttgcacaggaccttgtggtagaggcctcagactcaaagggaacctctgatgttttattacaagtggaaaccatagctcaagagcatagtacactaagtcagcaggttgatgaaaagtgttctttcttagaaaccaagcttcagggcattgggcatttccagaataccattcgagaaatgttttctcagttcgcagagtttgatgatgaactggatagcatggctccagtggggagagatgcagaaacattgcaaaagcaaaaggaaactataaaagcctttctaaagaaactagaagccctcatggcaagcaatgacaatgccaataaaacctgcaagatgatgttagccacagaagaaacctctcctgaccttgttggaatcaaaagggacttggaggccttaagcaaacaatgcaacaagttactggaccgagcccaagccagagaagagcaggttgaagggacaattaagcgccttgaagaattttacagcaaattgaaagaattttctattctgctccagaaagccgaagaacatgaagagtcacaaggtcctgttggtatggaaacggagacaattaatcagcagcttaacatgttcaaggtagggaactcttcatttttacccagtgtttttattgtcaatgaagtttctaatttgcttagaaaggagattgcctattttgtagaactttttaataatgattgtcatacaatatttgagccagaatgagcatatatgggggtaacacccaggcaggtggggcagttacaaggccactggggatttgggcctttgtgggataaggtctgagataaaatcagaccaaagggtgcttggcaaagttccaggcaagccagaaactgacatcatagggtccatttctggaattattcacaattgccatctgtggtgaccgtggctgtgttttgaactctattgcagatgtttatcttccagcaatttcttcaatggtgaattaccgtcttttctgccctttctttttataattatcttctcatccttcttaatttcttccacagacatttttcttctaaaagctcatatttttaaaggcaatatggagttccatgttgtaatctgtttcattaaacaaaggtcttaggctcatgccccagaggattagaggtgaattttttttttattgcatgacataagctcctcagtgccaagaaatgactgccactcaacagtgatcaatgacacttaatgaatgaaacatttgataaaaatggtgggccagtttccgtgtcattggatttggccttatttatgatagtgagaacagaagtcacatctgtataggggacaaagataggtttatccctggaaacaaagggtcctaaatagcaagcaattttctatatggggctgatataaacctttagggtttcacagctcctgttatatttatgaggtgtgttttactggcaaagatatattgcaccattagtgcataaagaataaactaagaccaaataaaaacagtttataaaaccacaaattattttctttgagagatgaatatgaatcaaatggacttccaaattctgtgcagttatagttgataaactctttcatttgcttgtctttaataacattatttaggtgactgaatcttgaaaaataccttctttttctttgtattgttattagttatgattatttgcagtttattaaacgcctttgaagcccagttccttcaaggctcacaaagctgtgattctgtatttagttcttgattcttgaaggtgaaggaaacgtccttattgttgacttgacctccttcattgctctgtcaaatttttgtatttctgatttgcaaaataaagatttcacgtgagagaatcctctattagaaaaacatagttctgtggcaattgctgcatcaaagactgggagagatcttgggagcaactcttccttcgtcagtaaagtttggaattctctctagaaccctgtcagcaccttaaagattaaatgacagtaaccaagcactgtttatactaatgaaatttaaccacattaaatggttaaattgtgaaacattatgatttctttcggtttcctgtgcatttgtttagaaaaaagaccttcatttctctttgctgtttctaactacttgtaagacaatggacaaagtaataatactggtgctgctatttgcgggtgtctcccctttggtgttcccaagtacagtgaaaaatgtggctgttcatgtggagaactgaaagtaagaaaaagcaagagataggaggagctttctcaccattgcactgaaagtgttttgcaaactgcaaagtcccaaataagtaacattaccattaatagctacagagattgttttatttgattgtgaagaaatatagagtgataatttctcctaaaataaaccatttagcatgctgtgtttgtttgctttcagattatttggaaagagttgattgattttattgaaattcagcaataaagaacatcatggcatactttcagtatcttgaaacccagtgacttgaaaaaaaagttttcaagtagacaaatactctgcatttagtatattccagtgccataggtaaaaaaaggacaagaatatgattatggtagctcacacaaccactaattccatttatctgtgtatgtgtgtgtgtgtattccttaaaaatagtaattacaataatcaacaaatcaatttattatgggcttactatgtgtcaagcactattttaatttatctttaatcctgttaacagtcatgagaggtagatgctattactattctgcatcttattataaagaagcctaggctcaaggaggttaagtgacttgtccaaggtcacacggatagtgtcagaacctgattcttttgatgaaaatgatgcactgcttcgtgtaaactttatttgtcatccatgtttcacatctggtattttctctgggggattttctaatcatctttgctgtagcctaatttagacagcccgaatacccagccattgttcattttaatccaaaataccaagaacacccacttaaggaacatgttctataaaactagcagctatgagaaatatgagatgaacatgtaaaacagtcttagaaactgatgttatgtaggtgccgtgatatgataagggtgatgatgataatgatgatgttgatggtggagattccagtgatcaccactactgctgctactgagatggagccaaacatttcattgttttagtgattatatctttcttggttaaagtagtaaattgacttgtttacagttcagtatttaatttagtttctgttgggccttagacttttgttaaacattagttttaacataatttttggaaagttttttaaattttttaaatggaatgatttgtattgagtgaaaagctagttataattcctaaaagtgaaacagaaaagtagtgaaggactgagtctgtcttccttattgactttgaaatataatctagtttgacattaatctatctggtagctttagtttaacctaatgtcacagataaaatcctataatagtttttcttaatacaaaataaactgccttctgagcagaactgagaataatagctattacccagttactcagcagggggtgccttctattcactggacccgtaatagaggatttaaagcaggtttgatagacttccccgattctgtttttctttctatagttcaagaaatagctgttaatagttacttgaggttttcttgtaaagacaaggacaaaattcattcgttcatgtttaagataccaattcaaacataatacttaaagcaaatgctattctaaaccaaatgtcctaactcactcagtgaaaactatcctgagattttgaaagtagattggtgttatcttttgtgttagttagcttgacgttttaaaactattttgattatatataagttctgttgtacataagtttttctacttctgaatactagtcattggactaacatgtctgaagggtgaagtgttttctatactgttggtaagttagagtaccattttccacttacacttatttatgattacggttaaattctatgcacactgttataaattggtggaatgaatagcagggcgattctgtttgtctctaggcaggaagaaagaaactcctttggtgttccctctatccctactcctatctgaagactcctagctcaagattatcttcaaatctaaaccacattattaagtaacattaatattaacacattattatttatcaaagacatatgtaactgactgtatacaaggaatgcctcccagtaattcctattatgtgattaacagccaatcaggtcttctgatcattatgaagtaaccattatcaccatattgcatgatttaatttcaatgaaaatcaaagagacttgatgctttaatgagtcctagctaaatctgtaccttccccacctctatctaggccaagcttgtcccacccatggcccacggcccacctgtggcccaggatggctttgaatgtggcccaacacaaattcataaactttcttaaataacatgacaagattttttttgccatttttttaagctcatcagctgtcattgctgttagtgtattttatgggtggcctaagacaactcttcttcttccagtgtggcccagggaagccaaaagattggacacccctgatctagaccattgtgaaaaaatgccttacctcagaacctgcttacagtttatttctggccactctgttgctgccccaattgtaattcattttgtccccacaaatgagtacatctccagtacattctctctgaggatttctttttattttcaaatggacatagaattacattgagcagaggatttttaagccaagttgaaaccagagacaaagagcagaacatatgcctaattatactgtaataaattttctctggtccaggtgaaggcattgtttaacccaggcatcattattttaatattcggtaaaccaaaatgccaagtagcatgaggctaaggaagacaggcagtttgagcacaaattcttattatggtgtttatcaaatgatccagaaacaacctctgatgtcaccatattgaaaatcaaactgtccaaaaactgctttaatagtacttttaaagtgttcatattgttatatagaggtcaatgacaaattattttccattttattaagaatggggaaattagataaaactgttgcagaagaggtttttgttagggaaaattccttaatagattggatttttgttaatgaagctaccttagcaaaggggttgcatgttcccttcctctggtatttttaatggtgaaaatatttccactatagacactgtaactagatgcatggcttttataggaagatcacattatttaataaacccagagcaaagtggcatttaacaactttaggaagaaagaatactccatatgctggtcaagagagaagccctactgaagcagagaccacacctagctatgaagaggtggagctgatctgctgtgtggtattattaacacctcatattcttatccacacaaactaggcataacaggtggataccctctttttcacatgatacaaggaatataccatacttctcggaaagggctgtcaaaagggaactttgcaacatgttctcttttcagttttgctgctaactaatgctacggccctttatgtcacagagctcctcttaacttttattccttcatttgagattgaggaattaaagttggttgttctgaaggcagttccagccagagattttataatgtaggattttttggtagttgttattttgttttgcttttaccttgataaacctatatcaccattttagagtgatccaataaaacagccaaactgcggtatctactgtcattattataggcccacctttgatcaaaggaaaccttcataatgtattttattaatatggaaagttgcttaaagttgtgtgtgagagagagacagagaagaatttgccttgttatgaaattagacattggtttcttgaaaagaacatttgagtggtaaatgtttatctaggtctctaatcattcattaataacaatgtaggataaggaaatgctacgattttaagtgaaaagtgtctggagctgctcaagaactggatacaacaagaaaatgtctgtgctcacagatcctattctcacatatctccagttgtcttcatttcaagctttatttcttttgtcagtattttaatatgaaaagtatttccagattttgtttgtttttttttttctctgaagaaaattgaatagggccattaacatgtgagttgcttctgcttgctggatagcttttctttaaatgaactttttgacatttatatatatatatatatatatatatatatatatatatatatatgaaatatgtatatatttcaattaataagatttatatatagaatcatcttctgttacatagaattttttttcactgtcaccagaaaacctcattgaagatgtgggaaaggcatagtcttagtattgtagtaacttacaggaagaagagcaagtgctcattaaagatattaactaaggttcacatcaagataaactcctgtcaagatcagttggtgaatctcttgtttctaaatcggtttagggctttaggatgagaatattctactttcttctaaatataaactgtattcccatgaaataaatagttattgcatattcatatgatgcatattcatatctttggaaacgtttagccatttatgtgaataaatttaatagtttgaaaactaaaaatatagcatgccttcagttttcattagctaatggcttatttgttttagaaagaacaatttttgctcttaatgcctgtttatgtacttgcagcacaaaacgcatatcccttgtttgacttctcatcctgatttcaagagctatcaggccaagagttattcattgataatagtgcgtttacttacatagacatttttcacttactgcacattgaacttaatacctccaatccttcaaccctaaaacctccatgtttcagctgataaaattgctcttttctatgagtaaataatgtgtaaataataatcataaatgtgaatgataaaacttttctatgatgtacattgttgcacttagtgggaagacttttcagggactttccttttaaaagatttaattaaactttaggaatataaaatgagaaaatattactgttttgcttataattcaattagtagttgtgtacttttctgaaatcatctgctttagtagatagtttagctggattatatctagtaggctacaaaaagtaagtaaagctacattttgaaaacagcattatgatttctgtattatgaaataatagtgttggctatttttcaggaaaactttacgtaccttattatgtatttctctcattgtgaaaatgtgagggggctgggcacagtgggtcatgcctgtaatcccagcactttgggagactgaggcaggaggactgcttgagcccaggtgttcaaaaccatcctgggcaacagagtgagaccccatctccacaaaaaatttttaaaattagccaggtgtagtggtgcgcatctgtacttgggaggctgagacaggaggatcacatgagcccgagaggtcaaggctgcagtgagctgtgatcatgccactgcatttcagcctgggtgacagagcaagaccctgtctcagaaaaaaagaaaatgtgatggatctagatatcatgattaatatttaacatggtttaatatatcttgattttattaacattagaggctataacatttatagtagctgtctaaaccaaatttttggggaaaaataaaccagtccggttctgctctatatatgagctcttacatgtcatccaggtaagactttggaatgtgatttcaagtaacaaagatatatgtaaattattgtgacaaattttaatagcacaaatcttaatgtgaatcaatataaaaatcagttcaataaaaaaggaatttagttattaaataagtggtgtatacttgaactcaattaactagggaatattttcccatagcactgtttacttccgaactgtgtcatggccattttctcattcacattcccattctagtgtaagtggtgtaaggacagtggtggctatgtctttacaacatcatttttccagtgcttacatgttgtttggcagacagtgagtgctatttttttgaatcatttaatttatgaatgaattatttgtgcagttttaaaaatgtactacccacctcaaatgtgaggttatatgttgctcctcttagcttttcataagcctagaataatattgtgctaatgattcagagttagagtctaaggtgaactgaattagagccattctttattatgaaaagttctgtaaggatcttagagtgtttagagaaaggcactcagagatctcaaggaaactttattattcatattgccatgaataagtagttttctaagcttacatatcaagagagcggcagctgggagtaagactcttggcctctactatttcccagtctagtgcccaatccactgttcaagcgtggtaagtatgagaccatttttctttctcttatcagtgccttattacagcctgtgtgcttgaacaccacagaatcaggtgcttgttgaaatatttcacgtcttgaacatgaaaaattggcattgatattgtgatgtggatggatatttttaaatctctttttctttatagatagtcatatatctagtcaacttaatgatggccacatactgagttgcatctaataatctaataattgttgaatggatgagttaccgatagagttttcattatgaaaagatttttttaaaaaagattcaactcttagatttatcgaatgaatattgagataacgttttctcattaaaggcacaaaagtttcctcccacatcttttctgtaaaattaacaaagaaagtataaagttgtttttactagaactgccttcttcatttggagttagcacagttttgttcatgttcaaatgattattttatgagattgaagaaagaccgcttcatttgtaactgacactctgacgatgtttcttattttgtaaaatagagaatgtttagattttatttaaataaaactattaaatttcctacaaagactaagagttggcttgctgaatttattttcaaacagtatttttagaagggtgttcagtagataaaaatctgtggaggtgattttgtttattaaatatctggagtcagtgagtaccactcttgggccttgtgttaacctcaagagtactgtatggttattagtaactactaatattcatgtcagcagtgctgagagcccctcactggtaggaatactttactctggagaacagttagatttgaacttgggcttcaaaagggaacggcaaaacactctcgacttcaaagtgatctgcactttgcatcgcagatactgctgaagcatcagattcttcagtgtaaaagtgcggtttcaactgaaggatagggacctatgtagccccccttttcccatttagtattcaaatgagtgcggtctctggaccttcacaaaataatttcttcgcggatctcccggtgccaggttctgcctccgcaagccctacggatcccctcccattttgaagtagtcggcggggtttccgcggtgtttgaacctgagctgtccctctccccagtggccggactcggcctgctttgcgctgatgtcaccacaagctgttacattgcagcctctcggcttcgaggtacctcccactgaaaccgctcgccgactcccgggaagaagcgaaagatgactgcgaagttaagtcacgggagggcgtagcaccgaagtggtagagagctgcggctccggaacgcccggcaggcccagagacgcagcagatggtgcctgaagagagagggcgttgctgcaagcgccctggctggagagcatgcctgcccggcaccgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggagctcttcgttgctgcaattgcctcaggtggaataagccttcctaaggaggaccagataagaatctttggaaatggctttttttttttttttttttttttttttaaagaagcttagtagtacaccatgctttctgtttactttaaacggttgctggattgtactgccctgggtgtctaaaagtctggtgtttttttctttcttcctttgagtagttctgaatagcattgaagaagcttaaaacaggaagaaaacctgccttttcaatcaagtttatttatagctactcccccctccaaaaaaaaaaagtaaaagaaaaatgtaactttctcataacgttagacttaacttatttttctctgaagatttgttctgtgccttgatgtgaacaataccaggtccctgtgtttgtcttttaaatttctggagcatggtttatttaccagaatggtggagttctgcaagccatctttaagtggattacagttaaccagagctctgccgaaattaacattcaggctgttaaaatgcttgctcatttggaaattttaatctggaaatatcagactaaaaagggaaatggactgacaatggaatgttctgagtgtttgagccactgttaagtgtgtgtttgtttattttctgtgttttggagtgtgtgaacggggactttgggagctgggaaaggtggacaaaggagatttttgttctctgttattgatgcactttattgtttagaatcatcctaaaatcaaccaggtaaaaggatagttgcatttatactgatgcactgctgatgaccttaaacacctcatgtattatgaaatatattatttgagcatgtgtctttatgctaaagacactccatagctctgttcagaagtatacttttttggaagatgctttatcttatttcttatctgtgtcaagagctgcaatatttgttttaactatctgcaaaatggggaagccactcagcagaccagactgtttacgtcagaatcccccatgtgtagggaagggtgaagaagaggaggacctaaatatcgaagactgttacgtcccacagcggtcaatctatgatactgttagactaaatgaacagatagactctggttcaaaaggtagtctatcttccaggcattttacagatcgaactttaccctacagtcacagaacactggatgttagttctttatgctctaatggtgcccttacttcttccagtgtatttgagctgagaggtcgggaagctaacaaactagatgaaaagatgatctttgatgcactcaaactaaatagtgatatcattcgaaccacaggattacctaaagccaaatctcatgcggaaaagaaagagcatagacggtcatggcgaatgtttgtcccggccaattttatggattatgcaaacaaaagtgaaagctcttttgttgaacctgctgatatgtcagatgctgttaccaaggccagcaagtgcagatggggtactaattctctcacttcggaggaggatgactctggtttatgtagccctccagcagagagggaagaaaaacagggcattttaactggagaccagtcacgaattaaaagtttgtcttctactgaagatattcttgtaacagaccaatacagaccatttttttctgttaattccattagcgaacagaaaatcccactgctttcatgtcaaagtgcccaccctgatgaaaatttcaaaatgattttacatgatgtttctccactagaggaagcaaaacatgtaaatggtcaaagggaaatccacgatgaaaattgttgcctgcagaataatttgaaagagagccctgtgaagtgtgacccattaattatgccaagaaatagagaaaatgagcatatttttaaccttggagaagaggacgaaacatacggacctggagaatcccaaatcacagcacaaagtagggaactcttgaaggattcccctcaagatttagatctctctcacacagatctaggggagagtgatgtagattgtggtagcaccagcttagtagaaaatgtgacacttttgacacaatatgattcaggagaatgcaacattgcatctaaagaggaagtggaggctcctctttctgcccaggagagcgaaatgctctataagaagttctccctgaaattcgtatcagcaagaaagaaagcagcacccagaaaaacaggggcccaggcaggaatattggacacagtctgcaatggctttcagttggttcaggtaattcatggaaatatgaaactctgcagtgtcaaaagtttgcggttctgctaaaagtttgtggttctgtttcagagtggtcactagtgtttctaataataatgaaatccacacttttgttttggaggtttgactagcaccctgcaagatgccacatattgataaatggataattataacaaattaatagggactgttttggagaagaattgatattcccagctgttcagggtcctgttattgattgtgcagatggtggccattccccttcatttagaaggcctccactgtgaatatatgttaatgttaggcttttacacaaattgtggtaaagacactgccatttaagagccattatattggatttattaagcttgaacaggcttagtcatgaaggtacaaacagtattatattgttatggcctgcaaagtactctatccacattaaggactttttttaataggttgaaaaatttctctcaggagctctgcatgtgagagtagagttattatgctgtactttgcaggcattatagctcccaactttttgtgagtggtgaatgaggtaagaaagtaaagggtgcagccttgtaataagtagagattgcttgtcaagcctgtaatttttttcttcccactcagattgaagttcagctgttttggtacttttactaaactcttctggtaaacttggcctcaaaggtagttttattttattttaaacttctcttcatgcttgtgtgctgtgggttagattagggggaaaggctctcttcataggtattttgttaacattgagagataaggaacttagacaatatcagaaccgttcctcttctcagtctgtgaaataattgttcttgttagttatgcctttttcttagacatgcagtaaatggcatgctaatttaaaagcttagcaaattaatttttttctgtaaaggatatttcagtttatttgtagaaaacaattaaatcttaggggagtatatactctttagtagttatctttttaaatccttagtatatttttgggggcactttagaaaactatcagatttacctagatctactccaatataaacccctgaaattaatttaaaaccaagaccagaggttaaggcaatttaatagaacattattgttatccttttgtcctgaaaactatataagagggaaaataaaacgtttccttgaatgtttatttacaagttcctggaatttaaaaggtagcagtttttgtacacccccaccctccgcccccactttttgataagtagtaaaacatatccaaagctattagtcctggaagttataacttagaaagtggtatagaaatgaaattgaattataatgccaaattctatctttaacattttgttgccaagtttctgtttacatatttgataaattttacctttttgcaaaattacggagacttcctaagtttttcctcaatgatttgggtgaatctcataatttatttgattatgtgtaattgatttttaaatatttattattgttatatataaactgccagtatggaaattgtctatatacattttctgtggaaaaggtagtttgagtttttagctaggaggagattttagagaaaatgatcattaatttgtttgctgttctctaatttactcatgtatacagtaacacaggagtatcctgtatgctaggccttagaccagagtctggaggatttgtctcctgcagcctctacatctttcaaagttatttttcatactgtgtctgcaatttttttcctgaagtgctattttaatatgtgcctttattatgtttctatgtattatgattaactgtccaatcattggtatatttatatagtgcccttcaggataatgactcagaatctcaaactatgttttaccttaatatcgatgtaaaactttccttccttagttccaataatttattttcctcatggcatcctccaagccctatattaaaaacatattatctatgaaagagttggctcatacctgtaatcccagcactttgcaaggctgaggtaagaaggttgcttgagcccaggagtttgagaccagcctggacaacatagtgggacccagtctctaccaaaaaaaaattttcttttaattagctgggcgtggtgacatgcagctgtggtcccagctactggggaggctaaggtgggaggatggcttgagcctgggagacagaggttgcagtgagctgtgactgcactactgccctccagcatgggtgacagagtgaggccatgtctcaaaaaaataatcataatattgatgtatctactcccagtattatctgttaaggggttgaagtcatccacctaagatagaaatataaatttctatactgatattaatttggcaaataaatattggcaaatattacatgctaggtaccatggtaggcccaggtcatagaactactgtaaggaaaacaaatttctgctttcatggcacttgtattttaatctagcacattaaatcctttgccagtcacaggcaactggggaactgtaaattggatgggatagacagtaagggagagattgctaggaatccactgtcagtgcaggtatgggtgacaatgactacagagtaaccagagttgctgtgctggtaaggtatgtgatcagatccatggggtgaggtcattgtatttcttgagagtccattggcatctctgtagacattgaggaggctatttgtgtagggatccatactattgcagcacatgcctatgtatttttcattttcctatctctgtattttggccctcctgccaagccatgttttggccacttggctcacctcatcctgtccctgattttccatttccaatgtgagtctcaagcttcagttgccagctagcagcagccattcttaggagagcctattaggattgccttgcccatgaaggctcattttgtacttattttatatttttgctctttagcattttctgtaaatcttttgctacagttaaactgggacaacagaaacattttcatcctatgataatgaagcaataaagagaggagacatgtactgtcttcttggttttataagtaacttaagtgtactcagaatatcattctttagtattctcaaatgtttttgatgtgctactaatttatatttagtttctttctgttcttcagaaggtagctatgacctatggctagacaataaaaattatctttacctctgtaataattgatggtttccacaacctgatgcctaaagaaatgcttattatatatttggcggttgataggtaatataactcatataattattactcttttaactgcaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtaattttctcacccccttcattgctattttgctgattattattcatgagcatttgtggtgaccatgaatcatatttgtggtagccaaacttttctaaatatgtctactgttttatattactgtaaactggatggctcaaactcagatgcctactggagctaggtagggaatctaaatgaaaggaagcaaactgggtaagacagagcctcttcctgctgttatctcgcctttaatcaagacagggtcacagatacaacagtgcaggtatgatgggcacatgcatctgtaaaggtacaggtcactacttagttccagaagatcattgacatgtaggcatgtaggcccactgttgccagatattctgtttactttcaaaataacctggaaatctcactttctatgtgaaaccttcctattttcaaatattagcaactaagttcacaccatacaaacaaagttatgtctttatgtcattcctggactaagtcctgctaccctcactgtagaccatcagccctcaattacttgtaagatgtaggtccaacctttttctaaattcccatgagagaaaacactagaaataatgctctgatgtcttagggagataatgctgacatacgatggcaggcagctcttacgagacataaattatcagaaaattattatgggatggcagtgcatatctggttgtggcagtggtggttactcttgttgttttctttcgattgacatcttcagcaggtaccaggtcttgaaactatattattcattctttaaagtctgatacatatgtgtagtgcaccttaaacacagttggaatgctgtatcaggtgtaaatataatccatagcacttacaatatcttgccagctactttattcagtccaaaaggaaaatatctgttgagacaagcaataagatatctctatgtaggacacagagactccatttactggtagacaaagggcctggtttgttgaaaaaagactccagagcttggagctagcagaacttaattggatacttttgttattcttgcctagcaaaatataattctgattctctctgctataatagttctgtttattcttaatcttttaaaaatcattatctctgatatttattagaaggaaataaaatgcaatattgataaaaatgactaatgtgctgttttttacgataactctaaaatatttgaatcattcattgctaatcataaaacgtattagacaatccaaaaacctccaagattgagtgctctatgttgactgtgatggtaaccttattttcatgcctacttgcttaaagtttgtctccttttcactgctatcctgcctactatcgatactttgggtaaattttaagtgaaaagtaaaagaaaatttgtgaccacacgggaaaataagcatgtaaaatagtgatttgtgctcagattgcattattttgtgaaacaaataaataagtggaaacaattggcactttgcaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaaggtaagttagtcatgcttttgtattgcgtttcatattaaatcttaataacaagagaaaaaatgcaaattgtgactcttttaattaataggataacctagttaaccggttgttgctgctgtagacattattttgttagtcattcgacaaatatttattgaacatctaccatgggccaggccttgttccagttgctgggaatatatccttgaataaaaaagatgaacatttctcattgagttcaaagccaagtgggaagggtgtgccaggattgaaagacaataagtaaagtaaataaatgaatggtgataagttagcaagtgatgaataaagcagggatcggggagaggcatcaggaagcaatagagcaaagatgagggacctaaagtgctggaatggagggagggagggggtgtgtgtaattttaaatagggtcatgaagggaggtcactgacaagatggcatttgtatggaaataacattgttcccttatatattaggttgatccctatgaaattgtctttttatatattaaatattgacagcttcttttggttccacctattactaaagagacaaatatttgattcatatatgctgaggaatgtgccattgtgtcttttgacactactaaagtggggccaatttgggaaaatagtgtcttcagagggttgatatgtacctgagactgaccacatgatagtttttgtgcccctgatagcaatggtcgggtatgaagtatttaataccactttgagtagtaatcagccagccatgacttgagatgacatgtgggaaggatcctagagcatggcgtactgttaaggtttctcccctctggaactttaaaaagaagaggatggattatgttaattacgttattttaaaactcaaagaaattttttaaaattttacattaattttttttaatttataaaaaagacaacattttaaatttctctttctgtacctggcttatttcacttagcatggctgctaataatgtactgtatatttcaaagttgctaaaagaatagattttaaaggtcctcaccacaaaaaaatgatgagtaggtgaggtgatggatatgtcaatcagattgatttaatcattccacaatgtatacatacatcaaagcattgaattgcaccccataaattcaattattattcatcaattaaaaatggaaaaaaacaaaaaattccacatttaccctcaattttttttttgtatttaagacttactgcttactttaatttctacatttaatactatctccctagaagtttttgaaaacttcagcatattgggaaattataccaattagaaatagatttagaggtaaggattaaggacacataactggaaacacattgcatttgtgcgatttttgcataatacagtgtctaccattcacaatttaaagttaactcccagagtcatgatgcttagccaacaaaacctattaattgattttgcttttttaattgctagaagctttattattaaaatgtatcaaagtaattagttctccttgctgccaaagcacctgttgtactttgattatatcatgactttagtatataaaaacctgtgccaacacagtttgtatgtcttacccttctctttaaacaagttcctcttaccttctgccttggtggtcctgatctcaaaatactcttttagctttttacttctgggtaactgtcaaatctttactccttaattagcagtcaggatcattaaggaagcagtgaagcatagtgtttcatacacttacgccttcctcattgctggtagcacagtgcctgtgcacagcagttgctcatgagccatttgtttgattagattagagcaaggtaaaaggctaattatagcaaacatttcatttcaggtgctttgaaatgtttaattagaatcaaattgaattttgtttctggtgctaaatcctgaaatattagtcttatttagccagctttggagatttctgacatcttctaccctctcttcctgttgccaatgatgtgtaaaagctgttttagtttgcagcctcacacagattttaggagccagttccacctagtaaaaggagccaagagcctctcgttttagccttgttaacttgtgaacttgggctgagtcttaacttccttgtctataatggattgtttaacgtgggaaagggttttgaaaacagtaatgatttataggaaccttttgtatcttgacaggacagatagttgttgaatgtttaaggcagtcttatttcattccgataatggagattttgcacttttttcatgattcattggagttatcctaagtggcaccttctaccgtattattctatattaaaaaattagtaatgagtttagtggccttaccaatattagttttgtctactgtgaaaagcccctgccacagtgtctgacccaatagtaataaatcattaaacaaatgagttacctttaaaatctcgcttttcagatcctttcatatgtgcatacatacaaaatacatttttgtcatacttcaaatgtacttagaatacattgtactttatattcatacaattattcccttgcttttttatatttaatgttttgtctcaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggtaacttatatacttccagttcttttgaaagagtagcagtggcctctgtctacaaaactgacattttgtattttgttaatacttcaaatcatgattttcctatgtttatcatgtatgtgaacagagatagcaaagattgtagtgcctctttcctcattcctctaatggtaatggcttgtcaccgctatatcccaactttttaagacaagcatttcccttgggagtgattacttcatttgtttattacatagttactgcctgcttaccatgcatcaggcacagagttaggtcttgtgttataggggtgagctgggcagatcatctctgtcatcagatagggtacagtctaagagggtttatagccattgagaagtaatgataaatgtgatgtctcaaagttgaaatacaggttgctgtgggagcatatcacaggaagaacctagcctaggggcagggaaatgacagttaagctaagttttagaggggaatgggagctaggaaacaaagaaggtggaagggtgctctaacttcatgaaggctaggaagcctagagcctggctccactgggtgtttgttctcaacaattttattacaaaaccccaacccatatttcagtatctgcattgatgccgccattgactagccatagtagtagctacattgaagagtagtcacctaggctggttgggttgaaatagatgaaaatagaagaatcactgacctgagtgagtatgttatataaattcccaccttctttggaaccagaatagtgaagagaaggatttgtctaaacttcaaatacagagtataattaattatagctttagggccatagaataaagtgctcccaaagaggtgaaaaatctcatgttgtcctctgatatgtgtcaacagattaaccgttctgtgtaatgccctgggagctgtgccctggctgccatgggagatactctcagtaattttaaaataataaatgagtgaatgtctagatctctgctttactaccataactagtcttcttttcctaaaactttcttcacagagatattaaattgagggatattggtaatggttatgattcatgcccagatttattgtggacagtttaaatcatagtaagtgaaatcccatcacagaatagttatttccactgattttagatgattggatatttgaatttagaagaaaaggtcacagatagtgataatccagaggtaattacgaatatagtaattttattcatttttaggatcaaatatatcaactgaaagtttttaaaaatgtgtgtgcattgtgatatgttatagaaattatgtttaatagcttatgccaattttctgtaattcccttcttcttcatagaaagctaatttttcaaaacatgtaattccctgaaaattaaacatgataagaagttaaggcagcaatatctcttgatcccagcagaaattatgtatacaggatttgatactgaatcaggtactccgtatgcagaccagaacaatagcttgctctagataaatactgaggacagcggaaacaggttttagctttagtcctctgcaactgaggaaacgtatttccaaagatattttaaagtaccagtaaaagtccaatgaatacttctcccctgttcatgatattttaatccataaaatattaatattgcttttgggaagtaaacctaaccctgcgcttttataaaataggaatcactattaattccactaaggagaggaggaagaagctatgtatgctcttcaaaatttgaaaccagttttgaccatttgattaagagcaatctcagtaactgttgctccaattgaaattaatatataaagcacttaaaatggggcctggcacagaatatgtgttcaataaattttacctgttgtcgttactattactgctgttattattataacattgctgtcattattataactgtaactattggaagtattgttacagaagattacttcagactttcatgagattcaggaacttgaggatgatctgttgttcaactttaattttttttaacagaagaattgttttaatatgttctttaaatgttaagagatttaaattgtaaccttagatagtttctacagaaaatgtttagaatagattgcaagagcatgactgaagatttttgttgaatatttcacacattcttcatccctaaatgaccttttggcacatttgtaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagtaagatataaatcacacattagcgaggttcagtttttattgtgtggttttgtgacataaatttgagttatgtactattgttttgtttaattgcaaactaaatccatttaacatgtcatgctttagttttatttatgttttcatttttatttgtccattctttttgtttttcttctttatttttttaaactttgcttaggccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggtattttgatttattttattttatcttattttttcatttcaattgtcattatttcttagtccttatttctgtacaattttatgtttatgatgatttcgatgaattgctgtacttaaaaaaagactgtttatacagattacttttaatgaagtcattttaaagaaaagagtgactctatccaattagctggatatttcacttttcattttgttattttattgttgtatacaaagacctgtattaaccagtacttcagtatgtccacaaagcccattttcatagggccctaagtattttctgaaaaggaatatgctgtgaattatggtagatgaacatgggacatgggccacagaggtgaaaagaagaggtctaaacatgggaacaataagaacatttgaaaatgtgagatatttactcaaatatgtctctgtgaaatctaattaaagttctctgagattaactaatgttaatgctaacttaaatgtttttccccccacataaaaatggtacctgtgttttcaggttctgcaagaggacatcttactcaggaaacaaaatgtagatcaggctttactaaatggtttagaactacttaaacaaaccacaggtgagatatctttcaaatcaaatcatcatgtggtcagcattttatattgttttcaaaatattttagggatgggaaaaaaccaaaacactttataatttttggtccattccaagacttttattctggagaatgctttgaagaccaatcaagggggtggttaggatatgatctcacttttttctcatgatctcacttgagttcttgatggaagttgtgtgtattactcataacataaagcactttggcacaggagctcatcagagaagcccaggacagagtcacattacttttccacttgtggaaggcagatgaacacgtaggttgtagacaatttctttttaagatagatcgcattgcagtgacacacagtatggctacgtgcatagctatacatgggcttcatttcttcatgtctgaatcaccaagaaaactgatacatagtttagtatctagatgagatttttaggacaactcagggaaactagttttagtgattcctttggccataggaatttcactatacctatattcagttcagcaatatgtgtatgttgggggcaagtaccattcattatgcattgaagaaattaaatgtagaatcaagagcctttagttagaagtctgaagcccaggacacagtttttctgtgtgtcaaaaaatgaggtagaggcaaataaagatctgttggaatagtgcagatgagtaatgatgaataactaagagcagagaggctaagtatcttgcccaaagtaacccagcttttaagccatgcatgaagtcagtatttgaactcaagcagtttttaacctctcttctttgaaaacaaagtctcatacagatagatacaaaagtactgctttccacatagctaaagacatttagccttttccagttcctacatttgtattttcagagtgatttagatttgctggaaatcttgggaaagattaaaatttagaaaagggcttctcttgagtaagattatctttagaaaaatgtctccttttgttctgtggaaatttcatcagtgttccataatatctgaagaaaccctctccctgccttttttttccttcataagaaataacgtgactttgaaattttaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggtaagctctgatttctgcattttggattagtcttttatcttttaggcagtcttattcacacaaaaataaaattatatttgtcttatgtcattacatatgctgaaggatgccttggtgggtggagacccaatagaaattggcagcagatcaactgtttaaagttttaggagcccagagatgaaaacagtatgttataattgttgcaagagtcttatatttgggagtatagtttattacccaagggacagaatgatgaaaacagaaaaaaaaaaggaaaatgatcattgtttcagagacacacataatttggttggaataccaatatttctataagataacatggggtgggttttctaattatatcacaaacgtaatacactgcatggtaatcattcctcttttccaagatatcagcctctgtttttatcatccttgaagtatgatcacatgtgggtgaaagggagttggtgaggtcaggctcactgagcctgtaatgattctactgtcatgatataaagccagtttgtcatcattttgagggtcacttaattctggcttggaatatcctcttcattttacttttctgttacctgattacttagaggttcccagaaagcaaagaataatacaagttaacttgcttgtttttgcttctgaaattttaaatatttatattaaatttcaaagataaaatcttgccgtgtcgacaaatgaattgttctttgaacttctcaggaaacatttttctttttgcaaaatagctttagataaaaaaggtttatttaactcgactgaaactaagggagggggggagtggggcaaagcatcacattattcgcctgcaaaggacttgagctccaagaacagttaaaggaaaagtctgttgaagctcttaagtgttactaacttatttgtatgttttcaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcaggtagggaaaaatggtttgttgtttaggcaataaattttctccagctgttcttggagcttttacctgaacaaagatgactgttaatactgtttccattcatttgctgtgcttccaaaatgaaagagtggatttgaaaagaagttgactgggcttcttcgacgtctgagcaccagggcaaggctaatctgcacattgttcacagccatctgcctcattgtttcacagatttatccttaccaagtcagacactgcgaagatcagcccagctttccaaacaaaatgcttttgtctacacatatgcatattgctgatattaatttttatgtattgactaagtctaatctgtatgtgagtaaatactgtgaattgttatgtaagtcagtattaactgttcatttacagaaagctggggcaaagagaatgttttctttttaaaaaggaagcagttttgttggtaatgtgaagtttttttctgaagatgacagaaggggggaaaagatgataggttccaatttgtctataactcctgcagaatgtatactccaagagttttataggcattcagcccttagccacagctccctgggaagactgtgggcaatgagtggggtcctggagatagaagttcgtaatataatacatgtgttgattaactttagttgaaatttctgtgaatatttatattaagtcatcacagttactacaaagtttatgtgtgggggtagtatgatattgcactgtactttagagcagagcttgtgatggtgtgtgactaagcttttactagtatgagccaaaagcaagaggcataaatcaagctgattctgtgggagcatccagaattaattttctaatgttgccatagaaatggaatttatagttagttctaaagcataatgttctgctcctcattttagtgctgtgctctgggatcacaacagctgatgaaatgcagtgatagcaaaagccctggctaagaaatttttgtgaaggagggcattcatgcttgaggaatgtatttgtgtgactctgtttaaacagaggagtttgtatgcctcatttttataggaaaatgagggtgtttatttgtgaagtttatttaactattgaaaaatatatttttttcactgaaatgtatttgaacgtttcccaactggcactgaaggcttctctaaacagcaagaaaattattctgtactcttgggagtaagaatttcttgagaagttgactgtggttggctggttcagtaaagtgaggaagtaataagggcacagtcacagattgagttttcgttggttagtaatctctgatatatgccaaggtcattaactgtggccaggttcttcaaggttttgcgtatgttttccaaaggcatgggggaaagtaagtcagtgtaagtcttccggaatcctttaggaaaataatgattttttttttctgatagaattagtccttatttaaaatttcaagattttctcaaagaatatagaaaaattcatgaaagaaagcatatgtaagcaatttggtctgtatccttccagtcttcgtcttgaaagaggaggagaatttatatagtaaaatccttttgaaagtgaaagacaatgtatatagtaaaagtcttactaccaacagattacacatcttaatgccactgatatcttctggttgttcatgtgtgtatttttatcttcatttctttgaaatacctgcaagtctgtccaatgaaaatacctccaataaggctacatagacacacagatgtttagagctgggaggaacatgcccagcatgcatgggataaagtgacttgcatgtggtctcacaagcagtaagtggcagagtagcaactaaaatttaatccctatctcattctccctcactgctgtgcctcctcataaattatatatagagaaaaacccttgagggtggtaaaccattttttttctaaaattcttcaataatccgaaggttccattattacaacaaagtggaggtatctaatgaaaatatttccagctgtaaagactgtggaggatgaggatacaacactaaaaggatcataaaacattaccgtgtagggaaacgtaagaatagagtagtaggtacctgtcttcctggtgtggcagagattttgcacttaaaagataagtttccaaactcataattttcaagtttataaagaagctaatatatccctgaaatattttataaggttgcctacttatagatgtttggaattaggaccagagtacagtttgataaaaatgtttgttttctgttttacccaataactacatccatgaaatataaaaaggagtgattaaaaaaagcatatctttagacctggacattagccacgtattttggactatctgttttgcattgtttaaacaaattaccattctgagtctcttctctgtatgaaatagggacacgatatgacctgagctcatctttttagacacacctttagtcatatgcaatttgttttattaacagtgactctttccccagacccctgcccccagcctaccaacagccacacatgatggggtaaggacatgtgtcttgaataatacttaacaattttaaaatttatagatttaatgatttgtcccagttaaatcagggagagttaaattagattttcaatgactaggtgttctgttttctgagcagaaatatctcttaagatacttcatattttttcccagttttaaggttgcatatatacagatatacctcttttataatgtcaacctgctttttgaaatttaacaaaagcataagcactttgtgaactgtcaagccacaatcgcagaatgtattgacttctaatcatcagcatggaagatgtcaagaaaaacatggaaaagacttaaaagtttgaagggagaacagaagggaacatacagataccttctcattagcacatactttgtaaccactttgtataaatttaggtttttaaaaagttttgatttgacagggttagattttcttgttaatcctatatcacaataacagttttgaaaagatacgctattgaactttcataacataggtgtgaaggccgtatttgttattatttgagaaataattgaaaaacctcagtaatgggtgaatgagtaagaacttgtacattcactgataccacccaccagtcccccaaatctgactctagatttgcgggcattgatattctaaaaagggtattattttttaaagtagttgggcccattcattacttttaggaagaatctgaatgggacaaggcagcttagtaaataatgatgttgagctgaactgcctcccttttacaatacatgccattatctgagttataaactgtacatatttttgcattttaaacctacgcagagtagcatatctttgttgctttctttctacaagctttgtggaaatggagaaaggcacttttacttgaaaaatgtacagacttgggttctgaattcagactaccttgattctttaagcctcagagcaattcatcatcctttgcttcttataatgtacaactgtcagtagttgctaaaatatgtatatcttactgggtctgggaatcccaagctttcttcagcagttctaattgcttggcttatgtaagtgggccccataataaccctgttagaaaggcccttggattggtggtttgggtgcagttaatgcaaacaactcattgggtcattaggaatcagcctggagaaaaatatcacctgtttatttcttttaaaggaccagaaggaaacatctcctacggaaatgagatttgttcagaccctccaggtgttgtggatgggaaaatatgtcttgtgttataaataaagacaagcaaagtggaaggaaatgctaatcaaaagaaagtgataagatccccagtaaggggaagggagtgaaaaggatgtccttgaggttaaggtttgcttatcactttgccttaaacctctattaaaacctattgtgtattgactgttgtgatatttggcagtctagaagtcagaccaccttcgttagaatctcaggctcagcatttactacctgagtagtctttggtaagttagttaacttccctttacctcatttttctaagctggaaatggagttaatggtaatacatgatacagctgtcaggattaaaggaggtattgcatgttaagcacttagaacaatgtgctcagtaggatgctggctgttactgttttagagagtgtttttcaggcatatttagatgtagctacttaaaatgtcttgcactaacttttagaaaattcctgaaaggctaattcaactataaacagaagttacagtagctagagttggtggttcggctcctctgatgctattaaagtatttccccaaatacaattatggatgccaagattatcaacattttatgttaagtcaaattttacttacttgtatgagtagtaaacaaatttactaaaatttgacctagtgtatttctctccatgttgcttacatataaagtgagccatgtttatggtccattagaaatatgtttatggaccatgtttatgttccattagaaatgttaaccagtcatttgagtgagtcatagacctaaaatgcctcgccttactataaattacttaatgtagatcctgtagctactccctttgttgcttaacaatatttgataatttaattttaaaagtttctcagatgacaggcgggaaatatctgtttgaagtcttttttttttttttttttttttttccttagcagagcaaatgtttgacttgatcaaagaaacattgtttggatttcagctttccttttttggcaacttagatggtatcaccatactgtttattgctggaaagtttttttttttttttaaatagggaagacatagtgttaaactaatattaatatttcacagcctgactgtctttatgaggacactcatttaaatactgtcaggctgaacacaaacaagagggttggggtattactttattttttttttcaggaaccagtggaagaaaaaaatttataactgttaaattttattcagatatcttgcagtatttacactcaggtagaaaggcctgaactgtttttctcagtcttatattctttaaatgaatcacataatcaatttttacctgtagctttacatgccttgaaaagtaagaatccacagaagactaactttcacttctttttcatggggattctttctccacacctgaagctgctgaattagttgatgaaatgtttttcttttgttttcatattgatcaataattgctcatgaataacttcatttgaaattaaataatatcacagaaattattgaaccagcttaagatagattattttaagtggtttcttggtttccttataattacagaaagtctacctataaacttgacgatattaaattttcaatatcaaaaaataaattataccccacgtttatgaagttatagcaaaacactgcttgtgggagtgtacattagcacattctacctgaagggcaattgggcagtattatatcgaagagagaaaacacaaataggaactgataggtgagacgttacccacagagttggttttctttcttttaaaattttttttatttaatatattttcttttaatttttaatttttatggacacatagtagatgtgtatatttatgaggtacataagttattttgatacacgtatacaatgtcttattaaaattaaacttgttttaagataattctaagttcacctgcagctgtagaaacaatacagagagatcccattgtatcctctactcagttttccccagtggtaacatctttatagtaaaatatcacaagcagcatattgacattgatacagtcaagatacagaatattcccctcaccacaagaattcttcatgctgctctgtgagccatacccattccatcccaccctaccctccgtaacttttgtcaaccacaaagctattctccatttctataatgttatttcaagaatgttcaagtattttttcagtcacaatctctttctcttctccttctgggactctgataacatgaatattaggacttttgttgtagttccacaggtacctgcagttctgattattttttaagttattttctattattcagtttgggtaatttccatttctatttctaagtggtaatttcttttccttcactgattctttcttctgtccccttcattgagctcatccactgagatttttatttcagttacatttttcagttctacattttcatttggttcttctttatactgtatattctttttctttgctgagatgttctgtgttgttgatgaagccttctaatttctcatttgtttcaactgtgaacattcagaagtactcattgaagcatttttatcatggctgctttaaaatcattgtcaggtaattctaacatgtctgccatctgggtattggcatctatttgattatcttctttaattcagtttgagattttcctggctcttatatgatcttatgagtgttagagcttaagctttctgttttagctgccttcctcttaccactctggcagaaggtgggggtgctaccaggtgaagatagaagtccaggttcccaattccacctctgttgacacctaggagatggctcgtcatttctgctgagtgggagtgggagttccagctccctatgtggtctctactggtaccacagtgcaggtggctgtgatggtgacacactgagtgatgatgaagatcctgactctccactaggccttctctgatatcaccccagaggagtggagggaggggcagttcgttattgcttagtgggggtggaagcccagcctccccacatggtctcaactgacaggatgatctggggatgaaaattctggctccctacttggcattctctaacatctcccggcaagagtgttggggaccttgtcatggcattgcaaggatagaagtgtaggccccccatttgtcctttcttggcatgagtgtgagtggagcaaccattttttctgtagtgtttggttggaatagagtggttattgtttaaaagttgtctgttttgctaaactactcctttcctggttctttggctagagagagcaggcttgttttgggactttgtacccgtttagtgttgtgtggttgctagtttttccagtatttagtcttagatacgtgaggcaaaaagaaaatcccagagaactcaccactgtgttcttccttgtggcccaaggtccatggtagttctgtcctcttctctcccctttgtggaatcttcttatgtatgttttatatataatgcctgggatttgtaggtgtacttaccacgaagaacagagaaaagctaatgtactccatcttcccatgagttggcatagtgttgcagagtttttaaagtatgaatttttaaaaatctagtttcttatctccacccatctttctccccacctacctgttctcccacctcatctggatttccagattcctttgaaaagttagaagatctggcagtactggacttgaatagccaaaatgttcattcctcattaattcttccaactgaggtcatttcagtgatcatttatggttggtactgtggtgtcacaggcccattttattcatgggaggcactggggtttatccgatggaagacattgaaaatgttcgtgctctttgacttgatagtcacttctaggaatctacactaaggaactaactagagatgccaacagaaatttatatacaaatatattcattatagggttgtttgtataataacaaaaatgcagaaagcttaaacgaaaatccaggtatgctagaatataatggtattatttgaaaatcacatttaaaggagtatgacatgggaaatgttcatactaaatgaaaaagcaggatatgaagctgtttatacagtgtcatcccagacattttttttacaaatctttctctcttgatttgtggaagaaaattcactacaataccagcagtgttaaatctaggttttaattttcttctgtatgtttttctctgctttatgaatttgtactgtgcttataaattactgttttaattactgttatgatcaggaaaataacatttattaaaatatttaagaatgctcttaaaaatgttttctgccattattaaatgagatgcttaaaaattatacatgaatcatttaggggtatactctgcatatatagagatgtatatttacacatgcatttataaacataatagtataataaataaatggggatattctattctttttgcttggaactatgtactttgatagcagaatgttagttgcatatcataggagttgaagtgatgggtgaaatgattaaaagatggtacctggctgttggctttcataactgttagatttggacagtactcctaaggtgcaaattattaagactgcctgaaaagaaggcaatagtgctagctgtcctaaaatcattaatgcagtgctataaatccagcatgttttaagagcttgtgtttaattactctgtggaaagttctcctttctttaaaatttagtcattatcacgaattattttaggatgccatgaggagacaagctcggattttccacttgtgtaataaggatatttcaaagaactgtagataggtattttctggcatcaggaacgggaacgtgctgacctaattatttatcttttgtttagtttgaccaagcagctgatgctgagttatcctggattactgaaacagaaaaaaaattgatgtctctgggtgacatcaggcttgagcaagaccagacttctgctcagcttcaagttcaaaaggtgaagaaatacatttccaattgccatatgaattatttgctggtgtgctccaactctataaaatgtgcttgtatgatttactttttaagacccctctagtgtaacgtgatatttttaactacttagcctaattgttttcattttagtcatacaatttcttgttttattttttgtctttattttggtaaatcacagacattcaccatggagattttgagacacaaggatattattgatgaccttgttaaatctgggcataaaatcatgaccgcatgcagtgaagaggaaaagcaatcaatgaaggtataatcttgtctgtggactggtagtgggactcttgaaaaaacagcaggtgttgagctttcagtcctagaaaaacacttctccgttatccacagctgccatttaagcagcaaaaataattagtttaaataaggcatttttcaagtttatagaataacagtgaaaggaatatttcttaagagaatcactatgaggacaatctttttgaataggcacaaaggctattaaggtttgagaccttggttaactggcacgcattaagcattcagttaatgttagctgtattattaccattattatcagtataaattattgttttttatatgtatcaactattgtttatgtgcttcagagacatttgggcctcttaataaaaaccaaaatatgtggctctctctaatgctgaaatccattttgtataaagttacagtaagctatatagggaaaatatgatctgagtaattaaggaagcattcagcttgtgtagttttaattatcctttaatttggcagaaaaccagccacaaataaaaatgttcaattcatattcagacatctaagcagcctgaagaaattgatgcatattcatgcttctggtaggaaagatatcccatgcatggcaaaaaaaataggaatctctatgcctaaaatcatattttaaagagtatgcattgcttttaaggtagaccacagataaaataataggatgcacaatgtaatgatatgcactcttttatttatttatactctacaatggcaatttgcttgtttataattgaatattatttttataaagactctgatgtgaaaaatacagattgttatgaaataatttctttgttattctgtggtttattgagttatgattgtgctttatcttcttctgctattagtttttgctatgagtttataccataatctagatcactgtgactaccccattaaatccgtgtatagcacaatggcaaatgttctgctttgattcctctttctctttctccttctctttctctttctctttctttctctttctctttctctctttctctttctctctctctctctccctctctctctttctatatatatatacacacacacatatatatacacatatacacatatatatgtgtgtgtgtatatatataattaaattttgttaactaaaaattttgacaatttcatttgcaaaaagtggtctttattttttttctgcaaaatatatgttgccagaatcatatgggacttgttttctaatcttgaagccattgtaagaatgactggagaattgtgtgtattgtttttggagatctcagtgtcttattcataaaaacttgaggcactttaatttaaagtgaacttttgtacgtataaaccattaaaatctgaatagcttttactgatgtattcatttaacatatatttgtcaaacgcccactctgtccaggtgtactgtgctggacagagcactctggagtgtgtgtgctcgttggcctgaccagttaaacatttcatccttttattttctagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcgggtaagcctggtgtgaaagagaatattgtattccccattaaaagagaatcatgatttttatggtggtttttagtacagttaaacacttacatgattaaggcattttagaataccgtgttctggtctgtgtaatttgcttacctcataattgcttcttatacagggttatagtgagaagactcatgtggatatacttgttgtatatgtcattaattacatcacaacttttataaaatatgcagtataaatcatctagatagaaaaaattcccatttaaaaatgttataggattaagcttttgaagtgctttcaatttacacacattgaattgttttaaatttatacatttagaatgtaaatgcagagtggaaatatatgggagaaccattatacagacaaggccattgagtttggagaaaatgtgtaatataatgaatgtgtcaaaatagcaatattatgaaagctatgaaaaggaaaaatgatgaagtataaagacagattattttgttcaccttaggtacatggaactcctttgaagttcttgttcctgtaagtgtaaatgggtaaagtaggaggagcacatttacaactacagttacatcacattttaaacatgtatgaaatggcacataaagccctcttttcagcagtcacttaattgttaatatggcttaaaattttgtaagggtttatgtgagagagcattccagactgtcagaaaaaaactagatttcttgctatttatggacttgtgaacctagttgctcttccagatctgtacagaatgtactctgagactaatcatggtgtgcatgtgtgtgtgtatgcgcatgagggggtgtgtgtgtgtgtgtgtgtgtgtgtgtgtgtgtatacgcctgtgcccaagagagaaggagggagagagggagagagagaaagggagggaaaagttcaattcagggtttattacatcattgtttggaatatgtgacatcttgttaatcttgtttgtttacctttttaatgaattggcattgaagactatactgaagtatttatttaaaagagagttttagagaccacactttaactttatttaatatagaacaggaatcttatggagttctatctaaatgattcagcaggagaaagacaagtatgtagaattcaatttttgtataaagatttatttgtggcagaaatctgatatctacttactgaattattttaaatgaaaaatgtttcatggatttctatgctgaggtgatttgaatagccacatttttagcatagcatcaaatagtatggaaaggctcattattgagctgaaattttaaaaattgagtttttttgcctttttgcataatctttaagctctcaaaacaaatttgtgattgtctgtataaagggaggtacaaaactttgtagccacatcttcaaattgtttaaactaaaagctttgctgttgcagaatatttgtagcctcctaggatggcatttcttttccagctctacagcatcttctccatgtattttgggggaaaatctagttcattctagccaggaatgaaaaatggctccaagggccatgttaccacatgatagatatcaagtcacaccagatagctccagcatgactggactcctatgacagcatgtgccaagaatcattttgtcacatataaggcaaaaggcatctccttttgggcccttttctgatacacacacatacctgagtagatggctggtaggtgttctcttgcctgtcatggaatggtttaagaagggtttaaaaaaggctcctcggccaggcacagtggctcatgcctgtaatcccagcactttgggaggccgaggcaggtggatcacctgaggtcgggagtttgagaccagcctgaccaacatggagaaaccctgcctctactaaaaatacaaaattagtcagatgtggtgactcacgcctgtaatcccagcagtttgggaggccgaggcaggtggaccacctgaggtcaggaattcgagaccagcctgaccaacatggagaaaccccatctctactaaaaatacaaaatcagttgggcatggtggtgcatacctataatcccagctacttggcatgctgaggcaggagaatcacttgaacctgggaggcggaggttgtggtgagccaagatcgtgccacggcactccagcctgggcaacaagagcaaaactctgtcttaaaaaaaaaaaaaaaggctcctctcactacttgccaagccaagttgccttatagtgatgctatacaggtgagatctacctagacccaaaggaactccagaaatatcagcagagatgtagcattttatttgagagtctcttgataactcttgagtgaaagcttgttttccaagcattcctgaaagaacattgacaggagaacgtatgtaacatcttcagttttccttttccatgagattatctatagctgatataccatcaccacctccattcggtaaagcagcatgaagatacctaattatgccaaataaaaataaaaacttggcctgggacgcccaggagctagattgcaaacatggccctcccacattcttatgtgcagcatgctatattagactcttccttcttttaaaattgaattcatctttatttagccctttctaaaactattttgaggcagtcttttgaaaaccttcaaaaacattttattacattggtgatagttaatgatgtaattcctcaacaggttctcaaaataatgctcataattgattttagtagacactttcaataaaaatctaggtatgtggccatcctggtgactgatagaaattagagtttgcaggaaaagattggtagcttatctctagaccatctttcctgaaagtaagattccccagagaagcttttgtgaggggctggagtttggagatacacattctggtgaggacaaagagctgctgatgagggaacctaatcaataatgtggtgcaaatgaaagacccctcaatgctgcacagaggccagcctcagaaaaacctgcaagcaaaggcagatcttccccctgggggtggctttggttttgacccatgaaaaactgctcattgaaatccatgggatccatgaggtgtatgtattctagctttattcaggcttccaacacatcttctctattaaagggaatggggatccacttgaattctacacccacgcactagtataaatatcattgtatttcttgattagctagcaaaattatgcacattcatatgacatgtgtttttccttaaatataccttacaaacaatgctcagtatatagctgtgtattgatagattgcccttgcagcctttaatattttaaaataatgaatatagattcattcatatgtgtgtctatatatcatatatatatagaatagattcatacataaatataaaatgtaatacatgttcattcattttatatcagtccgcatatataaatgcaatgccttgtgggcttacatcaccctaacattccttatcttgaggttttgtctcagcattgcatctaacttatattgagcttctttctattcttttttcttccttcccttctccctccttccccccgtcttgtctctctctctctctctttttctttcttctatttttgtatatatcatgagtgtgcagaaaggaacaccatcagatatgacttggtgtctgtaggttggggacatagcgagttcagaatacttttatataatatgaccctaggctaatgctcttgtcaaaatgtgctactcttggtatgagatgcataataaactgggattcattatttcactgaaccagcatctttgtaccctaaagggtctttggtgtgaccagactgttgtttaatctttgtgtcaggaccttctcttcctggcaaagagctgtatgagccatcatgtgttaaatgccttgtgatggggaggggtttgtttggagtttcttgccagctggatgcattgcaggtgtagacagctgtaatatggaggtgtgaccctgagatactgaaaagctgtttggtttgttatagcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcaggtaattgtttacactagatatagaattgggttcttgcagacaacagagcacagaaagacattttcctggatttcctgattaaattttaactaaaattatttcaccacattcactcttgagtattgatgtctgtgtccctcagaggtgatgtttgcttgcatccagcctttatctccttatctttctctgcctgcttatagatataatacaaataattttcaatgacttaagaaacgtgcagttgtcatcattgtctgaatatttaattcagtgtccatcctgagtagaatgtaatatttgccattgggggagataaaggaaagtgttataattattaataaagtactctcaagaaggcaatgagaagaaagaatgataggctaaatgaaaagaaaaagaatataaagttggatattgatggttttttcttttctgaaaatatcttttttcaagaagttgaattttgaaatacccaaagattttccattttcaagatttggttttcattattagatatggcacattagagtgggccagtgtcacaatcctgtgtgattattcctttaactttgagatagtatagaacaaagttcattcatagatgtgaatgaacaagtttttatagctttgcttaattgtctatggaacctttacaaataaaaattttacattctctcatgtgtctgattatgtgtttaaccatgaagtaaataaaaacttctgacacttgtaacttctgttatatcagaagttacaacattggggaggttttttgttaaaattttttttaacatttttcaattcaggaaatgcataacttaaggattccctggaatctaatcaaaacttcccatgaatttcacattaaataatataacttttcaggatgccataatagttcattaaaaatgaagtaaacaatccattgtaatagacaaatactcagcttattgaacttgatttttaaaattaatttgaattatgataacaggatgaagcagcaggtaaagagacattgctgccatgtcgtcctggtccaattacatattaatatataccatttcttaatggatacactcaaatattcataagaaactaagtctattgtacataggtagtgtgacagaggtgcatatacttcatgattttaggcatgtcttcacacaccaggtggatgtaacttttgaatgggtctgttgataaagaggctaagatttattcttaattctgacattaaattgtaaaaaatgttttttcatttaaatttcacacttggtattacagatcttttttccataaaagatctctttgttttgcccctagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaaggtaatacttttggaatagggaaacaaattttaaagcattctaaatgtttatgcggtttactcaccgtccaattggataacaaaatgccgcatcttaaaaaagatactacaaatgtgatgtgtttagggttgaagggctgtgtatgcaaatcccttgttaatgtcttcctgtgtttgtgaaattatttggttgaatacaaagcgtgccattatacatagaccatgtataaagaccatatgttcaaagaccatgtgtattcaggccttttaaatcagtaggttgaagcatattgctaataaggccatatctggggttttttcctcattactgactctgctaccttacatagcatggatcctgcatcacatagccacaaaaatgggaaccactaccacagccagccatctttgagatacgagctgagggtcaaaagggagagcatgtgcgtagtggaaattcacaatgagagtactctagaagcaagcccaaagtacataccatacattgttacattcctgggactgaacggacaattttactcttgatttggggagcataaaagtgtacctaggtgattatttcactccctttgggattaaggatagccttaatgaacttgaaacttgataaacttggttctactctgagctcacttttgtcaggaagaaccttggtttggcaagaatagcagacccagagatattatgttatttggcatagactcttggacccactgatatccactggactggggtcattcaaaacttggtccagttttagatacttagcaaattggatcactactttctgtgtgaactataacattctgctttgttggttacgtggggctaaccagtcgccttgtggatattgttttgcttcatagctgttcaggataagcttgaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagaggtaagcagaaaatctcatttaaagttagaaaaataagttgtggcataatgaaatccagattccttgggtaaatgttaggagttactctgttaacatttatatttggttctgaaaatggaatgtgcagtgatacagtaggagatagagtatacccacaaatttcactttgagattgtatgtttaaaacaatttctcaggcctgcgtggtggctcatgcctgtattcccagaactttgggaggccgaggtgggcggatcacttgaggccaggagtttgagaccagcttggccaacatgacgaaaccctgtctctactaaaagtacaaaaattagttaagcgtggtggtacacacctgtagtaccagctagttcgagggtgaagcatgagaatcacttgaacctgggaggtggaggttacagtcagccaagatcgtgccactatactctaacctgggcgacagagtgagcccctgtctcagaagacaaacaaaaacacaaaacaacaacaacaaaaaatttctctttatcctcactgtttttgccttatttcagggccttattatctctctctttctttttggcttccaaagtaatccaaagtgcagactgtcttttccttgctaggcctctgaccttgctgccagtcttctctctagatctgctcttactgtgttgctgcctaaaccccgtcagaggcatcccctgccatctggatcaagcccaaactccctagagcagggcatgcagctttttgcatgccagcctagctcatgcctatgtttccaaagttatgtttttctcttgctcctttaccaaactccctccctgctactgattagaaagggcgtttcccaaaacaaactgttttgctctttctagcgtcagtgcctttgcgcatcttatttcctcactctagaatgtccttcctgccactctactggcaaagtccactcagggttcagttggatcattacccccatgtaaaaccttttcttgtatacttagcagagttagtgcatctgtgttcccgtaatactttattcatgcaaaggactctgcacatagtatggtttactgttgcttatgcctctgtctttcctgctgtagtgtgggccccttgaggggaatagccatatctatttttctttgtatccccagtgcctggtttagggcttggtttatggttattcagtgtttgttgaatgaatgaatgtatttaaccaagaagatgaaagcaaaagtaggatactgcctttctgttgtggtatctttgtaccttacaggtcctacctggtcctgcctagggtaatgacataaaatgtaaatccaaagctagattattctaaatctactaacaaatatattaatttgtattgtttttggatttatattttacttgtctatgttaaatgtatattggtttggaaaccaaaatgtctttctaagccttacagtattgttgatatttttaaaaatttgttttggtatttgttaaggtatttcttatttatcatttcttaaatatctttataataaacatttgacatttgttactaaaagggtgctgtttttcttttaaaatatttcttgttgaaaaaatttattgcagaaacttagaaaacagaaaaatgattagaatgccaccttctagaaataactaccattgatattgttgtgtactttttaaagttttgatgtggttttgcttaaaattctaaggctgtcattttcttattctagaccataagggaagaaatagatggactacaggaggagctggatatagttattaacctaggttctgaactcattgcggcatgtggggagcctgataaacccattgtcaagaagagtatagatgaggtacaactggcttacttatcagaatggcttttaaaaagtttttagttaactaaaatattttgttaacagtagttgaaagtttaaaatatggcactaaaagaattctaacatacatcttgtagttaaattcagcatgggattctctaaataaagcttggaaagaccggattgacaaacttgaggaggcaatgcaggctgccgttcagtaccaggatggactgcaggtaaggggattacagtgtatgtgctggtcttagctggaaggaggaatcgtactaattgatgtctacatattggcaccacctcaagatctgccagtgcatatgcaattgtgggcaaattattcctgcagttgcctgtgtatctcatttcatgttttgtcttttagaagatatttctgacctttcagatatgtgtagatttatatacacatctaaacacatttctgtatacacattcagtgaaatttactttgaaaagaaatattttgattttttttaagtgaaagtaaatgttctcacacagtgttttttataaatggctcagcaccagacagtgaaatggaactaaatgtgaattctgttctgagtggaataagatgaaaggagtaaacactatctaaaaatatcaccaagtttaactaaagtcagaagtaaagaaatttgatttgaagccagtgttctccatgtacaaaaatagatttctattaggtcataatctggtgtgtaaaaagtgttttcttcttttccatgtatataatttcttttaatagttgtttttcacttaagggttttcattcagttcattaaccatttataaggtttttttttaatattaaaaattatcttgtcagttgaggccaactcgggtatatttctctccctacctcccttaaccttgctccgtttcctaacagactggcaggagtttaatctttcatccttcttaccatatggaaaaagcttaagtatttccataacactaagtgaatattatttttaaagcccagatgagaacatcttttccttttttattatgccattccatttctatatttgtaaaaataaatgtcacagctaggctttatgccagctgagaagttttttgaactttggaaatatatgaaagattttactacaaataacactttattatattctccctccctcttctttttttttttttcttttgtaacctaagtgataatttactctattaggtatcaatgacaagtaactaattcgggctccagtctgtgaggctaggtcattgttaaatcattgagttgtaatctcttccatggctagaggtggcaatgccaccacatgcagccatttaggaggtcacacgcaagccaccatggcttgtatagtctctttatcactaccagaaaagtaaggcctgtcataagtcctgttgatcatgtattagtagcatcacctgtgctagcaaagggcagattgatttattaagtagctacagtacagctagctgtagctagatgtcaaagctctggatgctaattttcaagatttgattgtaaagtaaaatacgttttatttcccaggttgctgcttaagtacttagtcagggttggctaatgataacttaaaaatccaagatttatcgccctactatatggtttgtaaacttcattaaagtgcaaaatatcccagtgctttgggaggctgaggtgggaggatcacttgaggccaggagttcaagatcagcctgggaaacatagcaagatcctgtcaaaacaagagctgaagtaccccatctacaatttttttttctttttttattagccagccatggtggcatgtgcctatagtctgagctacttggaaggctgaggtaggaggattgcttgagcccaggagtttgaggttacagtgagctatttgattgtgccactgcactccagcttgggtgacagagtaatggcaaaatgattttattttgtattcagtacctaaaaaaaatgtgacttgagcctttttagactatttttattacctaaataaataagaaatgcaggagagtctgaaacctgttataattcagaataatggtcttaatgctaataatttatatgtgcaggatcttaatgctaatctaaataatatgtaagggtttgagtcaaatattttgcctaagttctaaacagtaatttcttgcttatttgaatgaacaaatagatttgaatcttttcctttcagtatatttatacaagctgccttttaagcacatgtaatgaagaattccatgtgattggattctataaatgttttcaaatgatttttttagaagttcataatatatcaagaatctattgaataaacaatttcttttgcaaacttgtatgtatctatttcatatttgggacaaccattttggtatattactgcttttactaatttaggtgaaccatgttaattttttataaaatagtctaattctataatatcttttagatttatgattgtatttttctgtagtacttgaaatactgtagcaatttcaaatgtactgttgtaacaacacgtgggcgaatgtgtctttcaggcggtatttgactgggtagatattgcaggtggtaaattagcttcaatgtctccaattggaacagatctcgaaactgtcaagcagcagattgaagagctaaaggtatgtgtgggggctaatttatcgaagactcccttgcagttttaagtccttgattcacataattttgtacataaatttattttacctaatgtaagtatgacagcttaattataaagctagtttaatgtacatagtgctttcacatgctaagcaatatataagtgttctttaaataaaggaaagaaatactattaatagttttctttttatagtcaattaataactgttcgtatagaaaaatcagaaaatgcaaataaaaaggagaaaaacaaattatttcaagtcacccaaaatgttatatacctagagatcacctttcttagatttgatttatagcctttctgatatcttcatgttagggacatggggtgtgtgtgtgtgtgtgtgtgtgtgtgtgtgtgtatgtataggtagagagagagatgtatttagataatagtgtaaggatttttataacttgtttaacttgtttattcagtagtatattgttgtcactacactagtatgttgtcaatacactacagcatcatttttcttttcctgatatttttaattttaatttttaattttcgtgggtacattgtaggggtatatatctatgggttacatgacatattttgatacaggcatgaaatatataataactacatcagggaaaatggaggtacccatcacctcaagcatttatcctttgtgttgcaaataatccaattatactcttttagttatttttaattgtacaaaaattatttttgactatagtgaccttggtgtgctagcaaatacagggtcttattcattctttctatttttttatacccattaacccaacatttttattttctttagaatgttctgagtaattaatttagtctcaacaggttaaaaacacatccatgatataagaatgtttcccaaaaggtttgttttgtaaatgtttgttgttttccattgctgttctctgtagtttttgcttttgtaattcttgatctgcagatgtgaaagtggctgaactgtttcctctttgaattcctctataccaataatcatttatcaaaatgggatcagctatttccttcccaattttaactctccatatgcagagacatcacactgtttgcaatgaactttgctagattttatgtgaaaatattatctggctttaaaattgtagcattttcatatctaagtgtgacatagaatatttcatttagaaacaaattttctttttgagaattttatccttaccactaaattgaaattttgtttaactttaatttgttcatgtggcaaacatatgatatactttatgtacaattatgggtgtggataatttattttggttattttcgtataggtcagtgatttttatatagcagcctggttagaagtgctcactctgaaatcaggttatctgagtttaggtccaggttcacccacttagggcatatggcctcagtggtcttactggtcttactaactggttttactcctatgtctttagcttacattaaggataaaattatttccccaataagtgggttgaaagtaacttgaacataccaagtgcttactatacctttgttattattttcaaattattattcatgtatttttgaacaaagttaagggacttctagccatgaattttgtactgttacatattaaaataaatattttatgaaaggacagttacctattacaagcaactgtttgctaacctgttggttggcaaagccaagatgattaactatgtcagtgacttagaaagtagaaggagagagaatagcattctgtgtcagcagtgggtgaggcataggaatattaatgaacacagcacagctacagaaaacataaaattatcaggggatacaagatgtgtgtgtgtttcagagcaggaaatactaatttgagtttcttaagacttttttggctttcatatgtgtcaacatatgtttcattttcttttgtataattttaaaactcatttttcaaatgcatatattggaataagttcagccttgaaatttatttttttattgtagagaacaaaatgaaatgaaatgtcaaaattataaatagaaacatctatccatccaaaaatattgaataaagagaaaatattttccttattttttttgcctataattcttccattggtaagcctcatgtgagatttttactttgcgtcacctcccctcagtaagtagtgtgaattagaataatgatataaccaatagatttctttgtttggagttagtgatttttaacaatattttctttgtatatctcttttaaaatagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacaggtaaataccaagacttttcttaagaaattataaattttcaatttcagatattaatgtaaaataattattaaagataaaattagaattatttctgcttctcatatattctattttaaccatgaggagcgtcaaacttaaaacatagaaggatatgatgattaggcttcactggatacgtttatggacttatacaacatgaaacaattatttttgtccttgttttatagacatgtcattcataatatcaaatttataaatggattttctttccactttttctgtagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtacgtagctgttaatgcatgttatgtttcttctctgtccatttctagtgtcatcagatttcttggatatatttcttctttatgcgtgtttcaagtttatgattttgacacaagttcatatttgacatttataactaaaggttaactacttaaaacattatagtcaaaatgtttttcttaaaagattatggtcaaaatatttttctcattcaaggcaatttttatcaaacaaaacaaggatgagcaatttgtactaaagtttattagagctgcatggcaaacactaaagatttaaatccttaattatacctgtcattgtgataatgtcacctattttttaaagttgttagggatagcctaaaaaatcataggctgaaaatgtcctactgcaggttttatgtatattttcactctggtcatccatatttccatgtctctttcatttgcagcttgtttgtcatttctgacatatttttatctgtctgtacatctcttcttatgttggggcttatccctttgtctccatgtcactcttgtctttgactggatttttgtgtcttactcctttctggattttttaaagtatttattacgttttaaaaagttgttatatgtcctgcacttgatttaaagctagtaagttgaaaaaattttgtcttaagagatatatgcaaagcaatcttatattgttgtcacctttgtgacacttcttaatagatcattccctatcccttcagtcactagacttaatggataaaagattatgcacagtagagtttatcctggcattcaacaatctttcatagactttgacattcacattaatagtgatatcttcagagtcctaaatcctaaactaaaataaattttccttaactatcaaataggaaatgtttgattattttacatattgattcacattttttaaaaaggtaggtttttagcactgtatgctgtacagtttttgactattcttgcttttgttcttcttctttcatagttccccacagtaattgtttcctagtttaaaattttatttttctattaccttgtctatctacattgatagtcattgcccagccacatttgattaaacaatttggatttattttgcacacttaatgttgacatagaagcttgtttcattatttaatgtctacattatacatttgcttaaagccctaatgactggtgagaccaactgcctagcaacaaaatatgtttattctcatggtgtgagtttatagctgcatttacatttttataaacctatcaactgtcttaaaggtaacatacatcaggataggaactttgtataatatggtagaggtggaaaaatgaggcaccctgatccagttattttggtgggggataggtaaagacctcttacttctgtttgtctaattttaagtactttgaaatggccccttttctcttctctcttttctttccattcctcaaagatcaaaattagaggacataaaattcccagcagaattgctggaggaaggggcgaatgtttccgttcctttcctgctttcttctcctactcctaagctctgactttgtagcaggactcagaccattcagaagaatgaattttatagaactctcttttatattttggccatgaaaacatttaactttttgattctgagagtgatcctactcttaacataccaaagtgagtgctttctataaagataacttcttactcagttggttttgttggcttttaaaaacactccctaaccagatgcctcagaatatgagtgaaaacagtcagagaaacagtgatgtcagagggttactgatcttcactgaaaatccaccctggtctgaatttctttccagatgtgtgatgtgttacataggatgggagataatgttctttttctttactattgccaacactgagtcaatgagtaaagagtaggatcaacttttaccaacattagagggaggtttcttctgctttccaaaaatgtaagcatagcctccttgaaaggaaactattaatattactaaggctatactcattcagtaaaagaaattgatatttttaaaccttagggttgctttctgcacttaccccattttagtgcatttaagcgttattaacctattcatatatttccactgtataaaaggaaggcattatttgctgggttctgtagtaagctttttattatatatgttttctacttgaagaacaactgaattttggaatactgggtttaagtatctctgacatagagtgttagttttagggccttccaatatttcaacttagcagtcaattccaggacccctcgtatgagagaagataaaggaatattctggaattttttttctctttcagaatgctgattgtaaaatatggtactgtatgccttagacatgataattttatatttgaaaatgaatatataggagtaaaatatatattttggttacttgacatgagaattaaactaaaattggcttgaaccaagtgagaaattttagaaccttttaattataatctctagatatttagtgtcatcaattgcaaggtcattccagtgggaataactagcaaactgttctcacacagtcatttcaggggacattgatagagtaaaggtacatccaggaaggttgcaaatttaggggaaaagaagttcatcatttaaaaacttaatattagccagcctgggcaacatagtgagactacatctgtataaaaaataaaacaaaattagccaaccatggcagtgtgtgcctgtagtcccagctatttgagaggctgaaatgggacgattgcttgagcccaggtgttgaggttgcagtgagctctaatagaaccactacactgcagcctgggccacagagtaagaccccatctctttaaaaaaaattaaaattctacacatataacgtttttgtttgaggatgtttcataaccagaaaggaaaacaattgcattaaagatgatattaacatgttacaaactagcaaacatggtgttatctttatattttcaggtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggtgagtaagagaataaattctgaaagtttttatagcattcaagaccaaaatagcatggaattcttttattagttcacagactcctgtttaatttttataccttaaggagaggagtaaaaataagtgaaataaagaacagaacagcagaagagaacacagctttctagttcttagcataatactcttatctactagagctctcctgatgaagaaaggcaaatctaatggtacctggctgttcttaagaatgcatagagaggcttagcaggctgggattgtttgaagcttatttcctgcttgaaactgacagtgtttatggccccaacttaaaactgcctattacttcaggccaaagggttccatggcgaaattgaggatttgcagcagtggctgactgacacggagcgtcatctgttggcatctaaaccgctgggaggtttaccggaaacagccaaggagcagcttaatgtccatatggtaagcaaagtatttcctacagctttagcctcagaataacaaactgaccatgttatatgggccctggcgatacataaatcgtgggagaaggctttaaagatatagtttatggcagaaatcactgtgtatacatgttagaaacacaccatttattgattaaaattttaaagtcagaacccattctttatttctttctttttttaattttattattattatactttaagttttagggtacatgtgcacaatgtgcaggttagttacatatgtatacatgtgccatgctggtgtcctgcacccattaactcgtcatttagcattaggtgtatctcctaatgctatctgtcccccctcccctgaccccacaacagtccccagagtgtgatgttccccttcctgtgtccatgtgttctcattgttcagttcccacctatgagtgagaatatgcagtgtttgggtttttgttcttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaacagtgccacaaaggttagtgtgtcagtatgttttagaattctagacactttttagacacaaaccttcccccacaaaataagcctgtatgggtggtggtaatataacacagtgtaaattattaaattattgtgccttgaagtgtaaagaaaaacctccaaaataatcagaatgacttaaaattattgttataagcatgattgtctcatttggtttcatggaaggttagaaaatatactcttgttccgttaaaaaaaaaaaacttccttgtttgttttaatggtgatagagctttatcttcaacttcatacttacaccaaatacagacacaaagaggaggcttctgtttaactgtccagtctggagtgttgtacctgtgcgctgttcctacctagatcatgtgacacagttggctcctaagaaagatgaggaaaaaatgatgagacttgaaatgtgggctttctttcatagaaatggggactgtgaaattaaatttaggctactttggatttattgacattttaaattcatattccattgtaattcagcactagaagttctgagaggaaacagtgtttcagattttgaaagagtcccctaattttttacttttgtgaatttacatcagaaattttttaaaatattcaaatactgatgattattatcttgggagataaaagtagaagtacttagaaatttggcaaaagaaatagatcagtgtacatcaatatctacactctttaatagagatataatgttgttgtaagatcttaataaaactgctcttatttggaaataattttgaatttagtgatttgaggagggcgtaaccatcatgtagatgttgtaaagaaataaaacagattatgacagtaggtagcatcatatttatttcacaatcaccatcagtagtttaagtaagtcctactaattcggtgtagaattttctagaaatctttatggtatacttattgttttagaaagttatgtatgtggtttttgttgttgtcgttattggtttttagtgccacaggagacctatttgtttcactggaaaagtaatagactaaacttgtaagtgcttatcttcctttttgaaaaaaaacctgagaaacttccagatagctccttactttcctggaaagtacttgcacagctttgacagtgtccattaattataagtttaatgaactcatgaacagatagatgcttgggattattttctaataatataaatatttttaaaatgttaacttagaagaatataagaacttgaaagcaaagaacctacctttaagaatactttacttttagaaaatattccatttcagcgaactgagtttgggcggggtatttaaaatgaatcttttgtaaccctatataataaatcatagaaatctgtttaaataagtttaaatttgtgatttaaagcattctaaagagttgttgatatttgtaatatcatttcaataaagttcttttgattttgttgtgctagaaatgaagaaaagtacaaaacttacaatattagtttcctgagtttttagctatatctgaaagttttgctttaggatttaaagcttttagtagatgatattgtaaatatatttatatagggctttttttaaagcttaagaaataaatttttgaggtgatgaaaatgttctggagttagtggtgattacaaaaccttgtgaatataattttaaaaacactgaattgtatacttataatagtgtattttatattatatgagttatattgcaagttttaaaacgtataaagttgaaaatgtgagacataaaatatataatctttcagtgagaactatgatttaacccacattatagttgaataaataaaatagaactagtcttaattttttaaatgagaagtaactgttgttttgttggtcttaaactttgaatttgtttaagcaatattttatgtcctgtatagaagatacatacaacattctagttagaagctttagaaatgttctaaatgagaataatattcatagtaccacaagtttgattcttataattctgaataatcaacttaaatatattactgtgctggttatttactttctatccattgcatgttttctgagtgcagaattaaatcgtaccaatgaaatactacattcattgtatcatagtacaaggagggatctacgagagcctctcattttacagaggaaggaattgaggctcagagagatgaaattacttgcccaaactcacagaactaattagttactgtacagtgaaagctttcttgacagcatttaaactgttgcttcaaatcttagcatgccagaatgggctgataatgataacaccattttttagatttcccagtagacagggtatgactgtaggtttaattgttgtttcaatgtagtgaaaagtataaatgcgtcaaggttgccctgagagagcaaacagagatgaatatatgatgaggagcttgggactgatgacctagaaaaatagaactcttaaattttactttcttaaagtgatataacttgagggtatctcaatttaggaagtctgtgctgcctttgaagctaaagaagaaacatataagagtctgatgcagaaaggccagcagatgcttgcaagatgcccaaaatctgcagagacaaatattgaccaagacataaataacttgaaagaaaaatgggaatcggtggaaaccaaactcaatgaaaggaaagtatgtgctttgattaatataatagaatcagtgttttagttgtttcatgtcttggacttggccttatttctgagtagagctatcaggagtagaactttcaatgatttatgtttaaacattttttgtatatatttggagatttcatggggtagttgaaaataatattctgttttaacatgagaacatatttaaaggggtgggatatattcaaaaatagataaatatatagatcaaatgttacttagttatatttttaaatgttaagaactactcaaattctgggtcattaaataattaattctattttaatctaattaaacaaaagactatatatatgggtgagggagagagggaaagcaagagagtgagatgattgtgtatattcttttaagtacttacatttaaaaattcatgagaatggattaaaatgtatattaaattatgaatatgtctttgttacttttttaaaaccgcaaaactgacaatctaagaaatctcaatattgcatgaaaaaaacaataggcaagaaatacaagattatatgccatcactgatggagcataaagtatgtatttcataatattttgagtccccaaattaattgtatgaatgtcaacttttctttttacagattatatttagtaattgtgttctttggttaatttccaaaaaacatgctttagcgtatattaatttttttttagttacagtgagatgctgcttactaggcttaaagggttttggtttgccagtattttagtgaggcccattacatttataagatatttagttaatatattaatagatatgcataaataaagtggggataggaaaggaatctgccagagaatatttaaactgaaacaaacaaaataaccaaggcccttaaacatcacatactaaacaatctgtccttgcagactaaactggaagaggctctcaacttggcaatggagttccacaattctctccaagacttcatcaactggcttactcaggctgaacagaccctaaatgtagcttctcggccaagtctcatcttggacacagtcttatttcaaattgacgaacacaaggtatgtagtgagtcaaatagataggattctcttttcagacaccaggcttttttttttttttttgagactgagtctcactcctctgtcgtccaggactgtggtggtgtgatcttggcttacttcaacctctgcctcccggttcaagcgattcttgtgcctcagcctccccacaggtagctaggattataggtgcccaccagcatgcctggctaatttttgtatttttagtagagatggggtttcagcatgtttgccaggctagtcttgaactcctgacctcaagtgatccacccacctcagcctccaaaagtgctgatcacaggcgtgagccactgcacccggctgacagcaggcctttttaaagtcaaaagcatgcatttggtatttcgaaagctttcgtttgtcctttaaaataatttcaggtttatgacaccagaagcatttttaagattgatctgattttcatttgtttctacttatttcctttttttctgggaaaggtttttgccaatgaagtaaattctcatcgtgagcagataatagagctggacaaaactggaacccacctaaaatattttagtcagaaacaagatgttgttctaatcaagaatctacttatcagtgtacaaagtcgatgggaaaaagtggttcaacggttggtagagagaggaagatctttggatgatgcaaggaagagagccaagcaggtaataaccctttagaaaaattctctgaacttgtcaataaaccacttcttgctgttgaaatatatgttatggatgtacttttatcacaggctgtattaggcataacaatcatggcatggtgccatggtggttctttcctaaaagggctgtggcctcagtttggatgctgacatcactttttgacctggcagcaatttcagcccctggggactaatcttaagaagactgattatagcttgacttcatagacaggctattatcattgaggcccagaaagaagctcagaatttttttttattgggtttgttttctttttctttgtccttttgacctctgttctcataatcagagtgagacatcatacttcattgtattgctaccttttgtttagttcctaagccagactttcttcacaagctatcagtgctgagagccagacatgtagccctcccgacagctttctgaaggggcatattctctgtctgagttggtcggcactccccacctctttgaacacttgttgacagaccttcatttcttctctaatattttgagcagataatagagctccatctcactttgaaattaatttttttgaatcttttggggccactttaaaattttaatctagagattttcacaaatttcacagagaactctcctctccttactccctttacctgttgttaacattccattctagactaaacacaaagaggtaaagttatgcatctctgtgtgtctttgtactccatggaagagagaggtgtacctacctcgcttgacaaatatatatatttttaaacatttgatttttactagaaatttagtgtaatattgtaggaggattttacaattactttttgcctcagtcagctgcaattttctagccttagtgttgtaccccattgttttgaggagttaagctcagttgggtgatgcaaaaagatgtcacgggagtcaggtgtttcaatgtttaatgctaacagtacaaatgtttgaaggcttgagaaatgacaaattgcattgttatagcattacacaccatagaccccattttgaatgggaggtgtgaaatgttcagtgttacaaatgagtcactgggatatactccatctctaatgtttctttaagacagtattaattctcagcctgacagttttctctccacattatgtggtgcaataacatgtgtagtgccggcatttcttgagttatgaacatcagtttataaatgtttcttggatatcagtagccagttgctcatctttttcctcctttctcgatttaatcaattttattttctcattttgtctaattaactttataaatatttgctactgtttttagtgcaaatgtatagcatttcctctatttatatggcttaaaaatagttttgaaagcagaaccagcctcagaacttgtgcgtttgtatcattgaccttaccatccaactgttatagcctgtattatttggagtcaaactacctaacaccttgactagctgtttctactatttatttcttcttcttctaatatctcagtttttggctcagatattgatcatacttctctgactttcacaattcatgtgtctattctagtttccatttttccatgttttaattgattaaagttgtgagagggatatgaaggtttgtaatgagatgatctccagagagcccttacagttttgtgagtctgtgtccttactctgctcttattgttaaatatcttgttgttatttcattattcatgtgctttggtatacaatagatttaattttgattactaaattttttgttaggtatctgttcacttaagcttattgtgacaaataatttataaccaatttcacaattgtatcagaaaatagtacctgctggttcttgatgacaaaccgaaaagaaactgtgctcaaaatcaaatatatatagtaccagaatgtttgcaaggttatagatgccaaagagaataacattgtgttagaacccaaatattgtggctgctcagtcatataaaaccaatatgtgaggcacaggcattgatttgaggatattgatagcagcaataaagatgttgaactatctttgcattaaataggaatgcaatggcctcttttttgtttttgctactttaaaaaatcaatttacaagctttatacttacccctccccatttttgttcctctttcttaacatagggattaaattccctagaagtaaacccagatctgtcaacagacagcagtaaacaacagcaacaacaaaaatacaaaacattttctgagagtttatgttaattattgaacaagaagaaagtataaggaagaagttctttctgtagcttcctaacttttttctaggctcttttagagctgatatgttgaatgaattaaaacaaagtgacagtggggcacagccacaaatgctaagcattatcaagactttttttgtaatttgctgatgaaagcattacttttttcttcttcagtggaaattttgaaataataattttcaggattttcatcactattaatctctgtcttaaaactgtgctagatctcaagtataatatgcttgaaaaattttcagacaaaggtgtgaatttctttctagttccatgaagcttggagtaaacttatggagtggctagaagagtcagaaaagtctttggattctgaactggaaatcgcaaatgatccagacaaaataaaaacacaacttgcacaacataaggtgggtccataattaagaagagcatattgtctcattatatagttcaagatcactttaaaatccttacttcatcacgtgtttattcatcactaaagaaaaaatgtaggtccagtgtgaacctgtattaaatttaaaagctattgctcttcatgttgcttatgttgcaatatcttcactcttcagtgaccatttcactaatgattcccaggttaattgttaaaaagaaaaacatacaaaataaaaatggaaatcctctacaatctaaaacatataaaggatttgtagtggttttaaacattggcatttcagtttttcatgatagctgtcttttcctgtactttctttgacagacaaaatagcaccttgaaggtaattctgtagtaaaaagtaatagatattttgcggtatggattcttttaaacaatagagtgagaaaaattggatgcttgtacctaaattgtaaattaatattttattgtgtttgtgcacgtataaaattccacccaacctcaaaggtacccaaagacatgtttatatagactagaaaagcatgtagaaacattgttttttaaatattttctaccttttctatgcctatcatattttatatcttccacatgacattcaaagagcattccctcccaccctccccagctcttttgaatttggatttttatgtaattctatttataaagttgaccccaccagccatcaggatgaggatgtgggtaaaaggagagtgattcttgcaaagggttttacaattttaggcacgtacatataaattatcgcttgaaacataatttttaaaggctggaaaaattggggtgatataaaatttgtcatcatcaggaggaaatcctggccatcatcttcacataggttggctgcttgcatcagtgggtctaaccttaggaggtcatgattagagggatgggaggaaacatattgagcatctgttccctggccagatgagggctaatgaatggcttgctctgctggcaccctttgcctgtgagctgccacattcaatattgggagcacagtgacagtgaacagcaccttccttccttcccctctgatggcgaaatgagagcttccttctcaaaacagaatgctttatttgaacttgaatgtggatgttgtatcgtgtagtcttatgaaagtatattacatattaaagttagagagtcctataaataagaatatctacctttttaaagtctctatttggcaacagtgacctgtattcaaccataacattttttgtatatctgctttgtgaagaaaatctctgtcaataccatgattctataacactggcattctgtttagcataatatgaaaaaaaatttatggataactgtagaaataatgtgattgtaattgtgttgtctattacttagaaatttccagatgtagttgcctattacccatgacaaattaaataatttagtcatattaaaacactttaaagtatgtagcttttaaaggccgtaaaaacttcttaggtaattataaccttgagattattttagaaaagtgtacatttgcatagcattttactatctagggtaattttaatttgctacaaggattgagaatcactgtattaatgtttccattatattttgtgagtttgtaagcttcccattaagttgacctttctttgttctcattcctgctattgtatattcagtaacagttatctcattctttctactcttcctattgaatatttataaacatctactaggtgtaagatgataatgagaggcctacaaagacaatgtccctgctctataaaagcttatgattgagttgtgtagaaagactatacagatgctcctcaacttacgatgggtttttatccccataaaccctctgtaagttgaaaatacggtaaataaaaaatgcatttaatacacctaacattagcttacaataggacaagatcatctaacccaaaacctgtttctataataaagtgttgaatatcttaggtactttattgaataggtgactgaagtatggtttctactgaatccctatggctttcgtaccatggtaaagtcaaaaaatcctaagtcaagtcattataagtcagaaagcatctataattcatctccatttattagggatgcctctgttaatgcctcttacctgtttattagtcccaagaagaaattcgcatttttttcttgttaaatatttaggagtttcagaaatcactcggagccaagcattctgtctacgacaccaccaacaggactggacgttctctgaaggagaaaacctccctggctgatgacaacctgaaactggatgacatgctgagtgaactcagagacaaatgggataccatatgtggaaaatctgtggaaaggtaaaatgttctttaagacagtttggttactctgtagacctctttcaaatacacagtaatggtgctttgcggggacatttcgggaaccttaaatatttcctttgcctgaggaacttctgcttgtcctaagtatcccacacacatagcacttgcattgagaagtctttgctgttcattaatttttaactactcattacaataaaaagtgatatcattgtccaagcttctgccatctcagacttgactacacccactgcttctgactcgtcttcccatgtccacttttatcacttctttgacttaatttctacataactactggatagtcttttaaaaatgtaaatggaatcttgtcattcccctccttcacaccctttggtgacttactactgggcatgcattgaaacacaggcttcttaatgtgacgtgcaaggtaccactgatctggccccagcatttctttccaactccatctacccctttctgatctccctctttctcattacatttccatgaaaacccaagacatatttcaaaaattttaagtatttaattgagtacaatagtagtagagttcaaatatattgtacatgtttccaaattttcccgctgatccttaatcttaatgatttttgtcagtatcaagattaaatagattatattcagttctggggaactcacagtaagtttttgtcatgttagttttgaaaaaatcctttttttttttttttttttttttttgagacggagtctcgctctgtcacccaggctggagtgcagtggcgggatctcggctcactgcgagctctgcctcccgggttcacgccattctcctgcctcagcctcccaagcagctgggaccacaggcgtccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcctggcccttgaaaaaatcttaaattcctcagccacagcatgttacataccttttccagtgttgtatgcatggttttatttacaagatttttgaaaagacaaaaaaataaagtcctgacaaacggatcaatgaatgctaggggtttgaaggcgggggcagggcgtgtctataaagagacagcacgaggaagatttttgggatggttgaactgttctggatcttgattgtggtgatgattacgtgaatctatacatgtgttaaaatgtatagaagtgtataccaaaaaatgtcaagtttactgcctgataatctaaaacaaaattttaaaaatatttaaacagtttaaaaggcttatttttatgaagaaacatgaagggtccatggtttccaaaggtgggaattttcctggaacagatgccatgtatttaaggaataagaaagaaagtttagaaaagttttgtctttttcctaagaagagcaaagaaacaacaatgaataccaacatactgctcttccccttgagtaccactcaaccttcatcaattaattttagatgttcagatatatgagtgacgttttttgttgcaaggatcaatttttctacctttttccctagacaaaacaaattggaggaagccctgttattttctggacaattcacagatgccctacaggctctcattgattggttatatagagttgaaccccagctggcagaagaccagcctgttcatggagacattgatttggtgatgaatctgatcgataatcacaaggtattgttatctgggacattttattttatcttgtttgattattctgagtgtacaggaaatgtaaaccatttaaattagccttttaaaatcagaagactatagatcatactacataacagtctttattgttgaaatatgtgtccgtttgagcagaacctggaagcaaactttaaaagtgatggggaagtattatttagtgtcagtgaaatacttttgcttttaattaccagatctaaaacctttttagaacttggaaagtgatttcattctctggtgctttaaaacagatttcaagaatgttttactatctttagttatgcacttaaacaattatgtaataaaatttaaaatcattcattcagtgacctgacactaagtcattgcataagtatgtagatttgtgacatgacccatggtggtcatgaccaactgcttttaaaaataccgaaccaaaactgttttaaccttgccccttgaattatagcagtttatgagtcagcagcttatgctataagggatttgattattatttacttcgagaaaactggcttccttgaaatctcctgatatgcatgtaaaactgtcatgtcatgtaaatcaaaggtaatattcaaggtgtccaactaagtgtaaggtccaaaataatgaccaaatgatataaagcaacttagccttggaaacaatatgaagcatagtactaatgtagaatagttgtattggagttgactttatataaaaatgtcttacatcactctacttaaattcatcttgtatttcttctctctagtatctgagttcagaaaacttattccatttataatgttctctttatattggttatgctattttgatcttaccattctttttaaaagtcttattacatatttatttttccttttttctttctattctatcattatacccataagagagtttgttacacctgaaaagtgaaacaaactaaattaaaataaaataaaagaataaataaagaacattggtcaagtctacaaaagttaaaaatttaaaaatcacatggctttgcttatattgaaataaatgttttgtgtatggttaatacaaacttctctatttcctggcatttattcaatgagtaatgaatagcgtaatgttactttttacataaatgccatttctgtaaactcactgtctaaatatttactactctaggtaattgccagatcttttatatattaaaggtcatcaagaatgaattaatcatttagcattagtaatacaactggaaggctcaagaagttcaagtatgtaaaaatgctttggaaagtcttctgaaaactattggactagtcctatcataaatgggatatttagatactgtaccatttgcatgtgtgcttgtgtgtgtgtgaatgtgtgtattggtgtatacgtgtgtgtttgtgtctttctgcaggcacatctcattttaactgttagagttgaatcagtcaaataatcacttttgtgataggctcacttttgtgaatgatctgagtatcagaatagaaacctatagatatggccaaatggtaatattcatttatgatgatttttttaaaaacacattaattttattgtgacagaatgttggttattaatgtttgaaagatctagttgcatacacagactcttggatcaaaaataaagagctctgggctcacttcttagatcagtctgtggccaaaataaatgaatttaattcctggcacatcagtttgtcaaaattaggcaggaaaaaaaaaaaaaaaaaaaaaaaaaaaaaagcaaacccagaagcttttcctctaaggtgaaagacaaggatttaagcctctaaaatttgacattatgagttagtacctaagatattatgaaagaccaaggagtgttataggaataaaagaccatctgccaacttcctatggaattccctgccattatctctaagacatccgtggtacacacatcaagattgcttagtcctctgttaggttcttagatacatctcttagagtagtgccaaagccagcatccacttgacattcacactagtgatttgagagaaattgggacaccatattaaagaatcattaagaaaaggaatttgttgcattgttttatgaaattgaaataatgaaggctggctgccattatttaaatccaatatgtcattttaaaataagataatcttatcttgttttctcatgagaatgtgacaggactgaacaaatttatacaagactcttcttgatggtgctcaaataggagcagtgtgtcatttatcttctgaagatgctgccagaaatatggttattaaactgtaggtcttagatatctttacatgatgttatgtgcacatatatatctcaaacagtatgtgttgctgttttggttttgtaattaaaattaatttttcaaaatatggtcttcttaggccttccaaaaagagttggggaagaggaccagcagtgtgcaggccctgaagcgctcagcccgagaactcatagaaggcagtcgggatgactcctcctgggtcaaggtccagatgcaggaattaagcacacgctgggagaccgtgtgtgcactttctatatcaaagcaaacacggttagaagcagccctgcgtcaggtaaaaaccatgtaaatgagagctgggtgtaatgggaaaagtattgaaacctcaacaagaactattctagtaaaaaattgtgaggccctcgtgtctcaatcaggacagtctgaagaaggaaattctaatagcaacattgccttgatccttctcccaccctccctcatgaatttaaattactgctagagggaggcattctaatcttcacatacaagtgctgcgtgagtaatgtctcagcttggaagtatgatggactgccattcatctaaaatcaagttgttaaagtggtaaatttttcttcatataggctttttttttaatatattaagtgttttcttgtaaaatatgtgtatctctatcttcttaatgggagtaatgaagcaattaaatttaaaactttttttttttcattgaagggatgaatccactatacagttttgtaaattgtgctaacaggcatatttgggaattttgtttggggtgtgtgtgtgtgtgaactcttaggcagaggaattccactcggtggtacatgccctcttggagtggctggctgaggcggagcaaaccctgcgtttccatggtgtcctcccagatgatgaggatgctctccggactctcattgatcagcataaagtgagtaatatataaatgctatgtaaagctaaattagaaaatcaaagcagggaaaatagactcgggattacaaatatcaactgcatgaatattttccttcctgagaaatacttaaacacctgatacatttgagagtgtacttctgtccacattgcttacatatgtatgtccccatgcacccacacacatgtatgtgtacctgtcttttgatgtttccttttcagggaaggtagttactctgtttcctatctcaaggaagcatattgatttatctaggctttttggcttttgaccaaaattggtcaagattgttgcagttatcatgtggatttcaaaaataaaacctctttaacgagcagtttggcatttataaaattatacccgtaggattgtaaattagtaattttgccctttgtaaacaagacacacaggtaatttaataactcatctttgaatctatttttaagcctctgctgcttctgtttttaatcaagagccttttaaatcctttttagaagaaacctatagtatacattaaaaactttaaaaatgaatttcataagccaatattctattgaataactaaccaagtctaaatctggctattgagttttcaaatcaagatctttcctgcggcaatgcatgaaacttgccaaaacccttcagagagtaatccaaatatctcttaacaaatgttttttaacctttgactcaaaaagtcaagaatttgaaatggtaacgctcaatgtagtgttgatgtcagcatttcctattaactttaaaggatcttttaaacaccagtaaataattttgtcttttgaagtcaggctggaaatacatcattaattctagtgtagcatggattacatcatgtgtggagacttgttatgttaattaacaccctctatcaaagatgggttgctgaatctatagcgatgaaatattgccatgtcatttaaaaagtggtacaagcttgcatagcattttctggaagaatgaaatgctatatattatatacaccgtttaaatttgaagctagaatataagaagaagacagttacatcaaatgtattataaatttttgagtcagttcaatattttgaaaatgtagtttatattatattactgtgggcttaccatcagccagcattgagttccattaacatacttaggtttgggtctcagagtagcaataaatatttgctggacaccacttaaagcccattgtgcatatctaacaccctacagaaaggagcctatttgtggtatcaccactctcacaccaggaccaggaaacctccagaaggcacgtatccagagcaggggtagtggtttttacaacaaattatttttaaatagcataaaattacctgtaattttataaaacatttcttaataatattttgcagtaacactattcattcttttccatctcctctgcttcccttcatacattcaccattcaccattcaaagaaaaacagaatatttaatttcttaacaccagaactggagacttcttagcatatccagtttctaaaaatggcaagctttcccacatgagaacaaaccagtaaggtaaggttcagactaggttggaagggcatagaattcagtggaatgttgacagtccagtccaccaaattctaggtataaccttggctcctctaggtgtagaagtgattgaaagtacattatttgtatcagctgttctccaggggaaacacagatgttagattaacctatttttttctcttccttataatgttggagttttaaatttttttcatttaggaggatcctgtattgggaaaatgataatttaagttatgatatttaaaaagtaggtgttatcagagtgtgctgtcaattgaacgttgactccattatagtaaacttgtaaataaaaggtctaaaaagcatttattcagtaaatcacaactcttttgaaccaactaccgggaacacaaaaatgaataaaacacagtcttttaatcttgtggaccgaacagtctaacatagcaaaatgccagagtaggaggtatgtcacagagctgcttcacagaggttaaagacaaaaggccacttaaattagaataaaacatataaacatatcatataaatttaaattcagagagtacatgtacacgtttgctatatgagtatattgagtaatagtagggactggacttgttttataccagtcatccaaatgttaaacacggtacccaataggtaatgtttcaactctcaggcccctgtgatcctccgtgctttttggagtcttcagtgtctattatttccatctttatgtccatgtgcgcccattgtttggctcccatttatacatgagaacgtgtgatatttgattttctgtttgagttacttcacttagggtaatgccttccagctctatgcatgttgctgcaaagtacatgatttcattcttttttatggctgcatagtattccatggtatatatgtaccacatttttttttaatccaatcaactgttgatggacacttatattggttctatgactttggtattgtgaatagtgctggaatgaacatatgagtgctgttgtctttttgatataatgatttcttttcctttgggtagataccgagtagtggaattgctgggtcaaatggtagttctaattttagttttttgaaatattttcatactgtttttcataggcatcgaactaatttatattcccaccaacagtgtataagcacgcccttttctcagcatccacatcatttgttgttttttcactttttagtaatagtcatcctgacttgtgtaatatgatatctcagggtggctttaatttgtgtatctctgataattagtgatgttgagcatttttcatgtgtttgttggctgcttgtatgcttgtatttcttcttttgagaaatgtctgttcatgtgtttttcccagttttcaatggagttgtttgttgttttcttgttgagttgtttgagttccttgcagattctggatattagtcttttttcagaggcatgatttgcaaatattttctcccattctgtaggttaactgtttactctgttgattctatcttttgttgtgcagaagcttttttatttaattaagtcccatttgtctatatttgtttttgtcacatttgcttttgggatctttgtcataaattctttgcctaggccgatgtccagaagagtttttttaggttttcttgtatagtaaaacacctatatttcaaagtgaacacccctgttcacatagtgtgagtagcatgggcatcatcgatctctgcggcctctggcactcattgtgtaatcaagtaatcgctcttggtgcaggggtccagagagactggggtgtttgcagatctctaacattctatatgagattttggaagcgtgtcacatttttaagggcaaagattctcattttgtaatcacattttcagagttctatgatctgtcttatctatggatatagttctgatggtagaaagtacaattaagtatgtgagacatttgtaaaacatttatttgaaagatcatccttgaggatgtcaaggctttgttcattccgcttgctggcagagactggctagaactgccagaacagaggagagtggctcttactggcattttaaagggacagttctcacatgggctgacctgctgtcaggctcactcttccaacctccccttcactttttactgcatagacactttgggccctctctcccatacccccaaacatttatctttccttacccaggcttctctctactttgtacttttttattcatgctgccatatttcctggcatagttaatgctattttaaatattaacctccttaccttatttgttagaacttatttttggtcaatcagtattgtttctatctctagcaatactgtctctcccaatgctattctccattaataacataattatatctaaatttgggagagttatttttttgtataatacagtttttgaagcatgaaatatcctataaagttggccctctgtatccagatattcaaaaataaaatggttaaaaatattcaaaaataaaatggatggttgcatctgtactgaagatatacatacttttttccttgtcattattacctaaacaatacagtataacaactatttacaacaatttacattgtattaggtattattagtaatctagagatgatatgaagcatatggggaggatgtacttaggtcatatgcaaatactacatcattttatatcagggacttgagcatcattggattttattatgcacggtatcctggaaccaactccccttggattccaagggatgactgtacttgtattttgaagtacatgttagaaagtactttgttttctattttgtccccttttcctccccaattagtagatgattttcactgtgaataaaccaattgaagtttttgtttatttgtttaattctggcagtcaaacaaatgccaccagagttttgttttcagccaatgccaacagttaattgaagtctttgtttctgctgtaggaattcatgaagaaactggaagaaaagagagctgaactaaataaagccaccactatgggcgacaccgttttggctatctgccaccccgactccatcactaccattaagcactggataacaatcatccgggcgaggtttgaggaggtcagtgtgtctcagataatcttcagagtagcaatagctttgagagttgaggggtgtgggaaatttcaggaattaagatgcacttatggccatgggaaaatgagacctctacatagaaaacgttcttttaaatacgcttcttgtatgcattacaatctctgcaattcacttttctttaaaagctcaaagaaattttgcagctatgtccctggaaaattagaaggcaaatatttagtacactgtataacattttggcctccttccacattgtttctgttgaataatccagcagttggatggtgtttcggagcagtatatactggtggagtgaattggtatacataaagtgaattaattctgtatttaatatcttagcttttttttttctttcttttgacggagtctcgatttattgcccaggctggagtgcagtagctggatctcggctcactgcaacctctgcctcctaggttcaagcagttcctctgcctcagcctcccgagtagctgggattacaggcgcgtgccaccatgcccagctaatttttttgtatttttagtagagatggtttcaccaggttggtcaggctgatcttgaactgacctcgtgatccgcccacctcggcctcccaaagtgctgggattacaggcgtgagccaccacgccctgccagtatcttagctttttacatttctactctgtgccacatggagtaagcttacctgatccttcagagaatgcatatttgaactcaaattagaaagcaaaaggaagcctgagtgattgacatgcatctttaaattctgaagatgatgaacatcatcgtgggctctcatgtcctcctcaagccagatcttgatgccactaatggaatctaaaaagaccagaagcattatgggtctagctcaggatgatcctaattttcatttaaaatttatttattttacatcactgcaattattttactaagttggaggaaattcagagaaatttctgtttctctgacaggtgctggcctgggcaaagcaacatcagcagagattagcaagtgctctggctgggcttattgccaaacaggaattgttggaagctttgctggcttggttgcaatgggctgaaactacacttactgataaggataaagaagtcatcccccaggagatcgaagaggtgaaagcactcattgcagaacaccaggtaaaataaatataatcctaactcctgttaaccattatctcagatattttctttctttcactgctgtacttctcaaaacattgctttgttctcgttattttcacttcttcagactcctcagctccttacaactgtgtttccaactctgcaactgccctaaaacctctctttacaggaaccctctgtgacctttgcaaaactttccttctttgtcctctgtggggttacactcgtggtattgtctcacgttcactcctgccctcccttttgccttctaaatgtcagctctccttactccttaggtgttatcctcagctctctatttctctcactctgttccctcttttggtgatctcacccacctccacctccctggcttcagtgggtacaaggtacccacattaaggtatccacattaaatgtggatgcattatgttcacattgcattaatcaaacaaggtttgattgctctgcatttttatgtctgtgaagatgactgtcatcacttgaaatacatcatatgaaaaagggaacgtgttgtctttcttaggaaaagcagccttcctatatatccttcttgttttaaactcaaatgatgggtgtcacactcactttgatttacttgattgctcacagtttgtttaatatgcatttacaaagagaaatattaagtgttagctcagttggttaagcaattaatgttgccattattttgtgtgtgtgtgtgtgtgtgtgtgtgtgtgtgtgtgtgtgttttaaaagcctaataagacatcaatgtctataatggctctaagtgtaccaggtcatgtttcctgtgatcagaggtattagagttcttcagtgtgacaaatattccagaaaggtgttacttcacttttcccttttgtctgggtctccttttccccatcacttttcacagtctctgcctttccacagcctttgctgcatattccaaatagagggatacctagtaaataataataataagcccaaggagatgagataagcagtggcaagatagttaaaccttttaaatacaatggtagtatactttaacccaaatagtttttaccacccttggaatagcctatttatgaatattttgatatgtccacattaaatgtggatgtattatgtcataatatatcaaagagccatcttttttttttttttttttttttttttgagaggcagggtctcactctgttgcccaggctggaatgcaatggcacagtcgtggctcactgcagcctcaagctcctaggctcaagtgatcctcccacctcagcctcctgtgtagctgggactacaggcacatgccacctggcctaatttttgaattttttgtagagacagggtttcactatgttgcctaatcaaagccatcttaaatatttcaaatatgtaggtgaaatgtgccacagaaaagttcttggaaacatcccagctacctagtttgtttgtagacagatgcttactaaagattcttctgaggagcttggaaacttgagtttggttgatgcacagacaggttattttattcacatgacttctcccatgtgtccatgcaggttattccactaaaacaaattatttttattttcaatttactctctttacaagcattaacattttatttatttatttatttatttttgagacggagcagagtctcactctgttgcctaggctggagtgcagtggcacaatctcggctcactgcaacctctgcctcccaggttcaagcgattctcctgcctcagcctcccaagtagctgggactacaggcgtgcaccaccatgcctggttaatttttgtaattttagtagaaatggggtttcaccatattggtcaggctggtctcaaactcctgacctcaggtgatccacctgccttggcctcccaaagtgctgggattacaggcatgagccactgcacctggccacattttatattctttagaaattagtaaatgcctgcagtatgatggtttagattttttttaccctaaagataaagcatatgatttattcttcttcagaaataataacatggttcttttatccttctgcttttagttcatttctaaagacggttttctgtagtaactcttatttgattgacatcatttctttcatttcagaccttcatggaggaaatgaccagaaaacagcctgatgttgataaagtaacgaagacctataagaggagagctgctgatccttcctcattacaatcccatattccagtcttggataagggacgagcaggaagtaagcagtgatcaatttctttaaaatgtcaataaataagggagctaattttcttttattttgaattatttgaaatttgggggcaattggtgattttacatgagcacttgatatcatgaaatactttctagaaggaatacgtgtgctcaagtattgtagaaacttatttaaaaataaagaaaaaatatacccaggtttctatacgtaactttattgtcttgaagtgtatctttcatattagctagaagaaaattgaaaaaatttacagtaagaatggaaatcatcacaccctttgcattgtctcatttgtcttccattatatatataacattaaagctgaacataacaaaaatgaccatgacgtggataatcttcatgacttagttgttcattggtgaccagcaatctcatagcttttgcccatgttcatgtgacttcaggctctatatacttcttgagctactttaacaacatgacatgacattgaaaacaatcatagttagcttggagaagatttaaaaagaaacacaatttgtgttatatgttttatgcgtttctgaatagaaatgcattttgcgtattacttaattttttaattaaaaagaaatgatgtcggagctattgtaattacttactacacaaggagacaaggtaaactattaagagccctatagccagactccttggctgtctccaacacttaccaaactgagaaacataaccctggacaagttacttaaactcattctgaacctcagtttcctcatctgtagaagggtataattataacttcattggactgcagtgagaattaaatgagctagtacatacaaaatgcttaacctacttccaggcatatagttaaatgctcaagtatttgttgtactataaatcctagctgggacacttaacattctatatgaccctaggctagtaatgtttctaggccgtatttagccatttagtaagatgagaaaaatttgttaaggtcattgttttgtgaagttgttgagacttgtggaaaacagccagaaagcaggaggaaagtttagtaaggcagtaaacttgggtttgagactatgcacaggaaacatgcaatctcagtggaaaatggatgtgggcgaaggctggggtcccatacacatgctgccatattttattggcatttgtgaagtgtcttgctttgactcttgtgactgcccagtgcctgctgccctcatctgctctccctttctgccttattctctaggaaggacagctgggtttgatgtaagtcattgtaaggtagtctcactggcctgggagatttcctttaacaaagtggaggatcacagcatgcttcgttgtcattgaaatggcatgaattttaagctggaagatgttttaagcataattcattgagagaggtttccagtatttaaatgcccctgtccagagatatttctttaaattgcatgaacagtgtgtgatccttaataaggaaaacagatttgggccttgacattatacatcatctaaattaggatacttttacttgcgtaaacacgtaattaagttgatgcagtcttagctagaagcaaaaaaggtcaagccttaacacatttcagcaccctggaaactgccatcctaaccgaagttataccttcacaggaaaacgctttccagcatcaagcttgtatccctctgggtcacagacacaaattgaaaccaaaaatcctagggtaaacttactggtgagcaaatggcagcaagtctggctcctggcgttggaaagaaggaggaaactcaatgatgccttggacagactagaggaggtttggaaattcataccctcaacaccacattgtcatttgccctcattcctcataacacattgccattgccaaaatcttggtattttttaacttttctgataataagcaaactcttgctatttgagtacatttttaaatttccaaaataaataccacaagtatgtgtgattttgtgaaatattgatatatgggatttggatttagggaatcaatgaagtaaaaaaaatgattatgttttaacaatcagaagctgattccttaagaataaaatctaacttgacataatgtttgctggtgatgctgcctggaaaatataatcttttatatttcagatcttttgattgtgtgtatttgattacctaagatttcaagttttagattctgcaattgggaaatttttagaagccctggggagttaagagagtggctaatagtgcagagggagagagattgaagggttaggtaagtgctgttgatctggacctgctatcccagtgagcatgactagtggtggtacttagagccggaccacctttatgactttggcattaatcagaaatttacagcttaagtttttaggaattttatttgtaaagaaaaatcagtgacagcaatggaatacattttaaaggcaaaatgtttctaagtcccctttgcaagatcatacctctttttgaaatgggaaggatatgtgtactacctagagaatcatttcaaaagttattcatatagtatagtctacaattttagtacagcattaactcaatcaaaatactttttgtccttttagctgagggaatttgctaactttgattttgatatctggcgcaaaaaatacatgcgatggatgaatcacaagaaatctcgagtgatggacttcttcaggagaattgataaagaccaggatgggaaaataacgcggcaggaatttattgatggaattctttcctcaagtaagttccaagacagatgactatgactgatacaatttttaaaggaaataagcacattttaaaagtgtgggtctggtaaacttgtgttacaataaagcattgtcttataagttgcctaggaagtcacgacccttaaaaaaatgtttttttggtaaaatttgtggctctggagtcaggaacactcactaactgtgtaatcacagatatgttgttccctccactgaggctgagaacttgttagaataataaagttaataatatatgattcttaaggtgttttctgtgtgtgtgtgtgtgtgtgtgtgtgtgtgtgtgtgtgtgtgttgcctggcatatgtgtaataggaagtcaataaattcaagtccctttttcattctaattcacattctgatctaactttgtcattagtaggaaattagaactctataaaacttcttaagatacttatcacctttttgtttgatggcccaatcatttgtatgtgatttccctgacagatgttactagatgtcattcttaaggtaaatttcatataatttattctttgactagcaattgacccatataaaattgccagtgttaaacattttcaacctaaaaaaacagcattttatatgattcacctaaatagtaattaaagataaattaagattatatataactcttcatttgctgtgatgtaaatcagttttttaaaaaaggattttaatatatttgatcactgatgatttaaccagctacactgagattgaaatgtgcaattgagaatgtcttgagaaagaactaacaagtcactacttaccattgttttcaaaattttagagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtactcattatcttcccattgcgtacaacactgatagtatgttctgccacgatatcatgcacaattcatacaaccattttattttcactctaattgttgtgtcaaagttttaaggattgtactatgtaatattgacattaaagtaaatatttcatcattgtttttggcaggtgacaaggcaggtagctaagtgtaaatgtgcaaagcgatttcaagttgagcagattggtgataataaatacagggtaagttttcaaagtaatgttgtagttcctttaaaggacataaattgaaatctgtatacaatttgatctccattgttttccaggagtcttatttatttacttttttacctcatgtcaaaatttaatggtatatgaaactcttacatttaacattttaatttgtataacggcagcctgcattttgcatattaggaaatatctttgacatctacatcatgcacattacctttaaagaaaaattcacaagaaaatactcaaatctcatatatttaggttgcttcatattattttatattttgttatgattagaggtaagttttcagatttcaaacaagaaagctactctaatccagaaccacaaagttaaaaatatggactcattttaataaatatgaaaagagaggataatgtcttctccacttgtgcagtaatttttgcttttattcaaaatctcaattaactcggttcactctcttcaaaacagaagaacagtgtgacttcattactctttctctatttttttttttctcttttggaacatctcttatatgtagtagctagataagaaatgtgctgagtttccccaatacagtgtgctacttctaaatgaaatattatttttatttttatacttaaaaaaataatcatcaatgtattcaaaattttaacttaaatttgaaatcctaagattttcaaaaatatgtgtacagaaaatagtctgattatttggtttgaaattgggacaactgggtgcctgcacatctctaaactagatactacatccagaagcacagagtgtgagtatgtgtgtatgttctagagtcatacagaaagtttcctgttgaactaattgtgtctttcttccatttttcatttttatcagttcttcctgggaaatcaggtataaaccagtggaatgtattctcaagttcctgatgatttttttttaactttaattcatagtcattaaagcttgccatggccaatctttcccatgctgtctccctagctactacattgttggttggcgtggtgtttctgtaaacgctataagggtccttgatccaggattcctttttgccttgtgtctctcagatgaggagattacttttaagcaaaccagataatgaattgtagcttggcttgctacaatgttacgaatgcaatttttaattcccattttttataatatgagcatatattttatgctagtactcattggaacacaaatttgattctccacacatctctgtgttaggctcattggtgtttaactgtttaggacatacggtctacagtagctgagaaggatcagcctcaggcagtgacacaggaagacagagagccaagaggtctccttggcactcagccacaagtaacaagttctctccaaagaagctatttgccatttgttcaaaatcaccaattttggggcttggcatctctgagtagaaatgttaactcagtaggctttaagtaatattccttttgaggaaagttatcgctataatatatgcagaatcttaaagtcacattttatgccatcttgatcgaatatttatattattggcacttaagtcaatataaaatgtttatgttgacatttaagtcagtataacctgtgtagtggcactacatcatgatcagaattttgaaactaaggagatactctgttttgatttaaacatgttcatgaagcttttattttattttattttattttactttggaaagaaccatgctatctatagtatctgaccatattacattagatatgactctgccactccattttaaagccatattacatctcaagcttcaaattatctattacctttatttattgcaagcaaataatttatttaaaatagaaatagttacttggaatagatttttaaaacttccattagttatactataatactgaaatgttacttttccattcttgctattttcggagtcagcaaatgggagagcatcttttatttgcagagagaatgagagaaatacctcaaaaggttttactcactgaaagcacagtcagcaacattagtctattttctcttgtcttgtgatttggttactgggaatatttagagaaattctgaagatgatgttagttgtctggagaatgcctaattaaaacagaaaattatttgtattcattacacttgaaatatcatctctataaggaacttttagttatttccttataacttttgttttgagtataatcttgaaccaaaatcatctagtcccattatctggttccttaagggtaattttctttaaatcccctcctttccctttgcttattagcggcaccaatttttttctaacaaaataaatttacacttttatttttaaattttaattaacatttcaggaagaattataggaaagtttaagtctcaatgtttaaggaaaaaagatttagaaatagtggtttttaaaagtttgatggaaaaacacatgagttcctgctggtgcattttacatgctttctaggtccttctgagttttaggatcctgagggatttggttggtattgtttttgggttttcttcttgaaactcagtattaaaacactgaaaagtagcagatttttttctacctagagttttctgtttatccatcatgagcccaaataaagtcacaattgtatgttacctgctttacaaagaagccatttatgtttaattgactgttcattttgctttcttgtctgctgggatgacaaccgtgaaattcagtctggtagtttttatgagttggacatgaacctattagaaatgatttaaagtataaaatcatttctcacaggctttcaaaacataaacctgtgatcagaaacctggaatctagaaatttattcaggacttgcagaatttgtagcatatctacattattggagatctattgaaagggcaagaaaaagatgattgcctgttagtatcaacagttatggtacagacaactatgagagaaaccttttagatttggcagctgtatcattaataatgtgtcattggctattctaatattacagtaatctaaaatggcatattaatccagcctttaacaaattggtttaccagatcattagggatgcagaaattttagttgactgtgaaatttatatgagtcatactcatttactttattctttttaagtgaaaactgcccttacagaaaagaaaatgagtttataaagatttctcacagagttcagtggaaaacggttttactgtaagagagagtttaatgaagaagaatcaaagcttattaaatttttcttagaatcattttattttggataagccctgggcaagtgggccagtgcttactttcatggctatgtttaattcctagaaacattttaaaattactgccttactaatattgtttctgtcataagaaagaaaaataatttttagaccaaagctttggtagtatacttgataacctttgtaatcttttttttttcaaactgtttcctttgggctaaatcagcatgcagccgtctaacacaaatcattacaaacccccttttctgagattttactaatcgctatgaactaagcaagaaattaaagtcggttgctttagctactgcaaattgcacatcatcctgtagtttagaattattattgacaactagaggttctttctttcttcactgaacagtttggagactcccagcaactgcgactggtccggatcctgcggagtactgtgatggttcgtgttggaggtggatggatggcacttgatgagttcttagtgaaaaatgatccttgcaggggtaaggagatgcttatcatgataacatcatgaaagtatttcaattttatattatatccagcaccaaaacatactgggcataattttggtcatttattccaatagtgaatgtttcacattggtctgtcagcctaaagttcccaaagaacctgtggcagtcatgtaaaccatattcttctcatttttttctttcttttttttttttttttttactttttctggataaatatggtgggcgggaaatactagaatccattttctttaggagacttttacatctacgattttccaaacaattataccaaccaaggaaaggattttgtctgttatgacatagcaaagtaagagaaaagaaaattgaggtgatgaagaccgaaaatactggataataaaagtttaaaggtcaaagtttttatgaaatgaagagcaggtgaggaaagccataattaaaaaatttttaaataataatccaatgctaacttgactctttgaagttgcagattagaacattaaaaatataaacatataatactatagctctctacatatcttccagcccaagtcctaagttagcttttaatttttctgttttgagatccttctgtcaatttttaagttctcaaccaatttacgttacacgtggtcatttgattgcaatttctaattaggtaccaattactcagtaggcccatttttcttcccccccaagaaaaaaacaataaaattgttataattttcttttacctgtgagctcactgtaatcctttttagcaaacaacaaatgttcacgtcagtgctgtctccttcagctaccaagtgggatcccaggtttcctcctgtagggcctcttggttttggtgatggtgtcaccatctggtacacatagacatatcagtcatcaggcttctccaccaaggccaccatggattgttatacatgttatacagtagccctgctctctcctggccaaagacacacctgcgagagaagtaaaacaagaacaaaagctcctgtttgttttatattttgaaaataatgtagcctaaggtaaaatgcaactccatttatgaagaaatcagaatacatagtgttctgttgggttgcttaggaaggttagcatggctgtggcacagtcttccaaatacatttttcttattgagccaatcccttgagtgcttcttttcctgatgcaacttttcttctaaaatgtgtgctaaaggccagatgtgagcaccctttgcatattcaactactgtactttgtttcttcttctgctaacagtattctttaatgtgattggtatcctgtgtcattttttctagttcatcatcatgggagtaaaatgttacgttcggaatcaaactcttcaattactactactcagcctactataggttggcaacctctctctttgcctctcccctctttccttttctctttcctacttttccattcttgcttcagtcatttgttttaaaataacatgcttcatccatcgcgtatggcttaactcatatccagctgagctggtgcttccaaatttaaattctgaaaatttgatgactttggttgtgttacacatgcaggtgttataagtgatcaaacacatgctaacacgttgctcaccgggttcttgtggagtgttctccgtgtgcgtatgtgtttgtatgagtgctgcatcactgactacctcacagatccttgggtctggtgtttgttattgcatgttggtaaaacagtttttcaaggcataaaataaaaatactagctgcctcatttaagtgaaaaatccagaagtttatatgttgtcatcatgactaacaagccatcaatcattgtgtgtaattatattctttaatttatccccatgttgaaatactggcattctctttacctcaatagtacatgcaaaagacacagtccctgccttactggtctgtcttctcagtgtgatgagagggtaatgaaaccatgtgggcatctgtagctggtggattaatgatattttagcatgagctttccattttcatgctgacactttctttaatagtggttattcttgctggtgtctagtgttagaataagcacactttattttttcctccccgaactcacctgtatccaaaaggaatgcattgtaaaggaatgcatttaactttttgttatgctgagttggagttggcatggcaaaaagatgttcttgaaattctcaacgtgatctctggtgccaggtggccgttcttcccattaacgattgagcgcctcttcttttccgtcttttctttgtgtgcattgttgtgtgtgtataacccagccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaaggtaagactcaggatgaagacttttcctccacctttgcaatcaatgtcccaagtagacttttgaatgttctatttagggccctagaatttgtaggaccagctatctccatttgtgcaccttctcatactgtgggaaatacaggaatttttttttgaatgtatgcttttgcctagtggcccacatagagatgatctatttaggaagcctttgtgatcttccagattgatttttctttttaaagcttcattcatttttttggtgtgtatgatttgccattggatcttttcacttattttaaattattattcttactgtgaaatgtgactctttgctatgaatatctctttctgtggctttgttttttttatctgctatccttttcatttgatttgccattgttccatacagattctccatcctttaacacgcaattatggtaaaccatggttgacaaacagcaaaatgtcaactccttgtaaagcagcagagtgctcagactttcccgtgccatctgcagaggtattgtaaggccccagagtccagtcttaacattctcctttaactgaagctatcactcactaacatcgttgcaccactccctaaatatatgtactttgctaaccctatgtctttttatacacttctataagataagtatcaaccgagcagttcttggaagatgtgagagtaaggggttaacagaaaagatagtctgcagctctttaaacagtgtcaatttgacccagtcactcctgcagactacctcctttttgttctcattcgtacttagttccactgttatctcttgggagagtaacatagagtaggttatagccagacttaagtaaaatttcttttaaagctactaaatatactagatataatatgggcaagaagtgcaacacattcccttcaaatgggagtaaaaggcagtatgatttgcaagagcatcactgaaaagaatgtttactgaatgttcactgtgggcatggtccttctggatgtctgttacatttatacctgccccaaaactttgggcaggtgtgacataagctctcagtatcagtgcaggggggtcagaggggtaggcttaggtatgcagaaagttatttgtcattttcaacaggtaataaatgtatgggttttttttaaagattttaataactaatttaagcatgctctaactttttaatacggcatgatatatggggagaagatatttaggtgatataaaatttgccaagatgaactcatgtatcaggtcatttacattcaattgaaaatcagctgtatatctttttaagaaatttcactgtgaaacaacagacataggtacaaaataatcagatattttattagaatcccaataattagtggggaaaaatccctaaataccttttcttgaaattgaagaaggtatttcaccttaatgataaaggacgtaacttaaaggccaggatcctcaaataaaagtaatataataacttttaaaagccctcttatgcttttcaaaacactttcttgtctgttacttaatcctcacattaataataagtgacaggcagagaaaaaatgtgttaccttcatgactccatggcaatctcattgctgagaagtgggagaattggaacaaaaacaacccattctttagcgtttcctcatttcttcctcctcattttcccaagcccctcatttccaccccttcccaccaactgggtgatgttagtattatatattacctctagagatgtctgtcaattattatggatctattatagcaaaaacagagaaaggttcaaacaacctcaagggacatattaacatttgctttaaatattgaaggctatgatgctgtgttcaaaattttttttaagtggaaactctctcaaagtctaagtagttattttgactagtgcaaaactgtgtttcatttcaaataacgtgatgaaacaaaaaaccaaaaaacaacatgtttctatgggagggactgtgaaataaaatcaaaacaatcaaggcattctgagaagaatgattttggtctttcacggttatgaattctgccaccttgagtggtatgtttcataatttgtggcttctcactccctcgtgttgttgagattctgtttaagttaggaatttagctagatcagcattgtcagatcttgggcaaatcatgtgcctcctcaggctcttgatttttcacattttcaaggttatgattaggtgagtgtgaggattaattgtggttatgtgtgtaaaagtattttgaaaacttgaacattctatgtatacaaatcacatatagatactacacttaagtgtatgtatagtatacacatatgtagataaatgactattaatattaataagagtaactcatgtatcagatgattataacattttaagctaataaagggaaaatcagttgtttaaaaatatacatgtaatttgtttcaatgcatttcctccaaatagttctctggctgtgttttcattgaggaatattatattacattccctatgttcctcaagatacttgtttattttttttaactttgggagaattttttaaatgttgtgatctggaaaaagtgcaatgattgtataataaaatctcatacttatgattgttttagacattctctacaaactcatataaagattgtaaaaaaaaaacttctccaaatgttgcctatgtattttgtctgtaaagactgtagaagtgatagagccaggaagtgaagtgatgtggtagcaagttatttaaaaatcactttttttctttttgcagttaagtttatttaaatgatgtctgtatccattatttatttacttatcattctgtgtctgtctctgcctggctccataaaagcaatggaggcagcagaatatccagacacagtttttctctgctccatgccccctctatgcatgcagtcaccatctttttagcaatacaccattaactctggaatattcactgacagtctgaaagatactaacatactcaccatttatttctccttgccatcacttttatgctcagttttgggggtctccattttgttttctcttcaaccatgaattcatattgtttagaaagtttctttgaattctgagagagaatgagaaattagaagagaaaatcaagtgagaaccccatgccttatttaattgaagagtttctcccccttcacctcctaaagaggaatagtagagagtttccacccatatgtaaagaagtggtgtcagtggaatatcatggtacaggagcaatattttgaaatgtcttgttgctggttaaatacagggaacgccaatacaaggaagcaagcttcgacttccaggatatttatcagggaaaggcttccactctggggaggacagtggcttgataacaactgcagctgccagagtccgaacacagtttgctggtgagtgtggtgcctttcttttttcaatggcttttgcagcatggtcatctgaggattaaagtcccttttcctcctcattggggaagaaattacaaattgaccctgaggtagtcttaaaatgatatgtagccccagtcctccaaaagttggggataaagtgagtcatgggtgcaagtgtctaaaagtgtccaagaaagatgaaagaattactgtacaacagaggaaaatatacagtggtattctaccccttcaagctgaaagattttggctcttctgccagctcagcgattgcacagggccctgttttggggtggttggaagaacccagccacactgagcctcacaccagtgtagctcacattgcttcgcaaaataatgaacctactaatctctgggttctgagctcagcaagcaagaagcctctttaaagtttccaatctcatctgttgaattcctacattcttggagttacctattcttgggcaagacttaaacctgtcttgtttgttctatgtttgcatcacacgcatccctggaggcataatttaaactttagaaagcacaatcttaaaggataggtatattccttatgtctgtttgcaataaatggaatcctgttttaagtaggggaagccgaaacttaccttgtagttggaaatctagccttttctatattatgtctacttagagtaagcctgcatacccttgtgtaatagagaaaggctgtgaatccacaactgttttctgagtgcctactacacaccaggaaaaaaagttaagattaaaggtggcatcgggtttcaaaaattagttgcagatggacccaataataagggtgagctgtctctaccttctttcctcagattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggccatccacagcgaagccttcaaaaatccccacgccccagaggaaatcacctgccagcaaattggacaagtcctcaaagagatagtgcaattggttctaccaaggcccttccttgagcatttattatttaagtttgaacgatgtaaaatatggtgtagaaattcttgtgaaatattgcaagaggcgagtttaaaattctgcagatggccttatttgtgtatttgtctttttattttatctgtataattttttttgtcagatattctggggttaaagtcacatcatatgtgaggaggaaaagtttaacatgaactaacatttctgcactgtaacgtgccgggcacacactaaactcagttactgtacctacaggtaagtctacatcctctctgacagccacagcactacatcaatccctgacgttagggatacctcatgacattttcctgtttttatggaaactctgagaagctgaatgatacatgcaggggatattttttgagatgatttaaatgtaaaccaaaagatggaagacaaaaagacaaacacacccacacgcagtctttgcagtatctgacagagaactcacaggaagttacttcaagcacttgccagtactatgatattcaagtaccttgcagcatttctctgccattgctttcaatgaggccagaggcatcctggatattagacctattatactgtaagaatataagtataaagtgcgttcatatacatgtgaggttttcttttgcttgagtggacagtagcacctgtatcattgaactcattttgtatcagagcaattttgcttgcagaaagctatgaaataaaacacgtcccttaactgcattgctatggaattaattttttttccccagggaaaactagtgtatttttttatgagcaatatcaatttggagtgaccaaaagatacttaaaaatgggtttattttgatttctcatctgaaataatcatgttctggtattatatctatctatatttaataaatatatacattttaatttattatgtgtactcacatactatagaaagatattagtatgcatttaataaaacatattcacttgaa

SEQ ID NO: 37663 - DNA, 385670 bp, Homo sapiens; identical to SEQ ID NO: 37662

SEQ ID NO: 37664 - DNA, 122719 bp, Homo sapiens
caaagctgggttcgcggctggcccaggagtgcggggcgcgactgggcggccggcggcggggaggggcggagcgcaggagtcggaggcgggagcagaccagcacggcctcgcggagccggcccggcggaccgtgacgggtcccctcacctcctcttctctcccctccccgcccgccctctctccctcccttcctccctcccgctcgcttcttctcacgccgggagcaggctcccgcctcgcaccgctgccccgcgagcagctcctcttctcccgaggcgcgcggggcgcccccgcgagccccgcggctgagaccccgcagcctggaggagggctgtccggggctttgggtgggtaccagtattacctcctgcccccatttctagaaacttccaggttctgaaggaaggggaggttcgggtatcccctggatgggggggcatctctagggcgccgccccgctggcgtgagctggggacgttgcgggcacacgacggggcgggtgcgggatcttggggaggggggctcccgagatagtggctgggcggggaactccttcctcagcctctcgtcagcgccgcttctcctggtttctcttgcagatgctgctgctaggggtggtgggagcagccgtgggacgcgtggccgggagcgggggtgacagcctgggattccgggggcttctcttccttgtcctcctcctctcctctctattcccagtgtggccgtggctgacactaaagactttgtagccatcaacccgagtgcagtttcgatggaaaatgaaggtaaaggcccctggccgaccggttgcaacgcggagttgagggtgtggtggtttgcttttaagttgtctttgtttttccacctttttattttcgtgagcttatttatttactgtgtatgtgaagtgtccaaggatttgcttacttagggtatccagcttttattttggtaacatggggcatttgagagattgaggttctgtgggtgactgagcttgattcagctttcttgaggaattcctgctctcttcagcttagggaatgagagggaagttttcatttcagatagcgtctgtgcatgtttaaatagctatttgaaaggaattactcgaggggaagtggaaatgggggacaaggggatggggctgcatctctgtatattggcgtttcaagcctcgatgtggtgtgtggcaggattcatttataagaaagcaagccatgttttattatgtctagcattggggaaaaaactcattatttttcaattcacaaaaaaaacccagtgaatttaatgaaatgttatgagatgagtgcttttcttaaagttccaccctatttcaaaacatcatttaggaggctgacagcggaacctgtttgttcactgtacactttggacacattagatcgtcattcacatgttacatgatccctttggcctcgttaaaatatttaatgcttttcctacacagcactgattatttttaaaattgttgaacaactgtgaataagtgattttttttccccctcctgaaacaacacttattctttggactgacttctgacttgtgcgtgatcatttttttttcttctgcctttaaccgggctgcaaaatactataaaagatacttaacaaatgacagttttttcctctggtataatttgttttaaaaaatatgtgtctggtataaaggagctgcagtcttgctggctgcttctaatttgtttttccattgttgagaatgtaagcttgattgtctgactaggactagtaattttgaaatgggtgtttcttatagatgcagtaatgtgttttgctctctgagacctctgggctatgtagggaatatgatgagaggcatgattatattgacaaattttactctggatggataattggcggaagacattttctgaaatactaaagtgtataactgcagaggagttatactgtctaattgggtcttgagaaacatttgaaagcagtgatgtttttggtgataaggaaagtcacttttctgagcctttttcctctcttttaagtttattgatttaagaaaggcaaatccattctgcacatgagacaaagaatgttaaatgcattcatatacttgtttcttggtagaaacatcttaaataacttctaacatttaatgtatgtttatgagcttgttttcagaatggtaccagatttaagagggtagcctaaagtaggtggattctttcatgttgcttttgtttcttgatctctcaggaggaagagcatgagtaataaagccgattctcattatctactgaggtgggagggggtggttgtgagataggagaatggtgcctacttgtgtctgtctctgtattttgtggccaaatatgaattttgtggtttcatagtaaaagattatacagttcttaaaaacgtgtggggttttctgtcccgttattcttgaccatcaagagaccatttttgtcagtttctccctatcgtcacatttttttttatatataaacagtttgaagaagagcctgtatatagcctagaaattttcaaaagtgactgaccatattaaactacatagattgatacctgtgcctttttattgttcacttgcctttttgtagttttcatccttctttgatatagtgtagtattaacaatttggaggtgtgaaacaaaaatggattcaagtcttgactaacttgtcttgaaccacttaaagctgtgtgattttaagtaaattacgtcacctttctgagcctgtatttcttcatctataaattgggattgataatctttaactcacagaattgagaggattaaatgagaaaccctgtataaattctcttgtgaggtaggaatgataacgtttaagagcttgagttgtggtggaaccatgcagactgatttgaatgctggattcgtcgcttaccatttggctttgtgcatattaaagttttctgtgcttccgtttcttcataaaataaagataatgatagaacctaccttatgaggttgttgtaaacattcaaacagtatctggcacatagtaagtgctcggtaaatgttaattataaattgcctagctgaatgtttgatacatactaataggccacctggcattaatattgtcatgacagttaaatgttggaagggggaacagtagtagccaaatgctcaaaatgaagttgtcattgttagttgagggataagtggagttaggtaaggaattttctatggcattagtgcttttaagcctacagaaaaagttagggctctaccaagaagccagggtccagtacagaaagagacaggtttggatttgaagcccgacaagtaatgttttcctctcctgaaaaatctgacaagttactaggcttctaagctttctcagcctctaagttatctcatctgtaaatgagataatgccctcttgcaaagttgatgtgagtaataaatgaagccgccagagcaatgtttgacatacagttaacttggatgaattgagtgatgctgctgttccctagtaagagtatcctccagtaggtatgcaggtagttacatttgtgggtgtgaacagtgtagaattgatagtgtttccctagagcatcagcatgaaggtttcttaggtagcttacagtggtgtggggaggaaatggtttcatccatgtgttggttccttcagcaatggtggtattttctttggcacttcggtttagattcttctggacttttttcctagggcccatttaaactttctcagcaaagcttgaccaatttttagctgtagactccaggatgtttcatgaacactttctgcttgtcactaggaacgtttaaaatgttaatttcctggaatttttggactacttaacattcagtcgtgagttaggattttatccagatcctttggaatttgtttttacatgtttatcacaaatctaaacagatcccgcttaggcatcttgagatgcacaagtaaacagctcttacctgatttttaaaagttaattgcatgtttaaagtgatagcttactagaaaagatatgtctagctggagaagcttgcacataggttttcctttctagtaatggatttattttttggaataaatttggcctttcccatagaaaattcagtgtgactttaatacacatgaaactttaatatagccttaaatgtttgactagtggatagaaatgtaatagtcttcaggatttcaggacatggttaatttaagattatagacagagctaataggtgtagagaacaatgccccaatcttttttgtttgaaaatggttgtatttacactttacttttaaaagcagtttcttaattcaatttcaaattgttaatcagctaggaatgtctcaagaaaaaattgcattactatagttggagaagctatagggaaaaagggatgagaagccaccttaattttattcctttaactgaaaataggaaaccaggttataaaaatatatctttgggtgtgggaaatatagtttatgttgtttgcagttttgtccataaaatgatagtcttaattagtactctgaaaaagagttgaaactaaaagagattatatatatgacattttgtaaactgtagtaatttaagccagaggatgctgtagagagtacttgtatgcaataaccttctgacagttggattccaaatacttgatttgtcttcatatttttgtcattcatttaaagtcagcagaattcaggtctgttaacgcaaagcattatgaaacaaaatagtttcctagggaacacacccctaggggcccaggactgattttggagatcttagttagccatgatctgttttgcaaggttaaattttgttttaaaggtgccaggaacactgtggcttgatggtaaagttagcatgaattttaaattacaccgttgttacatgtagcatcttaaaatatcttaaggatcagttcaagaggtcccctcacatttactttgttgaaacaaattctttttaataatggtttcaggcatcagttgtgacaaggttatctttatgcttttcatgtagacaaatgttggtaaaaggcagtaaagggtgcatcctgaggttaatgccatcatttcatgaaagaaaggatctctcaaaaaaaaggctaaattgataatttcctcttggatgtatatgactgctacttatatgcatttgttaatacagttgacccttgaacaatgtgggggttggggtgctgacccaccatgcagttgaaaatctgcatgtaacttttaactctctgaaaactaaactactaatagtctctactgttgcctggaagcctcactgataacataaacagtcaattaacacatactttgtatgctatatgtattatatactgtattcttgcaataaagtagagaaaaaaacttaccaagaaaattatgaggaggagaaaatatatttataattcattaagcagaagtggatcactataaaggtcttcatcctcattgtcttcgctttgagtaggctgaagaaaaggaggggttggtcttgctgtctcgggtgacagaagcaaatctgagtataagtagacctttacagttgaaactcatgttgttaaagagtcaactgtgtatcttctgtcttcaggctttaagttgctacgacaaaagtataaatcgtagaattacaaataaattacaccaattgtgttaaattaggttggtttagactaaacctgtgatgtgtttagaaaaagtttgaatgaaatgttgaaaagctgtcctagattatagacagaagacagtaatagtcggggtcagaagcattatcttaagatggccgtaactgggtgtctgattcaatttctatctctgctttttttaattctgctataggtattagagaatgtgtgaattggaattatttaatatacctgttagttgtaattgctttcttaagtaaaggccttttggtttgacatttggtcatttcgtaaacatgctgacctaaactcgtgtccctccctcagaaggaaatacgttaatttagtatgacatccttttttttccctttgtgcttatttatttatttatttttttgagatggagtctcactctgtaacccaggctgggctgggacacagtagcatcattatagctcaccaaagcccctaactcctggactaatgcgatctccctgccttagcctcctgagtagctgggattataagcacacatcactatacccagctaatttcttaatttttttaaagacgaggtcttgatatattgcccatgctggtcttgaactcctggactcaagcagtcttattgccttggcctcccaaattgttggaattataggcatgagccaccgtgcccagctttagtatgacattctttattcttttagaaagctttgagatattgatgcatccttatagaaattactttcatttatttatttacttacttaaaacagcttgataaagttggaaaaagcaggaccctaaataataaatatatttgccatcagccttttataggaaaactcagaaataataagtggaaatatttaggatgtcactcatcagactttttttttgaatatgtaaatgtgtttttttgaaaatttaaacacgcaaagtaaaaattaaaagttttggttaagttgtgaatttcagaaatttatcttggttatggtgtcctgaagttaaaaagaatagagcattagtacattagtacataaacgttctgttattctctgcctaagggcaagatccaactttgaaccaggtcctggatttcctctcatcttaaatcggagcctttttcatttgtagtataaataaattagccttttgatgctgtgattttatttgtatatgttatatatgagatttatatctctctttgtatgcaggcatttcactagattttgtttggccatctatttttagtgtttccctagcagcatgtttgctttacctgccttcatctaggtttctacatcatcaggggtggaaatattagttggcttaattaagcttgggagttgtaccttacttgctctgttgagtgtcagttctaccttcttttgaagcaggcaaaagcagttcatggcacaaatgccagaaatagcatgcaaaccactttgtagtggtatgcaaactaatttctgctgtgtccttttcttaatgcttgtgagggttactgtttacttaagagttaatatttggcttatgaaactagtatcagatgagaaattccagcatccctccccaccccagagaaagatgtggtcattggggactgctctgaagtctgccagccctctatcctaaaagttggtagatcagttattatatcttgatatgtacccctaattcatatgaggggccaagagagattagttactcctgatttcatctgttagaagataaagggagtgtggtttgtatctatattagagtaatgggaatgaagggtagggatggatgacagagatattttactcctaggaaaaatcagcaggacttggacagtgactagatacagagaattaagggaatagttgaatcagacatgactgcaagatgtcatttgggtcagtgaaggtgccattgattgtggttgaaggagtgagccgatttaggggctggctgaagggaatatataggtcagactgtcatgatgtgaggctcatatagctatgcatggagagaggtgttaaatcaagcaccaggattcaaagtgagctcttgaaggcagagacctcaatttgtcctttattcatcttgaacagactctgggacgtacctactgtcaattgaatgaaaatgctggcttcttccttctaagtggttctcatctcaggattgttttgcccccgggggacatttggcaatgtttagagaaatgctgggttgtcacaactcaaagtatgctactggcatccagtgtgtagagaccagggatgctggtaagcatgctacaatccgtaagacagcatcttctacctccccccgccaccctcaaaattttttagccccagatgtcaatggtgccaagattgagaaacactgttctaacaaacggcaaggaagttgactcctctaagccttggtttcctcacttgtaaagagattatgactacttcaggtttgttagaattagaccaggcagggtgtgtacaagtgcctggcatgaaagagcctctcagcaaatcctaatttcccttaccttacttgatgaatagatttaggggagttacttttggtcttttaactgctaatttcaaggcttcacgttttttttttttgtttttttttttttttttttttttttctgagaggtgagtgggatgcctaggaaacatagagtagcttttataatcttaatgcttttctcatggttttatcaaattatgattttgattatactttggtttgggtttgtactatttcaggattcagtatttagtgttcacctagcagtagacaatgaagttaaacccttagtgtagatcaatgaagttaagcccttaaattttactttttagcctgtaaatacattttatgtattatttattgctcacagaactgttattgtttggaagcaattttactattctttgaaatcaagaccaaaatgtactgaattttatttctcatggaaaatgctagacctcctatgtctattgcctttttcctttttatccatttattctaactagaccccccccgaagtcagaactcttccttagatttcctttttagggtcttcattaggtggctttcttttgcttgtcgggtgtctttttactttattttgtaaggtgttgaatattccctttattttgtaaggtgttgaatgtttcagtggtgttagggacaggaccaccgatattttcatctctaataccaatcccttagtgatctattccagtcatagcctcagtgtttaaagtctccttacatgtacatagttgtgtggcattctcatttttagggagtcactggaattctttgctgctatttctttccttttaggaaaaaaaccggtttactcttactatacattattttctccatctatagaatggaattactgtaggtaaaagtccttgagttcggtaaactatgtattggacttactaatgtacgttttattaattgcaggtggaatttagaaataacctgcctgtttttcatcttaaactaagattatttaaatattccattcattaattagttggttagaaaaattagcttttgaggaacaccacttaaacatggaaaataataacagagtacattttgtgacagcaaataaattatcggttaacttaaccctataggattcaaagttggtagctttaaatgatattaaattgtatttgactgtcaactgcttttaaaggcttacgtggctccccattgtacctgtagttatttaggtctggaagcacagggtgttaagaatgccaccataatgtcttttcataagggtttggtttgtcatagcctgtaaaattaggttcaccagttagctgctttatgaaatgaatgtcattggtcatggtgggggaggtattaggagaaggtataaaggaatctaaaaaaactttctttctttctctccctccctcccttctttccttctgccccttcctcccccctttcctttcctttttcctctttcccctttcccatttcccctttcccctttcctttcctttcctttcctttcctttcctttccatcttctgtattgctagtaaaataattgttgctcactgaaggctttaaaaaacactggttgcatgcttaatataggatggcaacaaaatggacgggtttaaaaaatatgtagatggtatgatacccctttcctccatccttgtaccaaatttctttcaaacctagaataatttatacaaacagatgtatcagtagatggagtattatgcccactttttaatttaatgatcaaaaaatgccaaattcttcccagagtggcagtataattcagatgtagttaactgttggatgcaaattcaattatggtagaaagatttactttactttgagaggtttttctaaaatcttctaaaattatgttgatttttaaaatttgaaataactttagacttacataaaaggtataaaaatagtacaaagaggtcctggatatcttttgcccagttactcctaatgttaacatcttatataaccatagtataattattaaaaccaggacattcacatttataaactatcctttttctagttcaggatccaatttgggatcctaccttgcatttagttatcatcatgttagtctcctcccatctgttaagcttttcagtcttttttttctctcatcttttataaatgttactgacacttttgaagagtactgttagttattttttagaatgtttctcaatatggggttgtcagatcttcacccgtgattagcatgtcttatgatgggtgaagttaatgtgatcacttggttaaggctgtgtctgccagatttcttcattgtaaagttactgctttttcctttgtaataataaatgttcattttaaccttgtagttgtataataattagtaattcctttgtaattaataccttcctctagtggggaggtactgcaaatatactgtgtcccatcatacttatcatgggccagttttgcaatatcctgtgttccatcatactttacatgggcaagttttgctatctatcaatggttcttaactggcagcagttattactgctttggtctttgcttaatggcgagttttctatttcactcattcttactatatttggaattctacaattaaggaagtactgtcctctttacttattaattatccaattaatttatttacatggctttgtggatattttgccttatgggttaaaatccagtaattgttgctcaagtcattctcgctttggttattgagggcacttgaaaatttgttcctgtgtcttttctacaataccctctctcattttgtgagcactaatttactttctggtatcacatgatgttctgggtgtatcttgtatttttcctgcttgcaccagccatggaatcaaccatttttccagggagctgagttcattttactagagaatgatatctagaaaccaagatctgggtgccaggtgtgctccatgctactgggtgtcattgcttctaggctctcttagtagatagagctagcagtgtatatgtttggtaacatgtatgaacacatatgtttttattttcttatctatccatctatgtatataaataaaaaactgccagtgatgctgccagttctgttcttccaccatagggtccattttggtcttttttcctgttcagcccttttctctttctttgttacttccttctccaaaggtgagaaactgttctcaaccacagtatattgacttacttgtttcatccgagtacacacaaacaaaagtagttttagaattagtgacctattcattccctggtgagaaacacagttttaaactagagtacaatatttgtctttaactttatggtatacaggcaaattctgttttcagaagttacttgggttcttttcatccctgcctaagggttatgttagtcacttgtaataaaattaggttcacttgttattgtttgtatgctgttttaagttcctcctacatcctgtttcatcatagcacagtatccctctcccatttatttatgataaagatgtgttcttaaaaggactggatttgcttaaggttgggtacagctgtaattgctttgccagacagcagttaaaggacatgtgctttggcaatcattctcttgggcttgcttgcctggttccttagtttcagctctcatttctacatcgtttacacttgggaattgatatcagctgtggccccataactgtcagtgcttgaaatcatgcccatcgactaaatcttatttgttctgtatgcacagttttagacccggagccacctacagtatgaatactaattctctcatagctgtggtaaatcatgaagtattttgtagaccctgtcctttactgggtttttctttttcaagatagaatcacttaccacaaaatttgtcattttaaagtgtataattcagtggtttttagtatagtcacaaaattgtatattgatataattctagaacatttttatcaccccagaaagaaaccccttacccattagcagtcacttcccattctcccctttcgctagcccctggtaaccactaatctactttgtctttatggatttgcctgttctgggtatttcatataaattgaatcatacaatatgtgaccttttatgtctggcttctagcacgtgttagtacttcatttctttttgcgatgaaataatattccattgtatggatatacacattttgtttattcatcagtttctactttttgtcaaaaaataacactattgtgagcattcatgtatgggtttttgtgtaaacatgttttcagttttttcaggtgtatacttaggagtagaagtgctgggtcatggtaattctatctttaatttattgagtaactgccatagtggttgaaccattttttcattcccactagcagtgtatgaggctttcttttaattaatttctccacatcctctccaacattttgctgttttttttttttttttccattgcatcctagggggtatgaagtggtttcacattgtagttttgatttgcgtttcccaaatgactaatgatgtgtcaaggatcttttgcatggattcttcatgcaaaagaatgaaggtggactcttatctcacagcatatgcaaaaatcatttctgcactctgacttctaatctgttggtttataagtctttgcagatccaagtaccacaatgttttggttactgtagattttgcgataagttagttttgcaactaggaagtgtgatgtgcttattggttatttgtatatctttggagaaatgtctattcaaatcttttgaccattttgtaatttggttatttacttttttgttgagttgtaagagttctttatatatatgtgtgtacacacacacacacacacacacatacgtttattctggatactggataggaatatattctatacttgtaccagtatacaaagatgtttacctaagagtgttcactgcagcaatgtttataagataattatcagagatatggtttgtaaatatttctcccattctgtggattacctgttcactttctgaatggtatcctctacatcagaaacttttaaaattgtgatgaagtccaatttatatatgtgtttcttttattgtttgtgctttatatatctaggaaaccattgcctgattcaatgtgatgaagattataagaattttatagtttaactctcacgcttgatccattttgagttcatttttgcatatgatgtgacataagggcccaccttcattcttttgcatagaatatccagttatcccaatactgtttgttaaaaagactattctttttccattgaatgtcttggcacccttgtcaaaaatcaattgaccagaaattatgggtttatttctagactctgaattctattctgttggtttatatgtctttgctgatgtaagtaccataatgttttgattactgtaggttttgtagtaagttaattttgaaactggaagtgtgagacctttaacagtgtctgcctttcttttttttttttttcagattgttttgtctattctggatcccttgcatttccatatgaattttagaatcagtttgtccatttctgttaaaaaggcagttggaattttcataagcattgccttgaattgtcctttactttgagaatataatattcttacttaggtacaaacataagactttttgagtactatgtttgggtgtgaccttattctaggtaacaagcatttcacagaaatagaaggccaaaaggtacatgaaaagatgttcaacctcagtcatgaagaaatgcaaattaaaaacaaaattataatttttcacttgtcagattggcaaagattagagtgtagtgatgactagtcttggctagactgtggggaaaatagaagcttctgagtttgaagtttttgacacagtccctttggagatcagtagcagtagctatcagaataaaaaatatgaacaaccaaagtttcactttcagaaatgtattctgtacctgtacttgcacaaatataccaagaagtttgtacaggatgtttactgcagcaacatttgtaataccaaaagacaggagtcagcctaaatatcatcaagaggactagttaaaattgaagtactgcatacaatgaaatgccctgtgagccactgaaaagaatgaggcaggttagtatgtaaggtgacatggagtccaagatgtattgaatgacaaaatttgttattgtgtggttctattagaaattaaaaaaaaaaaacaccagaaatacttgtatacacacctgtatagaaaatggctggcagtatacacagaaatagttaacagagattacttctgggcagtagaactggaaatctcattaaatcctttctcattacttgactttttttaaaacaatgagcaggtttttgttttctgaaaaatcattaagaatgactcagtagtgcaagtaaaattaaaattaatactactctttaggaataaaatatttgtttttttctgtcagtttgattgttttatatataatatctgttggtctctagagcagtttgattgttttgtatataatccctgttggtatccagaggtaaatgcattttattgtgatttttattgctgtgtggaaaatggattagaattagttcttgggtacaaatatttaatagtatttggaaccatatttttcatttctacatattgtaagtatgggagaaaaataagatttatcttttaagagttgtgattgtgctagtttttaatttatcaaatgaagaatatttaagaatatttaattctttaagtacaaagaatatttaagaatacttaagagcattgaagcctgattatgccactgttctttgggttcatgctctggaacttaaggttcagtgaagaaggtaaccatttcatagtatctcccttaacaaaggttactgatacattttcagaaaccttagtaccacaggcagtaaggaggcagtgagatccctctggattttgccagaccattcctagaatttttaaggtgaggggaccaatttcccaccccatatagaaatggcaccaacatctctcctagaaacttcctggtgattggaaactttttatctgttgatgctggttctgtctttagggagaatgtcatgtttcatgtaacatatcttaaaatatttgaagatacctgtcatatcctttatttagaaatctttattgaaatccaattaatggtcaggtactgcccttcatacttctctaggccgaatattcctaattccttccactgatcatcttaagacctcatttccagaaatgtcaccatagtatgccatgcttggtagcaggctctaatgatgccctaaactgaatatagacttctcaaggtatggttggattgttgtgaaatagtctaggctcattgactcgcttggactaaaaagctatctttctcataatgcagtttaggataatgtttacctttttagcaacaggtttacactgagaatgcttttacagctctttaaatgatgtatgaggtcaacttaacccatgtgtttgtctgaattattattgtagagccttagcatctggtatgttagtagttggtttttcggtatagtagtaggttttatatatatatttatatttatatttatttattgtcaatagagttagggtctcactatgttgcccaggttggtcttgaactcctgggtgcaagtgatcctgctgccttggcctcttaaagtgctgcgattacgggcatgagccacggcacccagctagtagtaggtttttacatttatttctcataagtatacgtgtatgcttttgtaaatgttgaggtggtggtatattgcctcttctcgttgattctgcctgataatcagcttgttagaattttgttttggtttgtagttctccttgaagaggtccttcacatcccttgtaagctggattcctaggtattttattctctttgaagcaattgtgaatgggagttcactcatgatttggctctctgtttgtctgttcttggtgtataagaatgcttgtgatttttgtacattgattttgtatcctgagactttgctgaagttgcttatcagcttaaggagattttgggctgagacaatggggttttctagatatacaatcatgtcgtctgcaaacagggacaatttgacttcctcttttcctaattgaataccctttatttccttctcctgcctaattgccctggccagaacttccaacactttgttgaataggagtggtgagagagggcatccctgtcttgtgccagttttcaaagggaatgcttccagtttttgcccattcagtatgatattggctgtgagtttgtcatagatagctcttattattttgaaatacgtcccatcaatacctaatttattgagagtttttagcatgaagcgttgttgaattttgtcaaaggctttttctgcatctattgagataatcatgtggtttttgtctttggctctgtttatatgctggattacatttattgatttgcgtatattgaaccagccttgcatcccagggatgaagcccacttgatcatggtggataagctttttgatgtgctgctggattcgttttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtagcagttcctccttgtacctctgatagaatttggctgtgaatccatctggtcctggactccttttggttggtaaactattgattattgccacaatttcagctcctgttattggtctattcagagattcaacttcttcctggtttagtcttgggagcgtgtatgtgttgaggaatttatccatttcttctagattttctagtttatttgcgtagaggtgtttgtagtattctctgatggtagtttgtatttctgtgggatcggtagtgatatcccctttatcattttttattgtgtctatttgattcttctctctttttttctttattagtcttgctagtggtctatcaattttgttgatcctttcaaaaaaccagctcctggattcattgatttttttgaagggttttttgtgtctctatttccttcagttctgctctgattttagttatttcttgccttctgctagcttttgaatgtgtttgctcttgcttttctagttcttttaattgtgatgttagggtgtcaattttggatctttcctgctttctcttgtgggcatttagtgctataaattgaggatacaaacaaatggaagaacattccatgctcatgggtaggaagaatcaatattgtgaaaatggccatactgcccaaggtaatttacagattcagtgccatccccatcaagctaccgatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtaaccaaaacagcatggtactggtaccataacagagatatagatcaatggaacagaacagagccctcagaaataacgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcatgggcaaggacttcatgtccaaaacaccaaaagcaatggcaacaaaagacaaaattgacaaatgggatctaattaaactaaagagcttctgcacagcaaaagaaactaccatcagagtgaacaggaaacctacaaaatgggagaaaattttcgcaacctactcatctgacaaagggcaaatatccagaatctacaatgaactcaaaccaatttacaagaaaaaaacaaacaaccccatcaaaaagtgggcgaaagacatgaacagacacttctcaaaagaagacatttatgcagccaaaaaacacatgaaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaatgactataaatcatgctgctataaagacacatgcacatgtatgtttattgcggcattattcacaatagcaaaaacttggaactaacccaaatgcccaacaatgatagactggattaagaaaatgtggcacatatacaccatggagtactatgcagccataaaaaatgatgagttcatgtcctttgtagggacatggatgaaattggaaatcatcattctcagtaaactatcgcaagaacaaaaaaccaaacaccacatattctcactcataggtgggaattgaacaatgagaccacatggacacaggaaggggaatatcacactctggggactgttgtggggtggggggagggatagcattgggagatatacctaatgctagatgacgagttagtgggtgcagcacaccagcatggcacatgtatacatatgtaactaacctgcacaatgtgcacatgtaccctaaaacttaaagtataataaaaaataaataaatttaaaaaaaaaaaagaattttgttttggttatgaggcaaggtgggtatccctctccagccttgagttaatgtcatcttggataagtatgctattcagtatttatctgagttgttgataaaatattaacagaatagagcctcgtggcatacctagtggtactgagttattaatactactggcccacctgtcagaaattatgcagtttagctgtgtattttcatgtgacagtgtttataaaatgtcttgttggcatcagaagactgtacagccttactgtacttaagacatgctgtttttaaatgattgttttctccttttccaaagttaaaatctgctgtatttatttaagatttttttggtgtgtgtatgggggaagaggggaggtggaaggatgaaaagattctttgcactaagtttgcttttggttaaaaagaagcctgtattcttagatcttaaatctagtctcactatactaaaattagtcccctaaactggatttactttgaaacttttggatgacctgactaatttaaatattgtacaatagttaagaaggaggacttttagtgttacacaatggttcggttcctggccatatcacttactagttttgttaatttctttttgtgttgggcacattacttctttaatctttaatttccctatctaaaaaagtagtaaaaataatgccctcttcagattgttttccgaggattaagtgaagtattagaaataaagcactcagcatcaagcactggtacttagcagcttaacgggcaaacctgctctttccctcctcctcctcctccttagtactcttcttcctattatgtttcctccaactgttactgtgataacatataaatgactaaatgtgaaatcagtagagttttagactttttttttaactcaaagcttcaaactaaaaacagtgtatttcttgcagatcctttaaggataaatagttgatcttttaaaatgaaagtgccctgtgaaagtttcatagctaaacatttttgttctttagtttaaggcttaagccatataggtttttttgtttgttttttttttgatttgttttaactagtcaagtgcatttcagtgagaagggagaaagagtagaaaggtgttggatctgtaactgactgtgaacaatcagttgagataactcaactgccttcagaccagccaagccctatagttttacaagaaaaaacccattcaggttagtaactcatgttgaattacttttggctactttgtgttcaataatatcattctggggtgtctttgtcttttttggggggcaaggaaatggggtcttggtattttgcctagcttgggcttgaactcttgatcttctgctttagcctcctaagtagagggtgtctttgattatatcttaataaaaggattggaagttgaagcaaggaattaaaaacataaatgtgaattactgatagatgttaggcaagtagttgtgtaggtgggactaacttgcttgactaagattttgattgcccatccctttcacgttctacctccctaccccataacataccttgaacatgaaaacatggggaacatagatttcaatagaagaagcccaattatttgtgaataagtatgagaaccatctggatattctgcagttgttataatacagagcaaatagagcattagcacctacgggaaagcagttggattgttgaatcttctttgacttgtttgttgctttggatgacaggagggttccttcctacctcttagtaaagattgggaaagaaaagagttaattgtgaacttactgggattaattcattctgggttttttttttttcccccccttgagacgatgtttcactctgttgcccaggctggagtgcaatggcgtgatcttggctcactgcaacctccgcctcctgggttcaagcgattctcttgtctcagcctcccaagtagctaggattaaaggcgcctgccactacgtccagctaatttttgtatttgtagtagagacagggttttaccatgttggccaggctggtctcgaactcctgacctcaagtgatccacccgcctcagactcccaaaatgctggaattacaggtatgagctactgcgcccggcctaattcattcttaattataagaatgtacagtttttgtttagggatatagtgttagttgaaaaattagggaaaaagtctgttacttagcttagtttttcatttatccttttatttagcagttactgagtaccagctatatgccaggcatagtgagtgttggtttgtgtgacctgcagttcttgtagctattgagtttatagtgtagttgagggaaaaacacgtttggatgagcagtgatagttacgtggtaggggactgagtgtgagtaatcggttcagggttgtcgcaagccaacacaaaaaagctcatagaaggaatgaggcctaaaagcttagtgtagggtatggagtgtgcaggctggacctggcttttgcctgcagaaatgtgctacaagcatttcagacaaagggactcagtggtagacctcttctacatatgccacttcagtagtgtggttttagattttatatttagccatttatatttagcctgaggcgttctgagtcagtccaaatccactgtcactaaataaatgggttatgtatcttaataacagaggattagccatccttatatgtgaagggcagcattactgggacatgtaaagcaaacttatttgtgacaacagaatatttaagtatagttaataaataggattcttatagtctcctattaggtaacattccttttagagatcctcatggagtatgagtatttaaagtgaggtggaggccaggcacagtggctcacgcctgtaatcctagcactttgggaggctgaggtgggtggattgcctgagcttaggagtttgagaccagcctgggcaacacggtgaaaccctgtctctactcaaaaaaaaaaaaaaacaaaaaattagccaggcatggctgcatgtgcctgtaatcccagctacttgggaggctgagacagaagaattgctttaacctgggaggcagaggttgcagtgagcagagatcgcgccactgcactccagcctgggcaacagaacaagactccatctcaaaaaataaaaataaataaaaaaataaagtgaggtcgaaactatgattttcttggaggacgggcccaaaaggtgattgattagtagggttaaagattaaatttgtgcttaaatttatatatatattttttctttcttctttttttcttttcaaagccattatgtattgctgcagtaccaatttcttttgccttagcggggaaacagctggtaccattgcaggcagaattcaagttccctgattaatgaagtggaggactgtttgaatctttaatgtcttacctttatgtgtaacttgacccctcagttctcctttttctttttttattcagccactcgacagctcaatttttctttttctttttttattcagctctcagttctctatctttttattgtccaaaaaccatacaaatggtgttttcttgcccacttttcttactcatgttgaggattggtttttctaaacatagcttttgtaaatcaatgtgtactgactgatttcacttccctgattatatccttaaagcagctaaggtcattggttactataaatgaagtacacacaagtccgtgacttgtgatggtttgacttaggatttttcaacttcacgatggtgtgaaagcagtagacattcagtagaaactgtacttctgttcttcactttcagtacagtattatttattaaatacatgagatagtcaacactttataaaataggctttgtattagattattttgctcaactgtaggctaatgtaagtgttgctgagtgtgtttaaaataggctatgctaagctatgatgttcgcttcggtaggttaggtgtatgaaatgcatttttgacttgttactttcaacttatgatggatttgttggcatattatcccattgcagttgaggagaatagtggattctatgaagataaacttaactaccaggtaaaagacatttcttttttttaaaagcagattaataatatgtgaacgcctttggatttgttttatctaagtaagactttagattttgttgtgttatagatggtttgcaattgtgtttaacacataacagctgggaatgagtgccagagtattatttctgaatcttgcttacatggtagtgtgtgctaaaaattaagatgtaaaacttttgcttttattttacctcgacatttaaaaacactagtaaaacttgggatcaggtgaaaacttttttgttttacttgcaaaaatattctcttaaaaatattgtggtaaagagatctagcctcttaatgaattttaaagtatacattattgttggctataggtacaatgttgtacagcagctctctagtgcttattcatcttgactgactgaaacttcatgagctttgattagctactctccatttccccttctcccagcctctgctaaccatcattccactctttgatttttatgaatttgtattattttagatagtggagttatgcagtcatttgtctttttgtgactggcttatttcacttagcatggtgtcctcaagattcacccatgttgtgccattttgtagaatttcttttttttttcaagctgaagttttatttaaattgtaaaagaaatggttcccaaaaaatgctggcgaataaagcaaaaggataagatatagtgctcccttcctacgagttagccagcctatccgagtacagggtaatatatagtacttaatgctggtagaattttgcagtagtttagaaagattatctgtgcctagattatgaagagattctcagtgtgtgatgcttggttctgggtttacaccttactgggcatgaacaagagccctctccttggccatagccaaatcccttgggcccaaagttctttgcatagcaccctttacaatagatttcaccttctttttcagtcaggagttgttgattcaagactcttcccacactttgcacatcggaaatagtttttgttccagggctttccagctccagttaccttctcagcagcatgtacggaatccccacatctggaacacttctcagcacctctgtatttctgagcaaatttagaagtctttggatttgcttgtaggcatgtgaggctgaacactctggcttgatgcccaggctctcaccacggtccatgttaagtatgccagcgccctggccataaactgtagccttttggcccatacttctttccatagcaggatttgcagtaaatctcttaatcatgaattgccactgtcttgctatctaaattattcctgcaaatcatgcatagaaagcagcagcagtgggccgggcgcggtggctcacgcctgtaatcccagcactttgggaggccgaggcgggcggatcatgaggtcaggagatcgagaccatcctggctaacatggtgaaacccggtctctactaaaaatacaaaaaaattagccaggcatggtggcgggtgcctgtagtcccagctactcgggaggctgaggcaggagaatggcgtgaacccgggaggcggagcttaccgtgagcctagatcgcgccactgcactccagcctgggcaacagagcaagactccgtcttaaacaaacaaacaaacaaacaaaaagcagtagcggtggaagctcctgccattacactgcacctcttctgcgtggtgcacggccctcccgcagaccccacacttgtttccacctctccacgcaggcattttgagttggaggcaggagcacgcatcacaggcggagctagagaggctgggctggagggagtgtccagggagtccgagatcgctagaattttagaatttctttctttctttcttttttttttattgagagagttttgctcttttcgccgaggctagagtgcaatggcgcgatctcagcttactacaacctctgcctcccaggttcaagcgattctcctgcctcagcctcccgagtagttgggattatagacgcccactaccacacccagctaatttttatagtagagaaggggttttaccatgttaaccaggctgttgtcgaactccttactgcaggtgatccgcctgcctcagcctcccaaagtgctaggattacaggcatgagctaccacgcccggcctagagtttcttttttaaggctacatagtattccattgtacatatattccacattttaaaaatcctttcatctgttggtggacattaggtttctgcagctatcactatcacattgtgaatagtgttgtggtgaacatcggagtggtaatatccgtttgagatcctgatttcattcttttggataaataccccaaagtgggacttctggaatatatggtagttctgtttttaaatttttgaggaagcttcatacttttttccatagtggctgcaccattttgcattcccaccaacaggattccaatttcttcacatcctcaccaacagtagttgtgttttgttttgttttggttttttgataatagttttccttacaggtgtgaggtaatattgtgttgtggttttgattttcatttccctaatggttaatgatgagcatcttttcatgtgcttactgcccatttgtatatgtttggagaaatgtctgttgatgtccttagcacatttttaagttgagttatttgtgtttttttactgttgaattattggagttctttatatatttggagactagccccttgtcagatgtttgcaaatattttctctcattccgtaggttgccttttactctgttaattgtttcttttgctgcgtagaagctttttagtttgatgtagtcccacttgtttatttttgttttggttgcttatgcttttggtattaaatccttgagataatcgccgacaccagtgtcatgaagcttttcctgtatgttttcttctaagagttttagtttcatgtcttaggtttattaaatcattttcagttgatttttgtgtatggtgtaagaaaagggcccagtttattttttttaggtttttacatgtagatatgaagttttcctgatgccattcctttcctcattgtatattcttggcatctttgttgaagatcagttgaccatatgtgtgtggacttatttctaggctttctttctgtgttcttgtggctctatatgtccgtctttatgccaataccatactgtttagattatggtagctttgtaatattaatatattttgaaatcaggaagtatgatgcctccagctttgttcttttacaagattgatttggctatttatggtcttttgtggttccatatgaattttagaatcgtttttccatttctataaaaaataccactggaattttgatagtgattgcgtagaatttatagatcactttgagtaatattggcatttaaaaatactaagtcttaacaaaacgtgagcataggtgtttctgtttttttgtgtgtcttgtttaatttcattcattgttttctggttttcaataaacaaacctgtcacctcattcaagtttattcctaggtagttaatttttttctattgtaaatgagattgttttcctaatgtccttttcagatagttagtgtatggaaacattactgatttttatatgttgattttgtatcctgctactttactcaatttgtttattctaacagttttttaaaaatggaatcttgcgagttttctttcttttttttttttttttttttgagacggagtctcgcacagtttcccaggctggagtgcaggggcacagtcttgggtcagtgcaacctccgcctcccaggttcaagtgattctcctgcctcagcctccgaagtagctgggattataggtgcctgccaccacacctgactaacttttgtatttttagtagagatggggtttcaccatgttggctaggctggtctcaagctcctgacctcaagtgatccgcccacctcggcttcccaaagtgctgggattataggcatgggccactgtgcctggcccaaaagggacaattttactacttcctttctgatttggatgtattttttttattttattaagcatttaatttattgcttaattgctttggctaggatttccagtactatgttgaactgaagtagggagagtgggcatccttgctttgttcctgatctttcaggaaaagtttctgttttttgctattgaatataatgttggctgtgggcttttcatatacagtctttattatgttactttctttttattccttgtttgtagagagtttttataatgaaagggcgttgatttttgtcagatgctttttctgcatctattgagatgatcatgtgatttttatctttgattctgttaatgtggtatattaatacattttttatatgttgaatcatccttgcatcacaagggtcagtagatttccctggtatgaaacccacttgatcatggtgtattacctttttgataggctgttagattcagttagctagtattttgttgggaagttttgcatctatatttattaaggatattggtctgtaattttctttttttgttatattcttcccttgttttggtgttagggtgatactggcttcatagaatgatttacggaggattccctctttatctttaggaatagtttcagtaacggtagtaccaaatttctttgaatgtctgaaataattcagctgtagatccatctggtactggactttttttttgttggcaattttttcattcctgtttcagtctcaccacttgttattggtctgttcagagtttctgtatcttcctgatttaatctaggagagttttatatttctaggaaattaaccatctcctctggattttctagtttgtgcatgtaaaagtgttcatagtagccttgaatgatcttttctatttctgtgttatcagttgtaatatctcctgtttcatttctaattgagcttatttggatcttgtctcttcttttcttggctaatgttgctaatggtctattgattttgtttatttttttttaaagaaccagctttttgtttcatttattttttgtaattttttgtttcaatttcatttagttctgctctgatctttgttacttattttcttctgctgggcttaggtttggtttgttcttgttctctagttccttgaggtgtgaccttagattgtctgtgctctttcagactttttgatgtaggcatttaatgctgtgacctttcctcttagcactgcttttgctctgtctcagaggttttgataagttgtgtcactgttacccctcagttcatagaattttaaaatttccattttggtttcattattgacttgaagtcgtcattcaagagaagattatttaatttctatgtatttatgtagttttgagggttcctcttggagttaatctccagttttattccactgtggtcagagaggatacttcatataatttcagttttcataaatttattgagtcttgtttaatggcgtatcatatggcctgtcttggagaatgttccatctgctggtgaaaagaatgtatattctgcaattgttgggtagaatgttctgtaaatatctgttaagtctatttgttgtagggtatagtcttaagtccattgtttctttcttgactttctgtcttggtgacctgtctagtgttgtcagtggattattgaagttccctcactattattgtgttgccgtctgtctcatttcttaggcatagtagtaattgttttataaatttgggagcttcaatgttaggtgcatatatatttaggattgccacattttcctgttgtactagtccttttatcgttatataatatccctctttgtctttctttttttttttgttggagacagagtcttgctctgttacccaggctggagtgtagtggtgcgaccttggcacactgcaacctctgcctcccaggttcaagcaattctcctgcctcagcctcccgagtagctgggattacaggcacacaccaccatgcctggctaattttttgtatttttagtagaaacgagttttcaccatgctggtctcgaactcctgcccttatgatccacctgtgtcagccttccaaagtgctggggttacaggcgtgagccaccacacctggcctcctttgtccttttttaactgttgttgctttgaagtctagtttgtctgatataagaataactacttctaggccggaagtggtggctcacacctgtaatcctagcactttgggaggcataggtgggtggattgcttgaggtcaggagttcaagactagccttgcaaacatggtgaaaccatgtctctactaaaatacaaaaattagccaggtgtggtggctcacgcctgtaatcccagctacttgggaggctgaggtgggagaatagctgaacccaggaggtgaaggttgtagggagtctagattgcatactgctctctaacctgggtgatgaagtgagactctgtctcaaaaaaaaaaaaaaaaaaaggataactacctttgcttgcttttggtttccattttcatggaatatctttttccatccctttatcttatgtgagtccttctgtgttaggtgagtctcttgatgacagcagatccttggttcgtggatttttatccattcttccattctgtatcttttaagtggagtatttaggccatttatattcaacgtgagtatttagatgtgaggtactgttgttttcatcatgctagttgttgccttaatcccttagttttttgtttttgtttttttttttcattgcatcattgttatataggccctgtgagatatatgctttaaggaagttccattttggtgtattttgaggttttgtttcaagatttagaacttgtggtgctggtttggtagtggcaaattctcccagcatttgtttgtctgataaagactttatctctccttcatttatgaagcttagttttgctggatacaaaattcttggctgataattgttttgttgaaggaggctaaatataggaccccagtcccttctagcttgtagggtttctgctgaaagatacactgttaatctgataggtttttctttataggttacctgatacttttgccccacagctcttaagattctttccttcatcttgactttaggtaatgatgactatgtgcctgggccatctttttatgatgaatttcccaggtatttttgagcctcttgagatttggatgtctagatctctagcaagaccggggaagttttccttgattatttcctgaaatatgttttccaaactttcaaatttcttttcttcctcaggaacacgaattatttttagctttggatgtttaacgtagacccagccttcacggatgctttgtttattttttttaaaataatttttctttatcttggcagattgggttaattcgaaagcattgtcttctgtctctgaagttctttcttctgcttgttcgattctattgctgagacttcccagtgcgtttggcatttctctaagtgtgtccttgatttccagaagttgtggttgttttttatttatgctatatatttcactgaagaattttccttttatatcctgtatcatgtttttgatttctttaagttggacttcagctttctctggtgcctcctttgattagcttaataattgaccttctaaattctttttctggcaattcagagagttcgtctttgttcggatccattgctgatgagctggtacgatcttttggtggtgttaaagaaccttgttttgtcatattaccagaattgtttttctggttccttctcatttgggtagactatgtcagagggaagatctgggattcaagggctgcttttcagattcttttgtcccatggggttctcccttgatgtggtgttctcccctttcccctaggaatggggcttcctgagtgccaaactgtagtgattgtttttgctcttctgggtctagccacccagtcgagctaccaggtgccaggctagtactggcgagtgtctgtaaagagtcctatgatgtgatccgttttcaggtcttgcagctgtggatactagtacctgctctggtggaggtagctggggagtgaagtagactctgtgagggtccttggttgtgtttttgtttagtgtgctggttttgtgttggttgtcctccagctgggagttggcactttcaagagcatatcagctgtggtgctacagggaggatgcacatttgccctagagacacttggtcaagtattcaggtttctcaggcagtgagcaggcccatagagctcccaagagattatgacctttgtctttggctaccaggatggctagagaaagactacgaggtgggggcaggaataggggtgtctcagcctctccttgggtgagcttgctgcagctgctgttgcggggggtggggtgagggtgtggttcccagtccagtggagttatagtcccagggggattgtggctgcctctgctgagtcatacaggccaccagggaagtgggggaaagctggcagtcacagaccttaccttgcttccatgcaacctgtggtcttaaaggctggtctcacttccatcatgcctccccaacatcaccaagtctttttccaggtagccggttaccagggtggatactttgccccagaccacaagcctcccccttgagaaagcaaatggactcatagtttttaggcctcccagagaacctgcagtggtgatccaatttcttcaaagggtctgtggattctcttggctttcctggtttgttcctgtggtagttcttgtattgtagcaaaagttcatgatgtgagtctccacatgttgctctgtctgtcagaatgggagatacaagctagtcctgcctcctatccaccatcttaatttgagcatctagatatagtttcgaataatgtgtatctacctacaaagttcaggcatggaacgaggcaaataaaacaaacacaaaaactggatagcaaaactactccaatgaggagataaaggttttcaaaaagtacttgaactggaaagcctaggtgatactaaaacattaaataaaatagtatatccaagacccagtatgtgttaatatatgggataaccagatcgttttaactgctctggctaatcctcatttctataaatatgtagacaaaactagcactgctgtatggtaataactaccagtatactgctttgtcctttaaaatgtgtctgccatactaggctcaaactattaaaccaagtttttctactaaggctaggaatgtcacatgtatgcagggatgagaaccttatcacacacactcacgctcacataccaggtctctcagcccttgggcgtcgccttccaactccatgtgtattttatgcatgtgatctttatatgtgttctttcgctgttttcctatcatgtgaaacacattaaacatctcaacacatttgcgcctggttttggttgcccagtagtattcttgtgtgcaatgaaaccagtgagcaagtacacatagtaggaattataccatcttggtagaaaacagctatataaacacggatgtacatatttcactggaaatctcaaggacccacctcttcagtctgtagcagaagtctgcttgccacatcagatccttttacccttcacctctattcttggaccccaaagcagggccagtgcttttagttttgtatctggtgtcctcaaaatgaatatggaaagttcataaacactatataagtactatgtgaatctggttgaaaacaggtaaaacaacaaacctacatatactaactggtagttaaatttatttcacaagaaaaccatctttaagattttttttttaactttttttttttttttgagacagagtctcgctctgtcgcccaggctggagtgcagtggcgtgatctcagctcactgcaagctctgcctcccgggttcatgccattctcctgcctcagcttcctgagtagctgtgactaccggcgcctgccaccatgcctggctaattttttgtattttttagtagagacggggtttcattatgttagccaggatggtctcgatctcctgaccttgtgaaccgcccgcttcagcctcccaaagtgctgggattacaggcgtgaaccaccatgcccggcctttttaactttttaaaatagagaaaacagtatattccttggggaaagatgaaggattgagaaaaccagctctgggtaaaaattattatgactgcacctggagttgattaggcctgcctaggaaagaaacaggcaactgctatatgaccacaggggacagccaccatctgagtctcagcagactagttcacacgccatgcaatgttgctgtatattcaaattgtaaaaatcatctagcttatcatgaaacaagctgcatttatcatcagagactgtcaggtcatcatctccacctgcagacagagcttaagcagcatctcacctatctcaaagatgacagactcttgtcactgttgtcaaaggggttgctgttctgtttcctcagtgagctcccagagttggttccttccttgggccctgtatctgtttatgttcccattttctgtctctggctccttttaccaccatcagggtaggcagacttggaacaattctctccaaatgggcagcttccatgttcttcgttaaaatacctacatgccttatcactcttcatctccttgtattcctgaaatgagtttctgctaccttctactccacgcagtactcatgtggaatgacaaagttaaatatggcctggcattctgggatggactttaccatcttgcttttctgttgcttagtactcctccacttgtgaacacacttgaggtgcaggtgtggttgcagctggagagcatctcaaagcagccctttatatatttagagagtatcatgcccctttagtgttttattgtttattatatgaaataataccgtttcctactctggagatttacagctactttgagcccatggaatacccccaaagggttttatgtaaagtgtgttcaaatgtagaccctatctatataccaactaccaaaggattagttgagaaacattttatgagtaaggctgtcatattgcatgctgggtactagagttagcaatttccaatatattattgatagaaaagtaaacattaataggaaattatcatgaactgactttactcaccttgtttagtctgtattgaccttgttggaagaaaagtattaatagctgtcatttgagctcttactagtggtaagtcaaatgctgtgttagtgtatttaatcctcaaacatctctgtttagccatattatccccaggttatatatatgaagaagatgaggtttggggatcttagaaataagagattttattgatctgtcactgcaggcagtgtaaatatatttgattcttcttaattttgctttatgatctcacaagatgaaataactatgtcatctatttcaattctcattgttttaagatttaaatcattttggggggaatcttctccaatgttttacttaggaacggttcaatgaagtctttcccctgtcctagtttgttttatagatttgaaataagggcatttcagtggctctaaaacatgtgtgtagcttttgtaaaattcctaatcttttctctaagtttttacatttcttaattatgtaaaaatattatgctataaaataatttcagtaatttgcagtaaagaaaggtaatctgtctctagtttcctcatatttattcaccgatatctcctcattaaaagttgaaaaatactactgctctttgttttaaagtatttaaacgtccaactgtactttttacataaataagattagaaaacatgaatttgattgttccagaaactcagtcatactgagagaagactttttttcctcagcaatttactattttttggagtaaatgcaaaaagcctttatgtgtgcaggcctctgtaatgacactctaatgtagtagaatcttctttgatttcatttgcttaaagatactgctttaaaagttttagggaaatattttatcctaaaaatgttaattatccaaggttgaaaagatcttacctgacagcttaaaaacttgtatctgggcagtaagatgataattttagtttcagtattattttaattgagtggatgtgtggcaattcaagtgttttcgtctcttaagtttcagtagtgggcagcttttgtctcccttctgttttcactcaaagcattttgtctgtaaagaatctcagcttaggactcaaaacaagtctgtgttgaggatttatttctagagttgtgttaaacagttttctgtagctatagataattacttatgaagctgcatcaagtacgtaccttgattactactatctcgtgactaactgcttgttcacagccttccccacccttcccaccagctccccttcactaacctgtgcatcctttgcttgtctggtctcttttacttcttgtttttctcctagtttgtgaatagctcttaaagtctgacttgttgtcatggtgcgttgaaagagtagccagttgtcttttctgggtagatcagctatgagctgactgactaagaggagtagttaaaatggagaaagcttagctgtactttgtcttgcatgttaaacgtaatgagtttagaggattatgattatttgtaatcatcaggatctgctagacaggacatctgttttactttttactcttatgttggtggagaaatagcgtgcttttcattcaatgtgaaaattttgtgttctagctgggcaccgatggcttagtttttgaaatgtaatttcttgagaagtagcatgtggttagtataaaattgtctttcctattaggactagctacgtaattagtctgaaatatttttctaactggaaaattagttgctgtgaacttttggatttttattattctagactgcattacacttgtttgctatattcaaatattttttctttggttttacttcctaggttgcacgttttcaaaaaatacctaatggtgaaaatgagacaatgattcctgtattgacatcaaaaaaagcaagtgaattaccagtcagtgaagttgcaagcattctccaagtaagtggttagtggggaggaagggactagatggtgtaaagtcagtcacttagactctataaaacagtgctgtctaatttacttttcttcagtgatagaaatattctgttctgtgccattcagcatagtagccacaagttgaacaggactgttgagcttgacatggggttaaacttgacagaattaaacatgactatatgacttgaaatgtggctagtgtgatggagaaactgactttaatttaatttaaatttatttaaataactacaggtggcttagtggctacctgattggacagtgcagctctagaacataatagcttttctaggaactatattagtgctgtgtaaggattggttggattaggaaaataattaacgtaagtagtggtaggagtttatctttttttgataagggttttctaaggtaaagtaaaaacttaagtacaagtttagaattgcagataatctgtaattgcttatgtaggctcttcctggttttcaaaagtagtatctatcgaaacatgaaaaagataatattttttatttttccttcagcagtcacatatcttagtgatagcattaaaaacatgggtatccttttttaggtttttgttgttgttgttattgtatttatactctgctttaaaaccacttatttgtaatatgtttgttttgaaaggctcctttattggactctattataataaccttttggtcagggcaactattttgggggtacagataattttattctttaatagttagaatactaaatcatgagagagaataactgaaggatgtaggtagtgtttatagaacataaactgttccaagaagaagttcatctgaacttcactgcttttgagtaatttaggaagcacaaaatttgagcatgaaataattacacagtccaagagtataaattaataccaaccccagggttttgataggcccagagaacaaggaagacatttatggcccattgaacgttctttgggagaaactaattttagaaaatggcgaaacaacaatgaaaaggaaaaagctaattaaaatgtactgttatgctttctgtaagtcttgtggctgattgtgttatttttctccctaaattttgtttgtttggtaaactctgcctttttgtttacattttttttaaaaaatcaattttgttgagatataattcacataaaatacaatgtactttttaaaagtgtacaatttgcattttgacaaatgtaatcaccaccaccattaagatagaacatttttatcactccagaaagctcccccatgtccctttgtaattaatccctccctctctatgtgtcacttctggtcccaggcaaccactgataggttgctctcataatagactagttttgactgttgtagtttctgtaaatgtgataatacattatattatgtgcttttttgtgtttttcttttctgtgctaacattttcaataactttcatgtataaactctaataggctgatcttcagaatggtctaaacaaatgtgaagttagtcataggcgagcctttcatggctggaatgagtttgatattagtgaagatgagccactgtggaagaagtatatttctcaggtgagatacttttacttcctcttctactgtgtaatttattaatacatggacttctgttatgtagttgcttacttttgtgatactgtttatggagaaaggaaataatttttagatgttttttacctaaaatttttcatttgttggggcttactgttaggttggaattcctgtatttttagtatgtaaatcttaaagacaacattttccatatgggtatattacacaaagataatactgttgacagtagtgtcctttgctgatatcaaacctacactatttaaatgataggactggcaatattttttaaggtaatcatggccagctcagaaaactagtaaaaagtaagttaggtaagttaaactcaggctgcctgggtacaaattacaccttcatttcttaccagttgtgtcatctttattatcctctgagccttatctataaaatggtgatgataaccttacgggagatagttagctctcagtagatgatagttatttatattttttcatcctaaattttaggaaagacttattctagactgcttttatcttgataacgattgtgttaatgtaaaaagttacaggttactatgattagttttgaagtaattaggttggtttgctaaacaaatattttttgctaaaaacttctttttagtaaatgtctgtgccttttaacctgcggtctttctaaaacgatctatgtttaacttttctaaagtgccttttctgctaatgagcttaaatttgccaggcttaattttgcgaatgagtttgtctaaagtagcaacactggaattttaaaggttggatgaaccttgtgtgtatatgtcttatttttatggaatattatttatatgtgtctttgtattttcatacttaccacattcccacattaccaaagacttcagaaagcattaacatagtttactctggatttataaattgtaatgatttgacttatccctaggcagtatgatttaatgttttactttcttgatcctgttaccaaagctagagcacctgccccttgggattcctgtgagaattaaatagtgcctgtaatgtagttaagcacaactaaacaaataacagtaaatagtaatcgtaatcacaaagcactgggtgattctttattcctctgcagcctgccatccatcaagtggtgtgcttagtaatgtggcacagcttttttaggggaaaataaaaaagatcatgggtcttgccctcaaagtgtgacgttaatagctaacatttttaagaactttttttggtttacacggtgctttaatgtacattcttagttaatccttataacagttctttggtataaggttctgttttaccagatgaagaatctggagcttaaaaagattaaggtgacacacagatgccagcaactggattcaaacctaggtactctgactcagtcaggtttgtggttggtcagccctgaaccatattgcagttgcagtgttattttattagggcagtttaacttattattttttaaaaatcctcgttagaatcacttggggagtgcttaaaaaatgctaaagcctgggccttatgcctaaagattttgatttaattaacttggtgtgaatctgggcattggtattgttaaaagtttcttataggattccgatgtgaagaaggattgggacttgttccagggaatggaaccataaaggggctttggaggtggtggcatgtaacctcagagctatggtatctaagggctggggctttctggtgggatggattctttttagcctaattactttgcaactttgacagtgatgtaacactttagcagaggaagagattctaacatcagagtttcaaggaatagaatgtccaactggaagaatttggggttgactctggtgtgaggtcatttaaatgctttctgatcaggttgatgctatagtcctgtttctttgatatgatttgctgtggtagatagaaaccaggaaagctagccttgaggaaaatcttcagtttcttttgtggagaggagggaatttttctgtgatatgtgagtcaaccacagaattgtaatctacaccattgtacttgagaaatgtttgaatctcagtgttctattcagtatttcgcccaaatttttagcttaaaaatcatcttctcctgctttttctagcctcagtagaaattcagaacagctgtatttcttaaattaatataccaaaaattgctgtatactataaggaattggttaattcttagttttaagtattgctatttaattttttttttctgaaaaggaactgttaaaaagcttttaaatgtagttaagtataaacgctttttttgttaattgaagagatacataaaataaactgagtatagacttttgtaattttccagtcatgctcttatggttttttttttttaaagcctttgctgagagaactgtcatgtacaaaactgtgttgaattgctgtttgtttttactttcagtttaaaaatccccttattatgctgcttctggcttctgcagtcatcagtgttttaatgcatcagtttgatgatgccgtcagtatcactgtggtaagaaaaaaattacatatttttaatctgttgagtaagtgtataaattgggattggtttttattttggaaaataaattgagaagtgctctcagatttttttcagtgtccaaattctgcttttattttattctttttgttgcgacagtttcttgttgtattgcccaggctagagtgcagtggtatagtcatgactcactgcagccccgaactcctgggctcaagctgttttctgcctcagcatcctgagtagttgggactacaggtgtatgctaacacccccagcaattttaaaatttttttgtaaagacagggtcttgttatgttgcccaggctggtcttaaactcctggcttcaagtgattctcccaccttgacctccccaaagtgtcgaaattacaggtgtgagccactgtgcctggctcaaattctgcttttattatagttacagtaattttgagtaatgttcaaaagtccatgattagcacacatgaaaattctttaactggtaattttcacaaatatgaaattttataattatctgattaaattttaaatttatttcactttgcagttgagaatatattttgactagttgtgaactaaagcctgacatgtgaaattaaaaatattccttatagtgcatgctgtatttacagcatacatttactatatatgattttattctttccagctaggttattctagctttcattgaactgttttctcatctttttccttcttgctccatttcatttttgtataaaaaatttgtagcaagtaaaagcacttatgcttaagaacactgtagatgttattgtagagatgcagctcttgaactattgcttgcagtatcccaggtatccctgagacctgttcaaggggtatgtgaggtcacaaccattttaataatactaaaacattatttgtctttcaattatagacttttggcattaatggcacaaaaacaatggcaggtgaaactgttagagccttagcacaattcagagtaatggcacccaactttgttaacagtcattgttttctttcatgtttcttaagaatgttcttgataaagcagtaaaaattaattttattaaatctggacccttgagtacataccttcataataatttatgtaatgaaatgggaagtatgcatgaaactcttttgtatattgaaatacaatggttgtctcaaggaagggtgatgattgtgaggcaaactagccttgtacttgaaagactgactcatagacaaactatgggtgttaggacttgggtaaccagcagattcttatttttgaaagtgaattaaatgagcgaatcagaccaaggaaaggcaactggcagaatttgttgctaatgataaaattcaggttttcaagcaataattagggttttggaaaatttgtatgcactcttatgggctggatagcatcccagtatttaagactttattccaattagatcagtagtgatttcaacaaatgtgtgttttttttaaaaaaaaaattgttacgaaatgtggtaaccttggggaagatttgggcaatcttggggaagatttgaataaccaagtgaaccaatatttcccagaagaccaatgcgtgacattacaaaatctgaaatggtaaaagatccattcaaatgcaagataggtcaatggatttcgatataatagattatgaaaggtgcattgatacagttttatattctacattgcagattacctttaagtaactagcacttgagttttggtgtagtagctaagaagaatatccacaatcatctgaaaaagctgttaaaatactcctccctaggctgggcatggtggctcatgcctgtaatcccagcactttgggaggctgaggcgggtggatcatgaggtcaggagattgagaccatcctggctaacatggtgaaaccccgtctctactaaaaatacaaaaaaaaaaattagctgggcgtggtggtgggcacctgtagtcccagctactcgggaggctgaggcaggagaatggcgtgaaccccggaggcggagcttgcagtgagctgagatcacgcccctgcacaccagcctgggcaatagagcaagactctgtctcaaaaaaaaaaaaaaaaaaaactcctccctaaaaaaaataaaaaagaaaaaatgctcctcccttttccaccgtatctgtatggggctggattttcttcatacactttagcctgaacaatatgttatagtaaatggaatactagctttctagaaagtcatatattaaaatataaaaatttaaaacactgctatttttctcacaatttttttggaaaatttatttttcataaagttatttgtgttagcatgtaatgaggtttaaaattttttacatgagttgatgagtagaaattaaaactgactagttgaaaaatttgatatggtaaatatcagtatatataacccacttaaaagctggtcctcaatttgtgagagcataaaagggccctgagatcaaaaagttagagaagctgccctggtaatggcaagccactgtaaactgttagcttctttccccacaggccttaaggtaaagttgtgatttcttttccagctgatctcagtgtttaaaatctgttattgtgggactgcagatagttagaaaaataaaatacagttaacagttacttctcaagttaatgtctgatttaaaagcctgtttcttttgtttaggcaatacttatcgttgttacagttgcctttgttcaggtaagtactctattttgccaacatgaaaatggtatgttaattgcttaaaaatcaaggtgtcttgtggtagaacctaccgttattggggggttgtaatgcccatcagaacaacttattctttgtttttcaagtaatttcagatacagacaactcttcagggaagcttgtggtgtgggactaaggaactgctttgatttaggtagtgagatgaagaaaatctagttttttatttgataatgttaaggataactgaagcagatggaaacaaaaagcatagtaatagaaataaaatccagcagtaaacttttttattttttcaattaaaaaattggaccagagtttatagtttcataacactgttatgttttaatgcctactagagctaagtctagatgaaacaaaaaagtatagaattaaaaggtcgatctgtgatgtaccatttgaagaaaattccacaggtttctgtgactgattcccttagccaaatgctacacttgtttgctgaatttatcacttaaccttattttatttgagtctgttttgaggaattaaaatggttctactcattgttggcatgacctcctctcccctccctttaaaacaatttctcattcctccacaaaaggggtgttgtgatctgaatcaaagtaattcaaacagtaaataaaacatatgtaaagtagccccttttaaaaattactatgaataatgtggagatactgtcaagatttctattaataagtacagacaaataaaaatgtaggcttagttttatgtttatttaaatatctgaaacttctgtagattttagaacagtgtttcacaatatcagcagatttcctttttagctagaacatggttaacaagaatagaattattctagcttagagaaaaatgtaatattgttgcataagcctgaagttcgtgctgttttgaatctgaagcctatactttgaataactatggttgttcttacatctacgatttattacgtgggtatttcttgtcactatcccagcctcttaaggtaatctctaacctagttgttattagttctgtagtaacccagtgtagaaagccagttggaatcagatcatttgcagtaggtttgtgagctccattagtagactatcagggttccgcttttaggggaatcttcttgcttagacaaatgttgcccatggtcaggtggagctggttagtctagcataggtcatgtcaggctaaccattattcaaggcagctattcattcagccaagtgagtgatatgacccactggaccactaactggaccttcttgcgtctttaagaatgtgtcagatatgtggagtgccctacttcagaaggattcctgcaaatagtatcactatgtatggaagaccttagtaccttgttctctttgatcactagaaagcccatgttttcaaaaaacaccacaaaattgtgattttaacataagtcaatatggaattttacacaagatagtgttgttatacacattaaatgctatggctgagactattaaatatgtttatgataggtacatttgatagaaatctcacaaaaggatgaaaactttataaaaagcctagtttcaaattgctaggtctgattcttacacacatgtgacccatcaccaaatatgcctgtgaaaccaacaaaatagtctataaacaagtaaaaatcctctccaaaaagatcctatttactgtcagttgaacttatcataatgctttaatcaaaaagctctttatcaaaaatgtataaaaaattcttaatactttatcattatttgttatttgtgctatattacttgtgtcttaagagggctttttatattcctttttatatttatgtcctgccttttttccgtgtgtctttgcaatccccattccccacaccactgtacttcttcccagccataaaaatagctaattgttttatatagtcgtaatgaagtcaccttacaataaatttgaaaaatgacttttaggcatttattaggttttaggtggtatgtttaatgatcattttgatatagaggtatctttataattgtagggagtagaggctaagaaaccagaagacataagtaaagattgggcagcatctatgtcatttattactgggatctaggattgatgggtattttctagcatattacagaatttttgggtaaacttccaaattccttaatatccttcatgtgtttggggtgttgtcttatgatttttacatttgtagattttccttatatttgtcactctaagattaagtagagactgattgtgttctaagttattcttacatagccttgtgttttctatttgaagtttgtgatggataggacattttgactagtactagcactgcagtcatttcaaaacattcccaacccttctacctccactatttgcctctccctcttttgaccttagattagaagattcttttgcttactacagacatgaggcaaaaatagcagtgatgtgtgatgcaagactgctcatggaaatgtggactaagtagtattgtgagttgaaggatgtttctgactgaccctcagctatttgttatctggatggaagaaggctagaaatcacattgttagaactcctgagaattttcctttttggatacacaggttgatgggaactgggtctgtcagtatagagccagccacatcttactccttgtttatcccatgtttgttctaatggtttactttgtaaaccattgctgttagcatgggcttaaattcctaaagcagatgttgtttacggttaattatctttgacttctgtggtcattagacacttaacataagattatctaaattttaaggctcaatgacttaaaacttttaatgactcaaattatgtactctttggacatactagtcagttttcatttttattctaaataaccttaggtttgtacattgaatattaaaatgtaaaactgggaatatttaattatcaaaattgatctctacatttaacattttaaaataagggacaagcttttctgggtaagaatataagcacaagtaaaggaaaagatgagaattgggggaaattttaaaataatgattgagattaataagtctaaatggaatatattcatgggagcaaaattaaattctacttttttttgtttgaataggaatatcgttcagaaaaatctcttgaagaattgagtaaacttgtgccaccagaatgccattggtatgatcctttttttggtatggatttctgcccctttaaaaatagaagttgaatgtgactagtaccgtacatattgttatccccactttgtctgaacataaggaagatactattaatctgacacaaaaagttcctggtctcattaatgtagcaaaactgtaccattgaaaactttaaaatccgagattctagagacatggatgtatttaacagattttttttttttttttttttttttttttagatggagtctggctctgtcacccaggctggagtgcagtggcacaatctcggctcactgcaagctccatctgccgggttcacgccattttcttgcctcagcctcctgagtagctgggactacaggtgcctgccaccacgcccagattatcttttgtattttttagtagagacaggtttcaccatgttagccaggatggtctcgatctcctgacctcgtgatctgcccacctcggcctcccaaagtgttgggattacaggcgtgagccaccgcgcccggctgtatttaacagtgtgtgtgtgtgtgtgtgtgtgtgtgtgtgtgtgtgtgtgtctgtgtgtgtgcgcgcacgcgcgcatgcatgcgcgtgtccatgcgcaagtgtgtgctaagccctgttctgggtatagtgattcacaatcaaacagacccaggtgattcaaaaggttgcttcaatttgcacattttacatttgaacaaataatttgtttttcaagttattttctgtcatcttggcatcttaagtgtttagaaacagtctttttcttggttcttatatttgccttttcctcagacaagcctactggaaataattttttaagacaagttgcatgaattttttttttttaaccatggttgtttctatttcgtgttacagtgtgcgtgaaggaaaattggagcatacacttgcccgagacttggttccaggtgatacagtttgcctttctgttggggatagagttcctgctgacttacgcttgtttgaggtaaatttgggatctgattgtaataagtgaaaatacgtggatgtagattaaaggataaacattactagttttaaggaattaacacatagttgatttgaaccatttggtattctactttaaaatgtgacatatataaacttttttttttccttaaaatgtatctgtctctactgtaacatcttttgaggtgtttgtttagtgaatcagcagatctttatagaaacctgcatattagggactgtgggagatacaaagatgatatgacagaatacttgtgactagggaacatactatgtgtacacaaattactcaccataaaatagaactcagtaattgagtaagagaagttcaaagaataggatatagacatttaaagaagggagaggttccacctgatttgaatgagatcagaatatgcctcagaccacatggctttggcagtgataattgaagagtagtactggacaaagatggggaagacaatgaagcaacaccattcaaatcactatgaacattccagtgtatgaaactctgttgggacatggtaagggtagaaaacgtgtgatggaatcagatttcagaggccttggatactaggcttaacttcagatttttttggttaggagttaccttttgaggctcctgtgcagttgctaaataatgttatccttaatctggctacagtgtgtagaatagattgaagaactggaaaatggagataggcacctagtttaacaggctttcaaaacccattagtatgcaggtcttatccaccattggaattaagctgtttgttaacacctgcagagcagtcagtctttaaatactatggccaaaagtatgagtgttctcatagatgctgtagaaggcctgaaaaacctttcagactgtaataagaacaaacttggcttaatctttcagcagaggccttttttccaaatatttgaaatttatccttagaaagctactggattgctttaattgggtgactaggaataattgataatattgcaagtgttactaattttacttcattatcctttttctcgtctttgaggtctttttaatgttaattcttttctactcttctttccttcagttcctaatattttgccgatgacaataccttgaattattcttcctcagagattaagtagtcttgtcacttggcataagttttcttccccctcccccagaaaaccctaatttaaattcatggagttcatgccattctttattctgggctgctgctcttccagttgagaagcagaacttctcattgggatagttagaagatggtgtttctcatttgcatggttcgagaaatataatgatagaaacttcaaaacaccattaatgcttgctaaactattttagggttttcatttaactaagggttaattgacttgacagttaattatttcaaagttcacatgtaaacaggaaagaaaacctgtcagtatagattagtatgtattttatctactcagcaaatatatattgaaaacattgtgaattttttatttttgtttttgagatggagtctcactctgttgcccaggctggagtgcagtggtgcgatctcagctcactgcagtctccatctcctgggttcaagcaattctcctgcctcaggctcccaatagctgagattacaggtgcctgccaccacgcctggctaattttttagtatttttagtagagacggggtttggctgtgttggccaggctggttttgaactcctgacctcaggtgatccacctgcctcagcctcctaaagtgctgggattatagtcgtgagccaccgctcctggccgacattgtgaatttaataagaattataagcatatgtcttgtggagtaatttattagttattattgttttccccctacttgttaactttgcaagcacttcatcagcacgttttattctgcagtactgtagttaggttgattttgttctagttaatccacttttacgtatatagttgaacattttttattctctctaccttaattctgccttatttgttttgcctgttacttgctaccccaaacagacttttgcaactactttgactgcagattgaaataactttccttaaagagttggggatcttttatccatctaaatttaaatgtactgacttaggatatagactgataaagtcagtttctcttctggacacagaagctgctagttttttgaaagtaaattggcttattggagttttgttggctcagtttggctgtggtgatctttggataattttgtaaggctagctggtcatttgatactactgtatgaaataaactgtcattagggtttaaaggaaccagaaaactccttagtcagctttgggatatcactaatttcttccaaagcacatagatttcactttagagaaagcaagtctgtgaacttctgctatgtagttagttctcttacagactaggcctaaagccacagttgcaactttagtgtcatcattttgtaactgtcataaattttagtgctttcagagtttgactgtaaacttgcctgggtccttagcagcttcttgttagcacattcagtgacttgactgttgtacaacttttatctggtacaacttttatcttcataggttgtgtcttagcttgggttgctttaacaaaataccatgccatttatttttcacagttacggaggctggaagttcaaggtcaaggtctggcagggtttggtttctggtgaggactgttgctagcttgagatggctatcttcttgcagagtcctcacatggcggagacagcaatttctctctcttcctcttatacggccactaatggcatcattaggactagcctcatgaccgcatctaaccctgattacttcccagggccccatctccaaatactataacattgactgtagagctatatagcatgtgactttttgggatacatagttaagactgtaacaggttgagactgccattttgtttatactttttaaagactaatattaataacttaaggaattgtgtagtttttcccttgcctgtgtcaggttttcagaagccagtggttgagccaagatagttttcccttggtatccactgaggatcggtcctagtagatccacagagagcaaaatccaaagatgctcaagtcctttacatacaattgagtagtatttatatataacctctgcacatttttctgtatactttaattcatctctagattacttataactcctaataaaatataaatgctatgtcaacagttgttatactatatttttaaaagttcgtattttttttactgttgtattttttttattatactttctttgaatattttccacctgtgattgcttgaatccactgctacagagggaggactatagttggtggcagtggcctttccagcaggagcctgagaggcactgatggagctaggacagtaaaacttagaggaattgagctttgggcatgttatttgtttttttttcccccgagggtttttattttaacttttagtgttgagaagaggcaccactggccaattacttgatgataaccaatggattggtcggacaatgactttagatgaagcaatcttattgactatgtatgcctggataacagtacattttatttttatttttatttcatttatttattttttattattatactttgttttagggtacatgtgcacaacatgcaggtttgttacatatgtatacaagtgccatgttggtgtgcagcacccattaacttgtcatttacattagataatatctcctaatgctgtccctcccccctccccccaccccacgacaggccccggtgtgtgatgtttccaaccccgtgtccaagtgttctcattgttcaattcccacgtatgagtgagaacatgtggtgtttggttttgggtccttgtgatagtttgctcagaatgatggtttccagcttcatccatgtccctacaaaggacaagaactcatccttttttatggcttcatagtattccctgctgtatatgtgccacattttcttaatccagtctatcattgaacagtatgttttgcctttgtgaaaacacagcatatttttggtgttgttccaggtaaagtctatatcaatatttggataaagaactctttgtaagaaaaaacagcgtgagggtcagatggaaaaaggttgtgggtttttttttttttttggtcttttgaaaatattttacttctctcagctataactttctaagccgaataatacatcgcttgaaatgatagcaagattttctttcatttgaagttctgaataagtccattgacactttgctttgtggttcatgtgcttatagttggcccccatcatttttttaaacctatttttgatctgatgattttctaaatgtatcagacttctttcagagaattaccacttgggctagcaaccaagattaagctgtttttatgatactggattatcagaccattttaatctgggcagaaaggttagttctattaggagttagggtctaactggggccaagctcaggaattcaaacttaagaacacgccagtgggcattatattgtgagccattttttaatctcatgaatccttgtactttgttatagtatagcagtttggctcagtgagtagtttctggtgttttcagggcttgttcctttctgttccctagttctaaggagaagtaaaaaccaaagataatgggcatcattgagccagcacagatatactttagctacctgccacctgaaggagtcagaaataatctccttgactggaaccccatgtagccattatgttcctatctgtgaggctcacattcttgcccagtctgttgttaagacccgctaacaagcagcttcctccacgttgggtaaatccattactggagcaatcactctgtgtcaagcattctgatttcctgagttaataaaatacatgttccatttactcaatgaaaaaatactctggtaaaacccaggttacaattctgatttggtttggtatgctttttcaaaaaagaatgttttcaaatatttgataaaatgtaagcatgtagtgatattttaaatttacttatgttggtaatgaagctaatttaggcaattgtaatccatttcttaggaaatcagtctgttatgaaaccattttcgccatttagcacatatttgaaaaccatgtacagcacattgtatcaggcttcagggcttagaagtgaaaaagacagtttgagccctctccattggcagacaccagcttgcaaacaactgtgattcaaagaatgatatgtgtctgctcatgaaatgaattgaccatgtgagcctaggcaagccgcttgattttttcaggcctgttttgtcactgtgacacagagttgccctagagcaatgcattccaacttctaatgtgcctaggaatcagctgggctctgttttggtaggtgtagggtggggcctgagattacgcatacttaaccagctcttagaccatgccaaaagcactggtccatccaccacattaaaaaaaaaaattattaaaacagcttttttgagatataatgtgcatatcatacagttcacacatttaaggtgtatcgttcagtggttttcagtatattcacagttgtacacccatcactacagtctaattatagagcattttcatcactctcaaaggaaaacccttacctcttagcattcattctgtattttccctgcctctagcagccactaatctgcttgccactgaaatacatgtgcctattctggacatttcatataagtagaatcatacaatatgtagtcttttatgtctggcctctttcatttaatgtaatgtttttaggtacttcattcatgtatgtcattgttttttactgccaaataattttccattgtaaggatttatatcacatagttggtgaatttaatccatttacacttacagtgattactgataggaaaggacttctgttgttacttgttttctatttgtgttatctttttatgttcctcagtttctcctttgtgcccttctttgttttttttccacgcccctccaattgattttttttgatgtaccttttttattccctcaaattattttctgtgcatactgtttacttattttcttagtgattatatgtggattacaatgaacatcctaatcttataacaatctatttgaagtgatactaactttgcttcagtagcatacaaaatcgtacagcccacacctccctcatctttgttatttttgcaaatgacatctttatgcattctgtgcccattaatatagatttataagcattttatgcatttataagtttaattatataggaagcaaacacaggagtcacgaactcaacatacaataatactgacttttatgtttacctacatagttagcttcattggaattctttatgtcttcatatggctttgagttactttctactttcttatttcagcctaaagggctgtctcttagcatttcttatgagtcaggtctgactagtgatgaactctttttgcttttgtttatttaggattttaaaaatttctccttcatttttaaaagataatgttgccagatagaaaattattggttgacagttttttttttctgaatattataaatgtctgctctttttggcctctgtggtttctgattaggattattaatcttaatgaaaattctgttatgtgataagttgtttctgtggctgttttcaagattctgtctttatctttcaatggtttgattataatgtgtttaattgtggatatctttgagtttattatatttggatttcattgagctccttggttgtgtagatttatgtctttcatcaagttggggaagttttcagccattttatcttcagctattctttctgtcgccttctcttttttccttctgagattgtactggcatacctcattttatcatgcttcaaagataatgcatttaaaaaaatatattaatagatttgtggcaaccctgtgtcaggcaagtctgttggcaccatttttccaacagcatggtgcttactttgtatctctgtgtcacattttggtaattctcacagtatttcgaactttttcaatattatgtctattatggtgatctgtgatcagtgatctttgctgttactgttaaaattgttttggggcatcattaacgatgttcatgtaagactataaatgtaatgagtaaatgttgcgtgttttctactgctgctctgcccgactgctctttccttctccttgggctttcctgttctctgagaaacagcaatatggaaattaagccaattaataaccctacagtggcctcttaagtgttcaagtgaaaggaaaaattgcatgtctttcactttaagtcaaaagctagaaatgattaagcttactgaggaatgcatgtcaaaagctaagataggctgaaggctaggcctcttgcctcaaacaattagccaagttgtgaatgcaaagaaaaaattcttgaaattaaaagtgctattccagtgaacacacaaatgataagaagtaaaacattcttattgtggatatgaagaaagtttgaaaggtttcgataaaacataaaagcagccacaatatttccttaaaccaaacctaatccagagcaggaccctaactctcttcagttctgtgaaggccgagagaagtgaggaagctgccaaagaaaagtttgaagcttgcagagattggttcgtgaggtttaagaaaagaagccatctctgtaacatataagtgcaagatgaagcagcagatgttgatggagaagctgcagcaagttattcagaagatgtagctaagatcattgaggaaggtggttgtaccgaacattttcaatgtagatgaaacagctgtatcttctgaataactttctgtatactcgaatcagaaagttagcaatttatgtaagcatctaccacgggataaaattaatttcatatatcgttttcagtaatacgtaacataacacttggttggtttggctttgagtgttagtaagttaaatacatgaagattttaaattacatttttcttcatttgcataaacagtgaggtatgttaatttttgagaacagaagtaagaaattttatcatgatcaggcagctacaggtgaatattttggaagattgttttctggggagagaaatccatttctaatctgcattttaatgatttgcttttaattctagactcgagaggtgattgccttatcagtgtaccgtatgtcaaaccgttctttagcttaagaacttatttgtagctgccagttgttccatattaacctgaatttttaaaagtactttctgcctttcaggaaacctttgtgactggcatttgatttctttctctctagtgttttatgggaataataatcttgtgaattttccaatcatttttattgtgtacatgttaaatatttagactgtggattatatagtcgtcttgattcttatttatattctgatttttgaactgttttatagcatattcacacctccaccagactgcttgaagaagaatgaaagtgaaaatcagttttcttgttcattaacaggtcttctgagggtttaatacttaaacttctggctggctgtcatggggctgcctgattctttgatttcactttatcctacctttccctctctcatgaatgcaatgaataatgactctaatatctttcttctcagacgaattaaattgtgactttattaaactgtaataggcttgcctaatttattaaattccaccttttctttccctctactccctcaaaactacttcctaggaaaactcttgcaatcactattaagagaaaataacttgtgacttagaaagtattcgtattcaacagatagttgaaatctttgcagattgggacattgtaagatttagacaaatttcatgatcatttgagttttagttgcaaatttataatgatataggaaaaaattagggtcctgagctcctttttcttccacatcagcttgtctgttccaccagacaagggctctcttaagtgattgttgttctgaggctgaaaccaaagagctaggttgctgacagagccatgaaatcatgcttttctctttttaaaaacaacagattaaaaaaaaaaattccttctctgttagtcacttcatgttagtatttatccatgtttaagatttacatttaaagcaaaagtcttcaaagggaaaacatgagttttacttctcttacagaaggaattctgtaaatttctacaagtatttttaaatattagtgggtctctttcctaattaagatcttggaaagttacgtgcaactctgactgttgtaacaagcattaaatatgagcttgctaaataaaatgaaccttatataaatttacttgtaattcagataatacataattttttacatatctttgctttatgtgttatactgtctttttctataagtggttacaaaattggggaggagaaataatttgcagattgatcctctaaataattaagaggaatctggagttaaagtctttcaacactggaattttatctgcatagtgttgtacctctataacgttggatgagttacttaacctttcagtgcctgtaaaacagataataatagtaattacttgcctcataggagttgttagtaggattaaatgtgataatttagcatagatatgtagcatagtgcctagcagatggtaagcaatgaaatgtcagctgatttttagtattggcattatctttgaagaagggcccattttaagatttgtttctcttaccttgctaataaatgtgttagtgtgaaaagttaaatagttccaaggttaacgtggaaataaaagtcaaataaatatgtttctttaataaagaaaaattcacttgcctttgaacatgacaggtgttttttaaatcttcagttgcgttaaggtaatgaactcagatttattaactggtttgtgtttgtatacacaattaatgttaaatgcaaaatcctttaaagtctaaatgactattgatctgtattttaaagaataatttttgtaagcttattttgatactaaaatgcattccactgtcatattatctaaacttctgggaaatgctagcacaattttgtctctttggagttatatttattttcatgatgaatattttaaaacttaacaacctattgtaaactgttatttttgcagttatgtttgcctaacacacaaacacaccaagcatgttcctgtccccaaggtctttgtactttttgttgcctttacatgaaatccactctccctaattatggcccagccttggagctctcaggtctgtcagggctctgcagaggattacctggttttggggaatgttttcttctaaaatgtggctctatctttattatgtttgttgttttccctctacctggcattatgttatatactcgtgcttgtttaaaatcactttcccattaatatccaagggtagaaactttgtttcattcactgctgattatcctactgtgtatgataaagcacagggcctggcacattgtaagcagtaataaatatttgttaagtgaatgtaggaatgttgttgatcaaattaaaacagttttgttgaggagatgaagattctgtgaaccaatttttaataatcattttacgtgaggttatttgaggtttttatgctcagaagtgaaccatttgaaaagatgtaatttataacttttcaccccccaccaaaagaaaagaaaaagaagatttaaatttagaatacttggtacatagtgtgaactgagagttaagaaaggcctgattgagaatactgactcagcctaaaatatcagtgatactgtgcagtaatttatcctgttttcttaccaggagcttgctcagtgcctaacactgatagtcagtaaatgtttgttgggtgaatgaatgagcctgtaaaatcagtaaagtcatgaactaattcctagtttcttacagagtatcctaaggacccttgaataaatgcttctggaataaaatggatggaaatttgcaacagaatcacctggagggcttgtaaatactgtctgttaggtttactttttccaccctgtgtttgaggtggagcaaaggactcttaacttctaacaagttctgaggtagtggatgtgatgctgtcctcctttcagaagctttgctgtatatctgtattcctgttgaggtgattcatgttaatgtattgaaggttttgagagcactgcagtagaggaagctgtttaactcttaactatttctgacttacttggccctagtcctctccctcacttgttcgtatgtatgtatgtatgtatgtatgtatgtatgtatgtatatatgtatgtatgtgtgtatgtatctatactcataaaattgttttttttttcttttttctgtatgcttgggtaggtaaatactgtgtcaggagtgaagccttcaaaactgagccctgttgcagagttggaagatattatgatagttatgatctgcatgaaagcatttgtatacatttttgagtcttgcaaattgtaatttggaataaacggcatgtataacaataatgattttatgaaaattgattccaaaatgatgaaatgatttctaagtaacatttttcccctttattcatttatcactttcagtcatcgtcgatggttttaatctgccaagccatatttccagaactttaggtacttgacaaaattaggaaataatattttgtcatgaaaagttgagttttctctagatgaagattgagtcttagctagtgtcaaatttttcctagttgtattttcaattttaggctaatctagtctcatggtacagcattctactttgcatgtcttagattttgttgacttaattgtattttaaaatatgattgtactgattctggtcttttagagtgatggttttgatacaagatgtggctaatcaatggaaaagggatgtttgaggaagaagtgatgatggttatgaactctagagatgttaaatgtagcacaaaatttgaatctgggattctttatgttccctaaggctgtggatctttccattgatgagtccagcttgacaggtgagacaacgccttgttctaaggtgacagctcctcagccagctgcaactaatggagatcttgcatcgagaagtaacattgcctttatgggaacactggtcagatgtggcaaagcaaaggtaaatttttttcctgatttgaaaaaagcagttcctttgtttgaaactattttctcaattattttttgctgattttatgtggaatttttcaaatacatgacaaaggataaaattgaacttaacccattacatctatttgtgaaactggggagaatctgtgtccccaaagtataatatttccgtagttctgctatttcccagataatggataatcctcaatacctgtttctttttaaagagagaaacagtgttttcatggatgtgtttattattaaataaattttaatttagttaatatgatactggctataataatctgactatatgttgttcacctgttgatcgatttcaaatgcttcctttcctgaattctgatactccaccagtgcaaaagacaccattcactaggggtaaaaagaaactatattaaatgtctcctattgagtataatacatgtttgtatttcagaaatactaatataggcaaaaaataggcctcagaattgagtctgctatacgtttttttttgagacggagtctcactttgtcgtccaggctggagtgcagtggcgtgatcttggctcactacaaccttcaccttccaggttcaagtgattctcctgcctcagcctcctgtgtagtagggattacaggcatgtcccaccatgcctggctaattttttgtatttttagtagagatggcatttcaccatgtgggccaggctgatctcgaactcctgacctcaagtgatccacccgcctcggccacccaaagtactggcattataggcgtgagccacagcacccggccagcaatacgtttaatgtaatgtttgtttccagagtttaaatcataaggggcaaatgctaatgacaggaacataaaaaagtaaatttgctgaggaaatcttaggagtgtgtatgttagacatcttcactgtaggtaagactttgaaagttgttggatgtgtgtgtgtatgtgttttggtttacatttcatctggatgtaaatgtattttcctgtttttccccttagggtgttgtcattggaacaggagaaaattctgaatttggggaggtttttaaaatgatgcaagcagaagaggtgagtacttaatatgttaatgatgtatttgttccaaatctgaaattcttcattgtaagtagagaatgttggattattttatatactattgagagcaatattttattcagaatggaaatcagttgtctctgtttagaaacataattggaaagcctgtaattgaaaaggtctaaattgatgttgttagtattctaaaggattttgagctttactcattgtttatagcagaaaaaggcttatagccacttatttgtagatcttattattttcagaaattagtgttgtggtaattttaaggattagtaattagtatatttgtaccttggaatatgtcttctatcaaattttttcaacttcacataattccaagtaagggtggcagggaaaagattgccaagtaaaataacctacaagatattctcggctaaaagtattaaagatgagttcattttaaatactttcttattataaaaagaagcttcattctgcaaatgtcgtgttctccccaaatcctctggatttctcaggtaacctgccaaaactccagtatgcgatgcaaagtgggaactcattccaagaggcgtggcagtgaagggatgaatagagaagagggttagcagttgagggaggattaaaagacctgggttactagcatgtttgtggataccaaaagggaaaaattggaaaagcaagtgagagagcagctgatggtaatgaagtcctgcagtggttggtaggagggagaacagatttttcctcaaaaggaagcatagagagaacggaccttttcaaataataaacaggtttttaaaaatagagaatttctgttcctcactgtgtgaccttgggcattgtgtaaaatctaagtctcagttttctcagtgaaggtgattatttaccttatgggagagttgtatggttaacttaggaattgctttgtcaagcacttagcaagcccctggcacttgataaagcttagtaaatatagctaattgtggtgacactcttcttcaatttatcaaggcaccaaaaacccctctgcagaagagcatggacctcttaggaaaacaactttccttttactcctttggtataataggtaagagaagagtgagtatgtatatatttttatttgagttttgttttttgaatgtgaagggtggtggtattctagttttatttattggcttttcttttttttattaagtttaatactttttaaaattataagactactagtagccattgttcatttcaacaaagaaaaaatagaactctgattcttgtaatcagaaaatatttcttgaaacattttagtatttgtctttctagtcttcaacaagaatgtaatacgatagttttatggactgcttttctatttttatttcacatatcctgtcataaaactcttgtcattaaattgatggtcacataaaacaaacataaaggttgtatagttttctattttgtgggaaaacatataagaagacctcttctagacatttaggattttttgagggtttttttttggtcatataaatacttctttagtgtggtgtcttctggtaaatacctctcttttttaaggaaaaattcttagaaataaaattatttagtcaaaggggatccatgtaacttttaaatttttggccagctttaagtattgtcattaacttcaactgtaaataaaagagttctcattatttgatttcacagttcattattagggaaaccgaatgctttgtcatgtgtgggttgatcatttttatttcattttatgacctgccaacgatttcttttgtcccttttcttgtgtcttgagtcttagattgataaaagctttttatatgactagattatcaatctttttgttgtataagtttttttttcccgtttaagttgcctttgaggcatgtggaataaacttggtaagaggacaatatatgtaattaaccatttatgcctagtgttccattattggaatgctaagcatgtgggacttatttatatcctactgctcaaggtcattgccaaggtctggttgcaaaaattcaaaaaattgcaacctcagacacaaatgggttaaaacatccccttttccttgagattctgttatcaccctcctattgataatctctgcaattaagttggttttgttctgttcctaaagattttcccaacctcatgtttataagaacatttattaaaacattgttgtatagttttttatttttgacattttactattttatttaaaatttattttagtacatggcttaaggcagagttttaacttttttactcaagttaattatcccattaattctgtaatccagtctttattcattggattgaagtcacgtttttatcacacattaagcacttgcattaattttggagtcttttctcctttaattttcttaccgtgttaattattccagctagtttagtatttcaaagtcagtaatacaatttttttatttgagatggagtctcattcttgttgctcaggctgaagtgcaatggcgcaatcccggctgactgtaacctccacctcctggggttcaagtgatttccctgcctcagcctcccgagtagctgggattacaggtgtgcaccaccacacctggctaatttttttattgtatttttaatagggacgggattttaccacattggccaggctggtctcaaactcctgaactcatgtgattgcccacctcagcctcccaaagtgcagggattacaggactaatgcaattttaaagcaatatttctgttaatacaatattagttgaaataactttgtaaatagtaattctgtttatccatctatcttcattgtaaacataaagtagaaggtaggaagttatcttagttatttttgttttactggtgtgtatgccctcataacttcttccgtttgattattgctcattttctagaaattttatagtgaatttgatagatcgaatgacattctagccaattaaatctttgtagtttctattagcactataccataaaccatttcaaatttagtaataaatatgtttcaactttacgatctctggttatatgttagtatattacattggacataatttttcttgccaaggtcaagagctagatcaggggtcagcaattgtttttttttgttttttgtaaagaactagatagtaaatattttagtccatatggtctctgttggaaatactttactttgccattagcatgaaagcaatcatagaaaatatgtaaataaatgagtgtggctatgttccaacaaatttcatttacctaagcagacaggagacccacagattatagtttgctgacccctggtataatcctttggacataatttctttcatcatgatagtatttgggataggatcttagaaggttgctatttggataattattctttagttatataaagatgaaaaaaaaaacttgtcttaaatgttcatattgatttgcagtcttgagatagcttattttatcaaacctctcgtgaatctgtttgctttttcctcacaaacctgcttgtgcgcccctttccccctattcttttcaaagataaaaggttaaagcaaggagtattggtttaattgatttttaaatttttgaaatgccataaaagtagtgatttttagatgttaatgcagttgtaggtgcttaacgtaaggcacatcactttttgagccaagtcgtaagtgtccctttgtgtgtagtatggatttgctgagaagtgtctggatattgtgttatggaaaataaagttttagggtttaattttgcatatttgatattaaatagaagacctatatgtttgctgccaccttctttttttcattgtatgaacatactggtaatttttaaaaaaataataaaatattactgctttaagggatggtaggagcagtgtcaaccaaaagtaaaactgtgtgtgtgtgtgcatgtgtggtgtgtgtgtgcacacatgtacgtatgtgagtatgcacagcattcacattaagcagtgttaactttaacctcccctgtttaatggatttttataaaatcttctaattgtgatctgatatgctttcccttttttgtcaagggacgttttagattccttcagcttgttctgttccttctaggtgattgtatgtaaaagggaaaaataactatttaattatctttcaggaatcatcatgttggttggctggttactgggaaaagatatcctggaaatgtttactattagtgtaaggtaagtctcaatactttataattggagtctcttttgcctcttttatttctctaatggacatagcttacgttttattatggagatcagtattacatggagcccataagagtataacatcgctacataaatagttcagaagtcatatattaaaattatccttagaaaaatgaaaatgtatgtatatggtaatgaagaaaacccatactagatgtctggaattactaatgcattattgcctttttatatataaatatacaattaaggattgtcaaattgaaaactagcaacatgaaagagaaagttcacaatatagaaattgaataatcaatttcagaggaaaacgaaacattgaagaaatgatgacaaatttaaaaaccaagtgtttgtattttcagagacttgtgaagaaactgcatccatgagataaattgttgtagaaaaggatcagagaacaaaaagagtttttagaaattaagattatgattgttgaaattaaaaattcaattgtaggggtgtaatataaattcaaagaggtctccccccaaaaagagtaaaaagtcttagaatgagataaaatgatgaagaggaataatttcaggaaataccacttgtaactaattggagtttcaaaaattacataagatatgacacacaagtattttctcaagctaaggcaaaaagtaagtctttatagattgaaaggattcactaaataccaagcagaatggaaaaaacttcaaccttgatacataattgtgaaactaaagaagaaaagtcaggtcatctacaaaggaagggtaactacgctggcatcagacttctcattagcaactgcagtttctaccacaggatctttttgggttcttctaaacattccaactcacaagactttcacagaccacatctgatacctgtgccctgaacacagcagggtaacttcaggcagccttctcctgagagtccgcagcagtccatgtagcaattcactcaagtacaaggagataaggtcaaccttgtgagtgtgggatctaccttgggttaaaatatctcgtgttctatgagagacgtattttgaaacatgcatttccagatgcctgcaaaggacatgtctagttacaagttactacacttgagaaactcaaagctatgatttcctataagataattataactttcctagtccagagagattttattagtcaggggatcccttaatcatagcagtgttatctagcagcatacttgacatattattcttaccaggtcactaggtgaacagaactagagttaatcaaatccagaaggggaagattattttattaactgttcatccacagcaacatcagattgcattagaataagtggagccgtggtaacaaattaggggggcaattgatcataaatctgtaaattgggcctagccaaaggattggtccaattagtgacaaataggtaggcaagtactcagaacattcatttcctacccatccttatatgaattccagcaaaacaagggtgaaagaaaggaagatgataatagacataagaaagggcaagaacttacttaggcatctaagaaaaagaaatcctggtagacctctgttgtaggcatatgaaatatttcaaatattagaacaaaagtcaatgtctttcaaaaagaaaagtcaaatagattacaaggaatcagaatgaataagaagtaaaaagatatttgtgatatagtgaaagaatgtgtttttttttttctcaagggagggggtgaaaatgcaatttgaaactcttggtttaaatttgtgtttaaaaacgccatgggttaaatataaaatacatttaaaatggggaataagtttgagatattaaacattgacatattatccattggatcatttttagtttttgaggatttgggtttttttttttttgagttctgtttgtacagattgacatatcataacttctgttctttcttcaaggtcttccaaaggacaagatacttaaaaattttcaaatagaataaaactcattctattttgcaattctgttttgcagtatggatccattggaatcttttataagtataagctacattatgggacctttaatgatcctatttttcctctttcttgaagtattttacaatttcttcaccctaggaattattttaacaattatttgcaagagtgctgaagatgactaaaacaataagaaagcagaaaaatgatggaatcattgagaaggttgatgtaataataaagtaaataatcactattctcttattctttagttttcttattgtgttgcctaaagtattgcatcatttaagaaggtgtaaaagaagtctaaaggcacaatctttaggtttgtttgttacagctttcattgaacaaaaatgagaattcagaatttttcactttctactataatggcaaagagaataattgacagagaagacttttcacaattattagacaaatcagaagatcagtgcaaagagccaaatagaagcactgtaggccgtaatgatgtgggtgaaattaataatataagtgaaatctcaagactgagtctttggatgatgatactctagatcttctcaaacaccttaattttgatgagtgagcaatctgtttttaaggacaaaaaagaaacaggtattctcttccagttaatcattctgcagcaaggactctatcatgtagtagttttcagcaagaatctggaccatctcttttagctaaacgaatgcatgaccctatttcattcatcttttatgatgcttgtttatcagcattgacttcatactgcttttaagtggagaaatgctgaaggctggtatgaatataaaagtgattaaaaggaaatagattatgcagaagtagaaaaattcattggattcatcattgtaattggtgtttataaatctaaaattgaaaatgttttgcagtcatggaccaaagaagataactgttctcttttcaacacaattgggagccatcagtggttttagaagtgttgcaatttgacagaacaaatgcaagaaagaagaactagattaataagctagcgcctgttagaaatattttttgaaatctgaaatcaatatttataagataaatatgttccaagttcaccaaaagcagtagatgagcagttagttgcatccaaaagatgttacccatttcaggtatagatgccttcaagtccaggaatagttttgggttatcattaaaatgaaaatttagagtgaagtttttttacaatttaattattcctctgcaaagttttgctaagatgacttaaatataaaagattgaaaagattcgttgtatctagattgtaagtgataatgcctgtttttccttaatggaagcattaaaaaaaaaaaaaaaaagaaaagaaaaaagaaaaaaaaggattccatttgaactaggaacattctctttgagtagcccaaaggagaaaaggaagtattaatgataatacatatttcttgactcttcagtgtgtattgtttagccaataatgttgttgcttatgtgctttcaactttaaaatcaaccagtaaataaagcatgaaaaagtcaattacggttatagaaaaggatgctaatgtactagattatgcaaagaaaaagttggtaatggaaattaggaagtagaagcagcagagggaacagtggtagaatgaagggttaaattgcttatgtccttatttctagcagatcaagaaatagtatttggaatggcacaaagaaagacttgttattttttaattataaaaggcgagtgaaataattctttaaactgtgataaaatacgcatattataaaatttacagttttaaagagttaatttggtggagttaagtatggtcgcaatgttttacaactgttaaccgctatctagattcagaaccttttcatcatgccagaagaaaaccctgtacacattaagcagtcactccccagttttcctcttcccctagtccctggcaaccactcactaatctgctatctctatggatttgcctattctagatatttcatataaatgaaatgatataatatgggaccttttgtatctgtcttttttcacttagcataatgttttcaaggtttattcatgttgtagcatgtgttagtacttcattcctttttgtggctaaagtaatactccattgcatggatgtcacaattttacatttatcagttgatgaatatttggcctgtttccatcttttggctatcgtgaatagtgttgccgtgaacattcatgtatgagtttttgtttgaacatttgtagttatctgtattttatagatgaggacagtaaactacagagctagattagtaagtagcccaggatcacacaagtaagagatggtgaagccagggatacaaatccaggcaatttgatgtcagaacctacattttttaaccactgtgcttaacctggcagctactaggtatccagtaaatgttaactttctcttccttttgagaagtttattttttaggtattgactatattaattttgcgttttattaagctttaagtaacatccaatttaaattttgctgtgagtgctgtttaacctacattttaatactttgtatatgttggttatagtttggctgtagcagcaattcctgaaggtctccccattgtggtcacagtgacgctagctcttggtgttatgagaatggtgaagaaaagggccattgtgaaaaagctgcctattgttgaaactctgggtaagtctgtgttaagagcattcttatgcaatgatgcgtaagtttatgtcaatagtgaatcatctcagagttttacagtttttatcttagagatttgcataatgatgtttggcttatggcaaaattggatatggttttaacaaccaaaaaaggcaattaaaaattcctatcccttaggtgaggggacttgaagagaaatctttctacatcatgttctaatgcacaaatcatgttaagaaaatccatacaacaactgaaatcttggagtaaaattaatagaatttttttcttgtgacatgtcaaagaagataatgtattattacagatcccaaatgtcatacttgagttgaatttgcctgtaagaacagtaaatttacagtagttatattgctgtaacaaaactttatgtgcaatatgctttgaaactccaaaaatgtactgaatttaatttctagtttgtattttaatatcttctccatatatgagaagctgaaataccttgaaaaatcctgattgaagaaattatacgggtttatatttagaaactctccaaactttctagaaaagatgttatataagatcattacataaagctaatgtgaagtagctttgtagaaactaactgtatataaataagaacatgtcatcatctaatttttatttttaatttcagaaactgtaccttatgctgaaacaagcataatgagagaagttaatctaaaattaacaatgagtttgatttctataaaattcagagaagtaggacaggattctagtctttgatttgttttttaagtgaacctatatttctccttgattcttttggtgacttgtaatgatttaattctttaggctgctgtaatgtgatttgttcagataaaactggaacactgacgaagaatgaaatgactgttactcacatatttacttcagatggtctgcatgctgaggtactctataggtttttaaaaacaaacaaaaacagtatccctttaagaaacttggtgtttaacattcctaacagttccagtgtcttaccttcaaaagggctgtaaattagtagtggagttattttctctctctgtgattttaccaagtctttgtctcattccacttgtacacttgttcaatccaaaaactttgattcctccttgacatctctctttcagtcaccccttcatctatccataatcaaatcctaccaattttgacttcctaaagaattttcccagccatctactttatagccagcttctttaagttaccgccatttctcacctgccattctgataaagctttttgactggtctttttccattcttgatgccctcactccataagcagtttgagggatctttttagaaccaaattttaagcatgtcactccataaattaaggtactccaatggttttccattgtgatcaggatcctgaactgtggcgtctcaaagccgtacatgttctgtcccttattttctcctctacccttatatgctaccctttgctttctgtgcaccaagtatactggctttatagttctttcgatgtgacacaattattcctactttaagaactttgctgcctttgtcactgtttaggatagtctaatgcctcttcatcctttgcaccttaattccaacccacttcttcagaacacccagaagtggccctatgttatatgttgtcttagcatttcatacctcttagtccttatcttaggtaaaattttctgtcccttttccccattataagagagcaggagctatattgcctagcacacagcctgcttcatagtaataaatactcgataaatgaatgaatgaatgaatcactttattttaacaattatatattgatacattgtctcttaagtgcacatcactgtgcagtagttcttcctgaaggtgcttatggacaggtctaatcctactcagtctatgcaggatttctgactggaatgctcttaacactacttatgttgggtacagtgatttaaaatgtatttatagctaattcattgagaaaaataagcagtaggcaaattgacagaagttgtacttgggtttatttacgtccattttacataggttttgaaaagagactcttgatatttacggtgttagatctggtcaaagatcccccatgctgtgttggtgaatgtgccctttctggatgattcagaagggtcattgggattacatgtgcttatatgatccaggtatggaaggtagaatattagtttttcttttgttttaaggtcatgctatatgtaatgcattaactatttgttaattgttttatctctcaattaatgtcattaaacattttttatttatttttatttttaatagagatggatcttgctttgttgcccaggctggtcttgaactcctgggctaaagtgattctcctgtcccagcctcccaagtgttaggattacagatgtgagccaccacacctggccactaaattgtatgatttttattgtgaaatttcttttcgtttggcttggtttgttctagacatatgatataaatacctggtttgtctctacctctgatttttaaaattggtgtgtaatatgctgtgttaaagtgatttgtaagtgctagcatatatctcaatgtctccaggcctgcatgtttgcaaaaagaatactgcttttgtctaagtcacagctttgtgttgtatgttacatatggtaatgcatttgagttctttgcaaactgtagtatgctatataagtgtaatgtcatataagtttaagcttacttatgtatattttcatagcttattcttttaacagtatattgtaattagaaaacaatgtctttttagattaataattgtgatgagaattagaatctatatttctttactaaatgtcctttttaaagacaaattttaatgcttttctaggtgaacacttttaacagtgtcattataaataaaatgaacagaactcattatagtttttgggttttataggtcttgtcaccaccaagtgtttgtagtgtttgtattattgatcccactttgtgatctttaggttactggagttggctataatcaatttggggaagtgattgttgatggtgatgttgttcatggattctataacccagctgttagcagaattgttgaggtaaatatttttttttccaagatggtgactttcttcataataacttaagacacagtgataggttcatagtttatgtgtatttttcttaggcgggctgtgtgtgcaatgatgctgtaattagaaacaatactctaatggggaagccaacagaaggggccttaattgctcttgcaatgaaggtacgtacctaaatttctcttctttgacatttgagacactgccctcacaacagaatgcagtgtcatcaatttcagtattactggtttttaggtattgagtgaaaaaaactcatactatttcattgtttttactatcttttaggtatcagttttattcctataaatgtaaagtatagacttttttcagtataactttattgttcacatgcaagttacaaactaatgagcagtcattgatttcttgtgaagaaatgttcctgtcttccacaatgttgagatctacatgtgaaatactttataaatgtgtgtaattgctgataaatactaacttttgaatgaataaaaggcaacattctttagtatttctatgtaaagataataacacagtcatgagaaaatagctttgttttcccagtctttcctttctctcctttgttaatttctcaaaatgattgtgaagttataatttgttttggggagaagaagtctcagttaacttttcatctgtcccaatccgtctccttatcccctaagtcctatatttgattcagtgagaaacctagtaagtccagcctgtcactcataacaaaaataactattcctacctttaagagtattcagagaaaattttgatacttgtataaagcaagaggcttctaaatgaggttgcttgaaatgagagacagtacagaattacaggttattataacatatttaatgaaataaaattgatagttttagaatatatagtttccttggcagaaaagcacatttctgtatcatttggtctccttacaactaaaacagcatagtactcaaaacatgaatccgttatcaagtatttcctgtgttatgcttataaagatattagtttctttgagggataaagaatatgaaactatctttttatgggcagagacctcacattttaggtagggaatttatattgacattcttgagacaaaaggcagtccaagacagcagacactgaaatcttaaacactgagtcacatataagataagaacaatgcaaattcagagctgggatatgagggctttgaaggataggaagggtttagatgagataagctagggaatgaactaaagtagaagtagagaggaataaaagagcatagagttggttgtggctaatgagttggccaaactggatgaaatgaaacgtatttgcacgaccaggaggatttttatagacgctgtatgtggtgggtttctggagaacctttaaggccaagaagagcctgaacatgtttcagtagaaagtagaaagcaatacatggtagaattttgagtagtttaaacatttttgatatttggaagatattttttgatatttttgatatttagatatttgatattgatgcaaacgctattaggagggaaaacaacaacatgactggtagtattcaggatataaagtggcagagggtaagggactaggatgataacaggtgagccatttgagtccctaagaagtgagagatttaatctaaaacttctattgatcataaaaatacatgctcagaattggttgggtacttttatttatttatatcctgcttcctttcagaatttgagtgggtagagggattaatacagtgtgtatgggaggtttagtcagcgtacaatccagaaaacctgccttagactatatctacatacctgggctttcatgttgaaaatgtatgctgatgtgtagggaagtacagtatatatagatggagcatttactatttcactattaactgaaaaataatccagccaacctagttacaagtggtgacccttgttctttgttaaaggaaaaaataatcacatataggtgagaattaactttctctttgtgccatatagatgggtcttgatggacttcaacaagactacatcagaaaagctgaatacccttttagctctgagcaaaagtggatggctgttaagtgtgtacaccgaacacagcaggtatccatctgtttaaagaatacttatttcctgtttagcttagatgactattttttcatttactgtccacctttgggtttagtcattgtacataataaagacttgttgctttaaagtacatgtaattaatagtacactcatctcttaattgtttgtgttctctttgatagtctttccttatagaatccatgcatagatatattcatggagttgctgctgtgtgagcaaacagcttaaatgagttgtagcctagtctcagtctcctgaagcttgtgacatcagattttttcagaattttttctcttcttcatgacagttccttataaggtctttgcagactgtgtttcaatctgtgttctttcactgaaggaatgtcttatctttagaacaaatgaagccaccttactttttgaaaagtagtttgcaaatgtatgtcattcatgttgattactccagcttacaagctgacaaaatgacataccgatattttaagccgccaccttgttcctgggtgcttgagaaatttttccagttagtgtaataagagttctgaattatctacagtgtataattatatcactcatagttgctattaccagcttgatgatgaaacttaactttaaaaaatattgaagcttgggctggatgcggtagctcacgcctgtaatcccagcactttgggaggccaaggcgggtggatcacctgaggtcaggagtttgagaccagcctgaccaatatggtgaaaccctgtctgtactaaaaatacaaaaattagccaggtgtggtggtgtgtgcctgtagtcccagctactcaggaggctgagacaggggaattgtttgaacctgggaggcggaggttgcagtgaggctgagacaggggaattgtttgaacctgggaggcggaggttgcagtgagccgagatcaccccagtgcactccagcctgggcaacagcctgtctaaaaaaaaaattacacacacacacacacacacacacacacacacacacacccttaaactttccttcactcttttgcctaggctgagtgcagtggcgtgacctcgggtcactgcaacctcaacctcccctggcacaagtgatcttcccacttcagcttcccaagtagctgggactgtaagcacgtgccaccatacctggctaattttgctaattttttgtagagatgggatctcattgtgtttcctaggctggtcttgaacccctggactcacatgatcctccaccttggcctcccagagtgctgggattgcaggcgtgagccaccatgcctggacttatttgttatttttatagttcctttgacaggaatgactagttggttatatgtttttacctatgagcaaacacatgatttttgcatgtgatacctatgattacgtctctatagaaaacaggaatgaagggatctcccttcattcatataagtggaaacatacagtttttaaaagaaaggccaggttggttaacactgaactttgaattgaagtcttccaggaactatgttcatgagggccaaaaaaaagatttccgtctattctttaaaggaacttttacaagcttaggtgaaagaagacaattggaaataaaactatgaaaatacaatacctttcactttaaacgttttaatgtaaagctttcagaaattgcattaaacttaggcgattttcagctgatgtcccttaaccacatagttatatggcaagcatatgcatatgactttttttgataggtctatttcattacattttgtaaaccatcacacggtacctcaagatagtgtggctcatgtaatgtttaataattttacttttcaggaacttttaatgtaatctaccaaagttttacattggaagattaaatcttcttagttgtgggagtgggggacagaaagtggcaggatatgtttggaaacatttgattattcttcacacttgctgacctgaagagttcctcttgcaagtgaaaaccaaccagtgaaatgaacaaacaaaacccaacccacagatgtgactcaggatctagaagaagtcatcctgacacagatagggaaacttaacattttaaaagtaacttcagtggctcagatagtttgcttttaaaggactttcacttgaacatgacaatatatatttatctctactatctccctggaacccaccaaaattactaacaaggaataaaagatataaactcagaaagtatagggaagattcaaaggtgccaggtacctttgaaggcagggagtaaggcataaggctaaaaatagtagagaaatttgaaattctgaataaggaaccaatagaactcccccaagtacctttgctgcttctttaggccagacggttagccttcctttacccctgtggaacaccagaaatctggggataagagtagagggtaggattaagccttaagactgaaaacagaatgattaagaagatgtcattgtcctgaaggataaagccctagttcttaacaccatttgtctcttggaatacatgaaggctggcatctccctactgtcattccctaagtaagaagattcaagagttttagaaaagctgcctggtctcgtaaggcagtggtccccagcctttttggcaccagggactggtttcctggaactcttccacaggcaggggatggttttgcgatgacactggtccacctcagatcctcaggcattagattctcttaaggagtgcacaacctagatcccttgcatgtgtagttcacgatagggttcctgcttctatgagaatctcaggccctggctgacctgacaggagattgagctcaggcagtagtgctctcttgcctgcagcccacttcttctttgtggctgggttcctaacataccatggactgtactggtccactgcctgggagttggggagccctgtcataaggggcacctttgagctaagctctttgttcattggaagcacttacctactcctggacttcatctcatcaccctacagcaaggcttaccagttgatccttagctctgccagtgctcatggagcttctagtcttttagtttcttcactcttttttttttttttatatactttaagttttagggtacatgtgcacaatgtgccggttagttacatatgtatacatgtgccatgctggtgtgctgcacccattaactcatcatttagcattaggtatatctcctaatgctatccctccccctccccccaccccacaacagtccccagagtgttcttcctgtgtccatgtgttctcattgttcacttctcatctatgagtgagaacatgcggtgtttggttttttgtccttgcgatagtttactgagaatgatgatttccagtttcatccatgtccctacaaaggacatgaactcatcattttttatggctgcatagtattccatggtgtattaaatacaagtgaacagggagggattactagatacttggagaaaatctttagtatgaaagccaaagaccaaaccaacagagaaagggatcttagagaaaggtagtggcagatgctgaagaaaatttccaaaaaccataaaaaagacaaaataactttcaataaaatgtttattaaataaagtcaagaaatgtatcaaagtagaacagaaagtcaaagacatgtacagtataaaaggtaaaaatcaaaacaaatacagaagatccagtaattaccccatagtggtaataggaagggtaataggaataggtaataggaagaaagaacagaaaatgagaagattttatcaactaatgctggaaaattttccagaatgaaaagactttagcatctagaataaagtggcccaccaactgctcagcacaatatgtatgttaaagcagagtggggtgagggataaacacaagacccataattaagaaatttgaggacacttggagagggagaattcgaagagcttctagagagctttaagcaaaggggagatcatataaaagggcttaggaactaaagtatggtagtctgccacttagcccagcgggatacattccaagactgctagtggatgcctgaaaccatgaataatattgaaccttatatataccgtgtttttttcgatccggtaacatagatggctactaagtgattaatgggcagggagcatatacggtgtggatatgctggacaaagggatgatgtccttggcaggacagagtgggatttcatcaccatactcagaatgttgtataattggaaacttatgaattatttatttttggaattttctatttaatatttttggactgctgctaagtaacagaaactgcaggaaattaaaccctggataaggggacactactttaatttctttatacttttcaatgaaaacattgacactggaggctggaagataatagagcaaagccttcaaaatgagaggaaatttatccctagctaaacttacaaatgtgaggatagaagaaaaatgtgtcccacaccacacaccctttcttagatattggtggataaaagaaaaaaaagaaaagggagacttaaaagacttaaaattcagtgaggatagaggtagagggttgttcctagataccagtggtacagcaggcctagaaatcagccaattagaaatggaaagaagactgaaggagggtggtctccagtaataatatagaggtaatagcttatctgcttctttgttgttgtgaaaaaataccatgagaagggttttatattacattgaagagtttaggaagaatgaatgataggtatacagaaaacaaattaaagaggtggttattaactttataaaagacaaaacttgaacaggaaaagaagtatcctatttgagctatcaatcaggataggccatgaaaacaacatcatgctctcctgctgcctccctgtccccaaatatctgctcattgtagttacttgggaatgcaggcagatggaagctccattttaatgtgagcacacactgtcacagcaggggtagaagaataggaaattgtgcactggcacctacatttccatttggaagtgacacaagtactcatgtttattggccaaagcaagtcatacctgaccgttgtggagtgaggacggcaatagggaaatacattcctgcctcccaggagaactgggatatttgtgaactgctatagtcattaccacacttggcttagcagcaaagagtcttgttgtaaacaaaatactggcagattttgctttagctatatcataaagatggggagggggggaatagatagtggaaatggggaaattaacatctgtcacaatagacagtgtataaaattgataactgatggagtagcagtataaacatgttaaaaacatgagggtaaatatcagagaaaacagctaagagagttaaaattattttgcttccatggagtaggactagtggtgagaagcgttgaacaggaaactgcagtatttcattataagcttttgaagattatttaccatgacaaaaaataaaagaaaaagtgcgataatacccataaatacagtgtgattgggagaattaaatggtgttttaggtagatagatatagacgtatatagtagctaatagagaacttgaaccattgtgagctgttatttctcttccatttcctgttatgttgcagtgagcctctttccacatttcagagtgccaaatttggggcttagtatagcattgccttttatgtgtgggatggtgggatagatgttttctatagaagatacagaaagctcccctataggaatatttaatcttcagagttcaggtggcagtcaaaaccttaggcttgagtaacttctctgggaattatgagaaatgaatgccacttaattttggactccaatggcaggtaagtacaagttgaaattaaacttgtgtttggtacattttcttcttaggacagaccagagatttgttttatgaaaggtgcttacgaacaagtaattaagtactgtactacataccagagcaaagggcagaccttgacacttactcagcagcagagagatgtgtaccaacaagagaaggcacgcatgggctcagcgggactcagaggtaaggctatttcagcatagtcccctggggtggaaaggtagagccttcttttaattgcagatgaattcatgcttcacatttgagctgtccaactcacttccaggatttgtagaacccttgccagtattgaggtgttaagttttagttggttaattggccctcaaaagatggaaatttgagaatgtagcaaaatatgaatcactggttcttttagatctccagaggtctctgagtagctgatagaaattttattttaaacaagtttatcttatgagaagggaaatggatcgaggtaaaatggtgttactctctttttatcactttgttttaaagacaaaaatacttttctaaaaattgagtctgaagcctctaatatatcctttaaggtgattgctaacttgatctgttactgttcaccagggaggtaaagaagtccccagattctgcttacttatatgctgctgactgagcagtgatggggagagggtctgctggacacacacacattaggccacctctcctagggatgtcatgtgtaagactcgggggttggtggttggtgtcctaacctgattcttaccttctggatagtcatctggcttctgcagaatatatgtagttatgtagtctctcacagcagttggaagagttggcttccttaattttattattttaatgaaataggagtctaagcactacaatttctgggaggaagaaaaacaagttatgtgaaaaatgtttttatttgttgttcacttaagcaaaggctttttttgagttttaaacattttgatggatttatagggcttctgttcttaaaataaactaagtttggaaaggtactcttaccagcagagaacattgctcccagcctgctgccattgcccttctctctgaaccttctgtgctgctgaaccaagatcactcctcatacccctgcccccagagcctggtgcatctcatctgggatatgggctgtattgtgaccatcttaacacttcatcccctgtctccaaggaaatgggaggcagagactcatggctgagaagttattttgcaaatggatattttggatggaaaaaaatttaaaggaaaacaacttttccttccccctttccccttttaatgtaagaggctttgatgacaggttctagagtttctggggtttcatcccaaaggcctgaatctggaacatgccctggatccccccacctcagtcctcaagctttctggacccctgaagccaaggcagattctttctcccagcgtcatttctggggcaggaggaatctcttttctggtttacctgggccagacctaagaatagcaggatctctgaaaccacagggttttgatgtgtttttatcaagccaaatgtacaattgccaactgacactctggataattgagcacagggggtgccctcgtacattgtaccgtcactcccttctgaacagttggcagaccaaactgtttggaagctcagatactctggctcagggtaacacttttgttccccttacactcctcaactttccacctcagctagggaaagagaatgacagttaaggcttgacccaggattataatcgttagagcaagtgggagtttcagagacttaaggggcactgcagggaggccttgctgccacaaaattagggtttggattgataaagcctgtgtcggaaggggcagtggcagctccactgagacaatcctgggaagactgtggtgcagagggcctgttactcccctgattcacctgattctggggctttgaccctttctttttaaatttacttttgctaagttgcacttatttattttttaaaaagaccgttggtgaacaaaatgtgaacccatttctttcctcttttgaacttctgggatgtcatcacttccagtttgttggctttgtttccagctattaataaagcattaaaagagtggagaaaaaaaggtagggaagtgggcagagtcttgctactcttagcagcacatagcaagaggttttaaagtggcatggatttagaggacttaaagaggtcttgaaggtctaatatatgctccctctttttgttagtttctggaacaaagttttcctacctcattatattgactaattcttttcatatgaaggattgtggaggtttgtgtatgtgtgttttgtactgtaacattatgaagtagaccagagttggtagaggggaaagtttttgttgcacagagttttgggaaacattctgctcatttgtctcttgcttcatgtcttttcttctttatctacccttgtgctccacttccatcctccccctgagattaccgtaatgaagaacagaaagattttaaacctcagttgatatgtacttacattacatcttatgaaacaagtttcttaaaatactgtggttcttaattttgatattagagtatattttgttttatgtcaggggctctccacatgaaaaaagtttacctatccttgactcagagagtagcagcagattttcactggtgctaaagaagcaaataaatacaggatactaacctctagactagtgccacccctccattaggagtgcgcagagctgatctttccgtcttaggatttgctgacatatatttttgtcactgtccccttctgttaccatcagcctctatcctaacaccaggaactgtgaagtggctcattctctcaagggtgaaagcctttggagcccacatctacataaataattaggtatatgactcttactttggaaaaatagaattacttgcttttaaccttgattttttttgagcatatgtaatctttcataccttctgcttgacgaagaatggatagtttctttggtctctctggggcttttcagtctcctcttgacttatttatgtttagtttgtatgtgcatgttacaagttgttcagtctaatatctcagatgcaggcacatccctttggttaataaaagtagtttccggagttccataattctgagagcaagctaaatgatatttgggaaatgaaaagtactttgtactatatcttacatgcccaaggatgatgacagggaaataagtagaaataataatatgatggcgttatttacatactcttagagaaccaacgttacaaataagaaatgtctgttcatgttatggaaggagtaaaagaatccaaactattgttggtattaatggttttacaaccactttccaaattagctttaccttccaggagttttcatgtacaaagttgttacaggctgtgtataattaactaatacagccttctcttcagagtgtttaatttttctggagatcttggaaatggaaagatgaagatccgttagaagccaccttcaaaggtgtttgcctgtttaaaattgactttaaagcctaacaaacccatagtttctctaaataattaattctattttttaaagaggtagagttcctgttgaaagtagctgcatgtgattactatgtgaaaatattgttcattttctgtctcttgcctactctgcccttcagttctttagtttgattctttttaattaaaacagcttaaagggaccccttatccagaaccattaaactataatgttttggtctgtaatcattttgattttacaaatgacattatagtcttaagtgatttatttaagaagtgttactgtctccaatttctatcaactaaattctgatgttttcatgactcacttttttttgttgttgtttggattttattatttcctaagttcttgctttggcttctggtcctgaactgggacagctgacatttcttggcttggtgggaatcattgatccacctagaactggtgtgaaagaagctgttacaacactcattgcctcaggagtatcaataaaaatgattactggagattcacaggagactgcagttgcaatcggtataactagactgctttcttttgttttcgatagtttttcttaaaatactgtggtgcataattttgtgaactattagttatgaatatgtttatgtaatattgagattatgcaattgaaatcgactcatggttttgctcatggtctatataaagttggcaaaactgattatagtttaaaaagtaataactttgacatgcataactaaatcatgaaatcacatgcattttattcacagaagggtaattatttttaatctcatgatcaactgtgatgacagagtaaaagcactagatcatgattgtcaaaggaaacatgaaacttagtttttcctttcaacttaagtataattttcaaagcagacttgtgcataatttggcagaaaatagcttgttatatgtatttgtttttcatcatgtatacctatatttgaatgctatttaagattaccgtaagaagtagaataagagcgaagaagagaatgaaagttaatttcccagagcctctaaactgtaattcatactgataaatttaacagttggctaaactccattaattcttatttggagaggggctagtccaggagtttcaaactatatattgtctaagaacaggtcactaggaacattatattattggaagaataacttttcgatgtttattttcatttatgtataactacatgattaccacagatccaccaccattttgtctggcttcggacactgtacttaaaatgcactctgatcttcgttacatttcagctgctgagcagaacctgattggcctagtttcgattcttaggtatgctagcttaaatagtcaaaattctttttttttttttttcctgtagagacagggtcttgctatattgcccaggctggtcttgaactcctgggctcaagtgatcctgtagccccaaagtgcagagattacaagcctgagccaccgtggccagccttgaaaattctttattcttaaatttaaacaaaaatgaaagtcaaacataaaactccagacttaatactgattcagataggtttgtattactggtaggtaacaaaagagaacagataacaaatcatactaaatgagcattacgttgactagcctgtcaagcaaaaacaatttggtttattacattttctctctcatttgctttagccagtcgtctgggattgtattccaaaacttcccagtcagtctcaggagaagaaatagatgcaatggatgttcagcagctttcacaaatagtaccaaaggtaggcctaaactaaagccttttggactgaaaggccttattctaagtgttaccatttctactactatcttaatgaaactgtttaattgtgaacatcagggatttaaataaccaccagatttgttggttcaaatcctgaaatgaagtcttatcattgaattagtcttatcattgattatttatgatatgatgtttatgaatatcagtgcaaaattattaattttagcaagaaccagatttcctctgagaaaagtactgtggaaattaatagtgcttgtatttatgaattagaggatggagagagatcattgatttatacttcttactcttttgttcaattttaattttagcatgagtatgtgattttttttaggtacaatttacatatagtaaaattcgcccattttagtgtatagttctgaacattgagtgatgcatgcagtcttgtgaccaccaccacaatcaagatatagaacagttccatcatccccccagattatcttaggcctttttgtggtaccttctccccctacttccaggacttggcagccactaattctttttttgtctctgccactttaccttttctagaatgcactaaaaattgaatcataccatatgaatgaggcttttgaatctgcttctttcacttagcataatgcatttgacatttatctatgttggttgtgtgtattagtagtttgttgttgttttttaaagtaatattctattataggtgtaccttacctattcaccagttaaaggacatttagattgtttccactttttgatgattatgaataaagatgctgtcaacatttgtgtacaggcttttgcagtttgtacacaaatttattttgcatgaaaatacattttcatatctcttgggtaaatatctgtgagtaattgctgggtcatacacttaatgtatatttaatttcataagaaactgccaagttgttttacgagatggctttattattttgcaaccccaccagcagtgcctggaacttctaatagtcctgcatcctcactagcacaagggattgtcattgccctcctcccccattctgataagtgtacaatggtatcttactgtgattttaatgtgcgtttccctcacaactagtgatgttgaatatcttttcatatgcttatttgccatccatatatcttctttagtgaagtgtctgccctgcctattttttaaaaattatgttttctaattattgaattttgagcattctttatataatgtggatacaagtcctttattagatatttgtttgaaaatgtttctttccagttggtagtgtgtcttttccaagagagaagcttttaattttgattaggtctagtttttcaatttcttcttttatggactatgcttttgatatctcagaactccctgcctaacccaggttcacaaagattttcttcgtgttttcttatagaagttttatagttttgggttttatacttaggtctgtgatccattttgagtgtatttttttgtatatgttgtaatgggttacggtttattttctttgcatatagatgttcagttattccagcaacatttgttgaaaagactgtcctttttccattgaaatactttttaacttttgattataatgcttttctaacaaattatttgtaggaaggaggtatctcctgccccacagcacagtagcttctttaaagccaggttccctgatatgagattaacttactttattatcttgggctgccttgtaaggggcctatcaaagcctggtttgtggatacccaggtcccataggaagtgccccataagaggtgggcagcagtcttcccagttgctgacagttcagatttcttggttttattgttagttaacttatatatgcacatctatttgtatgtccttcaaaataagcacttatctggaatttattttattagctattttgtagccatccattgttactaataaaatgtgctacctcctccttcatttattttacacttacaacttcaagttatatattcagaatgtggaattttcttaaattgtttctgcatcttaaggtatgtctatacttttttgattagaaaatttattcattagtggtatatgttcaacatagaaaaatcaaataatatagaaaagtaagagctacaatagaagttgtctgtaatctaacccacactcaggttatgcatccacagagtatccataataagttaacctattatgacttaaaaaaatgtgtttaacaaaacctggttgctactttatactgttataattctgaacattcattttacataactttggcatttctgaaatcaattattattagaaaacatgtttttaattgctgtacaatattttgagtataccatgtgtatgtgtgtataaatgcatagcatgcatatatatatatagagagagagagttacataaccattttcctgttgaaatttgagcttctattctttttactactgtaaatgttcctttaaggataatgacaatagcaaccatttattatctgccaatgcatgtattacctacattatctaatttacttcttatagctaccttatgaaagataggcagcaccgctttaaaaattctaataattaataagccttatttcttagcagtgttagatttatagaataattgagcagataacacagagttctacattcctactccatctctaccctctactcttacacagttcctcttcatattaatagactgcattactgtagtatatttattgcaattaatgagctaatattgatacattcttatttcatggtttacattaaggtttactttttgtgttgtacctttctaggggttttgacaaatgcataatgacatatatccaccattacaatttcttttgagacggagtctcgctccaccattagaatttcatacagggtagtttcattgccctgaaaatccctgtgtttgacgttttcatccctccccactccgcttgaatccttgacaaccactgatctttttactgtctctgtagttttgccttttccagaatgtgtatggttggaataatatcatatgtagcctttgcagactggatttttttcactaagcaacatgcatttaaggtttcaccatgtcttttcctggcttagtagctcatttcttgtgagcactaaataatattccattgtatgaaagtgccacagtttatcacttcaccttttgaagggcatcttagttgcttccaggtttggcaattatatataaagctgctctaaacattcatatacaggtttttgcgtagacataagttttcaattcatttgggtaaatactaagcacagttgctgaatcagatcatatggtaagagtatatttagttttttaagaaacaggcaattccatttttatagatgaggaaattgaggcccacagtacttgggagacttggctgatgtctcagagctagtaagtggtggtgttggcattggaactggaatccaggtctgtatgctccagagttcatctgttgtttgctgtttctttgaatattattgaacctaagatgtacccaactctgattattattattattgttattattttttaccactgcccttatccatgtacatctgattatttttatacactaaattcctgcatgtgaaatgattggactaatgttcaacacatttgtaaggccgttaacatatattgctgaattgtcctctgaaaaagtttctgtttatatttccataaactacacttcatacagtagcattaagtccctagacctccagccccacttccctcatcctctagcaagtggttagattttggatgttgttactaatagaaatacactattttgcttatccatattttttatttctcaacttctaatcactcatgaatgctgttttcagagagagccaatcatagtcctgaaagatgtaatctctaatgttgaaatcctgaaagattgaaatccataaagtcttaaaatcctgaaaaaccacagtccccaaagatcaaaatcctaaaaatctaattctggaaaaaataattttaaaataaaataatttacatttttaagaaggaatttatttgagaaacataaaaacatgaaaatgcttcattggtcactttatacaaaataagcaataataaataacctacatagttttgcaagcatttgcaagcataaacactcaggcatattatatgacagaaagatataacataggactgttatgagcatatgaactgtatttataaagaaataggtcataagggaaatgcataaacacctatcactgtggttgctaattgtgtgcaccccactttataactgtgggtcatttttatctttcacaaatgcagatgtatgaaaaggacatctgttcatttattgaggaagtttcaacatttttacatacatgtacagtgcttacatacaaagtcaacattgtgatcatgcactttcgtgaagtcagatttgcaaaacatgcataaaacaaattagaatcctttaagtctctataacttacgcttccagtgttggaaatgatgcaaaggtgaaatacatagcatagcaaattgtaaaaaataatactcacaatttaaaatagcggaaaaggaaactaaaaaaagaaaaataatggccgggtgtggtggctcacagctgtaatcccagcactttgggaggctgaggtggatggattgcctgaggtcaggatttcgagacctgcctggccaacatggcgaaaccccatctctactaaaaatacaaaaattagctgggtgtggtggtgggcgcctgtaatcccagctactctaaggaggctgaggcaggagaatcgcttgaacccaggaggcagaggctgcagtgagctgagattgcaccagtgcactccagcctgggctacagagcaagactccttcccccaccccacctcccccgccccaccaaaaaaaaaaaccaaattaacaacaacagcaaaaaacctaaaaagaaaatatgacatggaaaagcatattacagagataaatgatggacagttgcatggagatagtccataaaagctggctgactttcacgatcattaactatattttgaagtcttgcagcatgatgagtagttgcttttttttctttaagaacatggctgtcagcgtatgttcatattcattttctatgtggcactgctgtttttgaaattctatgattcgatgtacactaacatgaacattctctattaaattttcctatcctgtgattgtgattttcaggagtttagactttagggattttgatctttagggatttcagcatttgggattatggcatttggtattgcatctttcaagattatgatcccagtatgttgggatcatagatgactgttgggatcactgccacccagagagctggggcagtgtggatgtttgctttgtttttggggtggggaaggtgtttatatatttgaatagggctttttttttttttttggtgcacgtcctatcctggtaatctcttcctgaagtttatttctgaataaatcccatattggatttttttagtggtattgggacagagtattagtaaatgtatgtgaaatctgcagttacttaaacattttaccattagacttctgcataacttctcagagatgctaaaggtggtgaaactttcattttatttgctttcttcagtttgtcctctggctctcttataaaaattaaggtgaactctggaaaccaaccaaagatagttagggaagaaagaaactaattacaaattacatcatcagcctggacaaatcacattgttggggtttcccaagtagagtgtgtgtgcgttaattatagcagatatcctgatgctattccaaggagactaaaacaaaataagacctaagccctgtcagaagctcgttgaattgcttaaattcatcctactttaaagtggaattctataaatactagccctgcctcccaggtattttgtatcttttgaatacctaagtcttttctccaaatattattagagaattttttgtctcattaggttagcaggacggcccccaccctcatcttgtctttttccctacttcattttgtgttcatgtgacccttttatagccaatatgtttatttggccttcagctttttgattagtttagtttagtttagtttagtttagtttagtttagtttagtttagtttagtttagttagtttagtttagtttagtttagtttagttttagagatggtgttttgctttattgcccagactggagtgcagtggcatgatcatagctcactgctgccctgaattcctgggcccaagctatcctctgccttagcctcccaagtagctggaactgtaggtgctcaccactatgcttgggtaattaaaaaaaaaaaaaaagaaagaaaatccatttctgaatggatttttaaacttttttgaaagaaaggatttgcagaaatggagtctcaccacgtgttgcccagactggtcctgaacttctgggctcaagtgatcctcccacctcaacctcccaaagtgctggggttataggcatgagccactgcacgtagcctcgtcttctgctttcctttgtttgttttttgagacagagtctcctgctttgttgactaggctagagtgtagtggtgtgaccatagcccactgcaacctcaaactcctgggttcaggtgatctccccagttcaggtgatccctcatgactcagtctcctgagtagctgggactactggcatatgccaccatgcctaggtaattttgttattttttatagagatggggtcttgctgtgttgcccaggttggtctcaaactcctgggctcaagtgatcctcctaccttggcctctcaaagtgttgggattacaggcataagccactgcactcagacagtttgctgcttttgcttcacatcagtttgaataacttttattattgttacaaataaaacagaccttttgttctaaatcattagcttgttgacattttcccccatgtactagaatcatattaattgtgcccctcattaaaatatttttcagccatcctttttcataattcttttgaacacatttcattctccttttggaatatgaagtgttgctatgtactttgacctagagccagttaaaaagtagtactgaatctcagttttgcttgttattaagtcatctgggaattctcagtgttttccatttatgactttttctagtgtgtcctacattttccattgatccattgatagaagtggtcatcctctttcattcttctttttctgatttttacagcattacttgcatttatatttctactgaatctattcaccaagtccccatattattatcacaattcatatagtctaatttttaataggttgtaaacctttatttcaatcacttgttttttcttcagtgcattagttttctttaatctgtcctagaagatttgaggatcttcggtaggttattctaatgcaagacacatcttttccattaatctctcctttaatattttcctttctttttttttgtaacttcctttccctagtacatcttgtctattaatttccatcaaaagaactgtgagtgctgaccacaaatgtgacactgaaaaggaggactcataagaagagaaaaataccccttgtagattgcttctgaaaatatgtggccttgttctactctctttgatgatttttatctcttcctccaaatctaaaatcaggccaaaatacccaactgtcacaactggatcaagccagctgcaccttttaccaccaagtacaaggctcactgcaacccacggatacccatctaacttcgggacagccatgatccccaataggcagggatgacacccacgaccagcaagaagcagctacagaaaattgatcctcagtgcctctgcctcccataaagatttatggggatcatgtctctcggagaaatgaggcagaatagggaattagggtaatcaagggttaaggcataagtaaaagaacagtagatgcagccagttctaggcaagattaggcagcatttaggccacatccttaatcctgtgataacaagacagtagtctccacttcagcctctgattggctggggaccaagtctccacttcagtctctgattggtcacaggctaatccttcatagggtgtaaccaattggaggcctctaaatggcatctggtagtgttaccaaattcttttaacttaataaaaaccctaggccgggcacggtggctcacacctgtaattccagcactttgggaggccgaggctggtggatcataaggtcaggagttcaagaccagcctggccaagatggtaaaaccccgtctctactaaaaatacaaaaagtagctgggtatggtggcgggcacctgtaatcccagctacttgggaggctgaggcagagaattgcttgaaccaaggaggcagaggtagtgagccgagattgcgccactgcactccagcctgggctacaagagcgaaaatccatctcaaaaaaaaaaaaaacaaaaaaacaaacacacaaaaaaacggctgggtgtggtggctcatgcctgtaatgcactttgggaggccaaggtgggcagatcatctgaggttgggagttcgggaccagcctgaccaacatggagaaaacctgtctctactaaaaaatacaaaattagctgggcgtggtggtgcatgcctgtaatcccagctacttgggaggctgaggcaggagaatcgcttgaacccgggaggaggaggttgtggtgagccgagattgcgccattgcactccagcctgggcaacaagagcgaaactccatctcaaaaaaaaaaaaaaaaaacacaaaccctaaagaacattgtagttgggactcatgagccgcttgctcgagcccgttctactctatggagtgtacttttgcttcaataagtttgtacttctgttgcttcgttcttttgttcctttgtgtgttttgttcaattctttgttcaacacatgaagtacatggacaactcacagtcacaacctttcattcgctaacttattttgcagcttttgccaaacacttgttatatttcagtgctgtgtgctacatgattaatttctgcagtaattagagttttcacttggaaggttaccagtatgttttggatatatgtgtaactcagtcttttttttaaaggcacactgaagagtttctgaatggatttttgaacttttttgaaagaaaggatatttcccaaatataagttatgtgattcatgatatttggattgcctagggataatcagtagtgtgatattacagtgcagctgagtcttttgtttaagaaaataatactttttttatttagacctttattaaaggagagaaccagggaacagtctttatggtagtactgagatttattcagttgttcattcattttatttgtctttatagagcgctgttggtataggacaaaaatctctggcttcatgagtcttagaagataaatgaatataatgttaaataagtgcttaagagcaacccccccccccacaaaaaaaggcaaaatttgaatgataagagagggagattgaaatttttatatagtaagactagggagggcctcactgagaaggtactatttgacagaagagggacccatgttatatccgaggaaagagcattccagacaagggcagaggctggaagtgagtgtgcctggcatgtgtgaggaacaacgaggaggccaatgtagttcagtcaggaaaagattaatgataggagtgcagtgaggtgtgaacttcatgagggacccggtagataataaaggacttaggcatttgttttgagagagatgtgaaatcatttgagggttttgagaagagacacgcgatctcacttctgttttaacagtgccactctggctactgtgttgcaaattgactgcaggaaactagggcagaaataagaaaatcagtttggaggtattggcccagagtgtgggcaatggttttggagtaaggtggttgaattctggatatatttgtgagtggagtcaacaagattcgctgtcaaactgcttgttggcacataagaaaaatggaggaattaaggttggctcccaaaatttggagcctcagcaactgcacatatgtacttttcactaacagaggataggaaggagcaagattgagacatctaagaggaaatgtgaagtagggatgggaattagttttgctgatctggatttcagaagaaatgtctgggcttgagataaaaatgcattcaaaaaaatgcatgtaagtaaaatccaaagccatgtgcctgggtatgctcacctgaggcgtagggaattctgagacctcttatagagaaaggaactgagccctggggtgctccaacatctaggcatcaagagggatcaggagaagtctgtacaagaggaacagccaaaaaggtaggaggaagaccagtatcggtggtagtggaagccaagggaagatggtgtttcaggagggactaatcagctacgttagggtgcggctgagagattaagtcagatgagaaatgactgtaggcattagcaatgtggtggtggtggtggtggtgcaggtctttgaaagtcatgaatcgtgtttcactgcagttgtggtaacagtatgatcatgggatggattcagagagaatgggagacagcaagtataggctacttgctaaggagctctgctccaaaaatcctccccgttcctatatcaaaattttttccttgctgctgcactttaccatcagtatacaaacatgtttcctcttccatttaaaaaaaataaagaaaaaaaagggaaagggtggcagctgaaatgggaagggaagagaagtggtttttctttctttttttatatggaagggacaacatgtttttgtatactgacggtaaagatatagcagtgaggaaaacattttggcacaggagggaggagaatttctggagtaatggtcttaataggtaagaaggtagaatctttgacctgcagtagatgcatattgagttcatctgtagtaaaaccagaggttagttcctggatacagatactgagttgggggaattgtggaaattctcttctgattctgatttctccaaagtaggaagcaaggtggtcggctgagaaggaggctagagaaaggggatagattgcaggtacgaggagagaaaactaatatgaactaatcctctaggagaataggaaagagaatggtgtattatgtatattgaaatcaccataacttgtaaatattgttggagagagtgacatggtagtgaggcagaagttaaaatcattgtgaaatgaggggctgtgaactccggagcagtgaatgcttacagttagtgagttacagtctcatctgacattcagaactgaggttttatgaagggagaatagcggataccgtgttccacctgtaggctcccccagtggtactatttgaggaggttatagggatggtagtgttttgtggaaacactaggttagagcaaagtactatttgaggaggttatagggatggtagtgttttgtggaaacactaggttagagcaaagtgaaaaagagtaaaaaatagaggagatttgttggaacacagtgaaacgattttagatcaggagatggggtcagaaaaaaggattaaatatttattttggagagataaaaatcatataagcaatttagaagtacagtggaagagaggctaatgagttaacctgagtaaaagggaatgagcagacacttgacactgtaaaaaatggctctacagacactgagaagcagctgttctttattgctcctgaagacagaacaaagggaaaaggctattttagttgtatgcgagtgtcataggaaacagacgcaagagaatttttcctttttttgtctctggaacatttcaagaataaggctgttttctttccagagtttacacataatgatataaattggatgacttgtttagattgtgtatttcctgtggtacctttggtaaagattgaaatgaccatgtcagattaatgtcttaacaaacatatgtcatattgcttaagcttgatctcagtggcaaattaaatacagcttaaattgatgagtttttcatcattagttatgaatgcatgggttattctgtagaaatcttaatattgaagatttttagtgtatcttgtattttaacaggttgcagtattttacagagctagcccaaggcacaagatgaaaattattaaggtgagtgtgtaagaatcagattgttttatttctgtatacaaaatgctgctactttacttttgttatgtttgcattacagggagtagagcatcaaggtcagaaatactgtgaagcaaaacagttttttttttttgtaagagcttgacatagaaacactaatagagaatttagttggcataagatgtagaagaaaacttgaatgaagtatctgcaaatacagccttctttaaacagttagacagtataaaacaatgttctaactggggtccatagccgagtcatcccagcgtaaatagcagtaattagttagaaactaaataaatacagcaaggaaatagtgttgtgacagtgtgaacagtgcttaaaaggctatgattatttatattaattagtcaaatgtatttaaaccaactgatagagtatccagtagttaatggtcttaagttatgatagccagccattgtgtagttcagagtttctcaaccttggcaccattgacattttggactggataattccttgttgtgaagggctgccccatatgttattgaatgtttagcagcattcttggccccttcccactaggtgccagtaacatcccccaaatcctgatagtccaaaacatctccacacattgtcagatgtcccttgggagacacaattgcccctggttgagaatcattgtatagttgtttgaagaacagaatttagagatacagttctcacagatgggaatattagtagcaactttttctaagctttatcttactgagatctccatttgttgaagttcattgaacaatgggtggtctatattatttctaatcttaattatgtgaaaaaaatagggaggatttgtttatcgctttgtatggaagcaacatttttatcaaaattccttcctctcccctgtcctctgctccactctagtcgctacagaagaacggttcagttgtagccatgacaggagatggagtaaatgatgcagttgctctgaaggctgcagacattggagttgcgatgggccagactggtacagatgtttgcaaagaggcagcagacatgatcctagtggatgatgattttcaaaccataatgtaagctttgtttcagtgaatgcctatcagagaatcttcccctatcctttcctgtcccccacccctagagaattcaactggaaaagaattagtatttaaacattaggtaaactaaaccacttttctagggtaattatcctattttatggtatgaagaagatgatttgtgtggctggaacaggcatagtaaatggcaggaccctcatttaagaagtatttgccaagtgccagccacatttcacctttttctgggcactaatatgatggtatagtaatggcctttattttagttaaattcaggtagttagaaatatgcatatgtatggctctttttttggctttataataaatattgaaaattatgaagtttacatccatacctgttttttatatcagtaatttattcatcttgccctcatttaatgttataatttattaaatttaaatagctctatttgtgtcagccacagtttccagttgatttaagactccagtgtaatacatggtggtgtcagtttcacagtgttcaggtggggatcatgtgaatcccatttatttatttatttatttttttggtagctacctgttggatgacctgagtttagtgataaattccaattatatgttccaggctgctttattactctgttttggcctacagggaaacatttgggagcttaggactcacagtatttgccaagcttttgcaaggatatgagttttttctttccattattataattatatagaaatcttagaagaaatggggagttgattaaaaagcatagattttcctggattcagctaaatgaatgagataatttatatgaatccttgtaaaccatgttcttcatttaattcctctgcaacatgtgatctacttgatgtgcaggagcaacacgtagcttaaattctataattcctatatatctcattgccatttgattcctgacatgcattagtttaaacctttactctgcattttgtaccactaagaaaaatgagcttagaggaaggtgaagaagataatcatggctgggcagggtacctcatgcctgtaatgccagcactttgggaggctgaggtggatggatcacttgagcccaggagttcgaaaccagcctaggcaacatgtcaaaacccatctctccaaacaatacaaaaaaaatagctgggagtggtgatgtgagcctgtggtctcagctactctagaggctgagctggaggattgcttgagccaagaaggtcgaggctgcaggtaagtcaaggttgtgccactgcgctccagcctgggaagcagggcaagaccctgtctcaaaaaaaaaaaaaaaagataatcattttatgtattatgaatgtgaagtattttctcttgtgtgaagagacaatgcatgattttaatgttgaagtatcttcttcagaataagaattttaatattgtgacaaattagttcaggtagagcttaggcttgactttaattctttgctaaaataaatgtttccatattgatacatgtgttgtattagttggaattttattttatttatttgtttgtttgtttgagtcagtctcactttgttgccaaggctggagtgcagtggtgtgatcttggctcactgcaacctccgcctcccgggtttaagcgattctcctgcctcagcctcccgagtagctgggattacaggcatgcgccaccacacccggctaatttttgtatttttagtagagacggagtttcgctgcaccatggtggccaggctggtccgaactcgtgaccccaggtgatctgccagtttcggcctcccagtgtgctgggattacaggcatgagccacagtgcccggttggaaatttattttcaaaattagctctacagtgttttagtatagatacatttttgtatgataatattttctcacttcatctttattttttaaatttcaggtctgcaatcgaagagggtaaagggatttataataacattaaaaatttcgttagattccagctgagcacgtaagtttgcaagaaatttgtcaccatgggtcttctggataaattatatgaaaagtagaacttaagcagaatgcctagaaacttctctgccttatatttgtgagcattgttcatatgtcagttttccaaaaagaaaatttattgtattctgaaattttaaatggcatgataaataggttgtaaatgtaacagttagatgtctgtatcatcaaaatgtataaatctttgtgatttatttaatagctcacatctcattgtttcctcttggtatctttttccaaaagtagaaggggtattgtgtagtcaaagaacagttaccaaaatattgttgaaactatcatgcagatgtaaaaattctttatttgttcctgttgtctaaacatcttgaaaatcctttgttaaaatactcttagctttaaaatgtccacgtgactgaagaatagtttacttgaaacagtcttcctttaaaagcatagtagtaagagatttttaaatgctaaaaaagtggtatcatagaatcaacagatttactctactgatatttttaaatgactctctttttcaacaggagtatagcagcattaactttaatctcattggctacattaatgaactttcctaatcctctcaatgccatgcagattttgtggatcaatattattatggatggacccccagctcagaggtacgagttttttaattgcatgagctggaaagacaaggaatgtgtactaccctgataattaagttttaaaacttgatttatggacagtgttggaaaactttgcagcaaatgttttaacatttatgttataaattgtgtgatgtgtgtattttattaattctttttgagtgtgcatgcagtgtagatctgagcctttccactgttagatgcctagcctaaggttgagaatagatcaggaataggtgctatccctgtcctcaggaagtaagtaagccttttatttctaagaaatgggtataatggagaaatttctgggttcagttttattatctaggttctactgtcagttttagagactttgggaaagtattagaggacctgagtgtcataacttttttaaaaaatttaataataatggggtagttgagtgatagatgtcatttggccactccagcaaatcatcccagttaaaacctctttatatgaaagatatttcaaaattcagtcggtaggtcatgtatttcacaccgtatttgaaataggtaaacttacatgtaaatgaattggatggttttttgaaagttgattatctatcccctatcaaattgtgccaaacaaataaagaggagagaaaaagtgacaaaatcagtggttatttttgcgtaatcagccagcgttttatgatgcaacattttgtttctataagaaagcatttagtttgccgaataattgaggttagtgaggttgtgaaagtaacaaatccagaccttaaaacttgaaagtaatttatttttctgtttgtttttaagccttggagtagaaccagtggataaagatgtcattcgtaaacctcctcgcaactggaaagacagcattttgactaaaaacttgatacttaaaatacttgtttcatcaataatcattgtttgtgggactttgtttgtcttctggcgtgaggtatattcactggccaagctgctatattaacatgaattctgtatatctgataggattcttagttattttgatgggttacccagaaggctgggaagttaagggagctcttttagtgaaaaatataagaacattttaaaagagtttgatttccatctttatggataaataaaattattgattcatgtattagaataaatctgcagagaagtatcagttacaataaaaatacatgaaaatttagagagaagttggaaaatctgagtcttaaaatcatagagccactttattatttttaaataataacagtattttaatatctaatacatagttcatgagaagttttttttttactttttattatgtagattacagctattcactaggtgatttataggaaatttaggtagcttttatgtttcatgtgttaggctaaagttatttcttcctaatggaaagaaaatgtttatattttttaaaaagcagcgatttatccattaaattcagccactgaaaagtaattttgttattgcctcttgacagctacgagacaatgtgattacacctcgagacacaacaatgaccttcacatgctttgtgttttttgacatgttcaatgcactaagttccagatcccaggtatgtttaggtgaacttagttgattgacttgattgactcacttgagtagagtgctttctaataagtaggcaaagattatgggtttttagctttgcttaattttgtagccacagattgcagccccagacacagccttcttataaacatgtgccattggtcacaatgaggatggggcatttgtgggaggtaagctttatgtctgactagaacataaaagtattaataattcacaggtgttgtcatctgcgtttagctggctatagctataagatagatcgtggttaacattatttgagcatagaacaaacctcatagtttctgttgagattttattagtctcattttaaaagacagtattgctaggagtataagagcagttatgtgcctattttttttcccatcactcctgtcactgtgtcaaagcttaggacattctaattttgcttttcttcccttgttgtatcttaaggtgtgactgctgcttcttggtctaagtgttttgatagaaaataatgggctagagctttatggtacttttttagagcatattgtccttaaaaactagtttcatttgaggcatgactattcatttcagctttaaagcactttatgaatccttaactatattaccatttgccatgctggaacttctgagtacagcgaattctcactaattgaccaatttttgaagaagctgtaatatttatttttttatgaaaagtggttttactttttcagtacacacacaattaggtccattctccaagaaaggattttagattatctaccttagtgaatgtatagaaatgatttagcaaaatacaaataaagtttcttgatgtttgggatgttaaaaggtttcttttctttctatggtctaaattatatagtgtcactttttaagcaagccttttcttgataaataaaataaaagctactttaatatttacttttattccatctgaattattccaaaacagtagtaaaatttaagatatttcatagaattgacattgcacaattcagtgataaagtgacactgcttgttaaaaattagaagtgaatataataaagaagttatttctgtgaccaaggagtaataaatgaactctctgctctgccaacagaccaagtctgtgtttgagattggactctgcagtaatagaatgttttgctatgcagttcttggatccatcatgggacaattactagttatttactttcctccgcttcagaaggtttttcagactgagagcctaagcatactgggtaaagaaaacgttatctttatcatttatgtattttagataaatcatattttctaatgtgtttgttttaattttaaaattcttttaaaatagcaaaataagtaactcacttgatttgaaaaaggagtctattttttcacttggggaagctcaggggaattactctcctaactccagggttttggtttttgctcttttataggttatcaattgttataaaaatcataatacgtgattctcaaatatagcaaatcaaaacctgctctagagtatagtttataactttttatgtactatgccatcttgtatgaagagaaaactagacttaatctccctgaaaaccaagttgctctcttctttaaagttagaattttcagtaaactaataatttcattattctttcttgtttgtacattctaatttcacaaaatgtcagtctgaccaaatagcagaatgttttataaagactatttggaaattacacatttttcttacattaccatttattaaatgtataatacagtgcatttaaaaattagttttcctgtgtaggtgtgaggaatgatatatttgacagtaatgctatcctttattgagttctcaatttgggtatttatgaaaaggagttatacagtttcactgtattttttcttgtaagttaaaatttaccttaaaattgaactagttgaatttcagtattttaattccatattcacatttcttcctctttttaaaaaaatggcattttaaggaaacatctgcaattttccaagcagtaaataagaattgagatagtgtggatagtattgtaaagacaagtcttctatgctttgaaatagaacatattaatgtcaaatttttaatcttcagataggcattgtcattcaaattgtctactactgttgatacagtacttttttaaagggctgtgtgatctatgaaataaactccttttgttggtgatactgttaaaggctagccacataaggtttcagggaaagtggtcagaggacttgggttctaattctggctgctgcctttcctagttatgtgactttggataagtcacttaatatctttttttcttttcttatttttaactgagggtgattgtgcctgccttatggaatagttgtgaaacaatgtgtttgaaagctgtggtggccaggcgccatgcctcacgccagtaatcccaatacttcgggaggctgaggcaggcagatcacttgaggtcaggagttcaagaccagcctgtccaaaatggtgaaaccccctctctactaaaaatacgaacattagccaggtatgatggcacatgcctgtaatcccagccacttgggaggctgaggcaggcaaatggcttgaacccaggaggcggaggttgcagtgagctgagatcatgccactgcattccagcctgggtgacagagcaagacttcatctcagaaaaaaaaaaaaaaaaaaaaaaagttgtgttaaaatgctagaaaaatgtaagctattaagctttgcaactgtaagtttcaaagaaatgtaaaacccaacttattttctcttgcagatctgttgtttcttttgggtctcacctcatcagtgtgcatagtggcagaaattataaagaaggttgaaaggagcagggaaaagatccagaagcatgttagttcgacatcatcatcttttcttgaagtatgatgcatattgcattattttatttgcaaactaggaattgcagtctgaggatcatttagaagggcaagttcaagaggatatgaagatttgagaactttttaactattcattgactaaaaatgaacattaatgttaaagacttaagactttaacctgctggcagtcccaaatgaaattatgcaactttgatatcatattccttgatttaaattggcttttgtgattgagtgaaactttataaagcatatggtcagttatttaattaaaaaggcaaaacctgaaccaccttctgcacttaaagaagtctaacagtacaaatacactatctatcttagatagatatatttttttttatttttaaatattgtactatttatggtggtggggctttcttactaatacacaaataaatttaatcatttcaaaggcattctatttggtttagaagttgattcccaggagtgccatatttcagctactgtatttcctttttcttgtaatgtaagcagctcagataccatgtgctatcatttttgtatcaagttttttgcacaggatgtgaccactgtcagatcactgttcttttctttctttttgtgattgaaaagcctatactacaatttgaagtaaatttttgtttttcttagtaagtgtaaatggttgctttatttttattttaaaaaggtatgtctttggtttggcagaattcatgcagggctatcaagtggtgttctagggtaacagtgtccataattaacgcttagtcatagagtcaaaaacatttaagactgattgggttgaagtttataataaattatattaacatgtcttcctttttgaggtaaagatatatactttgtcaaatatcattttgtcatcctctaaatataaatccaaatacctcagctaagtaattctattttattatttttactgttatgtatgtttttaatcatatttcttaggaagtataggctactggacttagaataaaaagtccccaaacccaaacaaatggtttatgaaccagagtatatgtggaagattctttgctggtcttgctctgtgtgcatctgaagcttctttggcctagattttagcacaaacctgagtatatctcttctactttcatcatgtgttctgtaccttctttttgtttcattgggcatgctagggaaataggtggattttgtgtgtaatgccatcagtttttatgaaagcttgatgaggtataggtcatttgttttgagtatgtgggccagaaatttaaaattagaaatttgtttttctgttgagtatataaacaaaaattggtcccaattctaacaggtttaatccttcttgaagccaataagttttatcttttataatctgtcaggatgaaccactccttagcttttatccaatattaaactgcaagtgttagcactgaaatattgtcattgatagggaaaatatctattctttgagtcattgttactgaggcagttgagtgtaaggagctggctgcagtttattctacttaaccctttaaggctgaattgtcaaatgtacattgttccatgtcgttagatggaacatggaagccattgtctaatcaactctatcattagtgacttgatgtctcataccttaattttgtaatgatttttattctctgttacaaagacttgaaatacgtattaaatgcacgttaatgttttgctttgcattttaggttcagattatgacttgattgaaataaatgtgcctatacattcatttgctttgtactataaaaataaaaatgatttcttaagttaatgacatcccagtggggactattagcattaaaattatccatatggatgctgaagatacagaaattaaaattatccatatggatgctggagaatgcatagtacacagaatctatgatttaaaaagaagttgaatgtacagtacagatccagattgcaattttccataatatattaatccaagttgacatggatgagttaaatgggctagtatctaaattttaaatttttaccctatttcctaatcctaggacttgctagagtccctaacaatactaacttacttgatgtttttccctgttagactaccttatggagttatttggccccataatggctaaacatcagggaagaaaagaaaagaacttaaaataattcactgattaggtaaacagttctgaaatgatcaaaactggccacacagaacaaggctgaacatgttgtgtcacatttgtgctggacattgcatgacccagagatgaaacaaaagtgaaaccatgaaacccgaagaccctcccctctcaggatacaggctttatttatatagcagtaaccaccctcacaagaataagacacattatttacctgccatgcccatgtagggtatgtattttacattggtagtctttttgagatcacttaagttttggtctccttgatatactatataagtaaagtaagtattggtcacacttaaaaatagtttctcactgaaatgaattggaggcaaacaataaacataatatttaggaaacttaattaactctaccttgctttctgcctctgtcacttggcaattcacttccacatatgactcacccatgaagttagatgatgaactggttatcttttcattacatttttttagtacctggagtgtgctagaagtagaacgataatggcatccctgccctgtaggagcccatgaacacagatagcaggggatataactgctaataagctgtttcaagaaagtaaatagggatctttgcccatttactttaaaaatacacatagattaaaatgagtccagtgcacttttcactagatgtttccttgacattggcatttgaaaatctttgaagtgctttttaagactgagctcctgcaatccaaacagcagctgatttgcatactaaaacgtggtatggatgttcatccttaactagtacgtgattggacagacagatcattctgatggttaagtttccttgagctcagttaccacttgaactattaactcttatttaatgacattgttttgggttttggttgtcaagagttggttattgttaataatggataatggttaaccagtccctggtattaatgtagatacaattgtccataaacattgttgtaggtttagatttaaaaagaaaaagtagtatcatgccttcaggaagttttcagtcagttctggagaccaatgtgaaatatatccactagagtggtaaatgctgtccagaatgctacagtagttgaagtagagaaataacttcatgggatcctcaaagaaatttgtcatagaaatttcctagaactaatgacagctgaatcaaattttaagttgggaaactccagctgagaagcagtaggacagtgcagccaaacagcaaagcctctgcagaggtggtggtaggggctataaggaatctgtgaaaaccacaatgagtttgacactgttaaggcaggaggtacagtgtgaagggttggagagataggcaggaacctaatgctgaaagcagagacatttgatttgtctgatagcatgccagggcatttcaagagtttgatgtgagtttggatttttgtatcgtaacatgctgatggaagcacagagggtcaattgtgaagactgaaatagggagaccaattagaaaatcaaggaagcttaaggagtaaagggataattgagctgtggcagtcaggatggagagaaaggcatggaatttgaattgtcttttttttttttttttttttttttgaggcagggtctcactctgtcccccaggttggagtacagtggtgtgatcttggctcactgcaacttctgcctcccaggatcaagcgatcctcccacctcagcctcctgcgtatctgggattacaggtgcacaccaccatgtctggctaatttttttgtattttcggtagaggcagggtttcaccatattacccaggctggtctcgaactcctaagctcaggtgatccaccagccttgggctcccaaatgctgggattaggtgtgaaccactgtgcccagctttgaatttgtatcttctgagagatagcattgacatgactggacaggagaaaaggaaaatggaaaagatactagtctgtggcctttggcttgaatagtagagctattagcagaagaacctaagctaagcagggtttagtgggacacaggtccatctgaaatgtacagcttgtggtgtctttgagatttcccagacggatgtgttaatcaaagctatagctgactaattataagctagtagaaaaacaagcatccattttttttgttgttgttaaattaagcgataagtcaaagtaaactcagctttcacaaaataagattttctttaaaaactttcctttagcatagttattaatcagcaaacagttgtgtaaattcaaaatgcagaaggacaagataatatttcaatctcctttgttgttgaatgttaatagggaatctgttattaaggttactgactggaaaacactgatctgaattactggtagcaatttttttgatacatgtagtaagacactttctaagaggtgagagcgtgtgtgtgtgtgtatatgtgtgtgtctgtttatgtggcataccacatagcttaaggtatgccacgtaaggaaaccccaatgagtaaataacattaccattagaaaacagctacttactctgaatgagtaattatggcagaagagtagaaaacaatgttggtttttcatttgtttgttttttgagaaggagtcttgctctgttgcccaggctggagtgcagtggtgcgatcttggctcactgcaacctttgcttcctgagttcaagtgattctcctgcctcagcctcccgagtagctgggattacaggcctgtgccaccatgcccagctaatttttgcatatttagtagagacagggttttaccatgttggtcaggctggtctcgaattcctgacctcaggtgatccatgcgcctcagcctcccaaagtgctgggattacgggcatgagccaccacggttggcctgtttatttttttaaattttactcgtaatttttttggcctttctagcctcatatcctacacaatgctccaatacagtccacttccagatcattttggacagtgttactttaagttgaaatcgttttttctctgtcccaatgttgagaatcagagcttttacctctacttcagagcccagtgaaatgccaacaagaataacctttccagatttctagtgtgtgtttgtgtgtgtgtgtgtgtgtgtgtgtgtgtgtgtgtagtacagtttcttgtacactttttttttttttggcagggtgttgctctgtagtgtgatcatggctcactgcagcctggacatcctgggctcaagtgatcctcctatctcagcctctcaagtagctgggactgcaggtgcatgccaccatacctagctaattttgtgtatttttttttggtagagattaggttttgccatgttgcccaggctggtctcaaactcctgggctcaagcaatctgcccactttggcctctcaaagtgctgggattataagcgtgagccatcacgcccagcctcatttcttgtaaacactctttgaatgtagcaataagtttgcatataaaattgtgggattttatgttttagaaagcattaaaaatttaagttgaaaacacttgttgataaatctaaacagaaatttggtgatctctttcattcaaaattaaatgtcaaagtttggggagaaaagtgaaaacaattatttgagccattagtttttatccttagaaatccttttctaatgtaaatctgctggtgttctcgtgtacacgtgaacatatatgatgtaacagcctgtgcttgcacagctgctccaggtagatggtgtttcatttgcaggtcaccgtacacacctgattttgctattcctatcctgttttacgcaaatctggccaaactgacaaatatactgacaaaggcccacatttctgtggtggcttcatggctgttaggcctgacagaacttcttttcatatttaacccaagggtgccccagaatcattatttcttaagcaatagttgcattgctctacttaataacccttttgagtagaaaccacatctcattgttatgagcactcaatgccagaaactgagcaaactgttctatataaattccagagatccatttttgggctctggatttgtagcttttgaaaaatgtgccttttaatacagttttttaaaaaattactaatcttctcaactacattaaagaactttctattaaagttttctctgataagtataccaaagtgccctttagttgacaagtgacaatttggtgccatcttagggtcataaataaaataccatataatgcctggaccattgctcttatcaggtctgcatcttgcaggcatactgtgaaacacgtgatatgtgcatcttacaaataggtgactgtagaaaatgtatgtctgataggaaagacatgacaaactttacatttaagcattattagatcaattttaacaagctataaattagtatgttttaattcctattcctgtctcattcatctgtgtggttgcgtaataggattgcattagattttgtaagtatttttctatgtggagtgggtctggatggttggatggtccatgcatcagctagaggtattacaagttagggaaatagtttaatttgatcttgtttaactcacccacatggagctattatttagttttggtgtagaaactatggccaggcatggtgactcacacccttaatcccagcactttgagaggctggggaaggcgggttgcttgaggccaggagttcgagaccagtctggccaacatggcgaaactaaaaatacaaaaatctgtagagcgtggtgatgcatccctgtaatcccagcttcttgggaggctgagaaccagaactgcttgaacctgggaggtggaggctgcagtgagcctagattgcgccactgcactccagcctgggcaacagaacaagactgtctcaaaaaaaaaaaaaaaaaggaaagaaaagaaaaactgtgccatgctggtcaaattctcctgttgcttatttttgtaaataaagttttattagaacacaactatccacattcatttacaatattgtttattggcactgtcatgctgtggcagcaaaggtgagcagttgcagcaaaggtgagcagttgcaagggactatatgacctgtaaagcctaaaatatttactatctagccctttgtagaaagtttgcctactcatttagatattcaaaaagaggaaaataggccctgtaccttgcattcagtggattagaaaggaagtaccatcaattttctctaccctccaatctcccaacagtatattctctcttgaatggatgctcttggtagcagatttgatgtcagtgactactctgagtctccatcaaggcccccatgtagagaaagtcagagtgtctcagactgttgttaaaacatcatcaaccaggaggacatgccatcacattatcaaggcttcttgttcttacagtggctggagtgttctgatctgccgtcccatctgaattgtgcttcccatctctctctctttgctcacccaattttttatccatctgaagcagtctgctcctatctggttgatgggctcacttctacctcttggatgcacaagagaagtggaggtttccctcctattggttgtacaaacccagagaaataaagcttaatctgaataggcttaagtatgttatcttgcttagagaagacaacatttagtaatagcagaaactaaactatcctaacagctcagtcttagggaaaaaatatactcactaactcattttttcagaacagaacattctaaaccaaaacatatttgcatagttcccacagataccaaaaggtgactgtatatgtgcatgtatacataaatataaaaatatatttatattttgagagaaagacttagctattttaaccaaatagaatgttttcaggagtagcaggaatagaagagattgcatgtgcattgtagcatgttcatttttcatttgatttctgtccctaaaaacagaatccagtgaaactagctggaaatacttctttcatgtattatctcattcatttacttctctcattttaacagactgttatatggcctggtgcagtcacgccttttaaattttaaaacttccttccttaacatgaagttctcgtcttagaatttttacagctggatggacttgaatttggtattactcacacctctggaaagaaatgcagaagcagcttatcctgtatggctcagaaagctgttgctgaaagtggggtgtaatgtttttaatacatttttccaagagtagtatttaatttcaaattggtacaagatgcagaatcactttcagctgtgatgactgaaatgtgtcattaagacattacgagataaacaccaagtaccccacatctgtcttattgaaaatacagtgtcatattttgagtcaggcaccactgaaagtttatccttttatggaacttcctggtcttggtagtgacagctttccaggtgctgctcaggtaaatggtacaccagccagccaaacagcatgtggtagagagcagcacccagtgaaatctggcaaacttgctagggggaaaactgggtttggcctccttaggattatggagtagggccaggttataaccctggtagttgcaggaagaggaaattcctaggaaatggtaatatctgctcttcatctttttctatctttttttttttttttttttttgagatagagtcttgctctgttgcccaggctggagtgcagtggaacgatctcggctcactgcaagctctgcatcccgggttcacaccattctccggcctcagcctcccaagtagctgggactacaggtgcccgccaccacacccggctgatattgtttttgtatttttagtagagacggggtttcaccatgttagccaggatggtctcgatctcctgacctcgtgatctgcccacctcagcctcccaaagtgctgggattacaggtgtgagccaccacgcccggccacctttttctatctttaaacatgccaagggctctttcaaattgggctttaaaaacactacagaaaactctctgaacataggaaaaagggctcaagggggacaggtactcacatggggataattccttctggtcttttttcattattttctaagtttgagcttggctgcccattgaaattgtcttggtagttttctaccctttccagtgtggctacggctggagttgctataatattctcacattcctgcccatctttcttcttcaccatatttgatagtgttgatctcctttgcctctgcaaaattctgctcttaaacctgtggcaactctggtctcacgttgtcttaatctttgtactgcttaacactcactcacttcttcccacattccttgctttgccctggcttttcatgtgcggatataacaatggctatcacttataacacacttttagtatcaggcactgtgctaagtaacttaaatatacttgttattgtatcttttacacaataatttggactgttataatccttattttgcaagtagggcaactgaggcatagtcattgatttatttccttttgtgcacaaaggagaaaaagataattctaagggctttttagctatggtctttatcttctgaaattcaaattcagatgtcaaaaggttaatttgaattctttccccatgatcaaatggcatgaaagacctgtgattatatttacaggatgcatattaaactttcaaggtccaggtgtctcaaaaagtgcttttaaaaaatagacttccagtataattttatcaccactaaatacagaacatgattaggttatagtaaaagttttcctgtctctgcagctttctctctaaaatttattcatcttagctgcccagagttccttttgttacttgaactgctaattgaagacagtttccaaagcctaagatgagatttcatttgttagaactgaattagaaagagcaggacctaatcacttgattgcaaacataggaaactagattttggaaagggaatatgggatgtacaatattctgcttctacacaggtgttcctaatgtatatctgatctcaattttaaaattcctattctttaaagccaggtcaaaagccaggtctgagaatcttcttgtgatttaacctcttctcatcctggtgaccgctgtttccttattgtagtattcagtctgcactttgccattttgcacttgacagactgctttatgtaagggtaaaaaccacagttacttttgcaccaacttaataaaataatctcttgtcatttcattgtgtgttgtctcccaagcagcctgaacaagaatgtcttctgcagggggttcaggtgctatgtcatcatttttcggtgaaccaccttacatactcctgtgaagtgcctgtgacctctcatctaatacatgtaggagaagatatacaccagagtagtatacttaaagggacattattagactgtcactgctttactgcaaggctggataatttcagtggaatggtcctgagtgccatggttagagaaaggaacctgacttattacttctgctggaggaggacacttttaatgaaagaaaaacatggtagatgtaattcagtggttttaagaagcagtgttgatgataacccaggaaatgggacagttatattaatatagtctccagattagcttcaaactccaggaatcaaggtagggaggatttgatataacaacggtcttacatggtttttcttttttctttttttttttttttttgagacagtcttgctctgtcacccaggctggagtacagtggcgccatctcggttcactgcagcctctgtctcccgggttcaagcagttctcccgcctcagcctcctgagtagctgggactacaggtgccctccatgatgcccggctaatttttgtatttttagtagagacggggtttcaccatgtcggccaggctggtcttgaactcctgacctcaaatgatctgcctgccttggccttccaaagtgctgggattacaggtgtgagccactacatccagcaccggtctcacatgtttatagtcctcattagataccttattttccagtaacatttcttctcaaaaatagatgtacttgactactcttttcttgattcttctgggagtaaccatctctttggagatggttgttagtaaggttataaaaataaccttactgaggaactcccatgcaatcctctgaaaataataaaaatttccttatttcaagaactcttatttaacaaagtaattgttagggttgaatactctaggggcaaatgatttattgtgccttttgtaaaagtcaacacttggcaggtgtgtgtttgacactggctgatgctgggcttatttctctaagagtatggtaattctagtaaagtaaagaaaattgtttatcagatattaggaactgtacataggcctgctcaaaatggcagctttaaagctacctttagggctattcctgatggaatataccagtgggagagtacagaaggaagaacacaatttgtatgaatacaagtaaaatgaaggttgagtatattttcagatcttgcccaatgcatttattctacttggttctctttattttcaagttctcatttggaactggccggcactttcagaactctgggtatttctaattttagcagcctctatttggcagtattttccagagcagtaccttttaaacttcttccctacagtccacagtaaggaatatattttacacaatcacctaatacatgatatgtatatctgatattttccattctaactttttcattaaaaaatgctgggtatgactcattaaatactttcacatctcattaatgggtcaaaatctgtagtataaagagggcatagggtctggtattgctgcatatatctcttgatattttcacttctcactgtttcctccttctccaggtctaacagctcaggatgctgtttcttatttggctgaagccattagtttcaacttctcctttaaaacctggagtgcacctaaagtgctcttcaatcctgtcatggtctcattgactaagtacttacttttagtagagacagttttctgtctggcatcctcacttctaactttcattggccagacttcatactaaagtacaaagaggaaactgtttttaaaactttttgaaatgataaccagctgctacttaaaggcaataattgagtgagacttctactttctgagaatgtagctggctaaattgctgcaatttaaagcatatagactatattaccattaacttgctgaaatggaacatgagaagtataaacatggtttcaaacatatttagaaatacagaagcttcttaaatcaggttgtatttattaaaaacaaaatacaaaataacttggaattcagattattgtgatgtttatcccctaacaggtcagtcctaaagaaaaagctaattgtttcaagggtggtaacggaagaattttaagtaaggattatattaaatacatctagtttgatgcaaactgagttttattcaatgttggaggcctcactatgttcctctaagttttcaaccattaacaacccaaaccggttgtttccctcataccaacacttggtgtgtgcagtggttctccctctgttcttagaacagctggtattctgtttcttctgcctttttttttttgaatttgatctaccttttggtaggaatatttcagcgggggcatatgaccttgtggcattgaatagatattcataaagttgcttagcctcaggacatatgctcaggagactttctacagaggtcgatgctagcagttgctggcatagtccgtgcaccaggcttccactgtacagtctgttcaaagcaagaaaaaagtatgttgttaaagaagtaattcagtgcaacaggataactaccattgacatagcttcaacaaatgcatctaaacaatgagagctcttattgctctataatattatcgaaattacttaagaataatctgttctttgaaggaaggaactgagctggtatgacaaagattctttgctggtgatacttaaaaacttttcatcaacaaattacgtgatgcatgcttagtggttttgcagctagccccagactgagcaggtgtctttaacaaacactttaattttaaagaaaaggaatttaaaaggaccctgataaaccaaacaggcagtttgttagaatatgagaaaatttattggcatcatttgcaaggtcattcactgagactaaaaacctacttcacaaatagaagatgggattaattggaatccacaagtttattatggacaaagctgataaactggtaccttagcaatccatgtagaaccatcatttaatcagtgtaacatctctgtgtaaaaagccttggttatgctaagattcaagaacaatcctgctgtttaaatcattattaagagaactgttttgttttgcatttcctgttttgttttaaaaggatttgtggtaactaaagaggatccagtcaagaatggccttaaattattaaacgaaagaaataaagaatccaggggtcaaaggccaattagtcttatttgtgttagctcagatataaggcccagagatatattaacaacactgtttactgccaggaggctttttaccttgaaacatgtaaagtcccaccatattttgtatgcgtccatatatcctcattcaaagtattgaaggcactggggctgcaacagcaaataaaatagacaagcccctccccccacagagtttacatctgagtggagagacaaacaaaacacaatctatctcctttttatcttcatctctccctcaagtacctcctggatggtcaattaccaagatgtccaatccattgatcctatcacttttttcactgctccacaccctactgctgctgtcacttctttttatcatacccagcttaaactccacagacaaacattataattactctgtggcacataggctcaactcccttattgtccttcttgcctggtaaagcaaacatcctaggttaagttcacttgggcatctactcatcatctcacttagaatgaaagctccattagagctgagattctgtttttgtccctacaccctagcacagggtaggcatttaatatctgaatgaatgagtaagccatatgccaagtggtaagaaatgcaattaaaaaaaaatagagtaacaggactagagtgaatgagggtagacagtgtgtctcactagggtgggttatcagaaaaaggctctacaaagtgacatttaaagactgagaggaaaggagagagttgtatcctaccaatgattgcctcccctctcccacatattaatgtattacttaaaggaactgattttttaaaattggattgaatcatggaaacattctttgagaatatggaaataatttaatatttttcccgtttccagctcttcagctgtaacagtgactcaaaatcaattacattaagattagtttttttttgttttggtttttttttttaagtaactttgttgctttaaatataagtgaaaatactgtatttacttttgtgtgcttccatctgaactaaagtttcccatggtgcttaccgagttaggtctggctctgggagaggagtggacagcagctggttgagatacatccccatctggagacaggactgccactgacagaagatgtgagctgtgtctaagtccagtcttgtgcccagccgtgtctgcgccttcactctttggaactctgcatacaacatcttagcaccatcttcctgcagctcttccttacctaaataaagaaacagcccaagggcagtatttctaaaagcactgtaacagcttttcattttctccacatatactacaaattctataaagaaagaaattaatttaaaaaaactaagatgtttttctcttctggcttcataaatgccttgctgtataaattgaaatattgatactgaactgtctttttaatgatgacctaactttattcaacccatcggaatttactttttccctgaaataagatcttttccactggtctactacctgaccataaacatgtctgcatttgaattctctaaaccctaaatctgtgtctatgaaaaatacaaatgactattaaatattattctctttactgttctctttcaccg

SEQ ID NO: 37665 - DNA, 86528 bp, Homo sapiens
gcgagcggctgttggaggaaggaggtgggggccgggagcgcaaatggcgttgagatggttcagggccctgttcaaactccagcactgaccattcaccggcggaagcggcggcgcaggaggcggcggcggcccagcgggggcacacagcaggctctgttaccagctccagcagtggcggccagcgagagctaggcctgggcccggccggcggcgctcgaggcggggagggaagttgcggggccgccgctcctgcccccccaaccgggcttcctatttaccgaaagcagagtccctcgcctctctcggctctcacctgccggccctgctctcccgcgcgagggttccgcgcccgcccgcgggccgtagggagcgggagaggcggaggcggcccgtggccaaagcacccgccaggctccgagggtaagtgaggtgtcgggcggccgcctaggccgggagggagccgggagggtgggggaggcagaggctgggagcgggcggtggaagtctcactgcctcgcccaccgggccgctgaggaagttgggcaggggaatgacctgaggaactctttttttccccttttattttcctttttcggagttctttttcgggcgactgctgattgacttagctccccaaacccagtcaagtgtgttgatttcagccccgagtcctttcccgtggtttcatccgcctctggccgccactggggccttgcactgccttaaggattcggtggcagaggcttccggggcgtcgaaagtgacctccctttcctgggcggcgcgggttgggaggagaaaagttgcattgagtgtctagtccgaggggtccatcgcgcccactgcccgtggcgccccggctgtccccaggtgaggatttctggttagtcaggttcgtcccgtccgctttccatctttaatggaagcccttaaagcctttggggatcgggaagacgctagattagggtgggagtgaagtataaaggctttttgcttttttttttttttttttttttttaaatcacagcgcacttctctcaaaattcgacctgattttgggctagggcaaaagccgaacgaccgaaaagacttagtcgtcaatcattctttcctttttagttaggacagtctttggagtttaaaggttgagcaagattgtgtacttgaaacacttaaaatttaacttcaaggacgtctgcacacttattttggaatctgtagtgctttacgcttagataatgccattgcaaagacattttattgtgggaaacgataaaggcaatcaggaggagatattatataatgaacttctctgtacccatcgcttggatttagcagtgactattaaacaaatttatttcatctatacacttctcattccttaatgttggaaaatcgctgacgttatttcatcagtatttcactatgtatttgtaaaagacgtggtcttttggcacaaaattattattatcattattattattattttgagacggagtttcgcccttgttgcccaggctggagtgcagtggcgcgatctcagctcaccgcaacctccgcctcccaggttcaattgattctcctgccccagcctccggagtagctgggattacaggcatgcgccaccacgcccggctaattttctatttttagtagaaacgtggtttctccatgttggtcaggctggtctcgaactcctggcctcaggtgatctgcccgtcttggcttcccagagtgctggaattacaggcgtgacctgccgcccccagccagcacaaaattattttttatcacataaaataattaagtccttagtgtcaggtattcatctgaagacttcaaactttcaacagtgaatgctttgtggttatagaaccattttaacagtttttctgatgttggcataaaggaactcaagtctagatttttggtttggcctttggttagtatttttagatgattagcacataagtgaatccaaaacattccatctttgttggtgtgtatgtgtacgtacacttacagacctgcaggatctcagctttacattcttgaaggaacagagaatcgatttttattttgttgtccgtggtagttgcccagtatcctgttttgtttaggctgtacttaacaagaaagacagtaagacttgttagtgttagagctgcagtggaagatgaaatacatctccttcaggaacactgttttctcttaacgcagatatgtatgatgactaaattattaccttgtcaaattaaaattgggttctcaccaaacatgggggggggtctactactgaatttatataaaactcagacagtgactcattataaatggtaagaatttaagttaatcaagggaaaacaagtgtagatcaaaacatattcaaaagtataggtcaaatataatttcaattcttgtagctttcaaagtaatgatttttcattccttaggcccttgttcactttttaaagttatattcgatgtattcatgtttgaactgtagaaaggtcaaagtgttagacaaacggttactgattgatcatgtttaaaaagtactataactttttaataggcacagaactaatgcaagtaacttgttttaaaaaatgtttgactcttgatttactgccctaaagatttttttttttgtcctgtgaagtagataaatcaggtgaatcgatttgccatttataaattgaaaaggaaaataaaagttgtatgtttctatgtctgtattaatccatgaaacagtgtaatatgctggagctcactagccccagaaaatataactcagcaaatgagcacagcactatcgggacaaggcagataggataaggatagtttctttccctagggagatgaccatctaaggaacatttttaaagtcacagcgcaaattacattacaccaagaagcagaatcttcaagattgggttaaaagctgcaggttgtaaaacatgagaaaaagcaccattttggggaccttttttctcatgtgaattagtgccatgaaatttcaaagaactaaatttaatcaagtattggatatttctgaggccctgaaaaaaactaacattctgtgcttaagattttatataagtaattaccctatacaggttatcattatatcactgcaacctccatctcctgagttcaagcggttcttctgctccagcttctcaagtagctgggattacaggtgcgtgccaccactcccagctaatttttgtatttttagtagagatggggtttcaccgtgttgggcaggctggtctcaaactcctggcctcaagtgagctgcctgcctcggcctcccagcctctatacagataattttttaaggtaaaaatgatgtttataagaatagtaaattaattcatttggaacttaatatgcttcattttaagttagctttatggatatcgtattataagttggttaatcattaagtttttttactttgtaagtagcgtaggaatatgtactcattgtggaggaaaattgacatggaagcatgtagggtaataaatcagcctttctttataccccttcctcatatttgtttatttaaaagtctgtgtggtgagtgtcaaaagtcatgagggaagaatccctaggtttttatttttatatgcactgtttaacacttgtatttgatgattatatgttttcttaaattttttttcacagagaatatgaaactggtgtcaaaatgacatccagatttgggaaaacatacagtaggaaaggtggaaatggcagttcaaaattcgatgaagtcttttccaacaaacggactacccttagcacaaaatggggagagaccacatttatggctaaattagggcagaagaggcccaatttcaaaccagatatccaagaaattccgaagaaacctaaagtggaagaagaaagtactggagatccttttggatttgatagtgatgatgagtctctaccagtttcttcaaagaatttagcccaggttaagtgttcctcttattcagaatctagtgaagctgctcagttggaagaggtcacttcagtacttgaagctaatagcaaaattagtcatgtggtcgttgaagacactgtcgtttctgataaatgcttccctttggaggacactttacttgggaaagaaaagagcacaaaccgaattgtagaagatgatgcaagcataagtagctgtaataaattaataacttcaggtaagttttgattttctttattctccgccaagagagctttgtgcaaccaatttatttaaatgatttaaattctaaaatatatattgtgttttctttctgcacttatgatacatggggaccattgatagttttgtaaaagacatttaagaactttaaagaaaccagttggaggttgaaataaacaacttggatgttaacatttatagactgttgcgcagggtacgttttgggaacagtcataagtttataaccccaattccaataagaaatatctctttttgttgtgttaggatcacaaagtatctcatttctattactgtggaggatttggatggttattgataatgaaaatgagatgagtatttaaaatgaggattagttaccaatggtagactctctgccaaaactagttcagaaagattaagggggtattgagtggagacatttaaagaattgaacttgattccaaattgagattagtttggggccagtatcaacttgtattgatagatttttttttttgagaaggagtctcgctgtcgcccatgctggctccgcctcccaggttcatgccattttcctgcctcagcctcccgagtagctgggactacaggcgcccgccaccacgcctggctaatttttgtatttttagtagagacagggtttcactgtgttagccaggatggtctccatctcctgacctcgtgatctgcccgcctcacctcccaaagtgctgggattacaggcatgagccaccgtgcccggctgtgttgatagattttaaaccacaaaactggttgtattttaaaaatgttaatttgtaaatatagcatctagtattctctcctaaaacgatatattttgttctgtcttctgtaagggatttgagatttataataagtgaaaaaggtgcaattaattaaaagactgaagagctaatattgagggtggcagggaagaggtggggtggagaagtgggagcactctatcagcattaggataagggtggcagtatactgtaattgaaaagaaaccttagttcttgacgtcttggcaaagtttagcaataatgagaggttataaaaatctcctattttgaaaggaagtaaacacagacaaaacttggctgtactgaattcttaaggcaaatttgtcctttgaaggttaaggtatgtgaaacagtacaatgtactgggccttgcatagttttactaaaaatgttgagcattttttcactctttttctcactcttggatgagacgatgagccagctgttattgtcattcccttgatcctcagggttaattctaatttggctgtccttcctgctttgcccacatttctcctcaggcgttgttgacaagttaagtttaggttaaatttccattaaaaaacagcgtaaaggacctgtgcagtggctcatgcctgtaatcccagcactttgggaggccaaggcagttggatcacctgaggtcaggagttcaagaccagcctggccaacatggtgaaaccccatctctattaaaaatacaaaaaattagctgggcatggtggcgggtgcctctaaatcccacctactacggaggttgaggcaggagaatcacttgaacccaggagacagaggttgcagtgagccgagatcgcaccactgcactccagcctgggcaacaaagcaagatgccatctcaaaaaaaaaaaaaaaaaaaggcatagacagcataaaaactgtttccaggtcagctcctaaaaatgtataaatgtatattaaaatcatcaaacttttttttttgagacacagtctcgctgtgttgcccaggctgtagtacagtggcgcagtcttgcctcactgcaacctccgcttcccggattcaagtgattctcccacctcagcctccccagtagctgggattataggcacctgccatcatgcccaggtaatttttgtatttttgtagggacaggttttcaccgtgttggccaggctagtctcaaactcctgacctcaagtgatctgcctatctaggcctcccaaagtgctgggattgcaagcgtgagccatcgcttctggcccatcaaactttttttgaactaaaatgaattttaactcagctctcattttatataagaagctcaaagaggttaaatgactgtccaaggtcagctagtggcagaactggaatgagattcgtttattatcaacatattgagcacctactgtccgtcaaaccactgtacaaggctctgcgaatgctattctgcttgtgtttgttgttccaactgacatttcttttttttcttttttttttttgagatgaagtctcgctcttgtccccccaggctggagtgcgatggcgctatcttggctcactgcaacctccgcctctcgggttcaagcaattctcctgccccagtccccccgagtagctgggattttaggcacctgccaccatgccctgctaatttttgtatttttagtagagacggcgtttcaccatgttggcccggctggtctagaactcctgacctcatgtgatccacccgccttggcctccccaagtgctgggaatataggcgtgagccactgtgcccagcctgacatttcttgatgttttcagataatctacagtgtggggtgggtgggccggaggaagtaagattaaactgtgcaagtggtgaaagtgctcagggctgactccatcttccttaagtgtatggtcttttgaggaatggggcatcattggcaggcaggggccctgatggcagagtgtattaataaagttgaacgtttaggtaagggggaaaaggaatgtggaagttattcataagtaattgtttctgtagctttgcggacaatatatctttatgttaaatctgttgttggaagttggttggtgagaccaaccagctaagtgggataattgcttcccagtctatgtagctaaaatgtagttctaatgctgatactgtggactgactctgagtccaaactccattttaattggtctgtgaggggaaaatacatactaaaatacaggtaaatagatgttcaggaacatcttgtccatcttccttcctccttcacaaagggtctcttagtggtcagggaatggtgtagcactatgaatatttctttttttctcctctcccttggtcatccagagttgcaacaaccttggcagctccctgtaggataagaagtgaatttgagggagtgcatttaattttcatggtagacttatcctgtctctaatgtgtgcaagttagttgttcttataaaccatttgtaagtttgtatgtttgtaagtttgttatagttgtggggatgcttttgtactttgtgacttttcctttgtctctcccctctaaactggtcatttctcttgtgcctagactgttttcttgcattatgtctgtcaattttcattgcctttactctcactcagaaaaccttgtaattttaattgaaatttagaaacccaaacctaaatttttgataaaagaggcctctctaaatctcaagtggttcctaaccttttttgctttagggacccttctgagaatgataaagttttgaactcttttctccagatgcaagtattcatgtacctacttgggtctcagaaatcttagcagtcttttgcaggtcatggttaggcattttatttaaaaacctgttgcaaattttaacaactcattcaaagtgcacaggtgaagttccgtcatatctttccagtggagtgttgagtgtccttctcgttcatactatttttttgctgtagaattatatcacctcagtgaaaagggcttatccaggctcagaattattatgtcatttgtcctggcattacgtttttaagtgcatctctttctctataggggagtatgtggttgatttttttgacactgttaaaattctttaagtacttttataacggatagtacttttaaaaattttgttgcgggtgtggcggctcatgcctgtcatcccagcactttgggggaggttcaggagttcgagaccagcctgaccaacatggtgaaaccccgtctttactaaaaaaaatacaaaaattaaccaggtgtggtggcgcatgtctgtaatcccagctactcaggacactgaggcgggaactgcttgaaccccggaggtgaaggttgcagtgagctgagattatgccaccgcactccagcctgggtgacagagcaagactccaactcaataaataagtaaataaataaattgtgtttcacttgaagaggaaacttaggatgaggtcactataaaacatacagtggctgtaatccagcactttgggaggccgaggcgggtgaatcgcttgaggtcaggagttcgagaccagcctggccaacatagtgaaacccccatctctactaaaaatacaaaaaaattagcggaaattgcttgaatcggggaggtagaggttgcagtgagccgaggtggtgccactgcactccaacttgggcaacagagcgagactccatctcaaaaaacaaaaacaaaaaaaccccgcaaaacctacagtagttcccattttccagacagatgcttggtgggtaagggaaccagaaacaagattacaaactgaataggtactgcagggaagggttgtgttgctaaaatgtcctgttccttaaacaagaagaaaacgtttattatgaaacttttcaggcacacaaaaatagaatggtaaaaaaaaacctcatgtacttgattgtccacctccaatagttgtatctggcagatcttgttgcatctgttttgcacgctactctctccacttcccatcctttactccctggattttaaagctagtttaagatttctgtttctatctgcaaatacttctgtatctaatctttaattttgaaaacagaaatttctgattgcagttgctattaaagccagtcagttctcagccaggtgtgccaattaaaaatgactgttagcaggagctaaaggtccacccttctaagagatctccaggtattccttaatggtttgaatcaatgccgtcggtagtagaggcaaaaagaaggcttctcttgccttttatgcaaggctacttccatttctcatctttgttctgctacaggtttttaatctggactctagaataaagtgtgcaaagacttatatttcggcttggcacacttttcttgccagccagctgggattcagtctacatatcctgccaaatattgagataactacagcataggctcttaatttgcctgactggttttgtagccaataaatttttttaatttgcttaaagctgtaatgagtatttgtgtaagttagagggatggtattgtcaggagattttgaacttggatttagaactgaaggtgattttttagaaagggaaatgttttattactgaaagtttaaagtaggacaggaacttgtgatctgagatgagattgtcattggataaagtacagatgatatgaggattattattattttttaagtcctgaaaggatagtatcagcaagagttacctgcctttatttattgaatgtatttgttgtgtagaatatatttaaatcataccgaaaatcagcttctttttaagagaagtggataagacctattatttctttttttatttttatttttattttttggagacagggtcttactctctcatccaggctggagtgcatggcttatcacaggttctacctcctgggctgaagccatcttccctcctcggcctccccagtagttgggagtacaatggttcaccaccacactgggctaatttctatattttttgtagagaccgtgtctcagtatgcccagcctggtcctgaactcctgggcttgagtagtcctcctgcctccacctcccgaagtgttgggattacaggcatgagccactgtgcccggccctgttatttcttaaattcctacttttacatatcaattgatccttaatcacaactgtataagggaggctttatttccattatattgagggtaaggcacagttcagaggttgaataacttgaactgttaagtggaagatctgggaaacatccaaagtgttcttttcatacagtgctgttgtattctgatgtgaatgagataaattttgtcatcttcaaagctgtatatttagaagagactgtcactgtaagagcagttttatcttgatgttggaaataaagttattttgcaaggggcaaattatggattccctcttgtctctgttcaagtaattttctgctttttttaattttaaagatgtgatttttgtaaagaggtgggatctggctgtcttgccctggctggcctcaaactcctgggctcatgcagtgctcccacctcagcctcctgcctcagccttctgagaggctgggattacaggcatgccacctggcttaagtaattttctttttaataagaatgatgggccaggcatggtggctcacacctgttaataccagcacttgggtaggccaaagtgggaggatggcgtgagcccaggagttcaaaaccagcctggtcaacatagtgacatcccatttcttcaaaaaaaaaaaaaaattagcctgatgtgttggggtgcacccgtagttccagctacttgggagactgagttgaggatcacttgagcccagcagttcagggcagcagcgagccatgattgggtcacagcctgggtgacacagcaagataccatctcaaaaacaaaacaaaacaagaatgatgaccaaactatttttaatacttaccgaataaagtttttgacttgatttttatagatattttctactacttattttcatatgtgtatataaatggaaattcaacattatgtaaattatgaaagaggcattataattttaagtaaattcattttgttctaaagcagaacttttgtttcttactcagattttctgaggaaaaggagtattattctcaaggtttgtatattaacaaacgcatgggagaccactaacaaatttcttctcagatccagattgaataccagctatggggtaaaatatgaaatttataaacatagcctctgtactttagagttactgacttctgctggtcatgataaagaactagcttctaacatgacaacacttttatataatacattatgcttttcagagcattttccctaagtattttatgcttttagaacttgaagccagacagccgggtgcggtggctcacacctgtaatcccaacactttgggaggcaaggcgggtggatcacgaggtcaggagttcgaaaccagcctgaccaacatggtgagatcccgtctctactaaaaatacaaaaattagccaggcgtggtggcgtgtgcctataatcccaggtactcaggaggctgaggcaggagaatcgcttaaacccggtaggcagaggttgcagtgagtcaagatcatgccactgcactccagcctgggcaacagaacgagactctgtctcaaaaaaaaaaaaaaaaaaaaaaaaggccgggtggagtggctgatgcctgtaatcccagcacttcggtttggaaggccgaggcgggcggatcacgaggtcagcagttcgagaccagcctggccaacatggtaaaacccggtctttactaaaaataacaaaaattagccaggcacggtggcgggtgcctgtagtcccagctagtccggagcctgaggcaggagaattgcttgaacccgggaggtggaggttgcagtgagctgagaccatgccattgcactccagcctgggtgactgagcgagactctgtctcaaaaaaaaaaaaaaaaaccaaagagcttcgagccagatgatacctcatgaatttttcttttccagcacttgtgcctttaggaagtagtactcaactttcctagacccctgatggtagaggaggatgagtttgttcataggaaggtctacggggatgcctccttccagctattattttagtgtccatgaacaagatggactcacttgcatttctcgcattgtactggggaagatagaataaacaatcacaagtgtgctgaaaaggaaaaaatatatagagtggtgcgggagtgtagcactctatgggcttacttgcttgttctaggggtgcaggtacgtaggcaaggctgatatttaacctgggacctgttggtgcactgagaaaggatagaagtggcagagtttggtgacatgagtgatgaggaaggaggcatcaggaattattcccagctatgtaatgtgagcagctgagcagatggtagtgtcatttactgagatagggaacattttgacagaaagtttgagttcagttttgggtacattgggtttgagatgtttgtaagatatgtttcagtggcagatttgctggaatggagctgagataagaagccttgattagagacaattaattcgaaattcagtatataaatattatctggaaagaaaggattagttgaagtcattaaagagagtgtaagaggaaaaagtattaggactgtgctgtgaaggacttccaatactggccgggcgcggtggcttacgcctgtaatcccagcactttgggaggcagaggcgggcggatcacgaggtcaggagatcgagaccacggtgaaaccctgtctctactaaaaatacaaaaaattagccgggcgtggtggcgggcgcctgtagtcccagttacttggagaggctgaggcaggagaatggcgtgaactctggaggcggagcttgcagtgagccgagatcgcgccactgcactccagcctgggtgacagagactctgtctcaaaaaaaaaaaaaaaaaagaactttcaatactaatggagggggagaagaggaagaaactagaaaaggaaattcagtaggagcagctagagcagcttaagggaaaccagagaagtgatatattatagaagccaatgtaaaagtatttcagaaagtattgactgacgcggaatgctgctgccatcaacttaagtgaggactgcaaggcagaccttggatttgcagcttggactggagtgatccaaggggtgaggaaatggggggtaacaagtgtttacaacttgttaaagatgttcgaaggggaggagaagaaaaagggcagctagagggatgtgagggattctagatggtttaatgcgtgggatccaaagcgcaagagaaccgttttggaagaaggggtgctatgtttggctggaaggaggaaagttgagtaaaaagatgagcttagtgggaggacataagagaaggtggtttatagctaaaagtgtgttttcccttatcccataaaatgaccaaagaggttattactgaaagggacaaagaaaggcagggtaacttggggggtttgggggagcaggaaagagttcagatagatgttacttaaagtgggagaatgagctgtctagagacaaagtagaatttctggacattattgaggccttagttgaagttggtgtcactaaaaacacatggtcactaatctacctagtgtgtatgtttttttcctcctcctctagtaggccccattatctggaacctggacagaatacagaatattggataagattattagaattgtcctcaatagacattttgtcagtcagcatgtggaatgaagagatagagaagcaagggaatttagggtgttattgcccagagagagattgagaagatagactgtggaatttaaaatgctgagtgcccggacagggctaatgaataggagaaaggggagaaaggggttagtatactgagaatcttcttaaataaaaatgaagaatgggagtactggcacaagcaagttggatggttggtaggttgtgattaaaaaaaaaaaaacagtgggctatctgattttaatgtttatgaagtgaagcattttaggatatacggcaagcttctggatgcaactgagaactggtggctgagatggaatgcggaagattgttgatgatgagataaggttaaagaactgggaaatcagagggttggaatttggtggaattcagtgtgatagcaaaattgggatggaggagtagattataaatatggtgtaaaatccttaaatacatgaacagtgaataagaggttgaataagaggttgttggatgacaagtattaggaagattagagggtaactagcacaagccttaaaagaaggggctttaattttttttttttttttttttttttgagacagagtctcgctgacgcccaggctggagtgcagtggcacagtcttggctgactgcaacctctgcctcccgggttcaagcgattctcctgcctcatcctcccgagtagctgggattataggcgcctgtcaccacacctggctaatttttgtatttttggtagagacggggtttcactatattggccagggtggtcttggactcctgaactcaggtgatccgcccgcctcggcctcccaaagtgctgggattacaggtgtgagccaccatgcccggccactactttttttttttttttttaaatctttccttacttatttttgttgtctttttattattatttgtttagtcttacacaagaaaatcagagaagccaagaaggggctcttatataacagggtggaggagtaatcattttataaagaggctctggagagtcagcatatcagtgtccccaaactgtcctgctctgaaatagtagggagggctgcaggaaaagaggcacccttagtccagtgtagggcaaagaagtggtagaaagaatgaaccccaggtgtccttttaattttttttagaaacaaggtctttctctgttgcccaggctggagtgcagtggtgcgatcattgctcactgcaaccttaaactcctgggcttaagtgatcctcctacccccacttcctgagtagctaggactataggaacgtgccaccactcctggctgattttcaaaatttttttttgtagagagagtcttgctttgttgcctaggctggtctctgactcctggatgcaagtgatccccctgctttggcctgccgcccctcccaccccaagtgctgggattacaggcgtgagccaccacacgtggccaatattgacattttaaaatataacatgcagtttagatgtcatagtgatttcttttaacttttttaaattgtaaaataaaacagaaaaccacacaaaagggtctagcttaattaattattagaagaggaacactcctgtaaccattacctaagttaggaaatagaattgtgccagccagtttagaagttctttcatgcatcacttcctccttcctcaccctcaaagtattttgtttgtttgtttgtttgtttttgtttttggagatggtctcgctctgttgcccagactggagtacagtaatgcaatcatgtttcactgcagcctcaatcttctgggcacaggtaatcttcctgcctcagcctcctgagaagttgggaccacgggtgtgtaccatcacagtcagctaattttttttgattttagtagagacaaggtcttgaactcctgagctcaagtagtcctcacaccttggcctcccaaagtgttggtattactgtcatgaaccagtgcttctggcccataattattttcttgcttgcaaatgccataattacttgctgttcattctctttttaaaattttttctttaataatttttctttcttacaagtccccattatgccccagaaactgttcactttcgtatgtttaaaaaaatacaagaacatgctcttcaatagccagaatatagtgttccttgttctttttgaaattgtatttctatcctacttccccttcagaattttatcctaatgattatagtatttatgtttagtcttttagtggtcatccttttcataattcttggtataaaaatatgtatatgcatttaaattcaaatttttaagagccgaggctggtacaaaaatatgtatatgcatttaaattcaaatttttaagggctgtgaccgggcgcggtggctcatgcctgtaatcctagcactttgggaggctgaggtaggcagatcacttgaggtcaggagtttgagaccagcctggtcaacatggtgaaaccccgtctctgctaaaaataaaaaaattagctgggaatggtgactcgcgcctgtagtcccagctactcaggaggttgagacaggagaatatcacttgaacgtgggaggtggagactgcaccactgccttattgacagagcaagactctgtctccaaaaaaaaaaaaaaaaaaaaaaaaagagttgggcactgtggctgaagcttgtaatcccagtactttgggaggctgagatgggaggatcgcctgagtctaggagtttgagaccagcctgggcaacataaaaaaaacataaaaaaatcctgtctctacagaaaaaaaaactctacagcttttaggaattttatgtgactgtagtgctctaaactgttttaaaaataattctgtactacatcatgatcacagttatcagtgcttttatttttttaatcaaatgctctcagaatatttgatcaaacttgaatgctataatcaaacttgaatgctgtatatattaaagataaaatttattggaaatgtatcttttaagagatgagtgggcttttttcagttagtttatatatatatgaatgaatgttattgctaaagtatataaaggttttggacaaaaaagttctttggcatcaattttattcctattttttgttgttttttgttgtcaagatggagcctcgctgtgttgctcaggctggagtgcgtggctactcacacaggtgtgatcataacagcagcctcaaatgaaccgctggccacagtgccctgggtagctctaggtgggactataagcacgtactgctatgtccctgttattcctttttctttttttttttgagactgagtctcgctctgtcgacggggctcactgccacctctgcctcccaggttcaagcgattcttctgcctcagcctcccaagtagcttggactacaggtgtgtgctactacgcccggctaattttttgtattttttagtagagatggggtgtcaccgtgttagctagtctggtctcgatctcctgacctcgtgatctgcccacctctgcctcccaaagtgctgggattacaggcgtgagccaccgcacctggcctgatggttgctttgagataaaataaattaatagaaagtatttagaatactaccaggcacataccgagggcttatataaatatagttcagctttgttttactttgagttttaattgtgagtgaaattgagtatccttcataagttatttaattcattatagatatatattttaatgaattgcttctttgtgttcttggcttattatttattcatttatttttgaggcagagtcttgctctgttgcccaggctggagtgcagtggtgctatctcagctcactacaacctctgcctcctgggttcaaacaattcttgtgcctcagcctcccaagtagcgaggacgactggcatgtgccaccacgcctggctgggttttttttgtctttttagtggagacagggtttcaccatgttggccacactggtctcgaacttctggcctcaagtgatctgcctgactcggcctcccaaagagccggcattataggcctgagccattgtgcctggcccctagcgccattttctactgggacattggacttactgatgtgtaaggattcttggtatattaaggaatttaccttttgtgtttccctagcaactaatgataagcatttttcatgtgtgtattcttttttttttttgagatggagtcttgctctgtcacccaggccgtggtgcagtggtgtgatcttggctcactgcaagctccgccttccgggttcacgccattctcctgcctcagcctcccgggtagctggaactacagatgcccgccaccacgcctggctcatttttttgtatttttagtagagacggagtttcactgtgttagccaggatggtctcaatctcctgacctgatgacccacccgcttcggcctcccaaagtgctgggattacaggcatgagccaccacacccggcgaagtttgttttcttatcatgacagccattcagatatttaaaggcaggtttcatgtaatggcagttttcttccatccctgcaccaattaaacctttctagttgcctcaactgtatttcatgggttatggtctccaagccactttgtatcatttgcacagatttcttacaggttaaaggcattgtttaagtttagtcctcagcacaccgtgagataaacatttgctatttccacctcagcctcccaaagtgctgggattacaggtgtgagcccccgcgcccagccagtgaattagttttgttgttgttgttcttttaaacagagtctcgctcttttgcccaggttggagtacagtgacatgatcttggctcactgcaacctctgcctcccgggttcaagcagttctcctgcctcagcctcctgagtagctgggactacaggcgcccgccaccacgcctggctaatttttgtgtttttagtagagacagggtttcaccatgttggccaggctggcctcgaactcctgacctcatgatccgcccgccttggcctcccaaactgctgggattacaggcatgagccaccacgcctggcctagcattttagtgtttagcagccaccactagacgtagtgtaatatagtttggtatgggtcttttttatgaagtctcttttgactattgatttaattgagaacctctgcagtcattagcccctctgggcctttttttctcatctgtgtaatgatgggtttggtaagaaatcaaaggaagtatcttcattttcttataagagggtaaaggaagtctgtatatatttgtgtgtatagactagtatacagttacacagatgtatacatttgtgtgtttatgtctacaaaaataatgtctatttgtatctccatctccattaaacagttcaactgtttaatcttcaacaaacaattcattgccagtcttgtttcatttttatcctcactaaagtaaattcaagatgttgtatttgattcataaatatatttttttaacagataaggactccaaaaatatacaattttggcattttttatgttttggcttttgaatagacaacttacatgcagtataaaattcaagaagtatgaaagtcttttcttgttccttatcccttagtcattccatctctaagagcatccatatctgtacataatgtagagctgcctcattctttttaacaactgcatagtattcaggtgtgttgctatatggtaatttaattctttattaattggtatattgtttatgaaagcaaaaaccaggaaacagtgttctattgagtttcttgttacttatgtaattttgtgttcgtggaaagttatttctaaatacttgtaaatgaaactgctggcttcaagagtaagtcctttctttcacatgtacatttttagttttaaaagatattaccaaatcttaacctgttaaattacattaaaaccctttggaggctggacgtggtggctcatgcctgtgattgtagcactttgggaggcagaggcaggacgtttgcttgagcccaggagttcaagaccagcctaggcaccgtagtgtgaccctgtctgttaaataaaaaggggagttaggcaggtgtggtggtgcacacctgtagttccagctgtttgggagtgctgctcaggaggctgaggtgggaggatcacttgaggcctggaggtctctgaagctgcagtgagctgtgatcacaccactgtattccagtgtgggtgacagtgagatcctgtcttgagggcaggaaaacctattgggtagaattaaaaattatgcagtgaatctgtccatgtaaagcatccctctcacctgtatttgatgatgctaattgagatttgtaaatagcttttcttaaatgtagatgtattttgtagaagtaattttattgtttggcatagggtatacattttgtcagtgtttttctacaagtaaatgttgagggaattaataataccagttggaatcatatttgtatctcatttggaaaggttgtaaaaatgttctgatagtaaaaattgaaggcaacaaaaatgaattctccacataccagatgaataggcaggctgaggatttattactggctgatatgcataaatagccactattagccatttaactaacacaccagaactactgctaaaaattcccttgagattatatggcatttaggattagaagaaagaacagaaatagctagagaaacctgatcctatggacaggtttctggatagaactagcataccttatgggcagccctatcccagataaataaaaacactggtagaaggtttttattaactgttcagttggtttaggttttactaaatgatttttaatttaagcatctttatttgaaaagcccataatacccctaagaaggtttggctgagtcatttacatgtcattctgaatggattcagttgcttaaccctgctgaaatttcttgtgagtttacaattttaagggacttggttgcctgaggaaaggtcagtagaaggcatgagagctatacactgaaaagataggagaggaaatgtctgatatgtaaatgttaatttcttcacaacttaaaattatttgcagttcttccaagattgatcatatactattgattaaccacatatatgttatttattaacttttatgttgataccactcatgtttttatcctttgacttatttttacagataaagtggagaattttcatgaagaacatgaaaagaatagtcaccatattcacaaaaatgctgatgacagtactaagaaacccaatgcagaaactacagtggcttctgaaatcaaggaaacaaatgatacttggaactcccagtttgggaaaaggccagaatcaccatcagaaatatctccaatcaagggatctgttagaactggtttgtttgaatgggataatgattttgaagatatcagatcagaagactgtattttaagtttggatagtgatccccttttggagatgaaggatgacgattttaaaaatcgattggaaaatctgaatgaagccattgaggaagatattgtacaaagtgttcttaggccaaccaactgtaggacgtactgtagggccaataaaacgaaatcctcccaaggagcatcaaattttgataagctgatggacggcaccagtcaggccttagccaaagcaaacagtgaatcgagtaaagatggcctgaatcaggcaaagaaagggggtgtaagttgtgggaccagttttagagggacagttggacggactagagattacactgttttacatccatcttgcttgtcagtttgtaatgttaccatacaggatactatggaacgcagcatggatgagttcactgcatccactcctgcagatttgggagaagctggtcgtctcagaaaaaaggcagatattgcaacttctaagactactactagatttcgacctagtaatactaaatccaaaaaggatgttaaacttgaattttttggttttgaagatcatgagacaggaggtgatgaaggaggttctggaagttctaattacaaaattaagtattttggctttgatgatctcagtgaaagcgaagatgatgaagatgatgactgtcaagtagaaagaaagacaagcaaaaaaagaactaaaacagctccatcaccctccttgcagcctcccccagaaagcaatgataattcccaggacagtcagtctggtactaacaatgcaggtaagaatttaaaaaatatgtataataagtacaatagttcccccttacctgcagtttcactttctgtggtttcaattacccaaggtcaaccatattctgaaaagaggtgagtacagtataataagataaagatcccattcacataacatttattatagcgtattgttaaaatcattgttctattcttagtcattgctaatctcttactgtgcttgatttataaattaaactttatcataggtatgtatacgaaaaaacatagtatatacaggttttggtgtactattcctggtttcaggcatccactaggaactggcatgtattccctgttgatggctgggggggctactttaaatgtgtttttcaggcttgaatcaacagctgcatagtttcttcctagatactcaagtttagcttgttatatttattaaaagtacctgttagaaccgtaaatcaccttatctaaaggtacagcatttcaagtgttaatgatcaggtcccaagttgtaaggaaccaatttgtagattggagagtcttcatatttgagttttaatttaacctttagcacttgagaattttaaagcatatatgtgtatggggcagggacaccaaacatcgtgatgtttccacttgacaaatgcaaatgcagtgaaaacatagattagattttgggcctttggaactgtactgataacaggtggttataatgagggaaataccagaagattagaatttaaaaactctttgtggttggctaaaaactaataaacattcaaaacactctcaaaccctcctaagttggtttaataaaattgaaaagtgccaggtaagtatgcattccctcttaactgtggaaatttaatttgtgccgagattgtagactcagtagtgactaagggtcctcaaggagttcagtctccactgtgagagacaaacaaaagaaataggttagctctgccataattaagtcattacctgacaagggctttgtgaagtggattgactatctagtgaggaagaatttgtgaaagcttctaggatacatggtttcttaaccaaatatagtttttctggattggtttacatattaaataaagcttttttcctggtagggccacagaagtgtcattatggtaaattagaattacagtagtattttgaaatacaaattctcttgtagaatataagtcattcttgagattacctaccattttgctttatttggcctgaaaatagttttgcttaatttattcttcaaaactagacatacacaggagtacccctaggggctcacccctgcctcccccgaaaaaaaagaaaaaagaaatacatccagtgttgtctttgaatcttttctggagactggaaatttgcagcagccttactatagtcacttaagatctggctaggcagaacagctaggcatttgtttcctcagtagaatgataaatactgctatacaataccagcgcccttgtcctgctgtagtttacttataagcttttattctaacctggatagcaagttatcccctgcaattgagaatctgtggctgaaatttacatcttgtgtaatacaacttttaaagatgtaaaatgtgaaattagactccctttgagaaacttgaagtagatgctaaataacatttgaaaattagaggccatttggttgatctacccaaagttgaaatttgagtcttcataccataagtgaaacagcaaaaaattttaagcattgggatagagaagagtctttctatgtttcctattttgtttcgcttagaaaaagatacatatttttaaccagttgggaaataaactgactctttggttagttgtgtttgaagaccgacaaatcattaaactttgttatattaggtcattttaaatctcttgccaaggataactgtcctccttttctggtgttttaaatgtggcttttgtagttgccagcaggcattctttgaaggccaacatgatttagtggatttaaagttctgaaaaatgttacaggtagatacgcatgatgttttgtgtgtgtataaaccttaccattccagtgtcagtatccatggatatccagcagttatgtgacctctcggaagtaagaaaattattttggaaaagatttgatttttccatttgacataaaataagactagaacacatacacagcaaccaggtttatgatttctcttgcgggagggacaagcaggaagggagaatggcagaatgaaacttcttattctagggagtattttgtcagctctgtggtgctgtgatttcctttattcttttcttcccattttcattcattcatgtatatataatcttgataggttgtctggtaggtaatttgaaatattagtaagctagatagttttgattaccatttcagaaaacttggattttacagaggacttgcctggtgtgcctgaaagtgtgaagaagcccataaataaacaaggagataaatcaaaggaaaataccagaaagatttttagtggccccaaacgggtaagtaaagcactgtcagtgatttttattatttatttgttattggagggctcaactcttaattttttatttgaaagttactaataaacatcatagcaactgtctttcaaaggatatgtgtaagtcgttttttcagatataaccattttttaaaaaattgtaaaatatacatatttttaaaaccattctcaagtgtacaagtcagtggcattactttcacggtgttatgtaaccatcacaattatctatacccaaaacctttttatcatatccaacaaaaactctgtacccattaaccaataacttcctcccccactgcacacctagtcaatactattccactctgtctctaggaatgtgctttttctaagtatcttatataaatagaatcatacaatatccatcataaaccagatacaaaaggacgaacattgtatgaatctggtttatttcactaagcctgatttttctaaggttacatctgtcttttacggtatgtcaaaatttcattcctttttatggctgaataaaattccattgtatgtaagatatatatgtatatatataaaagaatattccattgtgtgtgagacatacacacaccaccacacctccatgccttccacattttgtttatccattcatctgttgatggacacttggattgtttttaccttttggctactgtgaataatgctgctgtgaaggttggcatacagatacatctgtttgagtctctgctttcagttcttttggatatatacctaggagtggatttcctgggtcagtatggtaggcctataactttctgaggaactgccaaactgttctctgtggttgtctgcaccattttacattgctaccagcaacatatgagggccctagtttcttcgtatccttaccagcacttctattttctgttttttgataatagcctaatgggtgtgaagtggtatctcattgtggtttgatttgcacttcactaatgattagtgatgttgagcattttttatgtgtttactggctatttttgtatctttgaagaaatgtctaagtcctttgcccagtttttttgtttgtttgttttagatggagtttcgctcttgttgcccaggctggagtgcggtagcacaatcttggctcactgcaacctccgcctcctgggttcaaggaattctcctgcctcagcctcccaagtagctgggattacacgcatgtgacaccatgcttggctaattttgtatttttagtagagatggggtttcatcatgtttgtcaggctggtccctaactcctgacctcaggtgatacacttgcctcggtgtcccagagtgctgggattacaggtgtgagccaccgtgcccggccctttgcccatttttgaattgagtttttttgtttttattgagttgtagtagtatgttaatccttagcagtaatatggtttacaaatattttctgctatttcattagttgtttttcactgtattgatattgtcctttgatgcaaaaacattttaattttgatgttcaatttgtcattctgttgtctgtgcttttggtgtcatatccaataaattgttgccagatccagtgttacatacatttttgtctatgtttttttcctataattcatagttttaggtcgttacgtttagatcgttgttctattttaagttaatttttgtatatggtgtaaggttagggccaactttattcctcctcctcttttttttttgagatggtctcactctcacccaggctggaatgcagtggtgtgatcccagctcagtgcagccttgacgtcctcgggctcaggtgatctcccacctcagactcctaaatagctgggactacaggcgtgcattatgatacctggctaatttttgtattttttgtagagacgtggtttcagtttgttgcccatgctggtcttgaactcctaggctcaggctatctgcctgccttggcctcccaaaatgtaatatggtccagcatgggtattgagaataatttgacttcgccttttttgtaaaaaattccttaaatagcttgttatagtgttttgttatttaaagttaaaattagaggttgccagtaccttttattcttgtagattgaattgcttttaaataactaaagaatgagtgtgttcaatttttatggccttatttttcctattttacctgaagagcccactggggatcttttcaatgtaattgtcctatagttttgcactcccaggtgcttaggtgagactttgaatttctagaaaactgtatgacttcacagtgatacgtagttgtgttttaataagcttttcaggtaattttggatattcttctacagtactaccccaaaactcaagaaatgggagtttcttgatgattagttgcaacttggaatgtgaaaccgtgccagtaacctttcatacattgcattaaaatctgctgctttatcttgcattttgaatgggcatttacccatacatgctttgtaacatcatacactggtcacttgcaaaatactggttacgatgaattatgcaaatctttcaaatgatgacacatttcattatacagtatcgaaaaaccatgttaataccactgccaaactcagaaaagtttgtaagtactgggaacctatcaagttcacagtggtagatacaagttctctaaaatttgtttttgcttaaaagttcaatttttttttattggaagcaaatacttcaaggaaaacaactgatggtaacagatttactctttgttttcgagaaaatgcctgccacattcccacgtttgaatcagcatagtttgtcgatctttccagtaaagatgatgtttgagaaaaaagtagctagtttggcttgcaacttaaacagtggtggttttttctccatacaaccactgtactttgcatgcagcagaagtgttttatgcatacttgttttgtcacagagattattagtgtattcagggatagagatttaataaaattaactatttttattccttcattaagggctttaagtgaaactggcattttactttttgactgctacatagtatgtagcagttagaagtcctacctttatttgtgctaaggcaccagcagttttacccaccattgcttttgcaccatccatacaaatgtcaatgcattaaaaaagccagttaacatctttataaaatattttttgaggcagagtcttgctctgttgcccaggctggagtgcagtggcgcaatctcagcttactagagcctctgcctcccaggtgcaagtgattctcctgccttagcctcctgggtagctgggactacaggcaagcgccaccatgcctggctaattttttgtatttttagtagagggagggtctcatcatgttggccaggctggtgtcgaactcctggcctcaggtgatccacctgctttggcctcccaaagtccagcgattacaggcgtgagccaatgtgcctggccccatctcttaaaaaaaaaaaaaaatgtagttgggcatggtggcttggttgtagtccaagctacttgggaggctgagacaggaagatcacttgaacccaggagttcaaggctgcagtgagctatgatcacatcacttcactggagcctggacaacagagtgagaccctgtctcttaataaataaataaataaatgaaaatttgaaatatacagaaaatgtgaaagagcagtaagatgagtacccatatccctctgcctagattgttttccagttagcatttaaccataattgtacatagtccctttcctttctccctctctataatatatatttactgtataatacttatattaagtatatgtacagtcttatttgaaagtttattttattaaatatatatatggtcttatttgaaagtaagttgcctgcatttcttaagaaaaaggtctcatacctgtggttatataacacttaagtcaattcctagtaattctttgatataatctgataatcactgtattcagttttccccatcttcaaaatgtcttttcatattttttttcccaaaccataatcatttagttatgtctctcttagttttgaacagtacccccctttgaaaaaaattccccttggtcctgaattttttttttttttttgagacggagtctcactctgtcacccaggctcgagtgcagtggtgccatctctgctcactgcaagctccgcctcctggattcacgccattctcccgcctcagcctcccaagtaggtgggactataggcgcccaccaccacacccggctaattttgtttttgtatttttggtagagacggggtttcacagtgttagccaggatggtctctatctcctgaccctcgtgatctgctcgcctcggcttcccaaagtgctgggattacaggtgtgagccaccgcgcccggatggccctgatggttttttaagaggccaggatatttgtcttacagaaagttctgcattcagaatttatctgattgtttcctactgatgtcatttaatttgttgcctcactgcattaaagtaccagaatttaagtctggaagtttgattaaattcaggttagactttttggtggggggcggtggggaggctatttcaccggttgcattgtgtatgatgctttacatcagaagtctcatgatacctggttactccactcttagcattgtttgaccacctagttaaggttgtgatcaccagctctcaacaaaataaaagtacatatctcattttataatttagttaggaaacttcagagtgctagtccagtaccacgtgcatgccctgttccccattattgtcttacctcattttcgtatccattgttgagctttgcctacatcatttattgctcgagttacagaatgatgagttttctaatcgttatttcttacacatttaatagctggaattttgtaaagaggaaccttcatctctccttcttcccctctccttcttccagctgtctccatcactatagattcagtaatttttgcttattggataacatttttacttactgacattatgctaagtcaaataactcagacacaaagaatattaaaaacggcatgatctcacttaacgtgtcaaattaaaaatagttgaatatgtagaaacagaatagaatggtggataccagggatgaggagggggaggaaatagggcagtgttggtcagacagtacatacttgcagttacataggatgaataaatgtagctatctgatgtacagtaggagacctgtagttaataatataggacatttgctaagagagtagattgtaggtgctcttaacacacacacagggtaactggaaagtgatggatgcttgcagtaatcattgtgtgtattaaaacgttatcttgcatgttaaatatatgtaataaaaataaatactatttactaaatgttttatagttgattttgcttttttttttttttaagttgaagttgttttatatttggccagtgtgaaccatttcaagcggtctcttgtatccttttgaaataacctgtcatctttgagcacttcccttgccttctgtacaataagatggctcaggctcatcttatagattccctgttttaagtcatggagtcatgtgtttttctaggaaccttggttctttttgtggacattagtacttagaaaccaagatctgagtgctgagtgtgttcatcgcatcaagggcctttcttcagacagagttaggagataatgttgaaaaatgaaccatgccgggcgtggtggctcacgcctgtaatcctagcactttgggaggccgaggcgggtggatcacgaggtcaggagagcaagaccatcctggctaacacggtgaaatcccgtttctactaaaaacacaaaaaattagccatgtgtggtggcgggcgcctgtggtcccagctacttgggaggctgaggcaggagaatggcgcgaacccgggaggcagagtttgcagtgagcggagatcatgccactgcactccagcctgggcaacagagcgagactccgtcttaaaaaaaaaaaaaaaaaaaaagaaccatgagtttatgttattgatagtttctttttcaaatttatttatgtatgtatttatttatttatttatttaagacagagtcttgctctgtcacccaggctggagtgcggtggcatgatctcggctcactgcaacctccgcctcctgggttcaagtgcttctcctgcctcagcctccagagtagctgggattacaggcatgcaccaccatgcccagctaatttttgtatttttagtagagatggggtttttccaggttagtcaggctggtctcgaactcccgacctcaggtgatccacctgcctcggcctcccaaagtgctggaattacaggtgtgagccaccgcgcccggccttcaaatttaacatcacagaattgtatacttatttgctttatcctacagcatacatatatatcaaaattataattccaataatatgagcaataaatatgagtgaattttaatttctttgtaattggttttttccttagattttagtttacttaggatgaacagttatggtactgtgttaaaatttgttgaaatgatttttatactgtctgcttatatgttaattctatattcagttgaagtcatttgtacctatttgtgttctgtttttttaacttagttatgaacttaatgttggagtaatttctttgctagtaacatagcttagaaggcagcagtgtacatgtacttgacctgattacaaaggaatctatctggcctaaagtaaatcaggtcatggcaacttgagtcagcagcaaacctatttactgttgatggatgcaaagtgatagtgtcagaaaattaagaaaattattgctaatttataaaacaaaaagagctatgggactgagcttatttgaaaaatgtaatatgagtaaagctgtgtgtgtgtatgtgtttttttttttgagatggagtctcactctgtcccccaggctggagtgtggcgacgcgatcttggctcactgcaacctctgcctcctaggtacaagcaattctcctgcctcggcctcccaggtagctgggattacagacgtgcaccaccatgcccggctaatttttgtatttctagtagatatggggtttcacctgtttgccaggctgatcttgaactgctgacctcaagcgatccgcccaccttggcctcccaaagtaccaaagttggcctcccaccgtgccaagccaaaactgtgtcttaagctgtgtcttaacgtagtagcctttttttttttttttcaaggcaaaacctttattcattttaatggtaggccagtgagagtatctggattttctggctctctaatctgattagatttaagaattccagtggccccatttccaggtggtaaagaggtagtctgtgacttgtagtggcaggagttttcctcctgttctatcacagtttttcagcctgagcactattgatattttggactgaataattcttggtttggaggctggccctgtacactgaaggatattcagcaacatccctggcctctttccattagttgtcaatagcacccccctcttgccttgttgttacaacccaaaatgtctttggacattgccaaatgtttcctggggagtgaaatgcatcctcctcccattgctgtatatgtatgtgtgtgtgacttgatagtatttcagatatgatgcccattactcctaaatacctagtttgtactttctaaaaacaagagcactttgctttactgccacagaatacccatcaaaaccaaagagttaacattgatgtaatccattgtctaatccacagatcccattcaaatttcagcatttgtcccagtaatgttctttatagcaaaacaactaaactacacccccatgtctcctaaacaaagaacccatgatctaatccagaatcacatgttagtttagttgtcacaagtctctactctccttcagtgtgccatgggatctgtgtttcctggtcttttcatggtttttacatctttggcggagttaaggccagttattttgtctaatgtccctcagtttgtgtttgatactttctcatgattagactcagattagacagttttgatggcaatacagaggagatgccattttcttgctgcatcacatcaggtggtacttaatgtcagcttgtaccattactactgatgttaactgatcacttggttaagatggtatttttcaggttcgtcacctttcctcattagacttcaccccctagttttggcattgattgttgcctgagtcagtttttacaacattggttgccaaatgtgatttcctaattatagcatttgttctacagttattagtatttggccttgtagtgttaggtagatattttcttcccctccatgtaggttagagtatatgcatgtatttttatatgtattcatttagttattacagtatgaacatggatttctactttattcagtcatttgttactgtatttatttaaatcatagttctgtcattagtttgatcttcttagatttagttggtggatgttccttcaagctggctttgatgtgtcccactattttgcattttcttacttacattctattttctttaattttaacgctctacgaatttgtgtgtcatccttgtgcaggggtcatgctaatcttggtatcgttccagtttttgtatatgtgctgccgaagcgagcaccttactgacattctaagatgttccaggctcatcctatactttcccagtcctggagtcagccatttcttcaaggattcctgtttgcagttcatggagaatggtatttagaaataaatacttgttcactaggtatggttatttcttctgaagtgtcattgcttctaggccctctctgagtagacagctaggaaacatgtaaaaatatgcatatactgtttcatatacagacacatgtctatttcatggtcattctgtgtatgtttagaaccatgagttcacactaatatttccaataccacgttttattctagacttctcattttccatattttaattcccttcgccgagagaaatctggtttccattatcctccacatgtgttcttattttcacaatcgtcatgtatgtaactagtttcttgactatgctgaccatcttcctcaccttagttctgctgacatagtctggccaagaggtcccccttccctctacctacccctctaccctgtgttagaaagcattaactctttttttgtttgtttgtttgttttgagacagagtcttgctctgttgcccaggctggagtgcagtggtgcgatctcagctcactgcaagctccgcctcccaggttcactccattctcctgcctcagcctcccaagtagctgggactacaggcgcccaccaccatgcccggctaatttttttttggtattttttagtagaggtggggtttcaccgtgttagccaggatggtcttgctctcctgacctcgtgatccacccgcctcggcctcctaaagtggtgggattacaggcgtgagccaccacacctggcccagaaagcatgaactcttaagcatacgtgtctgtgagaatttcctttagtgtctcccaggaatatagagttgttaatatcaggattgagggctgactcagaaagaagatgagggtgaagaaaacttgtagtaagaacatagttgaaatgatgattcagaaaagttgtcacttgctggtgagaaaaagaaagataggatttgataaatagggttgaaacatacctggatttaactacctattgtttctaggtaaggttttgatcattgagcagttcttggtactttcgttcatgaaatgtcatccagtttctgatttctggctacagcttccctacatgccattatttgtagctgtcatatgtgtgctgatatacttagattatttcttctgcttgccctgcttgtggtttgacttctaccttttcattcagctgctgcctgtcatccctgcttgtaagcattcattgtctgtatagtcaggctgactgtacaggttttcagtgcttgcggggttggttgtgttttacctgggatgttggccatcttgttttgcagttaagactgctgctgggtcattgatgaaactaaccataacgtcaatctcagtttcaattctccaatatttatacctttacgttctttttttgttgttgagacagggtttcactccagttgctcaggctggagtgcaatggtgtgatcatgtctcactgcagcctcgacttcctgggctcaagtgattcctgtgcttcagcctctagggtagctgggactataggcacacgccactgcgtccagctaattttttgtattttttgtagagatggggtttcaccatttttcccaggctagtctcgggctcctgagtctagccatctgccggtctcggcctcccaaagtggtgggattacaggcataagccatcatgcccagcctatacctttactttcatcattcccctgtggtttaaagctaggcccttctagcactatcttttgtctaactctttaaggaacattctggacttaattttttcttcccatctgtccttcaatatgacactggatagggggcttctgggcaattaaaatttatcagtataaatcatggttacatatttagttgttttagaatgttgtaattacataaacctgcagttttaaagttgaatatagctttatactttgataaacttcattttttgttttataaaatgagtttatacgggttgtcaacttactagcaaaatcttacaattgaagagactttaaaggacaagtactcccacatctcacccaagaacaaatgttccttccacacagtgtcttcctttagcagttagaacccactctcatgaaatagcatatttttctgtcagaacagttttacccagtgttacctttgttatatgtatggggactcactgactatcttgagatccagtcatcatgtggtattgtgagatccactatattctcaagtactagaaacctgatatattaattgatatgaagcctgaaaaaaagaatgactgtagcaattggattggtgatgagggaaactggcaaaagtgtggaagttaatagctgctgccattcacttacagctcctgggtgggtgatccaaagagttgttgaagctgagcaggttctggctgggcctaggtatggaagagagggagtcggttttagttggctttttttcatcattgtttttgtttggtgtttactacatgactttcactgtgctagggatacaaaaatgaataagaagagtatcttaaaaaggcagaattgttttttcctactggaattttgagcagtcttagtatttcctcagtgtgtttgttccaaaccagaagcatattgcttccttttatataggtagtatttaacttaaatattaaaccaggtaattaaaatcattgatctgtataagtcaaaaaggcttaggaaaatgtaaattattttctctctgtgatccaattcttgtgcttttttttcctttaatactttattctggaaggattttaataagtaatgaaagtactgttaatctttttttttgttttggatatggagtctcgctctgttgcccaggctggagtgcagtggcgcagtctcagctcactgcaatctctgtctcttgggttcaagtgattcaactgccttagcctcttgagtagctgggactacaggtgggtgccaccatgtcctagggctaatttttgtatttttagtagagacggggttttaccatgttggtcttgaactcctgatctcaagcgatccgcctccctcggcctcccaatgtgctgggattacagatgtgagctaccgtgccctgcctaatcgtattttctttagtataggtgcctttaaagtttgaaagttcaaagtattttactcttatttcccaggaaatgaggcttgaagtgagaaaatgtggccaggggttatcaggagctggaaagcactgacatctatttgatagttatagatgggaaggaggggggtaggggttggggggtgagtggggggagatgggagggacgggggaggggagagagagagcacgagtgagcacacgcacatgcgtgtgtgcctgtgtgtgtgttagggtgtttatagtttggaatttcatttgtttttccattttgtactacagtcacgcattacttaatgacagggttacattctgagaaatgcatcattaggcgatttcattgtgcacacagaacacaaagctagatgggatagtctgccacacacctaggctatatggtatagcctgttgcttctgatatgttgccgtactgaatattgtaggcagttgtaacacagtggtaagtatttgtgtatctaaacctagaaaaggtacagtaaaaatacatataaaaatggtacacctatataggacacttaaccatgaatggagcttgcaggattgcaagtttctttgggagtcagtgagtgaatgtgaaagcttaggacactactgtagactttataaagactgtacacgtatgctgcactaaagttataatagtttcttcaatgataaattaaccttagcttactgtaatggcttgtttttttctttttgctttttgttttgagacaatctccctctgtcacctaggttgaagtgcagtggtgtgaacactgttcattgcagccttgacctcctgggctcaactgatcctcccacctcagcgtccctagtagctgggactacaggtggacatcaccacaccctggtgatcttgtattttttgtagaggtggggtttcaccatgttgtcgaggctggtcttgaactcctgggctcaagcaatcctcccagcttggcctcccaaagtgttgggattacagacgtgaggcactgtggccaaccagcttactgtaactttttaacattataaacgttttaatttgtttaaaactttttggctattgttaataacacatagcttaaaacaaacacactgtactactgtacaaaaatattttcattctttatatctttattccgtaagcttttttctatttttaaaattatttttaattttactttaaaatcttttttgttgcctgggtgcggtggctcacgcctgtaatcccggcacttggggaagttgaggcaggtgggtcacctgaggtcaggagtttgaggccagtctggccaacatggtgaaaccccatctctactaaaaatacagttagccaggcgtggtggcgggagccgagatcgcgccactgtactccagcctgggcaacagagtgagactgccaaaaaaaaaaaaaaaaaaaaaagaaaaaaaaatttttttttttttttgttaaaaacttaagatacaccagcctagacctatccagagtgaagatcataattctcacagtcttccacctccacatcttgtgccactggaagttcttcaagggcactaacatacgtggagctgtcatctcctatgatgccagccttcttctggaataactcctgaagtacctgtctgaagcggttttacaatgaacttttttttgttttacaagtagaaggagtatattctaaaatggttaaaatatagtaaatacataaaccagtaactgctattgttaatagtcattcattgtcaagtgttacttactgtatctaattgtatgtgctatactcttttttttttttgagatggagtttttgctcttgttgtccaggctggagtgcagtggtgggatctcagcttaccgcaacctccgcctcgcaggttcaagcaattctcctgcctcagcctccagagtacctgggattacaggcatgcacctccacgcccagccaattttgtatttttcatagaggcagggtttttccatgttggtcaggctggtctcaaactcccgacctcgggtgatccacccacctcggcctcccaaaatgctaggattacaggcgtgagccaccgcacctggcatgtatgtactgtacccttataggactggcagcacagtaggtttgtttacaaaagcatcactacaaacactcgcctaatgcattgtgctaagatgtcactaaatgttaggaatttttcagctccattaaaatcttatgagaccaccgttacatatgcagtttgtaattgaccaaaaccttgttatgtggtacataactctgtaaagtacattattattaactgtagttaccatgctataagtcagatctccagaagctaatcattttataatgggaagtttctaccctttgaccaaaatcccatttcccctacctgccagcccctggcaaccacctttccactctttgttcctatgaatttgacttctttagtgaatccctactttttcccaaatggtttataatctattactgtatttaattatttggggcctaaatttgtcctgatttggctagtagagcctcattaagctggctgtttgatttgtctgccatgtccccatcattttgtgaaaacttctttcttcctggtgtaacacagtgttctaggttcatcttgtacctggtcagctgtaggctcgggatcaggtccattctccgaggagtaatgattctctttagtggagaatggtattagagactatgataatgggccctaggtgtgtcctttgcttcttggcgcttttagcaaacgggcataggaaacatgcacgtatacatatattacatacatacatatatattcacatacattcacatacaaatataccttcacatatatatgtggattcatgcctgtgtacataagtgatctagaaatcatgaattcacacataatcttcagtatccatgcattttcacaggattatttcttgccttctgtctttttcacagtgagagcccagggttctttctggccttatgtctttttcacagtgaacaacagcagcagcacatttactcaacttatatctaaataggtacagaattgctttgcccattccactacaataagtaaatttacaaaaattttcaggaattgtttggcaattctgcccttgccctactccaccctgcccaagattgagggtataaagtcaaataatatgttcacaaattacttgggattatttctgcctgcctgcctcttgactggtcagtgcattgggtggtttgtctggcttctcttcacagtgtttgctgtccatgtgaaatatgagtaggtttctttgttctggtttgctttaagtgttggggttttccgtttccattcttacttttttttttttaatgtgtacaacattataaaagtcaaaactatataaaaaggtaagtttaatgaggtcacttcatctgagatgtgttccagtctgtcacccacccttgtagggaaccaattttattgttttctgctgcttcttttctatgtttcttttttatataaaaataaacagactaaaatttttcagcccggcgcggtggttcacgcctgtaatcccagctctttgggatgccaaagcaggcagatcacctaaggtcaggagttcgagagcagcctgaccaacatggataaaccccgtctctactaaaaatacaaaattagctgggcgtggtagcacatgcctgtaatcccagctactcgggaggctgaggcaggagaatcgcatgaatctgggaggcggaggttgcagtgagccaagatcgcgccattgcactccagcctgggcaacaagagcgaaacgctgtctcaaaaaaaaattttttttttcttacataaaaagtagcatctatatgtcctgttttgcactgtctctcctttaaaatttagtaatatttcttggaaatcactatcagttcatgtagatcttccccagtatatatttttataattctaaagattggttttagattttttttctttagtttctgtcttcctccattctcttacatgttgactgtttatatcttttaaattgtttctttttaacgttgtatgtgcatagtttacccacatccagtattggcaaaattttatactttcagcatgtcctgttattatttgtttctaatctcaatttactgttgttcaaaggtggcttcttaggatctggttcagatgttgtaaaagaaatcccaaattagttattaatagatagcttatttttctctggcttaccagtctctggttgtttatctctggacaattttcaaattgctgcagtgtaggggacccaagtttcccttgtgtggtggtattctaccatttctggactattgattaagatagaaggaactagaagggaaggcaatgaaccatccctagaagccaggacccagaaggtgtacctcacttctcttcacacttcattggcaagagcttagtcacatgcccatgcaagcatcaagatgttgagaaatctatgtgagcatttgtccagctaaatgtttttaaaggaaaatgaaggggagaatggatattctctaatcacaggtggtgttgtctcaagatatttatagcttccggtttttttatttctaaatttgataatcatctttctaatacaacttgtcatcaatatttaatggtatttttagttgtgagaactgttattttagctgattttggtcatggctctcatactagtatcttttagttttaattgttgaattataggctaagttatgttctcacaaaatgccaactactgaattttatggttttttgcatggactttttagaacttatgaccaagttatgctatttcctggtgatattctgaagtgacagttacctacttttaataaaaccgtggctaccaattatgcttttgaagttctactcacagtagtggtgtgcattgttcttcatgaagataggaattgacaattttttcataaaaatggcagctgtctttaaaagtcattactacctgttgtatgcagttgattcgggcagagaagaaagactttgcagctttatttcttctcgttagatgtggattagattctctacagtgtttcatattgcatattacaatttctaattcttgatagtacagatgctgttggttttaatttaggagtttctgtagtcttccttcaaataattcaatactctggatatttaacatgtgttatgttttttatagtttaagaccatttgagattgtatgattatgcttaaaaggaagttgtaaagagctcaaagattctttgtaagacttttcttctcctgcttctgattccaattgtcttttttaaaggatttttataaatcctttaaagaaatttttgacaatccagatccaaattgtttttttctacttcccccttttgaattgccgctaaagtactgtgcacacatacacacatagttatgcattgcagtacttcttcagagttcatttagttgtacttcgtgctgattgattgaattactggtgatatccttgggtggataaagctggatgaattcttatcagcttactattttgtcttcatatagcacatagtttttaaaacgtataaataaatttgctcttcttgttcataaagtatttatggcttaaaaacattccttttttttggctgtgcgctgtggctcacgccagtagtcccagcactttgggaggccaaggcaggtggatcacctgaggtcaggagttcaagaccagcctggccaacatggcaaaaccccatctctactagaaatacaaaaattagccaggcgtgctggcgcttgtaatcccagctactcgggaggctgaggcaggagaatcgcttgaacccgggaggcgcaggttacagtgagccgaaatcacaccattgcactccagcctgggcagtaagagcgagaaactttgtctcaaaaacaaaacaaaacaagaacaaaagaaacccattcctttttttcctggcttttatgagccagcccagtgggggataacatgtcatttcctcttagattttcaggaaggaatgctttctttcctctgtttttgttgttgttgttttgttttttttgtttgtttttgtttttttgagatggagtgtcactctgtcacccaggctgtagtgcagtggtgcagtcttggctcactgcaacctccatctcccaaggctcaagtgattctccttcctcagcctcccggggtagctggaattacagatgtgtgccaccacacccggctaatttttttgtatttttagtagagatggggtttcactatgttggacagcctggtctcaaactcctgacctcaagtggtctgcccacctcggcctcccaaagtgctgggattacagacgtgagccaccacgcccggccttttcctctggtttatagttgtgattcagtaatccagtctgttaacaacaacctttgtggtgttattgtaaaaaccaacttttatccattgtttttatagaaactatattatctctcatgaagaaatgccccatcagtttgtcagtggaatattttttctttagctttaatggaatgtcacatttgaggtttttcttgcttatgcccctggagcactgaatacaaaagaataatatatttaagattactagtattgaaatatgctaaaatggttctgaatatttagaatgttagattattattatgaactttttgcttattttgttctaagtatttttctcattaatttacctagcacacagaatccatcctttttttttggagacaggatctcgctctgtcacccaggctggagtgcagtggtgtgatcttggctcactgcagcctccacttcctggactcaggaggtgatcctcccacctcagcgtctcgagtagctgggaccacaggcacgtgccaccattcccagctaatttttgtattttttgtagagactgagtttcaccgtgttgcacaggctgtctcaaactcctgggcgcaagacatctgtctcccttggcctcccaacttgctgggattatgggtgagagctaccatgcttagccacaattttttttttttttaatacagaaaaaagtttaggtatctggtttatatgctgtatctgcttttctttctttcttttttttttttttccgagacagagtttcgcttttgttgctcagggtggagtgcaatggcacgatctcagttcactgcaacctccgcctcccgggttcaagcaattctcctgccttagtctcctgagtagcggggattacaggcacctaccaccatgcgagacggggtttcaccatgttggccaggctggtttcaaactcctgacctcaagtgatccgcccaccttgacctcccaaagtgctaggattacaggcgtgagccactgcacccggcctgtatctgcttttctgttgcccaggctggagtgcaatggtgcaatcttggctcactgcagcctctaccttctgggttcaagcgattctcctgcctcagcctcccaagtagctgggactacagtgcctgccaccacacctggctaattttttgtatttagtagagatgggatttcaccatgttggttaggctggtctccaactcctgacctcaggtgatccacctgtctcggcctaccaaaatgctgggattacaggcatgagtcacggtacctggccctgtatctgcttttcaaacaagaataaaattaagaagattaaagacaagcctggtggtgcaatcagaatgactctgttaacatttagctaggttgctaaatggtaagggtgatttttgattttccatggaaagttgattgctgtatgatacttttacatatattgtacacacaatcacttccactgagtgaaattagcctgtgacataccactgttttgtgctttacatacacagttcacttaggagcatgtggaattactgtactgttttggaatgatgtaaagagctcagtcagtgttcccttttctctctttccctgtttcttcctctccctgccatatgtgtatgttagccatatacagatattacttattttaatttttaattagatgtgtcttcaatatctctcctcccataataaaccctatattaatcttgtaagacactgaaataaaagtcaagaaaaagttctaattggactacttccctttagattgcttattagtattaaaatggtaaaacatcatcaaaagctttaaaactaatagtattactaaattgccttgttcaacagcataaccaaaagttcctttaatatgaccttttaatataaattgttcaattattctgtatgctgttatgcttcaaggacttttgagatgaatagacacatcagttattccatttgtttatcatattctttattaggtaggtaggctatatatttctgttttcttacgaatgtgttagacttaaacctagcagcacatcatcacataacaattaataataacatttaatacttacaaagcacttttttttttttttttttaaagacagtctcgctttgtcgcccaggctggagtgcagtggcgcaatctcggctcactgcaacctccacctcccgggttcaactgattctcccgcctcagcctcctgagtagctggtactgcagttactcaccaccatgcctggctaatttttgtatttttagtagagacggggtttcatcctgttggccaggctggtctcaaactcctgacctcagtcgatccgcctgccttggcctcccaaagtgctgggattacaggcgtgagccaccacacccgacagcacatattctttcaggcactcttacagtgttttaattttttgagacagagtctcgctctgtcgcccaggctgaagtgcaatggcaccatctcagatcactgcaacctccgactcccgggttctagcaattctcctccctcagcctcccaagtagctgggactgcaggtgcccaccaccgtgccccgctaattttttgtatttttagtagagacggggtttcaccgtgttaaccaggatggtctcaatctcctgacctcgtgatccgcccgcctcagcctcccaaagtgctgggattacaggcgtaagccaccgtgcccggcctagtcagtgctttttaaaaataatttctctttttgcttctttaatttctttaattttattttttgtagagacaggatcttgctttcttgcccaggctgttgtgaactcctggcttcaagtgatctgcttcctgcctcggcctagaggcgtgctgcaattactggcatgagccactgtgcctagcccaatcaatgctttttaaaaagaagtaaaatgcttgagctttgaggcactcattcttgccaaaaggctgttgttaccagagcctgggctctgagtatgcttgaggtactaaaggtagttcaaattagggatccataactagcagacacacaagttacatagctggtctttgaaaagaatggaaggaatagagaggttggttttaaaatttatgttcagtccactttatgtgttgtgtctcaggaagccagatcaagtcattgcatgagtgcataaattgtttcagattgctaatgcatcatcatgttatgcaaacctggcatttatgaatgatgggtttgtgtacacaatccaaatgagaatttttccactttattagagataatatattaaaagctaacgattagttcacactaatgcttaatgctaattatgttgcttcagtgcagctagtaaggggatatagttaagttttttaatgtagattttttgacggtcttgaagtatgattttccacttgtcttcttatttttgttgtactgaaaataagatgtgtttcataagagaaaatctctaatttgtccaaaccatgtatttgaagttcaaaacataatttaacgtcacttttgtagaggatagagaggatgaggtgttacctttctattttgtctttgtaattatgcagttttctcttgaaagtgagggttttgttcttttacttgatttgattttgtaggtttactgtcatttattctcaattcggaaattcagtgttaaaactgaaaatcccctggaagtttaagtaaattgatagggcagcacaataacctcaattgatgtgtgagggactttacatctttgtcctgcttagtgtaacattttgctgcagaaatcatgtatgttattacatggtacttttttggatcccactgtgtcttggaatatgtggtatatgtattatatttaccttgataaaatttgagaactcttgagtggtggcacacagctggctgcagtggtttgctttaaatgagcgcattgtctgtcataaactgctggattcccattgttggaagattgtgaggcatgaattggtagtaggaagaataaagttttgccaaagaacccattgaactattattattatcatcattactattttttaaatttttttgagacggagtcttgctttgtcacccaggttggtcttgaactctggggctcacccaggttggtcttgaactcctggactcaagtgatcctccttcctcactctcccaaagtgctgggattacaggcatgagccatcatgcccagcccatgttgagttaaatgtgttgattacttagtaagcctagcaagaggtttaccttttttttttttttttgagacggagtctcactctgtcacccaggctggagtgcagtggcacagtcttagctcactgcaacctctgcctccggattcaggtgattctcctgcctcagcctcccaaatagctgggattacagatgcctgccaccatgcccagctaattttttttatttttagtagagatggggtttcactatgttgaccaggctcgtctcaaactcctgacctcaagtgatccacccgccttggcctcccaaagtgctgggattgcaggtgtgagccaccatgtctggcctaggtttactttcaagtgccatcttttcttggttagtcatagttgcacagagcactaattactgattttgtgacctagtactacagtgattatatttgccatagacatgagaatgggaattatggtgggactgttcccagatagtatccatcctgctgtttctaggacatgtttatgcatataaattattctttatgatttttagttgagagtcttttataaggatggaagcagttgatctttctctcatttctctagtcacccacaaaagctgtatataatgccagacattggaatcatccagattcagaagaactgcctgggccaccagtagtaaaacctcagagtgtcacagtaagtgaactgtacttatttattttgtgttttttaataagctataaattaagcagttactcttttaattcataatttgtaaatctttgacttttctatttaacagtttattttggctttctttactgaaacttattagtttcagtttaattcattggaaaactgaggattgtcagtaagatagcagaaattctagtgctgctaggttaaacaatgaaagccataaaaaataaggctcttgttactcatgacccacatttcatggaatttatagtatttagtgtttaagagcaagattgtccatatttgatgtttgtataagagctatgttgtgtattacatcctatatatatttctaagtggctttcagtgcttaatttgcttttcagagacaaatctcttcctgtattctagtaatacttttcaatccaaaacattaggaaaaagattcttagcaacttattttctccagaatgactggtaatatcatacatgatttctaggttaacagtaaagcttcagtcatctggagttatcaagtaacttagttctttataacaataagaaatttggggatagaagtctttctaaagtataatgtacagttccctgtcttcttaaactgattagactccttttgatagtataaagaaatcattttgtatattagtagtaatatagcatgctcctgttatagctatttatttttaccctaaactacttcacactcttgtgctactaaaattcttttgactctgtctggtttttctgtcctgtccctttctgcttatgaaagctatttttgcatgcagttgtggttctttagtctttctaatggtactagagacaaacgacaaattgtgtgaaataaaaagtttaaaaaagaccagaagaaatccttgagtggttcttctgtgtgcagatatacatatgtcttacctgttagtgcatggaattcaaagtatttctaaagacctttgagaggcctccctgctccctgctttttaaaaagctttatttacttttttttgaagctgaatttgccagatagatgagacgttcctatttttatatatttatttagaacaactaatttaatacctttattaataggtgaggctgtcttcaaaggaaccaaatcaaaaagatgatggagtttttaaggctcctgcaccaccatccaaagtgataaaaactgtgacaatacctactcagccctaccaagatatagttactgcactgaaatgcagacgagaagacaaagaagtaagcagccatatacagtgtttactgcatgttgatagatttttgtatgtaacatttagccatttaatatcttcaacaaatatcagtatactgatactcagttttgaaccacaaacttcttttgtcctaccatcatccttgttctaaaaatatttttgttgccatctaatgaactattttatgcacttatgtaaagtacagtgagcccatagatttaaatatgctagttcctagttaaaaaggggtgaactttttttttcttggcagttatatactgttgttcagcacgtgaagcacttcaacgatgttgtagaatttggtgaaaatcaagagttcactgatgacattgagtacttgttaagtggcttaaagagcactcagcctctaaacacacgttgccttaggtaagatcttatttttatattttacaattatgtgcatgctgtattaaattttttcaactaggtgttgtccaaaaagccaaacattttttattttgttatgatggggtagtatgtatagccagtgatatgttaaaatgctatccatttctttataaagaatttgattctgcatgataagagggaaagctgggtgatgagagcctttttaatatagcataggcttcagttttcaagagcttaaaaaaaaaaaaaaattacgctaaagcatctttttgccttgtgtggtggctcatacctataatcccagcattttgggaagccaagttgggaggatcatgtgtgtccaagagttcgagaccaccttgggcaacatagtgagaccccatgtctacaaaaaataaaaaattaatgagtcatggtggcatatgcctgtagttccagctacttgggaggctgaggtggcaggatggcttgagcccgtgatcatgctgctgcactccagcctggatgatagagtgaggtgaggccctgtctccaaaaacaagaaagaaaaaattaccagaaagaaataaagtaaataattaaaaaaaaatcttttaagttctttttacctctgatgttcaagtaataagttagatttatttaagcatattgtgatctggacgcttacatttgtacccaaatgctcaaaaagatgatcttttgtatttcctaatggattgattgaatactataattttgattaaatttttcagtcatttggagtatatccaatcaaatataattaattaattgtgatttttatcagaagtattaatgaaaggcagctcagattttaagcttttaatggtggtagtagtaacgtaaggaatgcactaaagacaattacgttatttttttaaaatacagtgtacctaatcatgcactaggcatcagtatatttttaataatgtgttttgcctatggtttttatattgtgatcatgtatgggcaatgctttgacccttttacccccttcctatttgctggttttggtattacacaaactcaaaactaatgtactagctgtttccagcccccctaacctgctctattttcttgtagtgttattagcttggctactaaatgtgccatgcccagttttcgaatgcacctgagagcacatgggatggtagcaatggtctttaaaaccttggatgattcccagcaccatcaggtattttttaagtttctgagattgagaagccttatgttgaaaactactagtctatttggctatcaaaaatatcttcactgaatattctataaatatatcctaattatagattgagttcattttatttgctaaatttgtagtgcttatggccagaagcttttgcttaatacttattttatcatgaaaacgtgaaaacattttttcttaatgtgtcattttatacttttaaaattgtattttgttatcttagctaatgtagtatattgatacagaattttgtaagcataattttctctataatcagaaagcactgagaagaatcttttaatattatttgatactaatgaatggaaaaaaactggtttggaaatgcagccctaattttttagaaacgtttttgtccagtgttgaatctggaacatggcctcattgtgataaggaataatttcttcattttccttgcctttgatgcttttgcataatgataaacataacaaaagttattaggtttaacattttccaaaattagaagaaagtaaccatcattgctaattattagcattagtagtattttgagatggccttactatatttttgttaaagaaattatgttctaaatacagattaggtgataattaatttaatactgcatcttctgggctgggcgcggtggctcatgcctgtaatcccagcactttgggaggccaaagtgggcagatcatctcaggtcaggagtttgagatcagcctggccaacatggtaaaatcctgactctactaaaaatacaaaaaattagctgggtgtggtggcaggcacctgtaatcccagctacttgggaggctgaggcaggagaattgcttgaacccgggaggtggaggttgtagtgatctgaggttgtgccactgcactccagcctgggagacagagcgagactctgtctcaaaaaaaaaaaaagaagttagtttgttgctgggcaaggtggtgtgcattcgtaagtcctagctactctggagactaagggaggatctcttgagctcaggagttcagatccattttgggaaacctagtgagacctcatctcttaaaaacaaacaaaaaagagaattcgtttgctttgttatgcagttaacagtgaacttagacattacagtgtgatttttaagggcagtggatcccccatggcctttacaatgcatcctaatttccaaaaataatttgctgtataaacatttaatcagacacctggtctgatgcttctctacttctgggggctcaaagtttaaatctttagatggttgtgttttctgtatattgaaataggtttaagtacagaatatctcaagtgttggaatatcccaaatgtaagacctttttttatattcacatttatctaaaatatttcaccttcagtatttagattgtgtaagtagagtgtcctggccaggtgcggtggctcatgcctataatcctagcactttgggaggctgaggtgggcagattgcctgagtttaggagttcgagaccagcctgggcaacatggtgaaaccccatctctactaaaaatgcaaaaaattactcgggcgtggtggtgcttgcctgtaatcccagccactcaggaggctgaggcacaagaattgctggaacctgggaggcggaggttgcagtgatctgagatggtgccattgtactccagcctgggcgacagagcgagactccgtctcaaaaaaaaaaaaaaaaaaaaaaaaaaattatttggttcaaccagacttgattgttttattttattaagcgatcctcacaactcaccctcccaagtaactgggactacaggctcctgccactacgccaggctaatttttgtattttattttattttattttatttattttgagagagtcttgctctgtcgcccaggctggagtgcagtgacacaatcttggctcactgcagcctctgcctcccgggttcaagcgattgtcctgcctcagcctcctgagtagctgggattacagaggtgcgtcaccatgcccagctaattttttttgtatttttagtagagacagggtttcatcatgttggccaggctggtctcaaactcccgaccttaggtgatccacctgcctcagcctcccaaagtgctgggattacagacgtgagccactgcgcccggcctaatttttttgtatttttaatagagatggggtttcaccatgttgtcaggttggtcttgatcaccttacctcaggtgatctgcccaccttggcctcccaaagtgctgggattacaggtgtgagccaccacgcctggcgattggtttattttaaagaaatccaaatatgtatatttcagcatcctgggtttatatacagatgtaaacacagctgtgttttccaggggaaaaaatgtgttaagggtatgatatagatttaaaattattatttaaattattgattttaaactgaaatatgactatctgctgtatcataaagaataggctgggcgtggtggctcacgcctgtaatcttagcattttgagaggccaaggtgggtggatcatttggcctcaggtgttcaggaccagcctcggcaacatggtgaaaccccatccacaaaaaatacaaaaatatcagctgggcatggtggcgcctgccggttgtcccagctacttgggaggctgaggtggggaggattgcttgagtccagacggtcaaggctacagtgagctgatatgtgccactgcagtccagcctggatgacaaagtgaaaccctgtctcaaaaggaaaaaaaatgaggtatatcataataaggtttttatatatatatactcacacacacatatctgcaaaaatgttttataaactcttagcatagtatagcctaagaaatatgtaactcagcatatattcttagagctatcaggcattcatatatggaggatccattgaaaggtaaattttaagcaacagcattttatttttttaaacatgtttcttcagaatatttttagagaggggccgggcgtggtggctcacacctgttatcccagcattttgggaggccgaggtgggcggatcacgaagtcaggagatcgagaccatcctggctaacaccgtgaaaccccgtctctactaaaaaaatacaaaaaataagctgggcgtggtggcacacaccagtagtccgagctactcaggaggctgaggcaggagaatcgcttgaacctgggaggtggaagctgcagtgagccgagattgcgccactgcactccagcctgggcgacagagtaagactccatctcaaaaaaaaaaaaaaaaaattttttagagggaccgctgaataaaacgtttttgaagtttccaacatggttagtaatataagttttaagcattaacttgtaaacaaaagtcattaatagtcttatttcctgagatgtcaggagttgcttacatgaagttttttttcttttctttttttggcctgttgaagaatctgtccctctgtacagctgccctcatgtatatactgagtagagatcgtttgaacatggatcttgatagagctagcttagatctaatgattcgacttttggaactggaacaagatgcttcatcagccaagctactgaatgaaaaagacatgaacaaaattaaagaaaaaatccgaaggctctgtgaaactgtacacaacaagcatcttgatctagaaaatataacggtgggttccttcttccttccttctaagatgagaattactttcagaaagtctttggttagttgcagtagctgtgtgactgtgggcaaattattttaattctaaccttggtttacagtttggcaaatttcttatgtttagatctgagcataatttcattccttgcctgaacttcctaaactagtttatctgtatttaggctttttgcccaataaatagttgcacattttctgttgcattttgtctaatccttttctctttattttttaagaaaaaaaaggggccgggcacagtggttcatgcctataataccagcattttgagaggccaaggcaggtggattgcttgaacctgggagtttgggtccgtcttgggtgacatggtgaaaccccagctctgcagaaaatacaaaaaaatcagccagatatggtggtgtgcacctgtagtcccagctagtcaggaggcttaggtcagagaaatatcctgagcccggggagtttgagggtacagtgagccgaggtcgtgcccctgcactccagcctgggtgacagagtgagattgtctcaaaaaaaaggtagaaactacatgtatattaggaattttgaattcttattctccatggatttcagggataaacatttcagaggatttacatccaccattttcttttttaatttttattttataataatagtaataattactgttttttgagatagcgtcttgctctgttgcccaggctggaatgcggtggtgcagtcatagctcactgcagcctcaaacccctgggctcaagtgatcctcccacctcagccccccaagtagctggaactacaggtgtatgccaccatatctggctaacttttgtatttttagtagagatggggttttcgccatgttgcccaggctggttttgaactcctgggctcaagcgatcttccttcagcctctcaaagtgttgggattacaggcgtgagccaccacccccgccataactgccttttcaatgagcaagcatctatttatcccagagtacctcagggtgtctaactgcttcatgggacttgaagaaccctgaagacaccacaaggaagattcctaggcacctcacctcccctgaggtggtgttccttataatacagtcatggccagtggctgctcttaatgctcatcacaatgccccatgtgtgagatggctattccatttttgctttagttcagttttgccttcttctggctttttacttgtagaatcaatatgttccattcacatattggtgattccatccacttctaggccagtagaagataattggcctgtggttttgaaaaaaaagaaaaaaagaaaaaataagtgtttattgtataataacctggttttcagacatttccaacatcaaaactctataaacatttattattgtctactgttcacaatggacaagtccatgcaaatgtacctccagagtccaaggaagctgagaggccaaagagtctgataaatccagttttttagaaagaaacatttaatagggacttaggaacaaaagccgtatctgtgtctcgggatccccatgccattacaccccacatccgggatttatatgctatatggaaagcataattcagaatggatgtgtagggctattgcagtgtacatcaaggttgtttgacataagggcaggatatacagtaagtacctgattttacactaggatcaatgggtaaactggaaattttagaggctttcccagaacagatgttaatcagaagccaggctgggcggtgtggctcacgcccataatcccagcactttgggaatccgaggtgggtggatcacctgagaccaggagttcgagaccagtctggccaatatggtgaaaccccatctccactaaaaatacaaaaattagctgtgcgtggtggtgggtgcctgtattcccagctacttgggagtctgagacatgagaatcgcctgaacctggaacctaggaggcgaggcggaggtttcagtgagccgagattggcgccactgcactccatcctgggcaacagagcaagactacgtctccaaaaaaaaccaaacaaacaaaagacaaaaaaacaaaagccagtgtctccacatctacttaactgaagactgcagcatgtgccacaaaaatttataggatgctttgtgctagccagatgtgacttaggctcttgctctattctctattttaattaaggtagaggtggtaatagattctggttatggtggaggatgggagagcaatttaactttaaacagcaagatacaaaactgacatgtattcagtacttttcactttataagattgtggagagaggtgttgtgcccagatggcaaatcaatgatcctccatgtcatcacatcgtctgtatgctacatgtaaaacttttttttgtttgtttgtttgtttttttgagacgaagtcttgcccctgtcacccaggccggagtgcagtggtgtgatctcggctcactgcagcctctacctcccaggttcaaatgattctcatgcatcagcctcttgaatagctgggattacaggcgtgtgccatcacgcccagctaattttcttgtatttttagtagagacagagttttgctatgttggctaaactggtctcgaactgaactcaggtgatctgtcctcctcggccttcctgggattacagacatgagccactacgcctgtccaaaacatgtataatttttatttacttctgtatttttgcagtgtctactgatttttttcatgctataaaagaataaatttgagcctatagtttttatttgcctgcatagttggatgaatatgactttatttttttgtcttctatattcaacatttagattcatttcaggtatgctgttaaataacatgataaacttgataattgaatttgtcttatgttttgttgaatttattaggatgataaataccagaataaaaactttcctacactctattaaatagtttactcatatgattaagccagagcacacttgtcaattttaggattcctcttttccccactaatgttagctgtccttgaatatttttgttttaaattgtacagtagatttactgtgttgttttgtacaatgaatatcctttacacgtttttgttactagttgcttaatttcttgaatatattggtatggctgatgtgccatgaaaagataatttaaaatagtaatatagtcatgctttgcttcatgacagatatgctctaaaaatgcatcgttaggtgattttgttgctgtgtgaacatcagagtgtacttacacagacctagaagttataacctgccacacatctagactatgtggtacagcctgttgcttttaggatgcaaacctgtatagcatgttactgtattgagcactgaaggcagttggaacacaatggtggtaaaatttgtgcatctaaacataaaaaaggtacagtaaaaatatggtataaaagatttaaaaagatacacccatatggacacttaccatgagtagagcttgcaggactggaagttgctctgtgtaagtcagtgagtgagtgatgagtgtatgtgaaggcttaggacatgacggcacactactgtagacttgataaacaccatacactggctcccaaagtttaactgttgactcttttttaataacacttagcttaaaacacaaattgtatagctctacaaaaatattctgtgagcttttttctgcttttaaaattattattttttaacttttaaaactttttctgttaaaaatgaaggcgacacacacacgttaaccaaggtccacacagggtcaagattatcaatatgactgtcttccacctccacatcttgtcccattggaaggttttaggggcagtaaaacaggcatggaggtgtcatctcccttgataacaatgtcttgtcttggaatacctcctgaaggacctgcctcgggggtcccccccactgccttgaaactctctggctctgtcaacctggctggagtgcagtagcacgatctcagctcactgcaacctccactttctgggttcaagtgatccttgtctctcagcctcccaaagtgctaggattacaggtgtgagccatcttgcggcctgttcctcttattttctgattagtgatttggctgtgctttaattctgagtactattccagttttcaaataaaatgcttgattagtaggctgtttttaaatgctagcttatagtatactgactatagcctaaaatatcaaagaatcctttttatgccaatagaaacaaaaacaaaacttcctaaaaaggctcgagttttaattattaatatcaaattaccatcacctttcttctaaacaaagaatgcctcattaggcttcagctttgcctgtatgactcatgaattaacacacacgaaccagtctaaattactctttgagggacagaatgaaaaatgggcacaattgtatctgtttttgtggtattggattctagttctatatttgtcaccttggagaacaactcttttttttttttttttttttgagacgggatctcactctgtcgcccaggttggagtgcagtggcacaaatcttggctcactgcaacctccacctcccgggttcaagcaattcctcctgcctcagcctcccgagtagctggaattacaggcacccaccaccacgcccagctaatttgtgtatttttagtagagatggggttttaccatgttggccagactggtcttaatctcctgacctgaggtgatcagcccgcctcggcctcccaaagtgctgggattacatacaggtgtgagccaccgcacctggccgagaacaacttttttaaaagaagtagattaaaatcttctagatcttttctaaatgtgcagtcttaaggttttcactggtaatatctgttatttgtatttctaaatatctaatttatgtgcatttttcaaatagacctgaaggacttaatgtaaactctcatcttttgaaggggagaaacttagggagaaaaaccagatcttgtcagtctttgctagttaaagcatttcttttgttatgctgaagttctttattgcagcaggaaccaaattgctctttgttgggaagtggctgtctgctttaaaaagaaaaacaacagccaaagtgaaataaagggcaataaaaactttactcaggttgtgagtgtggctcttagcttttgtactcttctggtggtggtcctaaagcattatttgtatacagttttgtcatcatggccacatgatgaatatctgagctgctaagcccgcagtatgccctttaaaaactagtcagtctgcaacactaaagtgaacaaaggatttgtatgcagaatagacaaaatacaccaaataataagaaaagacaatcagtcttgcaggaaaatatggaaagaataatgaacaggagtctcatagtagaaacatagttaatatgtgaaaaactgttcaaggttactgtcgttgtaaaaatacaaacaaaagcagtatgttaccattttgtaccctcagacaaaaatgttaagtgataacttgtacttttgaagattcagggcaactggcactcccacactttgctcctgagagtgttacttgttaaatccattgtggtaaattaatccaatattgatttacagttaaaaaatacatgtaccctttgacttagcagttccacacttgacctgtatactgtagaaataagagtacctatatatatgtataatattaaactgacaaatgatagactaatagcacattttctctatgaaaagctggttaaaaaactttgttcaatgtggactattctgataaaattgaaaattagttcaattttatgtataaaagtggtgttaaactacatgtagcatgcagtaaatttttgtaaagagaaacaatttctagagttattgctaaaagttgatattcattaatgatgcttctggtttttagactgggcatttagctatggagacattattatcccttacttctaaacgagcaggagactggtttaaagaagaactccggcttttgggtggtctggatcatattgtagataaaggtatgatatttacatttagaatgtttttatatattatttaaagcctgaagaaaatactccattgacgtacttcaaaaaataattgtatcagtttggaaatgtctattatcattattattttttagttgcatcctgcaaatttctaacatttaaagaagaggccggccgggcacggtggctcatgcctgtaatcccagcactttgggaggccaaggcgggcggatcacctgaggtcgggagtttgagaccagcctgaccaacatggagaaaccccgtctctactaaaaatacaaaactagccaggcgtggtggtgcatgcttgtaatcccagctacttgggaggctgaggcaggagaattgcttgaatgtgggaggtggaggttgcagtgagccgagattgtgccattgcactccagcctgggcaacaagagcgaaactccatctcaaaaaaaaaaagaagaggccattaacattttgatattgggggattatggaaacaaaataattacagagtatgcatttcaaaatctcacagtatgaaacctagaataaaaaatgttcagagaggttccagcatgttcatagcgtgtgtacagatggcttctaatgttagctaaaagtattctattggtaagtatcgatgataaatactaacttacgtttgtttcttttcacctagtaaaagaatgtgtggatcatttaagtagagatgaggatgaagagaaactggtagcctcactatggggagcagagagatgtttacgagttttagaaagtgtaagtatggatgactatttggcaaaaattattcagtcttaattgtgattgtgtgtgtaagagagagactgccaaatattttatatacccctggaggttcacttctgttaatccagatagaaatagcagtacattttttgagcaaccagttgttaataaacaagctaaatgagtagttttatattttaagagtacatgtattattgctgcaaatgaaatgttaggcttgtttgtttacatatgccaatcttttttaaagattttattatttttattattattttttgagccagagtctcactctgtcacccaggctacagtgcagtgacatgatcttagctcactgcaacctctgcttcccgggttcaagcaatttcatgcctcagcctcttgagtagctgggattataggcatgtgccatcatgcccttctgatttttgtatttttagtagagtcggggttttgccatgttggccaggctggtctcaaactcctagtttcaagtggcctgccggcttcagcctcccaaagtattgggattacaggcgttacactttgctgggcccctccaatctttattgttttttccttaatgtgaatttctacttgactacattgtttgtagataacaatagtgaaatgcaatcaggttttatttttaaattgttattagcattttgtttatttgacttttatttgagtcagattgtttataggcatggcctgtcataatatttggctttggagaatgatactgttgaactgcagcgagtatattttgttctttgactcttacgaaagacttaacccagttccgtatagattagaatttatactgccagctaatttcaggatgcataggtttgttcaccaggttattttaaaagtagtatagtataaattaaaagctcctggcatagattaaattgtagcgttccatgtgtcttctagagtgctttgggcacagtagataacagatacttctttgtaaaaatgtgttctaaatgaatctacttatgaactttacgttatttgtaagttgaggactgctctattctgacattcagtgtgtttggcaattcgttacagtgaatatgtagtgtagaatatgttaattatgaatgaatataacagtgatgtcttaattttttcataaagcattagctttcttattttacacctggaacctgtaggttgtgaaattattccctttggtaacaagggctgtttcttcctcatctttgtatcttttacgcaccaggcagaatgtggtgttacatgaatgaatgaaagttttggattgccacaattatttcatattcttcctttttaggtaactgtgcataatcccgaaaatcaaagctacttgatagcatataaagattcccaacttattgtttcatcagctaagtaagttttttgtttattagttaacaactaacattgttacttattttaaacatttggattgaccataaatgaaagaaatttggattagcttcctccatgaaatgctctgttgagttctgtgaattggttcacattgtgtaacaaaagttttaagagtacagattttggacacaaaatgacagtgtggattccagcttgataatttcagctgtataacttttgtaatgtacaaatcaagctctttacaagggggataataatagtggctaacccacctaggatttttattacagtaaaatgagttaatttgtatgtttgtaagaaatatatacatagtagatatttaaaaatatgtgtatattaaaaatacatataaaaaatttaaatttaaatgatttttaaagtatcttttgtatcatttgtgatacatattaatgagttaaattagttaatgtgcaaagcctagaacagtacttggcgtatagtaaatactaagcatttttcctcattcttgttttaaatggacttttctctgttcttctgcactttatttagacctgtttttctatatctgtatgtagcttcttccattccacatttatttcttcccacatttcatcacaattaggctaatgctgtcacctccttgcaggtaaaattcccaagtatgtctccagtcctggttctgtcttattacagcaacctcttcctgatatctctgtcctagttcttgatatctgccctagttctctggcctttagcctatccagaacaataccacatggagttaactttctccaaatcgctgctttgaaaaaataattttaatttctcaaatctctgattccttattgtctttggatatatgtacaactttcttattgaagtcagccttatcaaaggcccattgcagtcttactctagtttatctgttttttaacctcttattttggaggaattcaaatataaatagtgtaataaactgtaatgtacacattatcaatcatggccagtctggtttccatctgtaacctcatccattccctctcctgtattatttgaaacagatccagatattatttcgtccataaatacttaagtacataatgcctagaagaaaaggactcttttaaaaaatataaccccagtgccattttcatgccacacattattagttgcttaatattttatgtttagtcaatattctaattttcagtagtctcaaatttctagtctcagtagattttcttaatctgtaggtttttaaaatctcctttttttgtcttggatttgtacgttttgtatcttgcatttgtatattttatttttctttattttattttatttttttttctgagcccaggctggagtacagtggcatgatctcggctcactgcaacctctgccttctggattcacatgattctcctgcctcagccttccgaatagctgggacaacaggtgtgcgccaccacacttggctaatttttgtatttttagcagagacggggtttcaccatgttgaccaggctggtctcgaactcctgacctcaggtgatccacccgccttggcctcccaaagtgttgggattacagatgtgagccaccgtgcctggcctattttatatatatttagcactctcttttttttttttttttttaatagatacagggtcttgctatgttgtcccagctggtctcaaactcgtgggcttaagtgattctcctgccttgacctcccaaaatgttgggattacaggcattagccactgtgcattgcctgtatttagtgctcttaccgcatgcattctggttgtttgctaccatgtttttacccttccttaccaaagattattgaagttaaatgtttctgatttcattttcttttttaaattaagaaaaattgtgtatgttgtttctgatttaaaaatatctcttttgtatacttcataacctctgacaactaccttgtaagaggaagtatttgatatgacaggtgctcttttgttgtgattaggaaattcaggccaaatgtcttggaagtggcagtagaggtcagaattgagtgtttgtaaaagagcacttatctctaggtttttaagcttttcagcagaaaccatgatcaattcggagatagcatacagaaagattaaataacatatgctgaacctccttttgtcttcaaagccccagtttagcccagcctgaaaacagttgagttaccagtgacagtatggtaatcctgaccagcattcaataccagaagaacaaattattttaggttagacatgaggaacaccttcctgaccaaagggttgtaaaatattaagaacttttacagaacttcctcagtatgttttaaagggcaactaggcgtagattagatacggtttctttaagaattttgtgtgatatataatgcatgaagaatcaactgacagagtgagcttacttgatttgtattaaacttaaaaatcgtggacttggtgatttaaatagtgtctttagaaatactagacccattagggattatatttccttgttattttgggtagtatcttgagaatcctttttttttttttttggtatcataaagtttttaatgacacacacattttgtcctttaccttacaaatatttctttgggttttattctgatcatcatgcaatatacagaatagtttcttgccattaccttattagggtagaaccacctttgcaactttggacaccatttagtagacgtgaaatggaatatagaaagatagaatgcttgaacaaaacctctcagtgctagctgccttaactaaggtccttctctcagcttagtacccctgtgacagcttgcaagacactctgactttgttttattgtgcttatgtagtcagattatgaggctgatcattgagtgtccatcagactctacattattgattcctctctcaagttgccccaatatcctttgtggccagaggaagagaaaaacattcaactagtaaatccaatttctcttgcgaaaaagactcatagttctgataaagagtcatttcaatacctgtttcaccatttagaaaacatgtttctgtttgtatagcacctctgggaacctaatgcagtaatatcgccttcttttccatttgtccctgatctagatgctatattttttatgcaacccacctgctgttaagtattttacaattatagatttacgctctatcttttattctgtcccatctcaccctgctagcaaatttttatttgttttctttttttctttttttttctttctttctttttttttttttagtatttattgatcattcttgggtgtttctcggagagggggatttggcagggtcataggacgatagtggagggaaggtcagcagataaacatgtgaacaagggtctctggttttcctaggcagaggaccctgcggccttccttgtgtttgtgtccctgggtacttgagattaaggagtggtgatgactcttaacgagcatgctgccttcaagcatctgtttaacaaagcacatcttgcactgcccttaatccatttaaccctgagtggacacagcacatgtttcagagagcacggggttgggggtaagtttgcagattaacagcatcccaaggcagaagaatttttcttagtacagaacaaaatggagtctcctatgtctacttctttctacacagacacaataacaatctgattttcttttccccacatttcccccttttctgttcgacaaaactgccatcgtcatcatggcccgttctcagtgagctgttgggtacacctcccagacggggtggcggccgggcagaggggctcctcacttcccagacggggtggccgggcagaggcacccccccacctcctggacggggcggctgccgggcgggggctgccccccacctccctcccggacggggcggctggccgggcgggggctgccccccacctcccggacggggtggctgccgggcggagacgctcctcacttcccagaccgggcggctgccgggcggaggggctcctcacttctcagacggggtggccgggcagagacgctcctcacctcccagacggggtggcggtcgggcagagacactcctcagttcccagacggggtcgcggccgggcagaggtgctccccacatctcagacgatgggcggccgggcagagacgctcgtcacttcccagacgggatggcggctgggaagaggcactcctcacttcccaggctgggcggccgggcagagggcctcctcacatcccagacgatgggcggccaggcagagacgctcctcacttcccagacagggtggcggctgggcagaggctgcagtctccgcactttgggaggccaaggcaggcggctgggaggtggaggttgtagcgagccaagatcacgccactgcactccagcaaaaaccagtcaggtgtggcggcgcccgcctgcagtcccaggcactaggcaggctgaggcaggagaatcaggcagggaggttgcagtgagccgagatggcggcagtacagtccagcctcggcttggcatcagagggagaccgtggagagagagggagagggagattgtggagggagagggagagggagagcgagaatccttagatgtagctcatccccttggaaaattgtcgaggagacatgtcaatttgaatgaacttaaattaaaaaataatgatttatactgtcaacgttggtagtgaaggtaataaaaataatgatttgctctaatgcgtatgaaatatttaatacttgtctttacattaacatttgttatgtagtaataacatttactacctcagaagtgtccaacattagctgttaaccatttgccctgtttgagaaagggttgtggtctgtctcttatattggagagatcaataacatgcgagacaatttggaaataaagagattactagtggtaaatgtagatagtacagatataaacttctgccataagtttttaattttaacattccttgaataagttttttaaggtatcagatttttccaaaataaagtgaaatttcatccgatagcctttaggttcaagtaaatagaaatttgctgtgtacctattattatttactataatagtctatattttatttccttttaagagcattacagcattgtgaagaactgattcagcagtacaaccgtgctgaggacagcatatgcttagctgacagtaagcctctgcctcaccagaatgtaactaaccatgtaggcaaagcagtggaggactgcatgagggccatcatcggggtgttgcttaatttaactaatgataatggtaagatttttttccatttttttctcattgaaagatgtatattgcatgtgaaaacaagttatttttgtttctccttttcctggggtagtgatttttttatttgtcataatgtacttgacttactcatgtgtaggtttaaattgcttttaagagttgatatttttagaagcctagtagcttgacccagaagtatcaatagtatgtttcaatagaggaatgactatacaattctaagttaatatccatgttaataaatctccattattagtgttctaaggaagaatcagtaaccattttcctgtatccatttcttatttcagagtggggcagcaccaaaacaggagagcaggacggtctcataggcacagcgctgaactgtgtgcttcaggttccaaagtacctacctcaggagcagagatttgatattcgagtgctggtaagttgaaatgactttttcagaaatgagtatcatatctaataaggtgtgcaaaatgttaaccttagtttgggtttaagaaccaaccctttaatatattgtgggttttttttcatgaatttccttatgaacttactgtgtgtgtttcttttttttttttttttttttttttttttttttttttttttttttttttttttttgggagatggagtctacagtggcaacatcttggctcactgcaacctccgcctccctggttcaagcagttctcctgcctcagccttccaggtgctgggactgtaggcatgtgccaccacgcctggctaatttttgtatttttagtagagacggggttttgccatgttgccaaggctggtttcaaactcctggcctcaagtgatctgcccgcctcagcctcccaaagtggtgggattacaggtatgagctattgcgtctggctgaacgtacttcttattgtgcaaaagaaagccatgaaaagaccctatgtaaaaataaaaagtacgaaagctaaaattggcaattaaaaataaaaggaatgattctttgggaaaatcggtggtttttttgttttgttttttttgttctttttttgtttgtttttgagatggagtctcactcactctcttgcccaggctggagtgcagtggcacagtctcggctcactgcaacctccatctcctgggttcaagctattctcctgcctcagcctcccaattaggtgggattacaggcatctgacaacacacctggcttatttttgtatttttagtagagatggggtttccccatgtttgtcaggttggtctcgagctcctggcctcaagtgatccacctaccttggcctcccaaagtgctgggattacaggcatgagcgctgtgcctggccttttttcttttttttttttctttttttctttttggcctttcatactggtttttagccattttgtaggtggtagaacactgatattcagctttttagttgccattaaaaattgtgtatattgtgttcatttgttttaagtactcatctctgataatatgtgtcttttaaactttttgaagggcttaggtctgctgataaatctagtggagtatagtgctcggaatcggcactgtcttgtcaacatggaaacatcgtgctcttttgattcttccatctgtagtggagaaggggatgatagtttaaggataggtggacaagttcatgctgtccaggctttagtgcaggtaagcaaccactttaaaaacaaactcataactgcagtttgttggatttgtccaatttcttttatcatttgcaccttttacctccttttcttgcccatccactgctggccctctctgcccctcccccggcctttttagttagaactcctgaagcatgtctctgctggggtagaaagggactgttttacacctgaccaatttttaaatattcacagcgtctagggtgaaagcttattttaaaccagaatttgtaaccaattaaaaatgtggtataggctgggcgcagtgactcacgcctataatcccagcactttgggaggctgaggcaagtggatcacttgaggtcaggagttcaagaccagcctgaccaatatggtgaaacctcatctctactaaaaatacaaaagttagccaggcatggtggcatgcacctgtaatcccagctactcaggaggctgagaggcaggagaatcacttgaactgaggaggtggaagttgcggtgagccgaagtggcatgtcactgcactccagcctggacaacagagcaagactctgtctccaaaaaaaaaaaaaggtggtataatttctctgtagatcagtaagaggtacactgcttagaatgcattcttactttattttgctgattttttttcgactgttataatcactccttaagcattgttaccaaaaagcagagacaaaggcacatttgttctattaatgaaattgggtgcagtggcttacgcctgtaatcccagcactttgggagactgaggtggggaggatcacttgagtccaggagttcaagaccagcctgggcaacatagtgagctcccatctctattaaaaaaaaaaaaaagtcaagaatccaggcccatcacatccacttcgtgtcctctagtatttatttactcgtctgatctgtgtccagaactttgaccttatggaccacagaaaactggaagtcctttgtcacctgttcccttacccagtctggaaagtggcaaagtagccgagcatgggaaattgtgaatgagagtgtttctttgagccatttaaagtcattttttattatcctcttttgttctctattatgtgtgattgaatgttgactatagataagaggtagttaatccctaggcttttcttcttagactcagaatactccgttttgactagccttgaagttttagtttatttaaaatacaaaattaaatgtgaaactagtgatagattatcattacttatcagtaacagtaatagtaaatggtagtagtaatttactatcaatagttgataatagactgcttttagtctccagataccatttagagatttcatttaatgcaaaaaacatttgaaaatgtttggcacctaccgctttgatcccattgacaacatttatttttctgctaaatgaagcatttcttggccgggcaaggtagctcacacctataatcccagcactttgggaggccaaggtgggtggattgtttgagctcaggagtttgagaccagcatgggcaacatagtgagatcctgtctgtacaaaaaataaaacagttggttgagtgtggtggtgcatgctcatagtaccagctgctcgggacgctgaagtgagaggattgcttgcacccaggagtttgaagttgtcgtgagccgtgattacagtactgtgctccagcctgggcaacagagtgagaccctgtctcaaaaacgtttaaaaaaagtattctttttttctgttcagtagacttgtttttaaactttttatttcaaaatagttatagactcacaggaagttacaaaaatagtacaaagaatccctcccatttaccctttacctaacttcctcaaatggtgacatcttatataactgtagtactatagcaaaaccaagaaattgacattagtacattactgttaactgcactttagaccttattcagtttcaccattttcatctgcattcatttatgtttgtgtgtaacatatgtacctctgttcagttttattacgtgtatagattcatgtactcaccactacattgagatatagaaccgtcaccataaaagaattcccttttgctgctcactgtacagcctacctgccctccctgtctcctagctaccaccaacgtgttttctatctttttccatctcttgttttatttttttctatcattctagtctctttcttttaaaaattgacttttcttcaaatggaacctagaaatgaataaaaacttaccgtcagtcgcctcaggagctgtgtttgaaggcacagatgatagatctgcattatccacataataggggttcatttgcagaagccatccccacaccctcagagatccctgtttgtgagttgtttcagggatagtctcaaattttcctactgtgtctaattgacctgggaatatcacttccagtattcctcttttgcacttagtgttatagaagcctcttgtccttcagggtatcatcctatatcttctctgtctttcttttatctgctatggtttatggtttgtcatttttaaatcagtttaaagtttttgtttttcaattgtaataccttttgggtgatgggttctgttactcattttagaaaattgtgctgccttgtactcacatcagttaccttaaagtgtcaagaaatggctcttaattctgttattcaaagatagagtggaaaaatccatgttcagatttatatcgtttatgctactgataacgttggcctgaatccagtaattttcaaattacgtatcttttcgataatgttgtataaatggaatcttacaggtagttctgattactgacatgaactttcctctttctagctgttcttttcttacctatttatggatctgtttattttttaaaaaccaaacataattcacatacgtagtgggggaaaaaaagtcagatccagaaaggtttaaactccacagatctatttcctaaaacgttaccatttgtaatagttttgtgtttgtcctgagaaattagtgtttatgcatatatcaaaataaatgtgcaggccagacatggtggctcatgcctgtaatctgtaatcccagcacttggggaggctgaggcaggcagattgcttgagcccaggagtttgagcctggcctgggcaacatggcaaaattatgtttctactaaaaattaaaaaattagccaggtgtggtggcatgtgcctgtagtcccagctatttgggaggctgaggtgggagaatcacatgagcccaggaagttgaggctgcagtgagccatgatcctgccactgcactccagcctgggcaatgggaataagaccctgtccgaaaagtaaataaaaaaatgtgcaatgtgttttatataaatggactcttactgtacatagtatttagtctatacccactctttgcttaatgtgtcttcctgagctcttcatgtcaacacgtaggttcatcacattctttgtaatgactgcaaactagtagctttttgatttatacatacatacatacagggtctcactcttttacccaggctgaagtacagtggtccagtcacagctcactacagcctttacctcccaggctcaggtgatcctttcacctcagcctcccaagtaggtggaactacaggcacatgccaccacgtttggctaagtttcgtatttgtagagctgaggtctcaaactcttgcactcaagtgatcctcctgctttgtctcctgaagtgctaggatcacaggcatgagccaccatgccctgccttagtactttatttaaccaaacctctactgatacactttttgatggttttctgtttttttaagttttattttgttacaaaaattacagaaataaataccatagcatctaaatcttaggccatacttttcttttttttaaatttttttggagacagagtcttgctctgtcgtccaggctggagtgcagcggcaccatctcagcttactgcaacccctgactcccaggttccagtgattctcctgcctcagcctcccaagtagctgggattacaagcttgcgccaccacgcctggctaatttttgtatttttagtagaggtggtttcactgtgtttgccgggctagtcgccaactcctgacctaaagtgatccgcctgcctcagcctcccaaagtgctaggatttacaggcatgagccaccctgcatggccaggccatacttttcaaagtatgtctgtgggcataatttcctggtttaggaattgtgtcagaatatattgtactgtatttaaagttgatatgcctaactcctcccaccctcatcaccaaacacatacttcctgtgcccttaatttatacttccccctaaaactttttttttttataagagtccccattctttcatactcttgccaagatttttgccagtctaacaggttcctggatgtttttggtatttccttaaatggcattttgtatatgtccagaaacagtagtggttcattctttttatttttccaaagcccttgctgtgtttagcttccttttttggccttttcaaaagcagtaatccttgaagttgtgtcttcagagtaacctgtaacccccaacaactcagttcttcctggagtcataagtaggagtccatcattctcttctaatacatttttatctcagggcttgaaaattattgggaaatccagagagcttttgttgtttatatgtgctttatctgtctatatttactgaattagaaattgaaactgggagacattacattagctgttagagcagtgacataatcacatggcatgtagattccaaaactccactgtgcactcagtgaaagaagaaacaagtcagcagaccccttagtagtagtatgagtgtaattttgacctcctttactccctgatagggtcttaaggatccgtagggattcttagaccaattttgagaattgctgctctctataaagtttaatttttattttctgaaagatattattttatataatctctctttgaagtttgtataccactcttctgtatactcaacaaatctttgaggtctacttggcatttgattttcaggcaattctttctagtaacttggagcatttcccaaattgtgtcagtgttttttctatgtgtcagtactataccagcatagggaaaataaagtaagtgaaggcaaggaatttagcatattcccttttgacttaagaattttccaattttgtatttttttgcttgaatttcttgtattatgcaaattaagggaaattattgagactcattcttgcatcattattagatgacttcattgaatcttagcagcatttatactttcgttttggctttcagtagggtgtagagcaaaagcttttacttatactcacctctttttatcacataaccatcttagagttagtgatagatttaaaagcaactataactttatatttgcatatatgcatattgattggcaatctctttttaatgatcttcaaaaataatttttatcagctattccttgagcgagagcgggcagcccagctagcagaaagtaaaacagatgagttgatcaaagatgctcccaccactcagcatgataagagtggagagtggcaagaaacaagtggagaaatacagtgggtgtcaactgaaaagactgatggtacagaagagaaacataagaaggaggaggaggatgaagaacttgacctcaataaaggtatatttactttgaatggtgtatttaaattgaagatagtggtttgattttgtttttttcttcaaactattttaatttgcagattgtcttaatctggctattgcttgaggacctctctagttcagtccagacaagctttgatacttaagtgcttgtggtagttctcccacagtgaggaaggtgcgtgccagtggcaggcatgctagtgacgggaaagatccagttaagtcactcttccttccggggccctcctttcctttacttatctgtgaagagacatataggagacataataggattttttcagttttcagtttttgagattgttttttcagcttcactttaaacttgaagatctattgtcagattacagtaatagttctcaaagtgtaagtactagatggtaaacacagtaagaaatatactgtaggctggtggctcacacctgtgagcccagcactttgggaggctgaagcaggaggattacttgaggctaggagtttgagacaacaatctagcaagaccccatccctacaaaaaatataaaaaattagcctggcatggtggcacaagcctgtagtcctaggtggttgggaggctgaggtgggaggattgcttgagctgaggaattcaaagttacagtgagctatgattgtgccactgccctccaccctgggtgacagagtgaggccctttctcattaaaaaaaaaaaagatactagaggtaatatcttcgctaatcatacattattgagtatctactgttgtcagaatttgtgatacaacttttgccatttatacaagttctgcaaaatagccatttgtaactttgtatcactaaggttatgaatttaagttcagtccgccctccatacatgtgggttccacatccacagagtcagccaaccacaaatcaaaaatatttgaggaagaaaaaataatacaggttagtaaataatatagtataacagctatttacataacatttacattttattaggtgtcataagtaatctagaaatgatttacagtatgccagaggatgtgtgtgacttatatgcaaatactgcaccctttcctgtcagagatttgagcctcctccagttttggtattggagggtgctggcatcctggaaccaataccccttggatgcagagggacgaccatatgttcagcttcacatcagtaggaagcaagccgcagcaacgtctcgttctgagccttttctcctgttactcccactcctccccaaatctgatcaccattagttttaatattgtaatacttgtcttttcctttttctcagttactaggttttgatgcatttcttttttttttttttttttttggcgtaataacatttttggttttttagcagtcttttaaaaagttacagctttattgagatagaattcacagactgtacaattcatcctttaaaaatgagtaattcagtagtttttcatgtattcacaaggttgtgctgccatcaccactaattccaaatattgtttttatcaccactaaaggaacccaatacccattagcagccatcacccctattttcccctcctccctgggcactggcaaccactaatctactttctgtgtctatggatttgcctgttttggacattccatttaaaaaggagtcatacaatatgttgccttttatgactggcttctttcagccagcagaatgttttcaaagttcatccgtgatacagtatttgttaatactgtattccttagacaaataatattccataatattgttataccatagtttatttgtttactgatggacatttgagtggtttctgctttttagctttttgaacagttatctacaagtttttttgtagacatacattttcatttcttttggatttatacctaggagttggaattgttggattgtatgtaactgtgtgttttaacattctaagaaaatgccaaattgttttccagtgtggctgcactattttacattcccatcagcaacgtatgaaggttccaagttacttgtattgtaaaagaaaatttttagtcatcctagtgggcgtgacatgatatctcattgtggtttgatttgcagttccctggtgattaatgatgctgaccatcttttcatgaactcattggccatttgtgtatcttgtttgaagaaatctctaagtcttctgcccggttttgtgggttgtttttgttgtttttgagacagagtcttgctctgtcacccaggctggagagcagtggcacgatcagggcttactgcagccttgacgtcccaggctcaagcgatcctcccacctcagccttgcaagtagctgggagctacaggcgtgcaccgccacacccattaaaggtttttgaattttaatggagaggaggtctcactatgttgcccaggctggtctcaaactcctgagctcaagtgatccttccaactcagccttccaaagtgctagaattataggtgtgaggcaccacgcctggccctttgcccagttttaattgggttgtttttgttgttgagttgtaagaatgttttttatatgttctggatacttgacccttatcaagttcatgatttgcaaatatattttctcattctgtggattaatcttttcagtttgttaattgtgtcctttgcaacacaaaaattttaactaaaagttttatggtttcagcttttcttttggatccctatttcattttgattaaatttttgttaatctgtggatatccagttgtcctagcatcattcgttgatttgtagcagttttaaagtaaagataactaacagaatggttggttttgtgaggtttgtgttaattaatatactgttacaattctttacttcaattctctcagcccttcagcatgccggcaaacacatggaggattgcattgtggcctcctacacagcactacttcttgggtgtctctgccaggaaagtccagtaagtacatagttcagtgatgttttatgtatctttgaaagattccaatgtaacgacttcatacctttacatgtttcacttatttatttcttcagtgtttcccccttaatgtccaacttattccacaaaggctattggctgattatagggttgtttaaattgtttgtttcctatggaggaaaaatggcaagaaaatgtgttaacatttccagtagtttttttttttttttttgaggcggagtctcgttctgtcacccaggctggagtgcagtggcgcaatctcggctcactgcaagctccacctccctggttcccgccattctcctgcctcagtctcccgagtagctgggactacaggcgcctgccaccgcccccggctaacttttttttgtattttttggtagagacggggattcatcgtgttagccaggttggtctcaatctcctgacctcgtgatccgcctgccttggactcccaaagttctgggattacaggcgtgagccaccgtgcccggccatttccagtagttttatttaaattacctaaatagttttaaagtaaaaactttagtacagtctgtattggaaagggaatgtatagcattttttacatgctaatcctttccaatataggttttactaagtaaggcctggagtggagtaaattaaattgattttcactttttaaaaagtgaaataaagttgatctttatggctttattaggaaggatgtgcctgtcagagttaggctgttaaagatgtaagaaaaagcagttctggaaaacaagctagtcagtgctttaatctcatgaaaaaggaagaattacatacatgaaataaaattaaaaatcaaaatagtatataatattaaaaactttaaaatacttgttgagctttttcaggtacatcccaaaggtcagaatactaatgaaaaagctcttgtggccgggcatggtggctcatgcctgtaatctcagcactttgggaggctgagatgggcagatcacttgaggttaggagttcgagaccagccttgccaacatggcagaaccatgtctctactaaaaatataaaaatttgctgggcgtggcggtgcacacctctaatctcagctactcgggaggctgagacgcaagaatcgaatcgcttgaatcctggaggcggagtttgcagtgagccaagatcgtgccactgcacttcagcctgggcttcagagtgagactgtttcaaaaaaaaagaagaaaagaaaaagctgttgtttgatggatgaatctgttcacatgcctttggttggagtaaaagaagggatagtatgaaacctgtactcatctggcttaaacaagatggcagagtctaatttgggtgatgtcagtgcctcactgaggtcatcagagactcagatcatttctgtctttattatttttctgtatttttttgtagagacagggtttcaccatgttgtcctggccggtctcgaactcctgggctcaagtgatcctcctgcctcgacctctcaaagtgctggcattataggtgtgagccacagtgcccaccccatttctctctttaaactgctgtcctccacatgttgtcctctgctagcccttatggtcccgtgctgactacagctaggtgtctcatcaaattaagtagtgcctagcagtaatagggcctcttcctctatagtttttttttttttttcataggtgcattggctggaaatacatatctttttaagacaactgtttgtttatttcccctgtgggaccccatgccactctcacccctcaccaggtagacttctcatcttggccagcattgggtcacaatgcttttgtctgaaccagtcactggctgggaacatgggattactgtgagtggattagatcatcaggattcacttaggagaaatacaaatgtctagacaatcaggctgagtcagcctgaaagtgaaaggttgtgactatggggatagtctgctgccttgggaaaaacaaatatgaagggtaaaactgttgaagaagggtccagcagaatcattgtgagtgttctctttcagatggggggttgggcataggtggattatttttaagtgtaaagtccatttgtaaagccagattttgaaatggaaggcagattgttttctaggagcaagggcattgagggaacaagaaagagtggagacctataggaggggggcattagtttcagcaggaagcaggggccatctctttttgaagctggaggactggaagaacagagttaatgataaatgaatggctttatttgagcaggaactcatgctggctctgtgtacctgggcccatctacccaccccacgtttccttactttagccatctaattctttgtattgcctttttttttttttttcactttgtgtatctaagtcctgtgtgtttttctgaatccatcttgtccatctcttccatacttaacattttaactaacctaaatacaacagcccactctgtgtggcccctctgggtaccgccgatttcaggatcaagaccaaagttctcatcgtggctctggaggccccgcaagatctttatatccctttttcttatttccaatgacaagattttaagagcaaatcagaaacccatcacacacaggaaaggaggaagaggcaggcctcaaaagcagtgaaaaaaggccgggcgcagtggctcacgcctgtaatcccagcactttgggaggccaaggtgggcagatcacaaggtcaggagatcgagaccatcctggctaacacggtgaaacggtgaaaccccgtctctactaaaaatacaaaaaaaaaattagccgggcgtggtggtgggcacctgtagtcccagctactcgggaggctgaggcagcagaatggcgtgaactcgggaggcggagcttgcagtgagtggagatcgcaccactgcattccagcctgggcaacagagcgagactccatctcaaaaaaaaaaaagcaatgaaaataatatttaaatttaaagatttttagatactctgttttttacacactataggtttagtcatatttcagtcacgttctttcttacataatcgttcttgaaattgtgttattaccacatatgatttatcttgggccatctttcccatgctaattcctatttgtgtttgcctgtatctatcttgtctctaaaaagagaatgttcttaaattgtgggaaatgttgtgaattcatagagccccagatttatttgttgccttggagattattatgattaacaccaaaaagctagctgataccacaaaatgtaaaggaagtttggtttacctaatgtgtaagtgaaaagagatagacaagaaagcatgtggttgttgcagtaaatgctgctttgtggtctgatcccattttcacttgccctccatgtcttctcactttgcagctggtgcattgcagtggtcagtctcctcactgctcttcctgctttgttgcccctccattcctgggacattgcacattgccactggagctaacttacttcagagcacttactgatcacgtagctccttgcccagtcttccttggctcacagccaggaaggggactcatgactgtttagtgttgcaagaccctggacttaagactgcttctccaatttccaaacctactggacacttttaaaatttttcaaataggccatgctgtatcatgccttttctttttgtacctgctatattctgttaaaaaatgctgtcactgtccctcccattgcctcagaaacgctgtatgtcatgttctgtagtgtgttgatagagaagggtttgatttggattaatgaggggctttcatccaaaatataggagctaatcatatattctctattacagaggcgtacttttctactgagcagttctccagagacaccttagccactattttgcccaccactgtgatagcttttggtgggaggatcagtttgaatgtgtgtaactgatatcttcagcacatgagtactttagcagtgttttgattagatcttttctgaagctgtattcatctcatttttttgctgctttctaattttgcgagtaccctggcatgggaataggaaaaagggggtgggtagtggcaaatttctgaagagaaatatgtcatctctccttttttgcccccgctaacaaaagtcgaattgggagcttttgtgtgttttctttttgttttttggttggttttgtttaaccctttaccttgtgtccccaaacttgggacagtatactttcttttgccccttactacaggtgaaccttcctaaaagattttttctttttattctccgtaaaacatttaaagcattctttaatgaaatagttttttaagcaggttgtgtaatgttttccatgtaacagattggtttatatatagtttggctgcttcttgctaataatgaagggttttctctcctgatattgtctgagaatctatcatagatgaggttagattgcctttggaaagatgcttctagttaattcctgtcctatataattagttgaattcatctgtgaaggatgtgaatttttctttgatctttttatttcatgagcagctttgtgagtacattctcaggtctaaagtcctcaccctcttctcctattcccccagggcccccagtgaaacacacacatacattaaacagtgcagtttgttatttcaggcctttttctttgcatttatgaaagtaggtcggcatgctgcctcacacctgtaattccagcactttgggaggccaaggtgcgtggattacttgagcccaggagctcgagaccagcctggccaacatgatgaaaccacgtctctgctaaaaatacaaaaattagccaggcatggtggcacgtgcctttaatcccggctacccgggaggctgaggcatgggaatcacttgaacccaggaggtagaggttgcagtgagctgagattacaccactgcactccagcctgggtaacagagtgactgtttcatttaaaaaaaaaaaaaaaaaagtaaatgtgtacacaaatatttctttgtagcttttgccaactttacctttctcctttctttctgagggtgaggtaggaaatcacatgcagagtgagtgtggaaagagaataaataaccacgtgttccaaggatcttaaaaatttgcaccaagatgtgtgtcaaaaccaacaacattgtacgaggtgcaatctcatgttttctgccagctgaccaatatttcttgctctgtttcctcagatcaatgtaaccactgtgcgggaatatctgccagaaggagacttttcaataatgacagagatgctcaaaaaatttttgagttttatgaatctcactgtaagtagcttttattacagcttatatgattttaaatttataatacattgacagtagacataaaaatactatggccatagtaagtgggagcaaaaagggattttcttttaattttaataatcgtgttctatttcttcaaggtaatcattgcatgttatggcaaataactttatcaaacccacaatttaatctcggtgtactttgatttgtagtgttcagtttagtaaatctagaggtaaacttttatttatacttcttaaaatctgttaaatattaactgttacttcctttccccttcaccctgctttcagtgtgctgttggaacaactggccagaaatctatctctagagtgattgaatatttggaacattgctagctgctttacctttgcttcaggtgctcggtaatgctggagctatccttagacaaagaaaagtcaagtcatgaaagaagtccttgaagatataccaagaacattcatcagtatcattcgtgtttggatttttaaggccacctgatttcttcgtcatgcattcggcatttgctaaatgacagttactacatcaatctgcaactatcaaaaatgaggggaaaaggttcaggctgttaacaattccatgcagtatttaaatacatttactttggcagagtttataccctccccttgttttcttgctttattctgggcaagtttgaaggggaaaatttgtgctgctgttagtgcaactgctgtgtatgttgagccactgttgtcatgccagccaggtgcaaaggcagcttagctactgaggtagcgaatgttctgaggacattctagacaacagcttagttcctttttcaggctcatttgcttttgcttttttgttgaatgattccaatcgtaaataaagcttttaataattttgtgaattttttggttgttgttccctgaactactgtctatatttaaaattagatggaatccaaagatacacgggattaatagtatatttttttattcttgattaggtttgggttattgaactattttttacttttgagaccacaaccatattcaatatcataccataatgtgtcatagctataggcacaagaaaaacaacagtttgagagaatattatataagatgatgtgccctgttaaaaggaggaggcaaaatagtcaaacccagggtagtttacacttaatgctagggaggctcttaaaacattattagattttgaggaaagactctctagatatattttctaatgttcagtacaataaatataaggaagctaaaacaccaatgtggaattcctgtttccagataacatgtatattcttctatagagtgacaggatcaattgcataagcgcaaagccttaaattgctggtttagagaagacccttttttcattcagattctttgttcgtagagcagttatttgaaaaacagttatggaacacaaaacattttatagatttaatatcataacattgcaaatttttcttgtattattcacaccactggttatacttttttttttccttttttattgattgggcctgaatacaggctttctagagatctttttcattaatacttttaaatacctttcaggtagttacatcatgtttcttcattggatttgtaaaacttgaagccataaaaatattagtttggtgtgtattggggaaaatagctaaaagtctaatttttacccatttagactttgttatttccttgtataaagtgacaaatcggggctcttgtatcagtgccagctgtaatgtttttaaatgcagtggctgccttctattgtcttcctatttttgataatgcagattgttgggaaatctgtaaggaagtaactgattccaggcaaattgttttcttccttctacccaccccaacccctacccatcaccttttaagaacatagtacgccagtgtaacgtgggaaccattgagattgtatttgccctgagtattaaagctagcttagcaaaatacttttaaaaacatattggtaaatgatacccgtaaaattaaattagttatattttattttaaaatgcaaaatacattgatatttattaatcattggatttagggaaagggacagatttttggtgaacctgacttgtggcagatggtaaggaatattataaaacatttggatgagaacaatcagggcgaactgcatttttctgttacactggtaatcatttgaaaattgatttacctcagtgtttaacagttttttgttttgttttgttttttaaataataactaattgtcgagcactgatagagatgcagattttggtggggggaggtggtgggggagataatcacttcaccaactgcagtgcatttgtgtgtttttaaccctcagagaactctgcattttagggtacttgaggctgacttaactaaaagttttaaagtaaccttttttccattgtaaatatttctgtaaatactaccaattggaaattagaacagtagagtacttttctgaatccaatcctatttttattttatacagtatttctcagctgtgatctttggagcaaaagccaacggcaggaaaaaatagtttgtaccagtttcatgaagtatgtctttgggtttttgtaaataattttaactcaaataaaattgctactttcaatac

SEQ ID NO: 37666 - DNA, 105098 bp, Homo sapiens; identical to SEQ ID NO: 36980

SEQ ID NO: 37667 - DNA, 80792 bp, Homo sapiens
cagccggcggcgggctgggtgtttgcaatacaaaggcggccacgcgcggcgccgctcggtgagtagccgccgcctccagcctcccgctgtggagcaggggccgcagcctcgggttaggcggggcggggcgcggcgccggggcgctgaggacgcgtggcgaggcgggggctcggccccggggcccgaggaccgacggccgggctacgtccccggggccctctacgggaagtggttcgggggagggaggcggggaaacaggccccggaggccgggagggcctcgcgagcatccctcgggcctggctttcctgacgcgccgcgaggcccggtgtgggcccggcttggctgatctcgagcggcgtaggggccactgggggctgccgcgcagtcccagaaccgcggggactagctccagccggccagcgcgggtgcgtcctggctctgcgcgatcatccccagctttgcgccggggactgggatgagagcctttctttcccccggagttaggattccagcgctgcagttgaggaaactgaggctcagggaggttgacctctgtgcccaaggtcatacagttgccgggcggcagggcaggctgagcccaggttggaatcccggttctcatattacagctctcccctgcgaggcctctgcacctttcttgcagcctaggaggtgctaggcctagtgagctccgtcagctgctcctgcacgtaattttattatgggcaaggccaggaaaatgcaggatgagaagtaacgttttgggagtaacttaagtgctgtggagctagagtaggtaatttgtgtggtcagtagttgctggagaaagcagatgtcaaccctgtttttgatcagcaagcaggaaaccaactaagacaactggcagtattaatttggagatgttttagaacccggcagtttcccacaggatagaagtgttttgggaaatcaaagcttgtagccgtttttttaattgggggtgttgtggtatggtggtctaggggtagtgattgtgagattgactgtttatcctttgttccgtaatttgggtcttattaatgaaagtaagcagttgaggaatgtatagtatttgagaaataagcacatccacacatgaacacttttcttgctcccagattcttgttgaaaggtgtaacagttggatttatgattatatactttgatagcacttcacgtttgccagcatttgttattgagtgtttttgtgcatgggttgtgtgttttggcgcttattattcctatttgcatgtggggccctgtggtcctgtggagccaggcctggatatagccctggactcgggtcgggaggtctgggctctgcctgagctctgtgggaccctgagcgagttctttcacccacccaggtctcgcttatcagcagttcctttcttttagaaaagcacagggggacaaggggcggacctgctgagtcttgtggtgtgggagagaacgcgagggttcaggtgagagaccgcagggattcctggttgtaggggggaccttggaagtgactgagaaggagcctgccctggattaggtggggacaattggcctggcccagccagaaggaagtctgtgggtcctgctctcctgctctttgcgtggtcagctgcacaaagggcccagaacagacggcaggggagggtcaggagatgaaaagatatttcagaagaaggtcctgaggccaccgtggtctgagatgcgccgaggccggcacagagcactgggctttgcagttgttgttctgaccactcacagatgtagaacttgggcagaagacttcaatcctctgagcctcagttttcccatctgtaaaatgaagggataatcatacccattcacaggattgttgcaaaaattaattgagataaaaaagagcccctggaacataatatggggtccacgaatcattgtggttgttatgattttaaagtgccacagggtgccagcgaggaggggctctttgtggggttgggacagtcctggctgacgccggcctctgctctgtaaatcatccctgtgggacaccccctccccctgcctgccacctctcttccggttggcttttccggaccatctgtgtactgggttcaaggcctaaaaggtacctaaatgaggttaattgatttgggcaagcctgccaatgggggtagtcgaggggtacaggcagctttttccttagggtgggagggggctgttgcacggatgtcggcagcttttggagcattttgagagacatccaggtgttaggtcccgccaggacaccgaggctggtggttcgacctgtttgcacttgcacttcctcactggtagcccgggcgtgggatcttggagcttttgaggggtcctgaggaggaagtccctggaatcacccactagcagctttggggcttgttccttgagaagggcaaagtcacaattttgacactttattgaaccctggaccaatgtattgtataataagcccactcatttaaaactggaacggggtgtgtggggaaaaaagagttgggacaaaacccaagcaaagccgttcagtgacgtcacaggttcttcattcagaagaggcccaggtgcctatcggatggctgtttctgaaatgttcgctttctgagctgtgagggagggtctggagagagagaggggcccatgcctgtgtgtcgaggggacacacccacactggccctgctccttgatcagaggatgcaccagcgcctgaagggaatctgtgccccctaggaggccacactgggccctggggctgctggggtccgaagcaagtgccctgacctcccttcctgtgggttcccttcctcttcctctttccacagctttcccctgtctgtctccctacctgtaattcaccccaacaagcccttagcagctggggttggggtggggtctgtgcagccagggatatgttgagtagtgagtttctgcctgtagaaagctctgggtctgggctgacccagacccaggctgacacttttcacaatgaggtatgtggcccaggagtcttaaaacctcagcagtgtctggcccacaggctgttctgcacactgagggatgcagggcgcgttgtgccgctcccactcccagctgagaggttgggaggaaccagatggactgggctccatcaggagagaagccagaagcattttcacaccggtggtcatggctacagggtcatggttacagtggatttttcaacccactgaccaaatgttgtgattcttgcaacaacttaaaattttcggctgatgctgaatgctggggctttccagaaatagccataggctgttagaacaggcactttgctctgtaaggaggcctgtttgttcctgagtgtgagctgatttgcattggctcacaaagttgaccacagaccctgcatgggagacacaaccaacacccccatttgcctgctggcacgcacttgtgcccccctcccctccccggcctcgctccctggaagccctcgcacctctccccttgccctctgtcccctagccacacacactcactttttgatgaagtcgtcctccgcgttcatggatctcactaggctgtaggtcttcagtttacaagacaggagacaagcaacaagggttttaggataatgggcaccagacaagacaggcgcccagacaactgttctggcaaaacaatgtcccaccattggactctgtgcaatgccagaatgccaccagtctcggggtggcctctttgggctcagattttgggcaaatgagaatgtggaatgtaggcatagccttcaaatagttctgtattcattttaactagtaatattctttgcctctgtctttttgggaaggtactatttaaataggtgatatatacaaagtcccctctggcaagagacgttattcaaagaccggattttgtctggaaccagtttgtggtcacagaattagcacgtggtttttatttggtgcatgtgctttgaaaagtactttacatttactgcctcacaacagtcctatgaggtggctgtgctgatgtcatccctttttataaaatagatgcgaaactgcagtgcagagagcttagtaacctgtctttgatcacagagttagtggaaggtggaggcaggatttgaatacctccagagcctgcgctcttacctgctgagctatattgtctcctaatagtgccctggaacacccaggtgatatatgcccacctcccaattgctggggtgtggtaggggtggggggtaatacagaaataaagttataagggcagagcattctttttgaccaagacacgaatttggacagagggctcttgaaagtgcgtagagagaatgtgccattgggtctttgaaggaaaagaacgtcctgtccttaatcagtgagctaaataattaagagccaaaggatcggagtcaaagccttgggctgttttgctcagcatagttgtcataccatatttagatgtctacacccacctttatccaggccatttgtatttcttggcaggaacgtgagaacaagcgtcacctggggttgtggtatctgagggttgcaaagtgtcagcgctggaggagctgagtgatcactcatctgaccttccctccaaagcaggagtacccctgtccagcaccctgtcctgtctcagtggtttcagtgatggagaccctgagactgagtggaccagagttttccatccttcactcccagttctctgaggttactaataattgacatgaaatacatgcagacataaaaaacacaagctagaaagcaacactatgggaagtatttatgataaaaagtgaagatctcttcctccttttcccaggctggtccccaggggtgaatcttgtgaatcttgttttgtatgtatctcattccagaatttttttatgcatatcaaaatatgtacaaatgtaattttttaaaaatgggtccagctgggcgcggtggctcacgcctgtaatcccagcactttcggaggccgagatgggtggattacgaggtcaggagatcaagaccatcctggctaacatggtgaaaccccgtctctactaaaaatacaaaaaaattagccaggctggtggcaggcgcctgtagtcccagctactcgggaggctgaggcaggagattggcgtgaacctgggaggcggagcttgcagtgagccgagattgcgccactgccctccagcctgagtaacacagcgaaactccgtctcaaaacaaaacaaaacaaacaaacaaaaaaccacaatgggtccatattataagtatttttgtacctgttttcattctatatatacattttcatgttaatatttatggagctacctctctaccattttattatcagcctcataatattccattttacaatgtggatggcccataatttattaagccagagtcatacagatattaagttatttctgattttccctattacaattaatgctacagttactgtttttgtacacggatcttactgtatttgtacaatcagttcccagcggtatagttgctagggtttgccaataggtgccccaaaagatgggcattgccacattgcttaccccatttatgaccctgttagtagtgagtgacgatgtctgattctcctacttttcatgggccctggggttttaatgaaatgctttgattttggaccatctgaaaggcctctttcgattcctgtatctttaattatgaatggggttgaatatctctctcatatattattggccaaatgtgaactgtctatatgttttgtccattttttcttttgagctgttccaaggccattttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggcctccaaggccattttaaactgaccttaatcttctagaggtggctggtgttggcaaaaattgtggggttaggaaagctgtggcaggggttttgaattttggcagttccaagaaagcagcgtttcttggcaatttgtgaagcctggagatggattctgccaattttggaataaatgtggaattttctaatttaatcgtgaggcaagaaaccatgtgacctctgtcacctcatcctgacagtgtccgcagtgctgtcctttctggaactgtatgaaattgcggtcgtgaatgctttggagcgtctgctgtgtgctggagttctacagatgagcttaattatgggaacgccctcctgtccctgggcaaggagggggatgagcagggtgggggtgtgctggaggaggagacgcctgccactttgccaccctggaagctcactgcaagagctgcaaaatttcccacctgcctaacacaggcagggctttggtggcgggaccccagggctggctgtttttgctctttcatcacttttgtcaggaagtattgaaagacctttaaaaggcctctgacttgcagggcctctgacctgcaggccttttaaagcatctccagcttttctagtgagtttttgtattttggacgggaatgtctcacgaaccctggcatgccaagaaagtccccaatttcccagcaggtagtgatggatgcagagctgtgctcttctgtttaagaagctcctcaaggcactctggccaggacagtttaaccacagggacgctggtggactcagtcaatccagacctggcagagggcagcagctgcctataagtgtgtgccagttacagcagggcgtgggctgctgcccaggtggcctgactttctgtctgtgttcctttccctgtatcaccctgagtctgagccagacttcctcttttgtcacaggtaattcatcacccttatcaaccgccgttaagtatcagtccacaatgctctgaaaagacttcctctttgccgtaagtgtaaattacaggaggaagctaacactatttataaatcaatttcattttcatgcaagtcttattagtcatgataccattttgggcacttcctagaagctttttgtgtttttaaatgctttggatgaaaatcctcatttgtcttgtaaacctccaaggtggatgtgatctcggcgaacaccagtaacagcgtgatgtttgtgactttatccagtgctgggcggaccacagatagagtccccaggtgctgagacactgactgtagtgtgctcagaggagggcggctagggcagtgagcaggaagccccaaaatcgtccctgtcaagcccagctggggagccgacagtgccttccctagaggaagggtgccaggggtggtcatttagttgtcctgacatgatccgttggccccacgagcagcagccaggtctgtatctgagagctgtaatttcctgctgataacaggaacacagataaggggcaccccatcccagagtgatattaggttggcttttgaatcaccaggctccttggatgtgccttaagcccacaggtgccctttaagcacctgccgtgagggcagatgtgacagatcgtgtttgctctctgggcagtgagtgggttttgggtagcttctctccaggaaatgatgaatcactcggagctgagcaagtgccagagaagtcttcaatcacagactgaacccaggagggtgtttcggcctttctaagtccttaagggttgtagggaaggttttgaacaatggcttttgactttaccttctgagaggctctgtcagggagtggtgatgctgcgggtgagagcagttttgaaggtgtcacatccagggccaaccctgagccttgcttctgtagccacctcctatgggaggtcatgacaataataagattttgcatgtgttgtccaggagcaaagacctttccaaactagtcgttgtgttgaccactgaggatgacagcctggtgggctcagtcagagccattgtgttaataccctgctcccacacacatagctggtaaatgccagaagttaacactcacagccaggccttccgacccccaattttgtgtcatttctgcttttcagtcttacccttaggtgtcacagctgtttatttaaactgtttgcagtgaattttgtttgggagcattgtcttgtgaaatttatgctctggcagagaacaattcctgctgtcttcttcatttcttctaatttttttttttttttttgagacggagtcacccaggctggagtgcagtggcacgatctcggctcactgcaagctctgcctcccgggttcacgccattctcctgcctcagcctcccaagtagctgggactacaggcgcccgccaccatgcccggctaatcttttttgtatttttagcagagacggggtttcaccatgttagccaggatggtctcgatctcctgacctcgtgatccgcccgcctcagcctcccaaagtgctgggattacaggcatgagccaccgcgcccggccatttcttctcatttttaaattttagtgcttttccccctcgtgccccgacttgccaagctactttgagggtggtgggtgcatcttgctgttttacactctggaatgtcgtgatgggaccaaaaataaaagtttcttgcttgagatgggccctgcgatggggcaggtaccgcgtcagaaatgagcaagcctcgtccctgtcctcaaggagagaagactcacttggtagacagatgtctgttcagccacttgacaaatgacagtaatattgatcaagctactgccctggatggctgggctggagggctgaggagaaggttgaggctgaaagatagagttgtgtgggcatgtttatgaaggggtcatatacctggacagccgggggaggaaatggaggaggcaggtggaaatccagatttgaggggtaattattgttcaactcctgcaagacacttagttcttttttttttttttttgagacagagtctcgctctgtcgcccaagctggagttcagtggcgccgtctcggctcactgcaagctgcgcctcctgggttcaagcgactctcctgcctcagcctcctgagtagctgggactacaggtgcgtgccactgtgcctggcttattttttgtatttttagtagagacgtggtttcaccgtgttagccaggatgatctcggtctcctgacctcatgatctgcccgccttggcctcccaaagtgctgggatcacaggcataagccaccacgcctggccacttagttcttaaagaaaggagagtaggaagaaaagtacaagtgagaaagatgaacaaaaacggggattgtaagagtacatttattgagacagttttgcatttgcatttgctcggccagtcttatatataattagatgttgcttaccatgacatcatttcatttccaaggagcaaacccacaatgtgaaaatggacccactgttatgtcccagataacgtgccttaggtaatgttctagttgaaggaactagaaagggaattaaaatcattgttatttacttgcataataaatgagtggaacagcagattcctgaattgtccattaagaggcgtggactaaaataattcaaatccctttatttatttatttattttatatttttttgagatggagtctcactctgtcgcccaggctggagtacaatgacgtgatctcagcccattgcaacctctgcctcctgggttcaagcaattctcctgcctcagcctctcgagtagctgggattacaggcactcaccatcatgctaatttttgtatttctgtagagatggggtattttgtagagagcctgaccatgttggccaggctggtctcgaattcctgacctcaggtgatccgccctccttggcctaccaaagtgctggcattataggcgtgagtgcccggcccctatatttatttttaataatcgatgctgttcgagttgagtatgctatttattattaatgtcataggtagaattctaagtggaatacgcttgtagatttttatgttctttggtgtattatctgtttggttctaacataaaacagtttctaacccagaggtatctggaaagatggtattccagtgggatgtaataacctcagaaaatttgtattatttcagaaggtcaagctagacgatgtcacattgaaaaaacttacatgtttcttaaccttagagcttttctgaaaatccacagttagagaaacccagtcttgccaaaggatatttgtaagatttggctgagttttccatcaaaaacatttgaactaggggttgtagagtcctgtttcaagtggtaaataaaatcccgtgaggtgaagctgctatttcttgccaaattttgagattaaagtcagtaggtttgaaaggaatttggtatggggtgagtgaatagcaggcatctgaaagccgttccactggaaattgaagccttccatttggtcctctgcaggttttgtttatcgtttgtcacccttgaggtaattaagatactttcttctttaaagcagatattcccctcactgcttgatcacgtgttttagcagacagcaggaaactgacaccaaagacagtcatgagattaatgggcaggtatggggaggtgggttgattggctgggtttgtctgacttcttcaggtaaattagcttcttcctccagccttttactcgaaacataactgagagtaaaatttgggaatttatgcccagctggtttattcttgtattctttaaacatatgtgctagatttatttcaaagagagcttggaggaagggcagagaaagaagagcctggctgcctctaacctgcctgcacccctccaggcaacaggtgcctggggtgactgggcccaccccggtcccttaaagggcatggtccctcccgtgcctcctgggggagggattgccccctccaccccaagctctctttcaaagaaattgtttaaccaaatagtatcctggcttcctgaaatgagttctggttaatacaattttctctctccccaattcttaaaaaaaaaaagttaattgtgataaaatacatataacataaaatttgccattttaaccatctttaagtgtgtggttcagtggcaaaatggaaaccctgtacccattaaacacacactgactccctattttccgcttctccctagcccctggtaatcagtctttctgtttctatgagtttgtctgtctaaggtagctcatgtaagtagagtcatacagcatttgtccttttgtgactggcctatttcatttagcctactgtcctcaaggttcatctacacagtagcatgtatcagaatttcctttctttttaaggctcagtaatagtccatgatatggatggaccgcattttgcttttccattcatctgtcacactggagttgctgcctccttttggctattatgaataatgctgccacgaccatgggtgtgccaatatcttttcgagacctgctttcagtttttttttttgatatatacccgggactggaatggctggatcataagctaattttatttttatttttttgaggaattcagactattttctgaagtggctccacattttacattcccgccaacagtggacaagagttccagtttctccatatccttgccaacacttgttatattctgtctttttttttcttaaatagtagccatcttaatagatgtgaggtggtggtattcacccttttaaaaactttcagtgcttagtttaaggcaggcccagggtgtagatgttgagttcctaggaacagacaaaagactgccaggtggagcccatgaccctgtcacttgttgagaattattgagaagatttcctgctttcaaatccaggtattttcagatttgcaaagaagttattcaatagaggggacagctaaagatatcaaagcaccactaatctaagctaaagccacagctgatatcaaagcaccttctgattctttgcggtaggaaaatactccagaccaatccagtgggaaggtcacagaagaaactgtagtcttggctctgtctttgccatggggggagcttcgctaagtcacttcctgtttctgggcttacttttaaaaaatgaggttgttggaacaacaactaaggatcccttagttgagaacaagagagcagagcaacgattcagttattaaagatgcttcttcagttgctaagaactaaggagtggagcctttgtcttggaacggatagagctggaattagaccttgcaggtcactcaggccaatgcgccccctttacagaggagaggctaggatgcagagatgtggtaatgctatccagttatgagctagctagcttgctttctttcttttctttctttctttctttctttctttctttctttctttctttctttctttctttcttttctttctttctttctcattcttgggtgtttcttgcagagggggatttggcagggtcataggacaacagtggagggaaggtcagcagataaacaagtgaacaaaggtctctggttttcctaggcagaggaccctggggccttccgcagtgtttgtgtccctgggtacttgagattagggagtggtgatgactcttaacgagcctgctgccttcaagcatctgtttaacaaagcacatcttgcaccgcccttaatccatttaaccctgagtggacacagcacatgtttcatggagcaccgggttgggggtaaggtcatagatcaacagcatcccaaggcagaagaatttttcttagtacagaacaaaatggagtctcctatgtctacttctttctacacagacacagcaaccatctgatttctctatcttttccccacatttcccccttttctattcgacaaaaccgccattgtcatcatggcccgttctcaatgagctgttgggtacacctcccagacggggtggcggccgggcagaggggctcctcacttcccagaaggggcggctgggcagaggcgccccccacctccctcccggacggggcggctggccgggcgggggctgaccccccacctccctcccggacggggcggctggccgggcgggggctgccccccacctccctcccggacggggtggctgccgggcggagacgctcctcacttcccagacggggcggctgccgggcggaggggctcctcacttctcagacggggtggctgccgggcggaggggctcctcacttctcagacggggcggccgggcagagacgctcctcacctcccagacggggtcgcggccgggcagaggcgctcctcacatcccagacggggcggcggggcagaggcgctccccacatctcagacgatgggcggccgggcagagatgctcctcacttcctagacgggatggcggccgggaagaggcactcctcacttcccagactgggggcagccgggcagaggggctcctcacatcccagacgatgggcggccaggcagagatgctcctcacttcccagatggggtggcagccgggcagaggctgcaatctcggcactttgggaggccaaggcaggcggctgggaggtggaggttgtagcgagccgagatcacgtcactgcactccagcctgggcaacattgagcactgagtgaacgagactccatctgcaatcccggcacctcaggaggccgaggctggcagatcactcccgattaggagctggagaccagcccggccaacacagtgaaaccccgtctccaccaaaaaatacgaaaaccagtcaggcgtggcggcgcacgcctgcaatcgcaggcactcggcaggttgaggcaggagaatcaggcagggaggttgcagtgagccgagatggcggcagtgcagtccagcttcggctcggcatcagagggagaccgtggaaagagggacagggagacggtggggagagggagaccatggggagggggagggggaggtttctgttaatgctgcccttatgtctctcgctttctttttcttgtgagtaaaaaaataccaacagtagttcgtagatgtgctggcctggggttggggcctcactgctggggaggtggtctcatcattcggtgacaaacatagctcacgtgcaagggtgatgaaggcaaagagatgggggggacatgagaaggagcttcacagaaccgaaagagaggtcacttcaaaatccaaagacctgggttccagtttggtgaaatggggcgtgtcaatccagagagcccctcttcaccagccctgtgatcttcattgcactttggctgtcttctggttttaccatctgaaaggctgcattcctacagggttttgtgacagtcagcatgagataacgtatatgaaagaaattgtacaaagatgttattaatactgcttgcacgtagttttagagttagagggttacctctcttaccaaacacacgttaaaatctaagttcaacgtggaaggaataagaagtattagggttacaaagaatcatttcttatattgtacatcttttcaggaaccatcccactgcaccttttttgcatgaagttaaacctgcaccacttgtaaacttagaaaaatgtgtgttttgatgtttatatatatgtgatgtattagcaggacagatcaagggggagctgggctctggtgtttactcccaggtgaaaaggaaggcagatgtgtgttcctccttgagtgtgtttactaagggctgggcttgtttcctcggttgagagaggaggtgtatcagtacagagagcttcatttaaaattgtaaaatgaacctgggagggcttcttgcattctttgtaggtatcattcatgacttctggttctctggcctgttctaaattagaattaaatccgcagttcttaccagcccctgcatgcaggggatttgaccactcttgagcctcatttgcaaatgggtgtgctgatctcacttttgcttatttcataggggttgaggtaagatttacaaaaggtatattttgtttttttaacttgaaagaccaaggctttatccttggccttaagaatgtagcttataaaagaacaaacaaaccatacaatttcctctactctcatacacgcttctgacaccaaacgtgtgtgtgtctcttgcacgccaagcagttctccagctctcggagcacaccaactgggtgcctataattcaattcaattctgacaccatctacctggagttagtatcagattccacaggttaagggctcgttcccacaagctgtccctcacttcagatgccagtcacagtctgggcctcctgtgcttctgcttgactggctataaatcgggggttcccatgaccccctcctcgcgttcattcctttgtggatcggctcacggaactcagggaaacagtttactgattgtcactggtttattataaaggatgcaactccggagtagccagatggaagggtgcacagggcaaggcggtggaggcggcggtggtgcttccatgccctctctagcaccccagcctcccagcactgccacgcgttcaccaacctggaagttctctgagcccctttctttcgggttctatggaggctttattacaaaggcgagattgattaactcatcggccattgattacacttaatctccctcccctctccctccctggaggttgggggtggggtggtgggtgggtggggagtggctgaaggcaccaactctcattacagatttgttcctctggcagctgtggtccagcccccatcctccgagagtcctctgattaaactttggtgtgggtgaagagggcttatcatgaatgacagaagacactcctttcacctttattgctctggagctaaggagctatttcaggagcaggggaggaaaatgaaatatcataacaaaagacattcctatcactctgatcacttagaaattataaggggtttaggagttctggcttggatctggggatgaagaccaaaatatatatttcctattacatcataatatcacagcgccactgaatgataggaaaagctcccagaaccaacctttctacacagcaggtttgtgagccacaggttcacacacgtggtgtttcctggagtctgtaggtgacctgaggtgggggttttgtcagtgtggtcacatgtgtcctgggatagttgccttgaagaatgggagcagtgtggaccaggaggaggggtgaagtctcggggtggactggaagttacgtcatgcaaatccttcctgtttgggcagtatttgcaaccacgtggcttcacgagtccgccaaaccatcaggtgaataaacgggagaggagaagagagtctaggactcagccctggagtataagtcagagctggaaaagaagaggctccagagactggacggccactgagaggtgccacgtccctgaagggcctgaggagggttgatggcatgaccccatgaagcccagcaaggagtggagagaggagggctggaggactcccgcctgccatgacccagtccagggataagatgtgagtgccatgggccagtcacgaccgccggttagcacagcagggcacagtgacggcagaaggctgggagcggagagccgggcagagtggacagtgatgtgggcaggtgtggactgcaccaggtggtcagggatccagagctacgaaaagaagggcataacacggcggcagctcgcagtccagctgcttgaacccagaatatctcttggcctgtccctttccctctttttcgtctgtccctacctcctttccaggcggggaaggaatcgtttctctcctagtcttcctgccgtcaggtttttttcttgccagtctttacattgttacggtgatgctttttctaaatcttggatcaaagtgtcattttgttccagaatccgatggcttcacacagcagagcccgcatctcctggcacggtttcgcactctccattcttccctagtgcacattctgtgttctgggtgcagctccctcttccagtctggtggttttaagcttccatgcttctgcatggacctctcgttgtaccctgtccaccttgtcgtctgacatctgagggtgtccctgtcctccaagcccgcctccagcgccagctcctctgatgcaccttctttccttgatcataactcccttagtgtttacttaaaacaaattcggtgacactgacatatattttagtgtgtgtgtgtgtgtgtgtgtgtatatatatatatatatatttggagatagggtcttttgtccagccagagcaagatcctatcttcaaatgtgtgtgtgtgtgtgtgtgtgtgtatatatatatatatatatatatatacacacacacacacacaacgactaaaatatatgtaagtgttgctgacatgcatttatatatgtcatatatatggtcttgcgctccgtggctggagtgcagtggcacgatctcagctcactgcagcctccacctcctgggttcaagtgatcttcccacctcagcctcccaagtagctgggactacaggtatgtaccaccacgcacagctaatttttgtgtttttagtagagatgggattatgccgtgttgttcaggctgatctcgaactcctgggctcaagccatgcacctgtctcattctcccaaagtgctgggattataggcatgagctactatgccccgctagttccttgtatattacctgtgtttccttcacgagcctgtgagtctctccaggggacaggactttcttctttatctctggtgtggccccaggccctgtagaggagagatggcctgaatgtttgctaagtggattgcagttgacagctggccagcagcccagagcgctggtgttccctggagcagtggagagaagtcagacaggcaggcaaaggccacatggaaattgtcacaaacaaaaatcattcatttcccttctccagtaaaagcagtcatttgtttttcaactaatatcaagtagctactatgattggcacgatgggggatcctacgctgtatgaaatagtctctttcctctacagtcttgagatttagtgtgcaaaacctgtccatcatgacagaagaaggggcaggtggcagtggtcctaaggacaatataaaaaagcttcatgggactgcagaggagacagggcctggggacaactgagattagacatcatggggtcaaggctctctgtgctggactctgggagagtggagactggtgggcttgctgtgggagttggggtgataggccgtgatgggccatgatgggctgtgatggatcctgatgggccgtgatgggctgtgatggaccctggtgggctctgatggtccatgatgggccatggtggacactgatgggccgtaatgggccatgatggaccgtgatgggccgtaacgggccgtgatggaccctgatgggctgtgatggtccgtgatgggccatgatggacactgatgggccatgatgggccctgatggaccctgatggaccctgatgggccgtgatggaccctgatgggctgtgatgggccgtgatggaccctgatgggccatgatggacactgatgggccgtgatgggccctgatgggccctgatggaccctgatgggctatgggggtggatagaacacattccggaaatgagaggagctgaaagttgagtgtgtaatccacgtttttgaaatggtgaggagttcattttgattggctcttccttggattaattgtgtgtctgtgtgtgtttttttttgtctgttttccaggtgcagaccatgaattacgtggggcagttagccggccaggtgtttgtcaccgtgaaggagctctacaaggggctgaatcccgccacactctcagggtgcattgacatcattgtcatccgccagcccaatggaaacctccaatgctcccctttccacgtccgctttgggaagatgggggtcctgcgctcccgagagaaagtggtgagctctcagggcacggggacctggcaccggctctccttagagaatgcccttgtactctggtgatgccacctgtcttgaactctcagacccagagttttaggtcttcgttggaaatggccagtcacggaactgacagtgactaattgaaattattctagttagtatggctgtgtaaattaaagtgccgtggcacacaccactgtttattaagctcctgtatctgtgggtcaggaatttaggcagagcacagtggggtggtttgtctctgctctctggggcctcagctggaaagctcaaaggctgagggctggaatcatctgaacactcacgttctttgtgactggtggttgattctggctcttggctgggctcttcgctgaggctttggtcataccaactacccatggcctctccacgtggccagggcaccccacaacacagtggcagtggtgaggtgagcatcttgagagggaggaagacaggcagatgctggagcttatggcctagccttgcaagccacatggcgtcacgtctgctgtgctctactggttggggccatcacaagctgcctgggctcaaggggaggagaaataggcttttcttggtggtgtcaatggaagaaggataaagttcataaatttggagaggagaactaggttgctgcctgcagggtggccaattctgacaggctgggaagtgtagcctcctgccagaagcagaaacagacactttgaggaaggggcaaagagaccagggatttgtgctgtctggggtcacagaatctacatatttaataagccacaggagaggtcgtgagtgttcaggagaggaaaacatgcacacgtgcaactgagcttctgcctgtccatgggacccatgttcaaaacgtgatggcactagcaccagccaagggtggagttttctggtgtctaacatcaaagggtggagcagaggaagggaaaaccctcagggcacattctccctaggtgggccaggaccagttcctgggctcttatcaggcaaaaaacaaacacaaacaaacaaacaaacaaacaaacaaaaacgcagagcagcttcttttgttgataccagtgcacagtcttttgaaagggctggtttctgtttggcccttagggaggaaagcgtaatggtggttactgaggtggggtatgaggaagcctgtcctatctcccattccatcatggcctggaactcagttcttaaggtttctctggcatctccttgtcccagagggggtccgttcagtcagttgcgagcttagaattttatttctagtttattttcaggagtggcgaaggttctggaagagcaggtaggaccaggatattgatgtggctagttttagaagacaatctgccacacaaatggaaagaaacaaatccttgcaaatagacatttcatgcccccacctaatgtggattttgggatgatgtctcctgattggtcctttgagttaagttcaagaggaaactcttccttgagtatgtgtgaaggatcccagccaatagttgatgagttttccagggtgtaatttctaatgtctggggctggggaagctttgattgcagcttgaactctcaccagccatgtgaccctgggctggttactcctcttgtctggcctcagctcctcagccaaaaaaggaggagctagaccaggtggtctcggaggaatctttctattagcttgctgcaaaaataattgcagtttttgccattatttttaataattataataatggccaaaactgcagttatttttgcaccaacgtactgttttgggttccatctttcctggtcagggacctgccctcccgaacccagaactcctccagtcctcaagtgacagttcccttggatgggacggcctgactgagactgggagttgtgtggcacttcagggtgtatgcgatgatagcgtatctgtggagacttggccgtccccatgaggtctcctgtcctggtgaaggcagttcattcttttcttaaccatgttttcccttcaggttgacatagaaatcaatggggaatctgtggatttgcatatgaaattgggagataatggagaagcattttttgttcaagaaacagataatgatcaggtaaggaagcctgggtggtcagggttacttcctagttttgagctttgagtaatggttatctggaaacacggcagaagtttgtgcaaagtaataccggccgtggctgtgtggacgatggggcagagaaaagtgggcgttgatctgtgtgggggatttgagccagacggcctaggggtgtgctgagtccacacagactcagctctcctggctggcttcagtttgctgactgcttcccaggagacagagggatggacttcacacatgggcctggaccactgtcagaggtgtatagattacatcggtgtgtcaaatctcaaatgcccaatgttcttttatttagtgagtggctgaattactttaaaaaatattttaaaagctttattgagatatacatcacatatacacaatttacccatttcaagtgtacacgtagtggttttagtatatttacagataggtgcaactatcaccacagtcaaatttagaaccttttcatcaaccccaaaagaaacaccataccctttaggtatcgcctcccctatactccaccttccaactgctgagccctaagttaccactaaccttcctatctctatagatttccttattctgaacttttgaatggaattacagtatctggtcttttgtgcctgtttttttttgactaatgtttcaaggttcatccaggttttagtatgtatcaatattttattcctttttatggccgaatagtattccattgtatctatagaccatgtccattcatctgttctattcatcattacaaacaacttggggctgggcatggtggctcacgcctgtaatcccagcactttgggaggtcgaggtgggcggatcacgaggtcaggagatagagaccatcctggctaagacggtgaaaccccatccctactaaaaatacaaaaaattagctgggcgtggtggcgggtgcctgtagtcccagctactccggagactgaggcaggagaatggcgtgaacccgggaggcggagcttgcagtgagccgagatcgcgccactgcactccagcctgggtgtcagagcgaggctctgtctcaaaaaacaaaaaaaaagaaaccaaaaaaacccaaaaaaaaccaacttgggttgtttccaccttgtagccgttgtaaacaacatggctgtgaacatttgtatacaagtttttgtgtggacacgtgtgtttgatttttcttggttacatacctaggaatggcattgctgggccatgtggtaactttacatttaacatttgaggaactgccagactgtgttacaaagcagctgttccattttatattcctgccagcagtgcacaaagagttgtgatttgtctacatctttgccaatacttttctgattttgtgattctagtcattctagtgggtgtgaagtggtatctctttatggttatgatttgcattttcctaataaccagcggtatctgacatctttttatgtgcttattggccatttctgaatctttggagaaatgtctattcagatcctttgctagtttgtgtgtgtgtgtgtatgtgtgtgttgtttttcttttttactgctgccttgtatgccttcattatatattctagatacaagtcccttatcgggtatatgatttgtaaatattttctcccattgggtgggttctcttttcactttcttgatggtgttctttgcagcacaatagtttttagttttaatgaagtctaatttttttttttaaagtttgtgtttacctttttaatgtattctgttttttcttttgttgtgcatgcttttggtgtcatatgcataaagagtcctttgccaaatccaaggtcatgatttatggttatgttttctactaagacagaccacttccttaactcttttgttcacagatgaagcaccttaaaggggtctgatgtagggattcctgaatgaaatcgacttgaactagttcctttccaggaagacagctatgattaaaaaggaacggttctttatagctccaggttttaaagcaagtgtccataattgcagcttcgggacagaacagtcccaggcacagcctccatcctgcccgcccagaatggtggtgcctggggaggacccagcatctccccttccatgttctggagcaaccctgttgatactggggatccctgcatacctgctcttcacttctcttagatgggaagactccaaaaatactaattggttcctaatggcctttgacagaaactctttgcactgcatgtggacacctgcatttttaatttctatttgtacctggctttagatagatttttggccatcggagctgaggaagcattttgggccagcgtgcagcgggacctgtatgggggctgcttgctggtcttgctggcctgacagggtgcctgtgggtggggtggggccttggaggccagagtatgttcagctccatacagatgcctcttaggacccctgggatgctgctggaagctggagagcccgtgtccttcagcactgcttggtactgcatgtgcctgtgggggtctgcctggctgcccattcccttccagcccacggacagcaaagggcccttctctgctcttgatctgagaatctgtgctgcttctctagttgctccagtccagcagccgggtgagatgacctctcactcccttccagcctcagctgtgtgtctcaggtgtagacattctatttcagcatgtctgatgctctccaaacctatttgaatgatcagcagcacacgtttatttatcccctctgttttatgtatattcttattgtcaacgagtttctcatacaaaatgaggcattcattaataaaatgattactagagttttataaaaactgctgaatcattacaaacaactactaaatggacaggttgtgttttttccttttgtctttaaggagaggatcagtatctacttcctcgatgttcagggccctccttgggccctggtgcaggcaggttcttgggcggggctatcggttgttttacgtgtttttggtttttagatggttattatcttaattcattgcatataaaaaatacacaatacacattctctgtctttctctcacacccacccatgcacacccacatctacacagaagtgcaagagtgcatccaattcccagcataatatggtgagtcaaagcccatttttttcctctgtgctctgggtattacagccaaagttgaattttgggggcttgagatcactgagaattacctcccattgttaaaattacataaatgcaggattgagtacaaagtggcattcaatacattgttggctttctgatcttctaccagattgggcagccacatctccaggtcaccatggctgtggcctctagctgggccatctgctgtggccctccccaggaggtgcttggcctctgaagtgaatcctggaggcctctggcaaggccctgcttcttatacctgaattaacgaggctctttttagaaaatgtgttcttttcttaggaagttatccctatgcacctggccacctcccccatcctgtcagaaggagcttcgagaatggaatgccagctgaaaaggggctctgtggacaggatgagaggcctggaccccagcacgccagcccaagtgatcgctcccagcgagacgccgtcaagcagctctgtagtaaagaagagaagaaaaaggaggagaaagtcacagctggacagcctgaagagagatgacaacatgaacacatctgaggatgaggacatgttccccatcgagatgagctcggatgaggccatggagctgctggagagcagcaggtaataactgtccagggtggaggggctgtgccagaatcagacagttaactgttcaagattatttttatgaacttttcccccataattccttattcttttatgtgttttagaccagtggtccccaacctttttggcactagggaccagttttgtggaagacagtgtttccatggaccaggggtggatggttttaggaggactcaagcatattacatttattgtgctctttatttccattactattacattgtaatatataatgaaatacttatacaactcgccatcatgtagaatcagtgggagccctgagcttgttttcctgcaactagacggtcccatcttgggggtgatgggtgacagatcatcaggcattagattctcacaaggagtgcgcagcccagatccctcacatgtgcagttcacaacagggttcgtgctcctgtgagaatctgatgctgccactcatctggcaggaggaggagcttaggtggtaatgtgagggatggggagcgactgcaaacacagatgaagctttgccagcttgcccgccgctcacctcctgccatgtggcccagtttctaacaggggcatggaccccaggggttggggacccctattttaggctgaattttggaatcatgtggacccaatcctagagtggtataaagatttgctgtgctgtagccaagagacagttggtgatgccaaacctccttggctgatcgctttagcagcctggaatggagtcaagaaacaggaactgagcaaattaatagttcatgaccaaacccattttcttggaacctatttattcttatttgagcaccaacgatgcacaactgggctgatttataggcaagggctgatttcaggcttaaaagtgaatgaagaaaatgctgttttctctataagccaactttttcctttttaattttgacttaggtccaaagtttaatggaaattttgtttcctttttctttgcttttaacagtgtggtgaaattctgtttgtatgtattactattttggtgaaaaatgccagttttaaaagataaaattcattttgaaggatatttgatgtttcagatttttacataattcggtataatttttgataattttgttaacataaagaagggataaggggaatcaggagtatcttcctgtgtcattatttggaataaaatatatcttttttcgtggtgaaaaataaatgtcaactggcaacgaatattgcttttcccaactacagcctctatctaacctgtgacaggcttagaaccagcgtcattgggcttcttataattgccttctctgcatggctgttaagtacaaaatttagtggtaggtgttccaggtaacatcaacatatagacagatggcctctgcatgattgaaattgtgaattgtatttagtagtgagtgtgcttatacctgaaacgaggtcatttgcagttattctgtaatcgtaaggcatgtttggttgatgccatttatttcttctgctagacaaaatgtgatcagcgtatggtcattgagttattcagcagttctgcctgtacctggcaggggttttataccgccctggggccggtttggggccactctacctcccaggcttttggaacatgaccgtgtagggtagcaggaggtggcacgatgggaggatccagcagtgtgatcactgcatgtgtgtctgagtccaaatgctgaaacaaaatcattttacaattagaattcggccaaagcattagcacatagacacgtttatggatgccggtatctcactttttccccctccactgcctggaacagatctgggtgtttaaagagatcatgttaattacaaagcacttagagctaatcaagaaaaaattggaacttgattatgaatctatcattaagaattctttgactttaatctttttttttttcctccagaactcttcctaatgatatacctccattccaagatgatattcctgaggaaaacctctccctggctgtgatttaccctcagtcagcctcataccctaattcggatagagagtggtcacccactcccaggtaagctgttccctgttcccctggcccagtgcagaggcttagaagtcagtgataggaagcaattctaagaaaagaatgaaatagaaatgaaaagtgaaaataattaggaccaggaaaaacacggtgtagagtcggaggtacagattaggatcaaacacagaacatgttcagatcatacacttatatctggtgtcagaatccatctgcagatatggctgttagctccctggaggtgaacttgaaaggaaaaacatgtaaattacatcatgctaattgttaataggagaaaacacagtggcagagcctttcttgatacttagccctaagtaaaattcaaaaacagacgttgcttcaggagctgctgaggtcgttcagggctattagaatggtgcctccgccacacttaatccattctgccgaattcaagaatatttatttccctgaaatgaactcacaagttgccctagaggaaaacttggagaactagagctgctcactgtgcagatgccatcctgatgaccccagagatgtttacatcagtgaaacctctgggaatagtgagccccctggctagttttcaaaggacttggggaagagggtagagctaaatcctgtgttctcaacacaggaaataatataacccccattgggatgaaaattcattcttgggtggtgacaaaatcttagacgttataatggtttgtggtctctaaggggccacagcattaaaatctcatggtgggtggagttgggctattaatttctcagaatgctcaggggcatgttgataatgaaaaagagactgagaaacgctgatctaaatgccagtgacatccttgggttattcgtatacctcatgctttagattcgcttctggttcatggtgccagcccttagaaactctgggttcctacctgaagccggtcttatcaaaacgccacccctggttccagtttgatcagggtaaccttgtgaattagcaagcagcagtccccagtgtgtgctgacatggaggttggagagaaaatagatatgtcccatgcctggtttccagccaatactgatgtcgcgggttagtccagcaggctgaggctgaggcctgtgacaaagtccctgcatggaggtcttcctgcgtcagagcctagccctgttcaatagaaacgtaataactagctccatatgtaattttaagatttccagtagccctatttttaaaaagtaaaaaaaaaaaaaaaagatgaaattaattttaaagctatatttcatttgaccacagtatttccaaaatatcatttcaacaagcaatcaattttaaagaattattaatgagatacatcacatttctgtttacataccaagtctttataaactccattatgtatttcacatgcgcagaacatcccaatttggacaagccacgtttcaagtgctcaggagccacctgtagctggtggtttattatattggacagtgcagatataagacctttctagattctcattctttctctaggtctgtggagataaaatagtggagggaaaaatagtggtttaggaggaaaataatgtagaatatttagaacccaataatagatgaaaaaatctgttcaagcactgtatgttaattttaaggatttaaaagaaacactttaaacacaactctgagcgtgtttaatgctcaaaacatctgtaatgttttgcctcatgaatgcagcataatgactgagtcaggttatgtagctctgactatcaccaaatggaatgacaaattaggataaatagctacatttccacatttggaattaggtattttctgtaaagagacaattgacagcacacacgagcacatttttggattatgtagtttgattaagcacgaaagtgtgaccagagatgatcagttctacacatgggtgaaacagaaagtgaaataggtcatttggcagtttcctgcttttgtgtctcagaaaattcatgctgatttcttagcaatttcaatatccggtgctctgccattatcagatgtctgagtttctttattttcttaaaaatgtcgttgttgagagtagtcaaatactttacgtaatatatataatctttatataaagtatatatactttgtaattatatataatcttatatataatctttatataaagtatattatatatactttatataatcttatatatagtctttaaagtatattatatatactttatataatcttatatataatctttatataaagtatattacatatactttatataatctcacttgatgtaattgacctctgattttgtctttcttttaatgtgtatcacgtggtggtatccagtagcctggtagattgcaaaaggactgcccctcatcttgcagttgcggccgagggaggtctgtctagttcttgccctccacagtcttccctgttccatccttcggaaaggtagaggagttattttccccattgggatatattcaataatgaaaaatttgatctaactcttactataagtctattttaccattaaccaaattacttatgaagaaaatacctgtagattatatgaagtgaaaattttgatttaacttttacaaatcgatttcactaaccaaattacttatgaaaaatatgtatatagattactcttttcctttcgttataagcatttgtagatgatcagatttttttttttttttaattcctaaatttgactctctggaaattatggttaagcatataattttacctaattctgtgaagtgctttgaaaatgagaataatgaaatatagcttgggaatatgatcttctgttttctgtctcgggttgtttgacaaataagtttacaagatatttttggaataccactttaatttattataaacatttaagtagtttattgggctgtctgaataatggagtcagacactttccacagcatttctagaacagaatcttggagaatggcctgggctgggtctcaggctgaggatcaaaggttggtgtgttcactcgatgtagtcatctcagatttctgccttcattccctcagttttgacctacctactttgtggacttacatggtttactttgtaagccttagcaaatgaagctacgattaatttgtacgtggaaaaccttttgtctttttgattaaagatccagacctcaggatgtacttcattcagaggctacatttgcagaagaaaagtccgtttaaaatgaggaaaacaaagttgttaatagttaaaactaactagccttattgggactggcaaaaatactgaaaactttgataaggctaataaataccttgtttatgaacatcagtcattgaccttgtaagcttacttttttgaacaacccttgatcttaaaataataatatttcatgacggagcactttggagtcatctttctggtaaatcccacttggcagtgggccccattcctgcgtcctttttggtctgtctgaattccctcagtgacggtcggcagaaagcgcatctgtgtttgtgcacgagacctttggagaagggttgctgtggcctgaacgggcagcatttatggtggtggcctgtttgctgttggggagggacttgcagcagactttctcgtagggctgggctccttatgcgtgagttgcacgcctgagtgcctctatgggttttgtggctcgtggcttttatgaagggaccagaatgttaggaactctggagttgggaattgctgcaggagaaccgtgttccgcatttcgttcttctagagcagaggttggtaaagcacggcccatgggtcaaatctggtccaccatctgcctctgtcagactttcccgggcataggcagttggtttacatactggctgtggctgctttcacaccaccacagcagcgagtggttgcgacagacgtcgtaaaacccgtaaagcccgagatatctgccactgggctctttacagaaaatgtttgccgacccctgttcggagcaagctttgtctaaaggactttatttcatttagtgacagtgagataatttattgctgcaaagaacttatagccaaatatgttctattttgtctggtgaaacagaatggcaagagctttttagatactttgaggtttgggaacagcaccgttgagggtgagaagttggttttgatggacttattccatgatgatgctggagaaagagtggattgcggtcacacttgtaggtactgaggcccctcgctggaggccacagcctgcgcttttcccattgcagtgataccgaacacgtgactgtagacgcttcagtgccaccaaagcgttgtctctttggagaagtccagttgtggaactggaagagcaaggaggttgaaaggccaggagcctttcccacatggacgtgggggggcccacgtgccttcttataggactgctccctaaagggcagaaatgtgtgtctgttgggagcagggtgtcccattgcagaagctctcctaatgtgatgtcaggagcctcctctccccaggcaggcgaaagagagcgtgcaggctgccccgtggcagcacgtcattagaagggctgggagtcatgggcaccaagggagcagggaccaccctctgccccttggtgtgagatgagagagatggcacttggtctggctgctctatgcagcttgatcaaagagattcaggatcagtttagcccacaaggtccctgtttgttggatacaagttatgtatcatcatgaactcaccttgtattgacaggaaagttatattcaattggagttgaactctaggtaaatgagaccagaagcatcagtttccgaagaatagataaggtctgggaaagaagacggcaagggaaactgaaagctttatttcctgctttgtctgaaaaaccctgccgccttcctctagaggaaatgatgtgggaaaataagcaataattaaccatgttattatgcggcaataaataattacaagaattgctgctgtaaataatatttctctaagttgtttagaatatggtgaggatcttgtggataagttaatgacttttggatggttactttggctgggcagaagtaagaccttgtttgggtcttcagagtaaaaattcaggaaacatggaggtggttactgagcgagccttaaccagttggtgagtcccttgtgaagtattcctggaagacataagatcttagaaaatttcaacttgtaggctcctgcccaacgttatcgagtttatttgtggcatccagcatctttggtaaaattggcacatcatataatttccctgtttcccaggccagtgcagatgataaatatttaaaatatggactctaatgagtgcctgcccgagccaaccaagacccttttgcagccctctgacagcagaggaacttgatttggaaacagattgcaggagatgcgagtgcagagtggggtggggaagggtggtctttttgaggtaagaacagactatttttccctttctctttccatctctttcttttgtattctgggccacttctttttctcctctcccccgcggtgcaccaggcggcagggtggggcgggcgacccacgtggagcgccttccatgggaggcgcttccctgccccctggtggccggaggagggatttgtcatgaggctccgctcagagcgaacgacagctgggggtgcattttctgggctatttgagccatggagctgggcccaaaacatttacaaaagtttcttttcccaccttaattttcgctttgtgttttccttaagtccttccggttcccgaccttcaacacctaaaagtgattcagaattggtcagcaagtccacggaaaggacagggcagaagaacccagaaatgctttggctgtggggagagctgccgcaggctgctaaggtgagagtctcttcaattctgccacggaccgaagatttctaactcagcttaaattacatggaattagtatcatagcatagccaagaaacacagctaccaggagccagaggtaaaccaaaatatattaagggttagccttgaatgttggaattactttcttccacgttaccaacattatagagaggtctcattgcttttgtagattttaaacctatgggattcctcttaggatttacttttttttttttttcttgagacagagtctcactctgtcacccgggctggagggcaatggctctatcttggctcactgcaacctctgcctcccaggttcaagcgattctcctgcttcagcctcccgagtagctgggattacaggcgcatgccaccacgccccactaatttttgtatttttagtagagacggggtttcaccgtgttggccaggctggtcttgaactgctgacctcaagtgacccgcctgcctctgcctcccaaagtgctgggattataagcgtgagctgccgtgcccagccaggatctacattttctatcacagctaaatgcaaattaaattaaagaaatacaacttacacacaatcttgctgtcttgaaactgtaaacaaaaatagcttccagctcttgagtctgctaggtcattgatgagtggagcaaagccacagggagagagttgtggactcttggcccattgaaaaagaagctgagttgtaagagctggaatccacatgttcttgtgtccctcacacagagagacatctgggagagccctgggagagggaaaggctaatagaacagaaatgaaagatttcagcctaatagataaacaaagtcagaaaaccttaaggttttgattcatcaagtagtaagtatttctgggccctcattgttggtgggaccctgaatttgaccctatggagatctccaaaataaatagagaagcagctgagggtagcggagagaatgagggcctgggaggcagcaggttattctgggtttgagtcctcactgcaccgcttgctaaaaaggtgaccttgggcaaatgagtagacttccctgaacctcagtgtcttcatctgtaaaactgtgagaaaatgacagaattgttgtgaggttagaagggctaatgtaggtatgtgaagtatctggcacctgtaggccctctgaatatttgcattctttctccttggctgtggtacatgcacgctgagccccagtttccctatcttggatatgcagtgggtttacatgtaggtacataactggttcagcaaatatgtttctaaaaacatgaaatgaacacaatcttttctttcaagaaattttatttggtatgctaatgtattataagcatcttgaattatgttattatatcacaagctttaaaaaatattgtaaggtccttagaagatgctatagcctcttgcatccccaataaatgtttgtaatatgaatgaatgagtgagtgagtgagtgaatgactattgaaaacatcccttataaagagtcaagatgggcagctttttggagagtagtctgttgaggccaaagttgtggatccatttcctctctaggttatatttagatttcatagaaaatgctgatttacctgtccacagctatggtgctgacccagccaactctctttgcaagtttatgtcgttagttgctggagaaacagcatggaagtgcaaatccatcacttcttctggcaaaatagttgtaaccacagattttctgtagcattgtttttatttgcaattgaagctgtttgatcagatagagaagtgaatactttctcccctctttttagcccatgaattgcattttggtttttgtttgaataaatcttttctgtaactggaaatccctctggcggtagaatcagaaatgctaatttctcactcatgtgaaccaactgtcaccaaatctttacttattcactcatgttttgggaataaactttattgaaatatacatacagagaaatacacacattgtaaatgtatagctcaatacattttcacagcaggaacagatctgtgcagcgtgcacccagaccgagaagcagagcatgaccagcagcatggaaacccccactctttgcggtcactgctcagactgacccctctgctccctgcaaggggaaacttgatcttagcaacagagattagttttgcaagattcattcatgttgttggtgtagctgtaattcatttattctcatggccactgagaatcccagtgtgtgtgaaaagacttgtaatctaacagcatttagggtgctcctgcctgttggcattgctaatctcacttctctttggcagttgatgtttcacaggaaagttcatttgctttggacctaatattcttggtttctggactttttggcaggtatagaaatcaccaggtgattgttgaggcttaaaagtccctgcctacttttgattacttgttctccttgggtcactcagtttttctggttgcctttgtgctgaccttgtctctctctctgtccctctctcctctttgctctagtcttcttctccacacaagatgaaagagtccagcccattgagcagtagaaaaatttgtgataaaagtcactttcaggccattcacagcgaatcttcagacacttttagtgaccaatcgccaactctggtcggtggggcacttttggaccagaacaagcctcagacagaaatgcagtttgtgaatgaagaagacctggagaccttaggagcagcagcgccactcttgcccatgatcgaggagctcaaacccccctctgccagtgtagtccagacagcaaacaagacggattctccttccaggaaaagaggtaccaaggctggggcttcccggctctttttctgttcatagtttgtgctcactctacacatgacaggtcctttccaaagttccaaggaaactgaggtagaaactgaaccgtgacaatgatcatgttcagtctgagctcttcagcagaatatattaattatcggaatttagtcataggaaatcagacatgaagaaggccttgaggatcatgtagcaaacttcattttacacactgaggctgctcgctgagacctgggagagttaagtcctttccagcacaccatgggacccataagtgtgacttttataaagctgattattaggttaatcctggccacctctctccttgccctgcgttgctttccagccccttacccactgtaatttctgcatatcatttatcatgatttcaaatgatcattattttattgatttatttttgcctgactcccccatagaatatgtgctgtctgagatcaagagtcttttctatctaacttgcctttctctcctcggcgcttggcatagtggttggcacacagtgggcgctctgtgttggtttaatgcactcctggctgtgtgttagtatcaacgatgccaggcctgatctccatccacccagcagcttcgtgtggttttctagaattatatggaccaattacatcattttctgctagaagtaaagaggacatttgaagtcatcatggccagtgtctgacaatgcacagtgtgggatgctttgcctcggggtattgatggggaagtgcctaataaaagcttttatcatttcataataagtgtaataataatggtaatagcctcaatgcgtttagtgctcagtacacttcaggcactttacagaggaggaatgaggctcagcaagttaactaacttgatccaggccacacgatggtggatgacggccctggtttgtggaccttggtggtctacggtcacgttgtactgcccaccattttccaatgggaaaagcgcaggctgtggcctccagcgaggggcctcggtacctacaagtgtgacctcaatccactctttctccagcaacatcatggaataagtccatcaaaaccacctcaccctcaacggtactgtgcccaaacctcaaagtatttgtctaaaaagctcttgccattctgttttaccagacaaaatagaacacacttggaactgttgtggttcttgggcagtttgagtacctgggagcaaatctgcacatagtgtttaaatgctgtttctatagatacaaggccatgagctcatttctagaagagtggttttctgacttgagccatttgccgttttagataaacgaagccgacatcttggtgctgacggcgtctacttggatgacctcacagacatggatcctgaagtggcggccctgtattttcccaaaaagtaaaattcctgttaattcctcacatcatttcctataatctgaatatcattctgtgtgagaccagtttccccttatgtttgattagaaagtgtgcaagacagctgggcgcggtggctcacgcctgtaatcccagcactttgggaggctgaggtgggcggatcacttgaggtcaggagttcaagaccaccctggccaacatggtgaatcctcgttctactgaaaataccaaaattggctgcacgtgctggcatgcacctgtaatcccagctactcgggaggctgaggcaggagaattgcttgaatccaggaggcggaggttgcattgagctgagatcatgccactgcacaccagcctgggccacagagtgagactccatctcaaaaaaaaaaaaaaaaaaaaagtgtgagagagaggcagtgggaggctcccattgccttgtgaaatgcgcctgctctatggacataagggtgcgggtactgggcggcgccccacctctggacaggggcgcagcaccgggctgccctccctgcaaagcctgaggtcatgttgtccacagtggtcgtggtccacagcccagtaagtggcagctgtgcagcccttttttcccccaggagggtctcccgtgatcctggggacccaccctcagtccccctgcgatctagggcagggctggcgcctggaggggaagggcagggaacagggaggacagcttgcttcttcttcagtatattttagggggatacagggagatgcagccagctgagaagtaatggttttctctcctaagctaaggcgtttaatgtctctttccttgtcgtggtgctttaataaacatctgtgctgagatgcagccgtctgcggctctgagggtggccgcgtgccagagcatcactggatggtgatgtaggaccctgaactgggacagtcctcagccggtctctgccgcttttcctccttccagcggagatccttccggactcgcaaaacatgcaagcgacaacggagcccggtcagccaaccagtccccgcagtcggtgggcagctcgggcgtggacagtggcgtggagagcacctcggacgggctgagggacctcccttccatcgccatctccctctgcgggggcctcagcgaccaccgggagatcacgaaaggtaccgcgggcctcgcgcgggcgccctctggtggccgccggtcagaaggcgcagaggcttaggcttctccaaggagtgcgtgtcaaggcagcttttcccttggttgcggttaatgatagcacagatgatagcaccgaactcataatcccgatgtttctggcttgcagttagtcggcctcagagttctgtgggtcacccatggctcgggccatcgttgtgtgtctcctgtgccccaggctagcactgcagagatggcctccagaggcctgcaggctagagggggtgtcagtctaattaaattagagggtgtcggcagcgagagagaagtgcgccggcgccttggaacagggaggtctgagtttgtcggaggagggctgggaacttttcccagctggattcaaagggcgttaatcgggtgggcttaggtgattcattcacagcacctgccacattcgtagcaatgcactcccagggcctcctgacagttccatggcagggtgtgcccacgccccccagtgggtgcagtcagcagttatcagctggggactagacacagtggccctgcacccctcccgccccctctctcaccactgcctcttttccatcccctcgtggtatttctagcagggaaggggccgaggctgtgtacttcttccctctacctctcaggagccacccccatctccccttccaaccagggctgccatgtgagactcctgcctccaccctggtcccttcaaggctttgggaattttttcttccgcaaagattgagacctttttgttctcacgcccgtgccagccagtcccttgagagcggaaacaagattgtgtgctgggtcccgccggctccattcattcactcagttttcctagggccacacattaatacccagcctcactgtgtttctgaagtcatgggggctctctggacactggcgtgaggagtcccctgggcgttccctccctgatatacatgagctggtgggggtggggtggcagcactgacaaggctgggcaccgttatctgagtgttatctcatggggccaggatctgcagctgtccagtccttacaggtgaggccagatcgtcacagtcaggagaccccaggagagtccccggaggtcctgattagggctctgagggtgcatgttgaagccagtcaggctggcatcaagacccagggactcttttcctggacggaggagattctcagtgtctgatgtctgctgggtttcggttcggttcagggtaaataggagctcccagggaaggagtgggcgtggctctgggccagggagatggtcagaaccgcggtcaaggcttaaggtacagcccagctgccagagcccgtcaaagaactgagggtccggggctgaggtctgggcctcctgaccctgccaccttctcctttgctctgatcctggtggggctgccccaccatgatgagaacagtgccctgcctgcttctgattgtggtggaggcagccccatttttgaaagggccctgtgctttctatttacgacattatcagtccccatgaccaccctaggaagcagatgtggttattatccccatgctagaggagggaactggggcctgggaggtgaaccgcttgcccagggttacccccgtaatcgtgacttcagccgagggagcctggcttctgcgccatgcgtagccatgactctgcctgtgcagatgcacgtgtgtgctgttttcacccctactccctgtgtgaacgtatgtgcctcaactaaggtacacgtcccccaacatcctcagccttgccctggcctccctgcattgctgcacagacgccgccttccaggtaaaatggtgcggcctttacaaatacattttataggattgtctgcacagttggaatgcacaaactctcagaaaacacttgtgagtgagcaaatgaaaggtaggcctaattttgaactgaattttctttttgtttttccctgatcctctgcaattgctgtcacagatgcattcctggagcaagctgtgtcatatcaacagtttgtggacaaccccgctattatcgatgaccccaatctcgtggtaaagattgggagtaagtaagtacctcttgaaagtcactttggcagtagcatgatactgtttctgtttcatgttttcaaatagacctagacattaagccttagaaatatataaaataaagactttgctacattgcattattgcattatcttcactgtggtcagggttccatgccaatagaattggcaatatagctgataggttcagatagctctcagtcttgtgagttttcttttcttttctttttcttttttttttttttttttttgcgacaaggtgtagctctgtctcccaggctggagtgcagtggtgcagttgtagctcactgtagccttgaacttgtgggcttaagagatcttcccacctccgcctcgcaaagtgctgggatttcaggtgtgagccactacacccagctcgatgttcttattgaatgtgaatagtcacactctgcagtacatgggtatgtcagagtagcctacatctctacccttttgaaaaacttcattatcggctgggcgcagtggctggcgcctgtaaactcagcactttgggaggccaaggcaggcggatcatgaggtcaggagatcgagaccatcctggctaacacggtgaaaccccgtctctactaaagatacaaaaaattagctgggcgcggtggcgggcgcctgtagttccagctactcgggaggatgaggcaggagaatggcgtgaacctgggagtcggaagttgcagtgagccaagatagcgccactgcagtctggcctgggtgaaagagcaagactctgtctcaaaaaaaaaaaaaaagaaaagaaaaacttcattatctgagggcaagggatgtacaggtatttttgcagactgttagcaagcttttctcccttaagccatggatgttttacacctagttgcctttaccttgacacgtggcaagaaataccccaagcacgtcgtggtttggtgcagcagctgtacggtgggatttgggctgctggcatgtccaactgtctgccctgctggcacggctgctgctgggccctcaactggccgctggggtgaggtggggggagcctctgcctaggggtgatatggaggagggctgggggctagcaagagtattgagctctttaagggcctcgctggagtcccgagctttccttgactactttatatgacattggaaaggttttcagtctgagcctcggttttttgacatatatttcattgttttgtgttagatattataactggacaacagcagcacccctcctcctggcaatgcaggccttccagaaacctttgccaaaggtgagctttaacatgagaaagaaaaggggatgctagaaatgatgggtagcttaatctggggtggttggaatttcacttttattttggaaactacagagttaattccactgtgctcttttgaagttcatgagcatacaggccaggagtttctgatctctctcttgcaccttgcacgtggttgcccctcttccttatcaaggcaaaacctcccaatcatggtcgagcggaccgaagattcctttctcaatatctgccatgcaaggggtacaggtggaggctgagcagacaggtgccaggacctcagagcccagtgaggacaaagggagatgattgtcaccctggaaaggtggagcaggcatcagggtcaggtgcaggtgccctgtgtcaagtgtcaagtgtcagtgtcaagtgctgctcagccaggaagccagccccatgcctgagtctctgaggccagagccagtacagggcctggacagctcccagtctgcaggggagagtaggtaagtggccgtagggaggagttaggagggcagccacgccacctgccagtctgcagtgttctcatcctaccccaaacaattcactagacagtcagcctggagttgttaattttttcaatgatagatcttcctgctagattatacgttctttgctgcagagactgccttaggcttgtttgtatcctttgtgcgcttagcaagcttttgtatggcttaggatgttgccgtcggtcagccagttcaaacacttgagattcttgaaggtctaattggactttgttgagtctaggcttgctgcttcctgggtttgtgtgtgtgtgtgtgtgtgcctgtgcctgtgtgtcagtgtgtgctcatgtgcatgtgtgcatacgtgcatgtgtatgcatttgcatgcgtgtgtgtgcgcatgtatgtgtgtgcatgcgggtatgtgtgcatgcttgtgcaggtgtgtgccttatgtgtgtgcgtgtgtgtatgtgcatgtgtatatgtgtggatgtgcacgtgtgtgcatgtgtggatgtgcacgtgtgtgcgcgtgtgcatgtatgtgtggatgtgcacatgtgtgcgtgcatgtgtggatgtggatgtgcacgtgtgtgtgtgcgtgtgtgtgtgtgcatgtgttgtgttttgaggaccgcagtctcatcctgggtggtgctttatctgattatctttgtggactgggctgagggcatgttctccagagtggtttttattttgtccctgccatggtatccatggcctgggacacatttttatgtcaccgttctcaacacttacaaatccgtaagaaaaaaggccattgcaatagcaatatagctaaaggatttatttattcactgaagaagaaatccacatgggctctgaaacttaaaagacattagtccttgtgatatgcatgctaaatctttctacaagtcagtaacttttgactatatatggcatttctctaatatagaaattatttttaaatgtagaatttgcccatcttatcttttatggctgttgggttttgtatcacacataaaatggccctgcttccccatttccaaaacttgtgaagataggccctatattttctttttgtgctttcttgtatatggggcatatttttacaagttttggaaatttcgaaagatcttaaaatctttcatccatctagattttgtttcaagtgtaatgagaggtattaggaagcaaaccagtttttttctcaggaagttattgaattggtgaagatgatttttgttttaggaaacagaatgactaaaagtggcttaagtaatgatctcatatgatgaggatcttagaggttggcagtttcaggcttgatgaatttgggttagcttctttgtgattttctcagcttttccttgatggtcacaaggtgactgccgtacacatcgtctgctcagactgccgcatctgaaacgggagggtaggggcagctctctcatagttcaagacttggtcacatgatcaccactaaagcacttcttggcaaagcaatgaaatgactgtgaacggcttcgaccattgaggtgcatcctctggagttgagccagtcttctccgcatgcattgcagcctgattcttgaacagagtttcagatctgtcagcaagaaaggggaggcagatgagctgctcacagggtctgacatggctactgaattatcccaggaccgtgtattaactaaccctatcctccactcagaggcagttacaacttcaccctctgttacgtgtctctgtgaatttagatttatttctggacttcgttttctgttcctgtgatatgtgtccttgtataccaacactgcattcttttagttaccatatattttggtatattttaatacccagtagtgcttgttctacttactactcttctgcctgagaattttctgggctatttttgtttgtttttcaaatgaacattagaatcagtttgtgaaggactgaaaatactcctgtttgtttttttcctttctttggcctgctttctttttttaaaaaaaatgtggttttgttacatttatgagtggatttaggggaaatagggtcattcacagctttgtcaattgtcctatttatgagctggatgtgagtggtttgcattttagtgcagttgggttttcttttgtgtcagatagggatcttttaagctacatagtaaattacttatctgtctgcttcccttagactgaatctttcagcttaaatctttcttttgttactagctgaggtgtcagcttcttgaaagttctgtaaactgaggaagggacattacctaacttttaccttggtcctggaattaacctcaagatagataggtattttgttctttggaaaaacgtagaaaattatcaattcatatttaatctccccattaaacccatttacctaaaagtatgaattttctttttaatactcgagattttaaatcaaatgtacctattaatgcaaatgtttagaaatttacccttagtaaaaatcttatgcattttaccttttgttgaaaactgttttatcctctatcccatattaatcatttcatattttatttgataatcatcatattgagagtaatgatatcttaaccagttagccactttaatttgaaaacttccagtcttactaatcactaatgatttctaatgctttctttttttgttgttgttgttgtgttgtattttatttgttgtttgtttattcctttaacatcttcttaagtcttcatgcttaagttaccttcatgtaattttggacgccattaggttttgcttctctaaaatttttaacgcacaaatagtatgttgtgttttctctgatttttttttaaatcttactttaatttgcatgtatgtttcttttggtttgaatgtgctaagttgatctttttttgttccattatttatgttaccatccatttaaaacaggccactgtggaatctatcatgagggataaaatgcccaaaaagggaggaagatggtggttttcatggaggggaagaaacaccacaatcaaggaggtaagcccagaagacaaagcagtgctcacacttagcaagtgttggttttgtgtagtgagattggttttcatgtacttacatcagagaaatgaagataggccctagtgctgagtttccatgagccagctctgccatgaagtagggcgagtgctcgtggaacgtggggaaggtggggaggaaggtcaggagccagcagcataggtgtcacctcctggctctgtaactgttgggagactgtggtccagtcactccctcatggtaagatttcgtcatctataaaagaagggattcagcctgggaattcagtttcttaagaaattaaatatcttccttctgcttgtggagacaatttttctttttctttttctcccctcccctcccctcctttcttttttggagacgggcttgctcagtcacccaggctggagtgcagtggtgcaatctcagctccctgcaacctctgcctcccgggctcaagcaatcctcccatctcagcctctagaatagctgggattacagccatgcaccaccacgcacagctaagttttgtatttttagtggagacggggttttgccatgttgcccaggctggtctcaaactcctgggctcaagcgatctgcctgcctaggcctccgaaagtgttggcattacaggcgtgagccaccatgcccaggctgtgaggacaattttaatgaggcatactcacagcagttgactaattctctgagtcctttcactgaaatggcatgtctaaaggtccatggctttggcgttcatgtctatgagtgcctgtgatttctttcagatcttcgttgccctctcctctatttcttgaagcgcttgctttgcttggctcccaggcccctgtgtccacctgggtctcctcctcccagcaggctgctcctgctctggcttagtcacctctaggagggtcctcaaagctcatgttaggccaccttttctccttttacttcttacttttcccttctgcccatgcgatgactccatttttgtctccaaaccagacattcttttctactccacatccacttatcaagtagtcgactaagcagacatcgtcctgtggatgcctcaacgtatttcaaacttaacgcttccagaattgaactcatgggattcttgtgagttcttccatcattggggccatagtcagaaaatggcaccactgtccatctgtgggtgagattcatgcttttagcctcactcccacaccaggtcctatcagttttccatctgaaatacttctctgacgtgtccatgtctctccagctctgctcccacaaatctgcattaccatcatctctcccagaggtgcttccagatggtctctttgcacccatcctcacccttgcttcttcattctctgtactgcagatgcattggtctcttcaggggactgctcctatttttgttgctccttaaagccttactgtggttccccagggctcttataatgaaggcttgtgtccttaccacggcctacagtgcttgtgtgttctagctcctgcctgcctctttaatctcatctttgctgttctctgctctttgtgcattagcttcaatggctgaaggtaccttctaccctgggggctttgcacatgctattttcattacttagtattctgtggacccctctcccctgcttcgcttagctaactagcagatccagtagccctttccctgcagatgagtctggtctgctgtcctctgcctgtgaacttttccttcataaattttgtcatagttgataattatgtaattactagcgtgactatttgatgaacctctcctttctgtctagacccgaaacttcatgaggcagagaccatatatggctttgattgctttggtgttcttggtctccatattggacccagagtaggggttcagcaaatatttgttgagggcacgctgattactctgggaaagtagtatgaagaagccacagggacaacagtcaagttggttattttaatcataaactgccatgaactctatttatgccattagttgaaagggaaaatgtttgctggaagagttttatcaagatataattgttctttgacattttctgttagcatatctgaggtctactcatcagttttactaatctccaaaggttaccgataaatgagttcaaatatatatgctttacactagaggccttaaagcatgaagggcctctctggttttcttactagagagcagaatgttctagaatttaagatggaagtatatttcagtgacttctttgtagaatatccaaattctcaccagtttgcattaagtggagtgccgctataaagtaaggaacagttatgaaattaaatgtttctttaaaaatctgaaatatacttatttcagttagatacatatttgggaaatagtctaagaagaaattgctaatagtgatggctaagttacatgataaatagataaaacataactggacatattatatcaattatttgtgtggtaataaaaaaacctaaaggatatttgaacttagttcatgctagtcatatgttaagacagtcagcctattatatagtttgtattgttcattttctttattaaaggaccgtagatttcctctcctgacgaaacgagcacagagaaagagatttagtcgttcaccctcggtcccttggcatttctctctggtctcttctgtccttggggccagtgcccatctccgtcctcctttgcctgctatgtgcctggctttgtggttcagacacagtctcctttaatccccatggcagcgttaggagatggagaatttcacccgtttcacagatgaggaagcgaagttctgaatagttaaatgacttgcccaaagtttgtaagcaagagaaacaagactgggcccaggcattctcttagaaatccaaggttctttccagtacaccaacagaggattttctattaagagtatgtcatcttggaaaagaagaaaatgctttcacatcttccccaagcaaaatatggtacaaaaatattttcaagcgtttctatcagcaattacaagaaaatattttgaaaggcccccagaatccaagcagcccttgatcaagcatttgcataagctacagtgatgatggagtttggtttggtgccacaaacacttatggataacagattcgtttctgtcaaaaatatttcttggtttaatcgtacacttcttagcaaagttgagatcaggacccaccgaaacaaacacagccagagcctcctgggcgatcgctagggtgggcgtcattggggaatggtctatctttaggggtcctgccttaaggaagcccatgggaaaacaccggctgtctgcaagccccttctctgtggtacttctgtgactctttcttttcttcttttctaggaaagtaagccagagcagtgcttggctggcaaggcccatagcaccggagagcaaccgccgcagctcagcttggccaccaggtgcggtaggaggcttcttgggatgtttgcagcccctttccgcatccaagttcatggcgtgtgctgcctggatgcagatagggttcaccacacagttccaactctggctctgtgattcacttggtgacctggagcaatttatttaacttggttctcccatgagcaaaatgcatgcagttgctcccttagatagctaatttgcaaaataaatgtgagcctttagtgagataatataactagagcatttctcatggtcctggcatgcaatagtcctttatacacagatgatgatgatgacaataataacagtgagaataatgacagtgatgacaggaataaatagtagccctaacaataacatggaaataagtttcacttctgaaggaacttgcctttctctgtaatttaaatactgaccaggacttacgttgatacttttaacatggattcatattcacttggcataggagaggttagattttgatgatactgatccgtatttgtggtgttttgtcttcaggttaatcactttgtatgggattggaggtgactctgaggacagtcccgttatacactaattatgatggtggtatcatatactgacactgaatgatttgcgctgtaccatcttttacttcttacttcatgtttacagtattcctgtgcttaagaaatccaggattccatttcttatttagcagacagaaagtgctaacagattaattggggccagatccacatcttactcatttttgtatcttggaggccactgccccacagagtagtcgtttccaaagtgttgctcaaccgtcactgaaccactgaggttttctccatgtgttgttgatttatgggagaggcaggcgtggatttccattcctctgaatcccggccatggctctgtgtcttaaacaattttacatctaggattctttgctacaaacagaaacccacgtgggaggcaggtgggaaatgacctgatttctttattgttctctgtggagaagaacagggtggagacgagtgtgcgggacctggtaggggtgagtttgaatgtgactgtgaatggcctggctcgctctcgcctgggatgctcttgaaacctttctgtttcccctggtggtgtcccaggtgcctccccctgacccaccgctggtctgtgcttcacaggcacaagaaagaataggaaggcaccagggtatcgatatttcccagctgggaattctgagtttggctgtgagtgtgcttggaagggagaaggcaggtgtgttgaggatggagcccaggccaaggacatgccaccctctgagcagccagcatggaaagcagacatttcaaaataagtggttgtttactgcacaagctgtagcggaagcagtcgacattggagtcaggcaagtgtggtttggaatcccagctttgctcctcggtaaccattggaccttggggaagctccctgacacatctgagcaaaggtgccagtgccaccgtcagtgcccagacaggctgggatggagctggcctggaggctgcatgggaggcatgctaccccaaaagaggcacacacaacaaagatgcgaaactgcgtgctctcagcaacttaaaccaacttaaatagctacactagaaatgccccgctttcctggaattcattttaacaaccttctctgtcttggcaataatttctaaacacaagaggtagcacagagcaggatgtacagcagggaccttgtccaacagccttcagtgtgatctttggcaaattaatccacctctcagcgtctccatctgtgaaatggggttaagaataacaccgatgcggtagaccccgtctcactgggtcttcgaggcaacttcatgagaaaatgatccagagtgcagaaaccaattggggaggatggctctgtggtcacctggaggacatgcgttcaatcccaaaccatacagtttctgttggctgaatgcaggatgtctgccaaatccatcctgccctctggcagtgcccaaggctgtgggagcccacctcttacattagtgtgacctggatgtgagacatggagtcaaaggagatcattttggaacttttaaatttaatgactgccctattggatttcacacttgcatggggcttgtagccccttcgttttggccaatttgtcccaatggaaacaggtgtatttacccaatgcctgtaccccaattgtatctaggaagcaactcacttgcttttgattttactggctcataggcagaggggacctgtctcagatgagactttggactgtggattttgagttaatgctgaaatgagttaagactttgggggactgttgggaaggcatgtttgattttgaaatgtgaaaagacatgagatttgggagggtccaggggcagaatgatatgctttggctctgtgtccccatccaaatgtcactttgaactgtaatccccataatccccaggtgtcaagggtgggaccagttggagggaattgcatcatggggccgtttcccccatgccgctgttctcgtgatagggagttctcacgagatctgatggttttacaaacatctggcatttctccggcttgcactcactccgtcctgctgccctgtgaagaaggcacctgcttttcctttgccttcagccatgattgtaagtttcctgaggcctccccagccatgtggaactgtgagtcaattaatacctctttcctttataaattacccagtcttgggtatttcttcatagcagtgtgagaacggactaatacagccagtcttagacctaggggaagatgggcctgagggtcagagagttaggtttacaagggagggaagaggacagcaactgggaggggcccgtacacagtgggcacagtggcattgctggtgccagcactgctcttactcttactccttctagacatagcaggcaggaccccaggagagtgtggagagcagcgagatacttctgcagctcttcccacgttggaacctcagctcttgcagtttacttggggtgtcacggattttctcactgtccgatacaatcatattcaaatggggcaaaaaatgctttttcccatcaaatagaaacagctggaccattcgccattctgagttagtcacagtatggttccttatcaaacctgaaaaattaagaattgactcttgtgaaaactcagattttgaaaagaatataaagttctcttgaaaaatgtaaaccttttaatttatactggcatctcagactttgagtctccttattagagtcatgcagttgactaaaaaaaaaaaaaaggtgtcagaatgttttcctaattgacagacgtgattgacagaatagtccccgaagtcccataattgagcaaacagcttgtcaccatacaaataattaaaatagcgtttgaaaaacgtacactgacaagtgctaacttagatgttgttcacagctactcttctgtgcacacattttcaaatgacatgagcccttttgttttgttttgttgcttcttgcagatactgtaaagcaagcaacatttaatgagccattgtaaggggtggggtgggggcctccgaaaaggaggcattttattctgtgcagggtggcgcaatctgagacgtggcagccgcaaatgaccgtgtacttgccctaagccgaaaccaccaacagccaactgcgcatctcgcattttagtctttgtatctgtgttttcctttctgtgttccttcaaacatggcatgctgcacaaatttagtggattttttttttaaagcagcagatggaaatcacagctattccgccttgcctcctcatcccgccggcagaggtacacatcaatctgttgtcaccaagagctttgcttcacatttggatctcatttcactccaaactgtttggttggaacataaacattttcccattcaatgaggggcctgtagcctcgttcttcttctgcttgacaaggaaatctgcaccaccctcccctccccgttcccagcagcatttgccaggctgtaccagctccaggaccacatttaccccatctgaaaacctccagattgttggttcagaggaaccagcatggttcataggatccgtaggtgttagaactggaagggactttggttggatcaggtcattttacagatgagcccactgaggcccagggaggaatttcctaggatgaggcctttgctggggcttatgtctgggtctcccagtccaggtctctctagcctgttacctgcctccatcctgaagttttgggtggatgtgattcagttgttcctctgcattttaagataaagaaatcaaggctgaaagataaagaaatgatttctccaaggtaatgtagcccgaagttaccatgggctggaaacctgtgtttttcagagtctaactgctgtaccatctccactctacctagaatcaggatcagcccccaatgtcatggcgttgttccatccacgtgtagcttagctctgccacagaccaaccacagttctagccgatgctctgttttccttcaactcagcctcctgttcccatggcgtattcccccagggctctgtcccagtgatctctaaatctttgtcttcagcccaggtctctgtgttgtgatttagacacaagccctgcgtgagtgggaataggttgtttgctgtgccatcgatgcctggcatggtatgcttgagtgtcggttgaatgaactctgggccaccatcccaaagcccaccgacctccctttcctggggcccagggagcaggtgcttagggaggggctgctcattctaggactggaaggagctgggtctccacataagtgtggtagaaacaacacagaagtggaggtgctgtgggacactatcctccttcatgtctccccagtattgggcagtattgggttgtagggatctcttttttttcttttttgagacagggtcttactctgtcacccaggctggagtgcaatggcgcattcttggctcactgctaccttcgcctcccgggtccaagtgattcttttgcctcagcctcccaagtagctggactataggcaagaaccaccacgcctggctaatttttaaattttttgtagagacaggttttgccatgttggtgaggctggggatcacttcttaaatgaacacttatggggtcagaaagctgtaggttgcataggagatcttaagggaggcaggggcgggggaaacaggaggcagtaaggcgagaggaagttagcactgagaggagagagtttattgagataaaaagataaagacaatcctggtacttcttctcttatgaaattcagatcctttccccacttttaaatgggatgattggtttctctgctgttgagttgtttgagctccttgtatatatactgggtatcagcccctttttgaatgaggagtttgcacatatcttcttccatttaacgggttgtctcttcgctctgttgattgtttcctttgctgggcagtagctgttgagtgtgatatagtcccatttgctcaacatcactaatcaggaaagtgcaaatcaaaaccacagtgagatagcatctcaccccagttagcatggctattatcaaaaagacaaaaaataacgaatgctcacaaggatgtggatagaagggaactcttaaacactgttggtgggaatgtgaattagtacagctattatggaaaacagtatggagatttcttagaaaactaaaaatagaactagcatacaatccagcaatcccactactgcttatttatccaaaggaagggaaatcaggatgtcaaagggatacctgcatctccatgtttatcacagcactattcacaggagttgaaatatggaaccaacctaagtgtccatcaatggataaatgaatgaagaaaatgtgatatatacacaatggagtactattcagacataaaaaagaatgaatcctgtcatttgtggcaacgtgggtggaataggaggtcattatgttaagtgaaataagccaggcacagaaagacaaatatcacgtgttcttactcatatgtgggagctaaaaatattgatttcatggaggtagagagtagaatggtggttaccagagctgggaagggtagaggggagaggaggatgaagagaggttggttaatgggtacaaacatacagttagatgaaaggaataagttctagcgtttgatagcacagtagaatgattatagttaacggcaatttattataaatttcaaaatagttagaagagaagatttgaaatgttcccaacacaaagaaatgataactgtttggggtgatggatatgctaattaccctgatttgatcatggtatgcatgatattttgataaatgcaaatatatacgtttatcagaatattacatgcaccccataaatatgtataattaatatgtcaatagaaaaataaaaaatacgaaagacagtaaaaaaaaaataagctggagctctgtgtatactctaaccttgcctagaggaaggtgctgagccagaggctttgtaggaaggcaaagtaccggagggcttgggatgtgctgctttgggggccactcagccttttccatttagtctaaggcatttactaagtgattcatatagcattgaggcattttcaaagatagtggtcctgggaggcagagctgatactactgggttggggattatgtcatagcaggattttcattgagtgaatagctaattacagatatgcattatgtgagctatttaaagaaaacgagcctaattcccaccctgcacctcccagctccccactaaacaaaaaagtctagaagagttaggggcactgacctgtatattctgagcagggaagtaaggcgtattccttgctcatgggatgaccctctgggggatcctgagagaagaattggtgagtctttcttgctttcactggcacctgtccgtaagtcctagaaaggccctaattgcttggagttgtatatttggcgagctttatatagggaactgatggatgagtgtggacttgtagaaacttggactcctagcgcttggcatgcagtctcagataggaagagaagagagacagagaagacagcatcttcctaggccaagagggagtttaaccctgcttgtcatgagtaggaacctgttggcttaaaatagtggtggtagctcatcaataggcaagtgaatgaggagaggcagcccccacacgtgtaatgcaagagatgcatgaatggggatgtagtgagagttcattgataaatttaacgtcttatggtaaatgaccacccgagagacgggactcaggagagactggattgacttagtcattgattaaaggctaatgcatttttcatggctacccagatgcattttctaattggtgatgacatcactgtgtgttccagggtaaagcatgaatcatcctccagtgatgaggagcgcgcagctgccaagccatcaaacgcaggccacctccctcttctgcctaatgtcagctacaagaagactctccggctgacttccgagcagcttgtgagtctcccatgcttggcgcggctgtgttgtgagcacatgaggtttctgcagactcctaaggctgtgtgatggttgggatgtgcccgttacttgtcacctttcatcccagggggcctgcaatccctcaactgggtacccgctgtttccaccccaactccagcactatccaggctgggtccccaatatgaccttgccttttgtcttctccttttgctggcctggccctggaggatctagtttactagagttaggaggaaggcagcctggcggagctaattcgtcctaaggtgtcaatcacagatagacttgaaaatcactcaagggtgtttttgcttcaagagagagatgtttgttaactcaaatgcatctcttaagttggtggaaatcaagcagttgtgatagaatttagagaatttcaggtaaccaggggcatcacctggtcatggtgtccttttatttttctgtgtgtgagaccagttttaattaaaagccctttcttggatcccgttggtcatggccagtgagcacctgtccttgcttttttgtgaatcaagtcttgtgcatttctcctaagagttagtggggagcctggctcaagtgtgagggtgtttactaggaaaagataaggaagaggcccagacacccactcaggccatgtgtgggaccctgcagcctgggggtctctgtgtgactcactgctcccactggcgacactggggacacctgcagtcaggcagcctgggggtctgaatggccagctggtgtgcaccaggagtcctggcacagagactcaaaactgctcaaaagtcactttgtattttgaatttggtgtgatttctttgggtctagactatattcttctggatatgaggcatgactgataaccaagacttctctttttccaattcgtgtcagtataataataatttaaaaacatggttatttagggaaatgtattttcacacttggcttaaatttgtctccctgaatgatgatcttcctatttagtcctagagtggtaagtgtatcctattccaaacttgtgatttattacgccgtgtagccccgtcattgaatcctggctaatgactgtaatctgaaaatacttgatcaaattagcactatcctgggaagtagaacaactctgtagcaagtaggcaagttgcattacaagggggcctgagagagctgaggtttcattttgcctgtccagccccggaaagaaccagaacaaggaagggtggggaaagaaagaattatacaagggcccagggcagtcacttgtttttaaagccgaatcctgcttctcatagaacagaagccaaatgcccatcaatcagggcctttccctcaagcagacaaatactaatggttcatgtttttcagaaaagcttgaagttgaagaatggccccaacgacgtggttttcagtgtcaccacgcagtaccaaggcacgtgccgctgtgagggcaccatctatctgtggaactgggatgataaagtcatcatttctgatattgatgggacaattaccaggtaggtcctgctgacttggggcccatggtagatttctttgcttcaccgtgggggtctctgggcctggtgttggcacctctgctctcctcatgggacttgcacggttcgaattctggtgcagttggagctccttacgtagtttcagctccttggtggcaatcattgtgtttagggcttagttgtttccttctggggtattattatctcttcgacttggttgcttctgtgggggcttctcaagaacgtctttttgaatggcctttacctttgattgaacaagccggtcacctcgatgcatgatcagactggaggcgtccttctgtggattacctgtccctccgtcagcatcaactttgatgacttgagccttgggctttctatccagaaagaaagttgtgggtcttgtttgtgttttttttttttttttatgaggcatgaatggtgcaatgaatctgaaagggatttttactttatttttctcttttcctcttcatttagatcagatactcttggccacattttgcccacccttgggaaggattggacccatcagggcatcgctaagctgtaccataaagtgagccagtgagtacagagttcctgtttcccgcctcctgtgaacgctggtgtgtgcaccgcactctgcatatggaatctttcctgtcccagcacggggtgacttgcagagagggctgcacctcaaccagggaggggcagtgggggtcaggggtagcagtggagtccagagtgaaagtgaatcccagcaactccaaatttgaattcaataccaagaaacaaggggcgaagtataggggaattgattactaggagaacacagatggtggcagcattaggggtgagactgaggtttagttcatcccgagggatggcagaggtagccagttgaagaaataggagcttatatgttatatatgccaagtgattttctgtagactaaaaagttgcagattccaggcaagttttggcggcgttgcagaccctgcgagccaaccagcagggcacatcatgtctacctggtctgtggagtgctccagcaagtggcccaaaacagaacagtgcccaccgtgggaccctcagccccagacatcagatgggagaggggttctccgactgctctcctgtgctgggtacatgggttacttcacttatatcttacagagattctgaaaagcacataatatcatttctgtatttagatgagtgaaattaactaggagaactaaagtgatttatccaaattctcattgctctcgtctgcctccagggttcagagccctgcagggattctccatgccccgccccttccgaaacacccccattctagcttgccaggcccaagcctctctcccgctcagtcatgcctcctccagccttttgtggcctagagtctcccatgcgagtgaaatctccccctccacagcattctgttctccagccagttagagctggaaggtgcctctgcctgaatcaggacagtgcggtctctccgtgggtgaggtgggtgagcaagttacattcacacttagtgagtgtcaagatagtgtcaagacggaagtgtcaggcccatggttcccaaccttgtttgctcatctctagcccacagtggtgatggtagggaatgggccaccatccagagctgtttctagaactctgtgaacacagatgaatgaactgtatttccctgccctgcatccgttcatccatccagcattccttgagtgcctgttagtgcctcatcctagggcaggtgcctgggattgctatgaactaggtaagtctctgacctgggactttatgatccagtagaaaaatggcggcttggagagagaaccttaatcctggtgggattaaaagcttcagattttgttgggcacatgtcgatagtcccagctatttgggaggctgaggcgggaggattgcttgaacccaggagttcgaatccagcctgggcaacatagtgagattcccccccatctctctaaaaaaataagtatgtacattaaaaaagcttcagatgtcatcttagatgcccaagctcattggtttgactttacttttctagatttcatctttaaaaaattattaatacaaaagttatgcatacttcttaagacataaaaatactaataaaagaggctgagattatggaaacagtaaagcgcagaggttgtatcaccctcctgcctgcccttgctgcaagctattcccttccttaaaagtagaactactatgaacagtttggttctatcttgctgaatttcaaaaacttatttacatccccacacacatacactcacattatttaattattcatcatatcttttttgtttcattttatgtaatatttaccttactctttttgctactgggcagaatcctgtcgtctagatacaccatactttctttaactcgccctctattgatgaacgtgtaggtagttgccactttttcccctattgccaacagtgatgcagtaagcgttcatagacaatgcttatgatatataatgcatgtataaataaataaagaaggcacacacacttagggaagtcccgctgtaaagtagattcccaggagtagaattgctgggtcaaaggatgagcacatttaaagctttgatcaatattgccgaattgccctctcaaaaggttatcccagtctgtgctgctgtaggtggcgtatgtgcagcgtcgcctccccacagcctcaccacgggctgacctttcatttagaaggattaatctactcatgaggtgccttgacttgtgtgacactgaaaattgcatctatttttagttgaaggaaagaaaccctcatgggtcaggatgttgagtagtgcacagctgattcatttggtttttggaacataaatctatttctgtccttactgtaacattaaacaagccctgttgctttttaattttttttttttttttggtcttgatttgtctcttggttttctcagaagagagatcttcttgaaaaataaagctgtgtggcttactgaagaacccctgaccattcttttctttgattggttggtttagaatgagtgaaacctgtttgtctggacccgcagatactgcccggagcatgatgtgacgtggagacccaaacctttgcctgctcattgagttggatatgtgtgttgtccgcgcacccagtcaggcctgtgtgatttgcaggatggccagggcttctgaaaacccatcttcagggcagctttctacaaccttcagggctccctgctcagcactgtaggaggaggtgccagctccttgatgtggcatttgaaacctggcactttcaggtcccagtcttctgccaagcccttattttcagctgctgtttctcagcccttcctgctctaatccagcgactctgttcctcctctgcactccattcccttcttcctgcctttgctcatgtggcggcctcagcttgacatggcttcccctctgattttcgcttctccatatttttatagcctttaatgcctggctcaaatgccacagtcctcaggccacaatctgtgaccctagtcagctctggtctcttccccgtccccggacttgctggactctatgtggatatcggagggcttgggcctggcttgttggcctcggtccccatcatggaggacagtctggacacgatggcagcctccagagccaaccactgatgaaagtaattcccatcctagcaggctctctcaagcctcctcacacgagggccttagcagccaccactgggagacctgtcaggctaagaattgaccaaggcttgtgacccactgttctagtgactcccatcatacttttgaatctgtattgtgatttctagagaaacagagaaatgattctcatgctagggtaccagggaaaagatgccgtttacatgagggtttgtggactttttcctgattttgcttcccttaaatttgggtacgacttacattttatgcactgtagtatttgtctaatgaaaaagccaatcttcagctgggcacagtgactaacacgaatagtccgagcactttgggagtccgaggcaggtggatcacttgaggtcaggagtttgagaccagcctggccaacatgctgaaaccccatctctactaaaaatacaaaaattagccagggatggtggtgggtgcctgtaatcccagctgctcgggaggctgaggcagaattgcttgaaccctagaggcagaggttgcagtgagccgagatcgcaccattgcactccagcctgggtgacagagtgagacaccatctcaaaaaaaaaaaaaaaagagagagcgagagagagagaaaaagccaatcttgcagttagccacttgcctgaaacaacagtgaataaggacaattttgttttctgctgaatttaatgacttgtttggatctagtcagcccatgaggaatgatccataaggctaattgtcaccttgttcatagagagggtataaagctggcttgagtattgatgaaacagaacaaatgcaaatggaagatacaggaacccctttcagattcaggtgcattcaaaactagaaggaaagtcaagaaggactgttgcctaaaagatctagatcattcagctaatgggtcctttgaggcctaaatttgggcaataattgtttgaatttttgaccttatttcatacatgcttttatattcatgtaaccagaagccagtgtctttgtgacttagaaaaaagaacacttaccgtgtttcccgaggttcgttagctccgctggggtctaggtatgcggtgtcccaagccagtggactgaaaatgagaggcatctgtagcagacttgttagggtcttttttttttggagatggagttttgctcttgttgtccaggctggagtgcaatggcatgatcttggctcactgcaacctccgcctcccaggttcaagcgattctcctgcctcagcctcccaagtagctgggattacaggcatgtgccaccacgcccgggtaattttgtatttttagtagagatggggtttcaccctgttggccaggctggtttcgaactcctgacctcaggtgatccatccacctcagcctcccaaagtgtggggattacaggcgtgagccactgcgcccggcctagatcttttttcctttcctgcccgcagcagttatttctttcatgtcagcacttctttgtttattgcagtcattgccctctgccagtaagagataggatgatgcgagatgataagagataggatggaaggtctgatcaggagtcgggccaggatcccagaagcggcagccattagctcaccctgggccctgggaccgagtaccttccccactctgagctttgttttcctcttctgtaaaatgagattaggctagatgacccctgaggtcactgctaacccaggaatgctctgctcctggctgtgtggattgcacaagggtgtgttttgtttttccaagccaaacctcagtccaaactcagagggagcccctagactctggttgcaccaggagctgtcctaggtgccgtcgggggtgctgagcagtctctcccttcaagaagcttgtggtcttgtgggaggagacacttagggctccctgtaataaggcagtgaggggcagatcgagtgtgaaagatgttggtttttgttggacatacatcaggaagttaattttgattgaccagaggtgtcagaggaggcccctgtgagaaggtggcactcagctgagtctccatggaggagcagggtttcaaaggagaggaaagctcaccacaggtggaagtaggagcgagaggggaggctgggagacgagcaggtactgggtgggctcactgaaagggagactccggtgcagacggtggggtgggtaaaagatgaagcaggaaagtaggcaggagccaggttgcagagcgcctgggaggcaactcaccaagcctgagtggtgctgagccttcctttctcaaggtggcttgtgaccctctctccccttaggatggcagatggggccacagagtcctttttctctacagcagtggctctcaactgacggacatatggcagtgtccagagatgcttttgatggacataaaggggcatgctgttgactcttagtgggtggacccgggatggtgccgcatatctgatgaggtggcatcgtgggggcctcggtccccaacagacactcctccaatctcagatgtcagtgttgagaaactgcagtctagaagcttgcaaaatgctcccgaaggtaatctttccaaactatttaaatctccccgagtcagtgtcttaagagggatgcagagattaggcagaggagaaaacttgtaccaagcctgggcatggatccctcttttttttttccttcttcccattctggtgtttctccagagccctgttccagttgctgagaatgctagaggaacaggggtgatgtgtgtatcgcacctttatccactgacacctcctattcctgggtcccacctgtccttctgggtattgttggttttccccaagcaccctctgcttctgtggggcagggctgtgccatgccctgtgcgtaccccaagccccgtgtgcagcctggcataggagtgctcagtgagtgagtgtgcactgaagggaccgtggaaggagcctgtgggttgagcagggacttgggctgggctggcctgtgtggcatgtcctgccaccggttgtccttctgagtgaggggtcttccctgtgaggggcaccatggagacttagtgctgcctgagcatttggtggggcacttgttggcattgcagacagcttttgttgaaggcaggagggaaggctcttccaccagcagcaaacattttccccattaggtcactctcgagctggctttccagctaagtttagtcaggcaagaaggctggcatgctgacagtaactcagtggcatggcccaactgtgaaatatatttgacaatccagttctgagtgagattagcatcttagatctctgcaggtggcagcttttaggactttgatgtgaagagctatacatggaaatagtgatttctttttaaagattgtatgaattagatggctaaaatacaaagatatttagaaattaaaaagattggctgggcgcagaggctcaggcctgtaatcccagcactttgggaggccaaggcaggtggatcatgaggtcaagagatcgagaccatcctggccgacatgatgaaaccctgtctctactaaaaatacaaaaattagctgggcgtggtagtgcatgcctgtagtcccagctactcaggaggctgaggcaggagaatcgcttgaacccgggaggcggaggtagcagtgagctgagatcgtgccactgcactccagcctggtgacacagcgagactccgtctcaaaaaaaaagaaaaaaaaagaaatttttaattttgtttgattttcagatgcatccctgtattccagacaagctgatatttctagattctttttgtcttaaaactttctcatttcttagttttaaagaacatgttattgagcaattttcgaaacaaatccattggccattataaaatattcatggtagaacaatatgttggataggaagtgggtagtttattcactcattcagcaaatattcactaaatgtctgctacatgccaagcactgtttttggcacgggggttgtagcaaagaatgggacaaagtccctgtcctcatggagtttatggatgaatgagagatacagtcgaatgaaggactataacgtcatattagtgatcagtgctaggaggagagggaaggcagagcaagggccagtgcctgggtgaggagtgagggggtgtgtgtttcatcgcatgggggaggtcaagggaagggccttctggagaggtgagatccagcagagacctagatgaggtgagggtacaagcagtccctgcagactgggggaaaggtgctctaggcaggaggaacggcatgggcaagtgccagcgcagatgagcgtggcgagttggaggaaggatgggaacacctgtgtggtttgccaggagtgaggagttggacagtcattgcagatggggttggggttggagagaaaggtgggggccaggtcttgttggtcttataggccacagtgaagggtttggacgacgtctgtgagaggttgcagcctcaggagggctctgagtgtgagtgggctacgctttacattttcttagagcaccacgtggagtcgggatagcagcagggaggtcattcaagattgtcgcagcaacggaggccaggaggccatgcggtgtggacgtggtgggagcactgggtggtgccgagggtggagcagaggggacctgctgattgtgtggcgtgggggctgggggtaggtagacaccaacggggcccctgagggtttgacgtcacacctgggttaggagagtgccacttgctacttgcagtgccacttgcaacaggggcccccgaggagtctcggggtgagttggggaggagccgctgtggtgtgtgtggttttggaggtacccattttggagtgcgatgagtactgtggggtccacggtgagcacgtactgcgcagtgggtgtaatgtggagttcatagtagcctgcagcttgggagaggggtctggacggggtccatgcatttgggagatatcagtgtatagatagtgtttaaaatttttgaataatatgttttacttaatccaacatattcaaaatgatatcacttagacatgtaatcaatatgaaaacgattaatgaaatatatcataccttctttttttttaattaaaaagtaaactttaatgtcgaaaatgcaaacttggggaagacagaaaaggtcacacacagggctgtcacttcacacttggaaggttgcacagcggccgggcagaggtgctcctcactttccagacagggcggcgcatactttcttttttttataatagactttgaaacttggtatatattttatacttagagcacatttcattctagacactaaatttttgatagttaaaaaaagtgaaatggggccgggcgtggtggctcatgcctgtaatcccagcattttgggaggccgagacgggtggatcacctgaggtcaggagttcaggaccagcctggccaacatggtgaaactctgtctctataaaaaatacaaaaattagccggcgtggtggtgcatgtctgtaatcccagcaacttgggaggctgaggcaggagaattgcttgaacctgggaggcagaggttgcagtgcgccaagatcacgccactgcgctccatcctgggggacagagcaagactctgtctcgaaaacaaataaacaaaaaaaaaaagtgaaatggacctgctaacgcaataaagttgtgttcatagactagttgtttcttcagtctagatatggcatttggagctgtggaagtgggtgaggttcccaggtcctctagggagtgtggggggtgtggagaaatgaggcctgagaaccctgggcgcttgtgcgttttgaggctggcagagctgatgggagcaggcgagctgctgtgtctgggaagcggtggctgctgaggaggagaacacccggacactctggagtcctgggagctgagtgactcaggtgctctgggagaaggaatgagcccccgaggcagatgctactggggagtccattcctacaagaattgagagttgatacctgggtttggcaagatgggcatcagggtgacctgtgcagggacagcaaggaagggaacaagagaacaagagtctgctaggagtgtgaggagaggaaggaaagtgaagaagtggactcaatgcttgtagtcagctttttggaagaattttgctacaaaagggaacagagaaatggtatcttagccagagagagactaaggatgttttggtgtgtgtgcatgtgtgtgtgtgtgtgtgtgtgtgtgtgtgtgtgtgtggttgttttggcttggcttgttttaaggatgaaatgagagattgcagaatatttatgtgctgatgtgaattacccaaaagagaggaggaatttgatggggtgtgtgtaggggcgaatgaagcaaatgctggagcaaagtgtgtgaattggcaggtggctgtggtcttgtcgcaggggctctagccaagagctgggaccagggggagtacaaggggctcaagcgcaggcaggtgagccagtttcatccatctgaacctcagtttccatagcagtaaaaccaggggaaaatactcatccagccatgttctcctgaggattaaacaaagtggggaatgcaaaagcacttagtgaattacagtgaaatgtatttaagcctatttctcaattgcaagcaagattttgtagaatgtggacttttgtatgtgggggaacttgaaacagtgccattctccacagaacagatatggatcaggatttatgaatgcagaaaggttccattttctgatgccatgaaatgtgaatgttttatgtctttcaggaatggatataaatttctctactgttctgcccgtgccatcgggatggcggacatgacgcggggctacctgcactgggtcaacgagaggggcacggtgctgccccaggggcccctgctgctgagtcccagcagcctcttctctgccctgcacaggtaccaggcctgctccctgcacctccatctgtgagcctgttcagacccgctctcttcctaactgcaagttttgtaagaatagcctcctcactggtcttctgccccaatatccatgctccatagcaggcaccagaaaaatcattccaaacacaggtctacacctgcattggctcctcatggctttcaggccgagtccagactcaggagcttggcgcttggtggctcctcatggcctgcgcctcccctcctctccaggcgtgtttctctcgtctctacatctcagtctgtgtctcccagacaattgtctctgcttggagcctttgcacatgctgttccgtctttttgggtcactctcctgctccatctcttcttgagtggcctggctgaatcttaatgtccgttggacaatgagcctctatctcatctccttagggatccttaagtggcctgtctgcgaaccaccatcattcacctggcctttgacacccatcatacttgtcattttctgtcttagatttctgggaacactgttcattttacgggtcctctaacagaccactggccagtttctgattaccttcctcccttcacctatggggccatatcaaggtagctaagccagactaactctggccccttggagttggaggaagaaaacactggacgtccctgtagttggaggcccagggcaatttactagacacctctcaaagcaaaagctattgtggtcaaccataggacattggtccctgctgaaggctgattgtaaatatcataaacttggtctttatgaatgtcattgacgtgattctgcctgaatttgaagaccagatgaactgtttgctgctgctaatcatgcaaacagtggaagaatctagatgggccccaaatgctgtgttgattcttgtgtattttcctttagctctgtaggtaccttttccatcacggcgttgttttgtgtaagcagtagcttttttcctgtagtaaaagatgtcaaattgagacatgcacattctaggggagaaaagtcaggcacaacctagtgtatttcaagtcctcagagctatcataacagcactgatctcaatagaaatcctgatattttagtgaaattgtgtccctaagctatgctgacaatttgcaacaagccattcatcagcctgtgttaagtagtaaggctttgctaggccaagcaaaaagtccacatcgttactccgacatcctaacactaactatgcatttaaagtgatccttttcatttccttatttaaatatcattgtccaaggtgtattgctttttccctgggaggaattattttaaaaaccctaaatctcatagttgatatgtcctcttggaaggccaaggtgctccagtggcagatggccaccggcctggtccttcctagggctgccatcaagccagagccgttccatgtgctagctgtcctgtggagttctctagaattgctagcgaaggctgccctaacacaaatgaccttccttttttttttttttttttaattttactttaagttctgggatccatgtgcagaacatgcaggttttttacataggtatacatgtgccatagtggtttgctgcacccatcagcccgtcatccaggttttaagcccagcatgcattagttatttgtcctaatgctctccctccccttcccccccaaccccctgactggccctggtgtgtgatgttcccctccctgtgtccatgtgttctcattgttcaactcccacttatgagtgagaacatgcagtgtttggttttctgttcctctgttagttttctgagaatgatggcttccagcttcatccatgtccctgcaaaggacatgagctcattcttttttatggctgcatagtattccgtggtgtatatgtgccacattttccttatgcagtcttatcattgacgggcacacaaatgaccttccttagcacaactctttaactgggtgcagttctgattttactgctaggttttgaattaggatgaaggaggggaaggtagtgggtggatatgcgtgtggtgcagttggcaaaaacaagccctcagcacaggatggtgatcacttagcctttgtcaggagtgctgcgaatgtcttttcccagttcatagcttttaatgaaaataaacttagttttatgtcattgaatgtattgtttcctctgtagttgtgctttttgtgtattaccaaagtcttctctgacctgtgggcatgaagacagtcctcctggattttatctgaaggtgttgctttcacatttaggtctatagtccactaagaatggatttatttaggtagaatgaagtaggggtgcagtttaattttttttttcctatatggatattcatttgtccccacaccatgtgctaaaaagactgccctggctgggcgcagtggctcacgcctgtaatcccagcactttgggaggccaaggcaggtggatcacgaggtcaggagatggagaccatctggctaacacggtgaaaccctgtctgtactaaaaatacaaaaaattagccgggcatggtggcaggcacctgtagtgtagtcccagctacgcgggaggctgaggcaggagaattacatgaacccaggaggcggagcttgcagtgagccgagatagcgccactgcactccagccttggcaaccagcaagactctgtctcaaaaaaaaaaaaaaaaaaaaaaaaaaaaagactgccctgcccttgctgctccgagatgccattgtggtcataaagcaagtatctgtgaacgtgtggttctgttttggggctttctgttttgttccactggcaaaggcctggacgaattggccaaggccatagtgtcccagctcccacagctgcagaagctcctcaccttcccagcatcggaagtgctaggcctggctttctgctcgttttcgtagcttctagactcaaatttcatcaaaacacccaagactctgttatgagtttgattgaaattgcagtgaatctgtagagcaatttaggaagaattaatatctcaaaattatattggatcttccaattcaagagtatagtctattcttcatttgtttaggtctttcctaatatatttcagtaaagttttataattttagctgtaaaggtctggcacatcttctgttagatttatttctagacattttatattttaaaatttgatttaaaataccatttacacaattaccttttctgcttgtttctaatgcatgaaaatgatgcgattaatttttgtactttttttttttggtacattgacttgttaaccttattagagtctttttaattctggtaattcatgtgtaggttcatcttcttaatgtgcatatttgttttttgtgatgacaattttttcccctaattctttctagtatgtataacttttatttatttttcttacattattgcatttgataggacaggcaatacagcagtgaattgccatgatgatacagaccacccttatttcactgttaataagatgttcactgtaggtttttttagtattcccttctattcctggttggagttctcatctggattagatgttaaattgtatcaaatcctctttttaaatttaagtattttaaaaaatgaattttaatttgggaggtaactggtatcaaataccctttttgtatctattgagatgatcatgtttttctcttttaacctgataatgtgttatattgattttaaatattaaattactatttcattcctggaataaacccagcttttatacattgctacaatttgtatacacacatacacacacacacacacacacacacacgtgtatatatatattttagaatttttgcacgtatattcacaaatgagattggtccacactttgcccatactttctttttttaggttttgtttttaaggttatgctagcctcatcgaattaatttggagatgttcttttttgtttttatgctctgtcattctttgttccctggatgaccaggataacccttggtgaaatggctcatccttggtgttttcttttgtagaaagacttgaaagtacgggtttactttccatctcgtgcttttctgggatgtctcagctgcctgacacacactaaacttttgaagatttgagttttctcagtgttgcggcagctttgtcagctaaaaacagtttgatgctaaaggaagcttagcctctcatgttaatctgttatttatttgtttaacagagaagtgattgaaaagaagccagaaaagtttaaagtccagtgtttgacagacatcaaaaacctgtttttccccaacacagaacccttttatgctgcttttggaaaccgaccagctgtaagtagtagattgggtatagaagaacccttgaaatgactgccttttctggttgctgtcatctgaaagccctatccgagaaccatatgtagagtcagattctcatcccagaagcagtagcctggtgaagagccacttgcccacatctaaaggcaaggggattacaaattatcttatggcttccagggttctttgaaggttggcgggtgggtcaaagcttgagatatgggacttaaaactccaaatttcaaattactcattaaagcagtaaagcaagaacatttaatcggattagtttctttctaccagaagggaaccgcaaaatcagtcctaaccataatggcgaattcagcatctcacgttttaagtgtctagtgttgtctcgtatcatgaaagaagcgctttgagattttgcatgtattgcccgcatttactggaaagctaagtattctagagaatgtagttgggtactaactgctccatcagaaagtcctacttttgaaagttacgagagattttcatgaagtaggaatatgggtcaaagaataacctgaaggaatgttagaattgcggggacgtggtaggttgtcttttcttcaactcagtccttgaacagatgagggaattgaggcccagagagcaaaactaattgaatagtttcccatcaaaggatattctttcactgcaccactttgaggtagagctctggttaatgaaaatttgatatctcatcaaatcagaaataccatggacttgtttttacaatgaactcttttctaatgaacactttaaatcacctttaccaaatataggatgtgtattcatacaagcaagtaggagtgtctttgaatagaatatttaccgtcaaccctaaaggagagctggtacaggaacatgcaaagaccaacatctcttcgtgagtattgtacacattttatgtgattatgatatcagtactattatcttaaaacggtgcttcccagtttgcggtgtaccttttcccctttgctgcctatatgttaatctgtaattcttataatgaaaaaatgtattttaactccttgtattttgtccaaaacataatttttagacaactggaattaaatcagatcccttctgggtctaaaatttaaactcgtggttagagtctgctacagaatggaattgaatgaatttgaaaactagtagtttagatttgccaagttaggtttgaaagcctagaatgtgaatgagaaatataaccaaactgaaatatgtgaagttatatttaaagatgaggaactgtatatctcttcacataccaaatgtttcttaccagagacattgctgtgtaattgttaagaattcccttcatatttttggtcaaagcccagtttttctgagtcggtgggctaaatgggattactctttctaatgaggcatccttgtgtgcttagaatcactcttgactttatcctgtccccctcgggttcctaacttattaggatggagagcatttcctcattccatgttgttgggaggttggcccactgggtgacatcagcccaggccgacccttgtcttcctgccttgtccatttcagagactacacctcttctggtctggtctgtgcagacctggaaaagagcctctggcaggccaggcacggtggctcatgcctgtaatcccagcactttgggaggctgaggtgggtggatcacctgaggtcaggagttcgagaccagcctgaccaacatggagaaaccccgtctctcctaaaaatagaaaaattagccaggtgtggtggtgcatgcctgtaatcccagctactcaggaggctgagacaggagaatcacttgaactcgggaggcagaggttgctgtgagcccagatcgtgccattgcactccagcctgggcgacagagctagactctgtctcaaaaaacaaaagagcctctggccttagtggccccagatagcccgaggggttcctctttatctggaggagttagactgggggagtttggttctaggagattcctaaggattggttttctccatgtagcttctgtggttttagatagagagataagttctctctagggcagatttttactttcaagatggtccttaaactagttggattctaactgagtgtcaatagggcagttctaggctaacaggagtcctggggctgccccacaagactcctctcaccctgcagtcatgccagtacccaagcagtcctcaaggtttgtgcagagagaggggaggctggagccaaggccctgttccctcctgcagaaggcgaggcagtgccaggctgcttcctgattggcagaaaaacagcaggaacttgattcctttcttaacccttccttgcggtttctgccacctccactgttctaagtggctgactgtgacaatgtctcgttcccactcccctctcattccccaggctggagaggacctactgggtttctatttaggatctgtgttatagtctgttttcatgctgttaataaagacatggacccaaggctgggtaatttatacaggagaaaggatttaggctgggcacgatggctcatgcctataatcccagcactttgggaggccgaggtgggtggatcacctgaggtcaggagttcaagaccagcctgaccaacatggtgaaaccctgtctctactagaaatgccaaaaaaaaaaaaaaaaaaaaaaaattagccaggcatggcagcttgcacctgtaatccaactacttggaaggctaaggcagaagaatcacttgaacccaggagacggaggttgcagtgagccaagatcatgccactgccctccagcctgggtgacagagtgagactccatctaaaaaaaaaaaaattaaaaaaaaaaggggagacctcacaatcatggtcaaaggaggcaaggaggatcaagtcatgtcttacatggatggcagcaggcagaaagagagctcgtgcagggaaactcccccttataaaaccatcagatctcatgcgactttatcacagggacagcatgggaaagacctgcctccatgattcagttaacttccactgagtccctcccacaacacgtgggaattcaagatgagatttgggtggggacacagccaaaccatatcaggatcaaaaagaactttgaaccaatgagacgctgtccaggaatgggaaagtggcaggtcttgccatgcacgcatggaaagagggactccagcatctgagagggtttggctaggtggcctctgcggtcattgcattgactgaggctctagggttaaaatgcacacctcgcccatggcttggcctagggtggagctctgcagactttactcattgccaggggatgttgacattttacacctggactggaggcggggttgttcctgtgagagagtaaatctcctcccccaggaagctcacatttctctggcgctgaacttggtatagctatttctgagccaagtagatgcttgtcattcagaactgggacagtcatctgaaatgtcttcagaggctggggccacacagcgggagcagctcagttctttttccctttcgtttgcgagtgtctgtgcgtaagctctgcctgcttgggaggagcactgtgtgtggaggtcggtctgggggaggcgcgcagatggaactcggcctggccgctcagggagtgtgagagtgggtttggttccagtgcaccgcggccttgtagtcaagcctgcagggaggggccctgctgccgcagccacaaacctcagacaaataagccttaaagccgggaggtattttaaaaatctgtctgtttgtttgaatcccaaggaaagacataactcttggttttgtattaggagacgtcactttcccattttgtgcaagcacactgtttctcataagtcctttggaggtcctttattaaatatacacactcggcttcatttagtacattattttatacctcagaacatgcacacttctggagtctggattttggaagttcctttaggttcttagcaatttggaactagacagtgatcagtgactgtcaaggaggaatctggggatggctggcagtgggctgggtgtgccagaatctcagtttggaggtgcctggaggtctgaacatgcatattcaatatagcaatagcaactttcttttcatagtataagccacagaaactaacatgcaacatatttttgggcatgcaaataaaagagagcaagagaacgttgtaggaagcattgggaagccctgctctaattcagctccacagactataaagacgaagggctccaagagggcaagacaattgtccaaggttacagcaagcaggagagcccgggtctcttgaccgtcatgccaaccagggcttttttctctaagacgtgttgataatttgtcatttagatacatttgagcacccagtatacattattttaatgttgcatatgttattttatttaaattatccttaaaactgtggcatagtttttattttcctccctttacagtggaggaaattggcttagagaggttacgccatttgcccacgatcacgcagctagtaaatggcagagctgaacatcaaattaatgtctctttaaccccaggacccagctccttttcactatgcaatgaagcaatctctgtcaggtgctccaaagatgtgccttgtctgtgattcttcccccgatgtcccatatgtgacccctgcagcaggcgctatcccatggccatggtgacttcctcctgccgtcttttgcttggctgtatctcctttacctgtccttcaagtgaagtcaggtcccacccacctcttccccagagccttctctgatgccttgtttgcatactcttcattttcatctctcattttcaattaatcgataacaaattattctagaatgacttgagtcgtgtcgataagtaggcggtctgctccttgaggttgtagatctctcttgacttctacgtgcagccctgggtgcatagctggtatcgctcagtgccagtgacaatgtccctttccttccaggtatgtgagactctgtgaagtagtcgaccacgttttcccgttgctgaaaagaagccattcttcagactttccctgttcggataccttcagtaacttcaccttttggagagagccactgccaccttttgaaaaccaggacattcattctgcctcagcgtaaaatgtcccaagcagcctcttgccagcagtgcagagcctggttgtcacccattaaaggataggtctccccggagtgcacagctccacctgggagcctggcgcgtcatcattggcctgacagcagagagaattgagaagcatttctcccctgccccaccccggggctgacatttctaagcaagataggaagggagcactttctaggctaggagttgggtgcatttgtaccgtgaaaagcattcctcagttgtggcttaatgccagttacgacgctgcctttccggcctgctccagcaagtagctactggttcacgtgcagtttggggctgtgaaacctaggcagaaggcggctgtctgagggctgtccccgcctaggacagggtcaatcgaggaatgccagatgtgcacggtttttggcaaagtagggggcacatttccattatagcaatgttagtgccaccaccttctgaacacagtggggagggctgtgaaggctcatgtgacctggatctgaggtctctgatagaaatctggacgccaccgggtccaggcctggcctcagacttggccttgtggatgggccccttacagtatttgctgactagtctcatttttaggtgataaatttttctttaattcctttggttaaagatagtctatttcattggcatatctccccccagtttttgtggctcaaggctggaatatttatgccttaatatatctatggcagacatttaagaatgcgctttatctagctcatggtaactttgcaacgccttagattaaaatgacagtaaatattactaaggcagtattttgaatgagtttgacactgccggcttccttccatccagcgaggtggtgctgacagtgtggacttgagcacacttatgccaaatgataatgatactgacttctgttgggagctctccaaagaaactggttggttttaagaaaatagtttcaagaagttcaactatattcttttagatattatgtattgttttactctgattaggttactgtgataggcatttattcatattctttctataccactgtcattaatatattaaaaagatgtatgtgttagactatcgaaagggccttattctctctttctcatagactgaccttcttttggaatttctgagtcatttattttccttagctttttccactcaaattaagggcaagcgaaaaagtaataatttggcattctttaagcctacagaatgtgattctttcacttgtttattacactggctcgtggacagaacaatttgaaaagtgaaagaattattttggtaaaagattttgctttacttttcgaagcattatttttttaaagagtgttttactccaacgattgaaacattttcctatttaaatttcattgttagaatcacaggaggcaaaaaatggaacggttgaatgaaattttactctttctgtgaaagaaaatccacagagttgttgcctccgttgtagttggtgggccccgttagcattggatgcctttgccaaatggttcatgtggacacacaaaggcaaacagatctgccatcgatcgcagatttctgtagaaacacggatgtgcatgtgcagattcccttttgcaggtattaaaaataattaaaaatagtcctgcctgaggttgcagtgagccgagcttgcactactgcactccagcctgggtgacagagtaagactccatgtcaaaaaaaaaaaaaaaaaaaaaaaagtcctgccttaactaactcctctgcgcttgttcactagtaacctaaagaggctatattcattctttatgcaatgagggtatttttgagtgaattttaactgctctgaactaagtataagctcatgggcctgcaaaggttcagacggtttctcctttgcacccaggaggaactttggctgcgagaatggggggatgtatccctcatgcagttggcatccaggcagccctctgcagcagcacaccctgcaggcggagttttcagaggatgcaattttggatcccgaattttgatgtaccttaaacttccacatcactgcaccctgaaacagagcatgctttccagaaagtcacactctcagatctgtgtcaagttcaatgtgagccctggcaaggctggcatattaacacctgccttctggcttctgaaagtgagatttgtatatgggctgcactcacgcatatacgagttggtttatctttgtgtacatgactataacccagtgatgctgaggtcatgtgctggaatgctgtatttggaccacacatttcaaagttgccctatggaaatgaatcctacttagtgacaagtcatcaaatgtttgtcacatgtgatgaagacaaatatgtatacctggcatagagaaaaatatatacctggtacattggagaaaaataattacactttcaaagagaattccctttgcaattttatgtttggatcaccactgtaagcacactttatttgcatttgatctgtatttgtatatgctgatgcaatgataaaaatcactgtaatacttcattgtgttgtactggatgcaaagctagaaaatattgcaataaatgagaccgatgaaagacttctctg

SEQ ID NO: 37668 - DNA, 80792 bp, Homo sapiens; identical to SEQ ID NO: 37667

SEQ ID NO: 37669 - DNA, 80792 bp, Homo sapiens; identical to SEQ ID NO: 37667

SEQ ID NO: 37670 - DNA, 36652 bp, Homo sapiens; identical to SEQ ID NO: 36675

SEQ ID NO: 37671 - DNA, 36244 bp, Homo sapiens; identical to SEQ ID NO: 36676

SEQ ID NO: 37672 - DNA, 9025 bp, Homo sapiens
ctcttctcacatcagcgggtccaggcccaaccgacagactatgggggctccggcaaccaggcgctgcgtggagtggctgctgggcctctacttcctcagccacatccccatcaccctgttcatggacctgcaggcggtgctgccgcgcgagctctacccagtcgaggtgaggggcgcccctcttatcccggcccgctgaggctctcccggcgctgcgtccacagggccttcacctcctccgcgctcgcgcactctgggttccagttgcctctctcgggtcctgcccatgcctcccccgctcctaacccaactttagttcggtgttttcctcgggctttgtctctatcccagccccttctcccaagcggcgggggcgaacgctttgtttcctttaaagtcacttcttccctgggtttaaggtttcccgcgattccacctctggccggttgtcagtgtctgagggaagtagtctggatgaagtggtgtccaaagtcacatgttaggtttgctttaagcttctggttttttgtttgtttgtttggaagggctttaaaataccagtctgatcccaaagaaaaaatccgagtagaaatagacctgtctgaaggtttagcaccttggttggtgcagctggggcgttcacagatcgtcactgcttcgagatcaggttccagcaacttccagagctcaggagtaaattgccatcttttcagattggctcttcaatattgggttcgagtaacaatgatctcctgagtaaaaataaaggtgaaaatcccgatttcctggttgttggagagcattctttcaaccccaaactctgctttaatgctttgtttttttcttcaaagctatagttttagtttcccggttcgttgaggtttttttctcgtatctggaccctgtgaccttcttccatggaattcctgtcctcagttttgtttctccatcttatctataactgtaggcaggactgacttgtctacccgaagattttattttgcgtctgtttttccttaaatgctttttatctgccgaggaggggttctttacctgagggtcatgaactcccaaaaatgggtgcaagtgtgtgtgccttttgtttcctgcaaggagaatatagcttccatcgacttttcaaggggcctaactctcccaaaaaggccacggctcaagaatgttctaccactcccataagtcactcttttttgtttgcttctagaaccaaacacaactggaagacctctgacctccttttgcatgggaaaagcgtaggtagcgtgtagcaagttgcagtctggggacttggttcttccaagaactggaggtgacttgggcaggtcagggctctatatcctcctcaactgttgagagagttgagttaaattataagctcaaacatatacagggtgggttagttttcatattgctgttgtagttaccacaaatgtagtgatttaacagatttatttgtttacagttctggaggccagaagttcacaatgaaatcttacagtgctcaaatcaaggcagggctcactccttctgagggctccaggggagaatctggttcttgcctcttccattttctggtggctgccaatgttccttggcttgtgttcacgtcacttcaatctctgcttcgggtcatcacattgcctccctttctgtagtcagagttccctctgcttcgcttttataaagacacttgtcatacattcagggcccaccagataacccagaaaatctcccatttcaaaatccttaattacatctgcaaagtcccttttgccaaataaagtaatagtcacaggttccagggattaggatgtggttatctttgggggccattattcagcctactacagggccagagagtacagactcttcccaaagaccgaagaggtcatcgcagctctgcagtaaccattaattgccctgaagaaaggaaaatctactacagtgttggcctatctgtggtttttgaaacctgtgtggccagcaatactcagacaggctgcctgtttacaatctctggtgttataggaccttttaatacttggtaattagcctgctactccatgtagccattccagacttcacagctgttgtcttctttatccttcctggatgtgccattctcacaagcccgtcttgctcacccctaacaaaatacacttaaaaggtgctcagcatcatatcataaagatcccatttaaatgtttacatttgataaaattttctcagtcttttttttagaaacagggtcctttgtcacccaggcttggcgtgctgtgatgcagtcatggcttaccacagccttgaacctgagcacaagagatcctcccacctgtctcctgagtagctaggactataggtgcacaccaccacacctggctaattttttattttttgtagagatgatgtcttactgtgttacccaggctggtcttctgggctcaagccatcctcctgcctcgggctcccaaagtgctgagattacaggtgtgacccaccgtgcccagcgtcagctttatttttttaatgctgacttactgcagaaggcccaagggccagtgcaggcagcatctggccagaacctgtgtgtgtgtgtgtgtgtgtgtgtgtgtgtgtgtgtgtgtgtttgtgtgagatttaggcattagcacgggcatcctgggtgtgtgtgtatctgtgtgtgtgatgatgtttgaaggcattagctcggtggcatcctggcatggaaggtctgtgcctccattcttgttgctttggtgtaggaaatgctgattttgttgcttctctatggggcaaataataataaacgccttgagttattctcatattctctttgaaaaatgccaaaatttaacatctgtcattttcttcctgaaatagaaggaatgtttccctagagttaaaaaacctgtaggagatcacctagtggttgggctgaaacatgcacaataaattttttttcttggattgcaccaaatcactgcttggaaaaactcatttttttatttactttttgtttttctttcttttttttttttgattttgtttttgagacagtctcttgtcgcccaggctgtagtgcagtggtgcaatctcggctcactgcaacctctgcctctcgggttcaagcaattctcctgcctcagcatcccaaatagctgggattacaggtgcttgccacaacgcctggctaatttttatattttgttatagatggtgtttcaccatgttggccaggctggtctcaaactcctgacctcaagcgatctgcatgcctcagcctcccaaagtgctgggattacaggtgtgaaccaccacgcctggcctggaaaaactcttattttattatgaaacagtaagaatttagtttggataagaacatggtaaggagaggatgggaagcattttgtagtatcatttgcagctgggtaacattgcttctggtaaaaataaggaaaaacaagtgagcatctggctctgaaatcagtctgtgttcccattctaaattatagaagtacaagattggtgagtagcaaccactggtttagagatcgtgcgtgcaggccaggtgaatcttttatgtataacaagggtgggttgagtcaaatagagtcaggtataagtggaaacagtttcattacctttggtagggaggccataactaataatttttaatgaccagtcgtgagctgcgattttaatgggattaaacttgaatatctccaaatatgtattaattacattcaattaatcattatgtgctagccattattttaaagactacatgtattaagtcactctcttaccaatagtgaagtaggcactattactggctctattttattgatggggacacaagtgtagggagattaaaggccttgcctaaagccaggcactctaccccaggtcctacacgcctcacccatctgccaggtgcctgggctttctactctcctactcacaattagtcccagcctcattctggcatcaggtggcaggtatatgactgtgggcagatggttggttacgattatgataattcattattacgacatctgggtgattgttttttaaattttgctgatctcatcttgtaggccttagaaattaaagtgctgtacaagtctgcctcagtttatgaaatagttggatcagagaggttgtaaacaaattgaatagaaagtgaagttcaaatggccagaatgcctttttttttttttaatttttttttgagatggagtctcgctctgtcacccaggccggagtgcagtggctcgatctcggctcactgcaacctcagcctccagagttgctaggattacaggcgtgagccaccacacccagctaatttttgtatttttagtagagacgaggtttcaccatgttggccaggctggtctcaaactcctgacctcaggtgatccacccgccttgacctcccaaagtgctgggattataggcatgagccaccgggcctggcccagaatgcctcttaaattttgcagtcaggccgggtgcagtggctcacacctgtaatcccagcactttgggaggctgaagcgaggatcgcttgtgcccaggagttcgaaaccagcctgggcaatgtggcaaaaccccgtctctacagaaaattagctgggcttggtggcgcatacctgtagtcccagctactggggaagctgaggtgacagaatcatctgagcccgggatgttgaggctgcagtgggccgagatcaaatcaccacactccaccagcctgggcaacagagactgtctcaaaaaaaataataataattttatagtcaatcttttaaagcaggtagtgtcatccagtatttttaaaaatctaaaaagcaaaaaagggatcttaagaaaacatctagtccaagttgctcattttacagatgaggaagtagaaccctggagagggacagtgacttagcctttgtgtttcttatcaattcaatcctattcaaaccacattcccatccagaaaagtgcttagaaggaagcgaagggcattgctatgaatttcaatttcaaattaagtacaaatttggatatcctttggtcaataaattggttatctagccaaagcctttctgaaattaataatatgctaacaggatatttgtttctggatgtttgcttaaagtgctcttgcagcagtggggcttctatttcacaatagcgaggctttatcttttgattaaaaattaacaggaaaaatattcttggattttccattgtaagtaagataaattcttaccctggagttgcctttattaatcataatatcaagacttatttgtctttgaaggcctgtgtgtcagggcagcgccacatctaggaggttaaatgtgacaaacgtttagtagtccacatagagccaagagcactaggctttgggctcctataaaagcccaagatgggaagccttaaactctgcttcttttctctgcctgtagccaggtcagcatggatccgcatcctttttatttgacaaggtaattacaagcgtggggcccaagctagaactgagacgctaaaaccctgcataaccaagaagctactaggtagtttgtagtttggggcagagtttgttcttccactaaaatcctgtctcctaaaataaaccaaaaattagaattaggggagttaaggaacttgtttgtcatattggaattaaagtgtccaaaattacatcgccacagaggttagatttacttcccctttcactcccacccccaccccgcaaaaagaagagggaaattcaattcatttctgcatttgagggaatctggcctttggaggagtttggtgtgtagttgccattacaaaagggaaagtgtcaggatggttttcatgtgtatttgtttttttaaacaaagaatgatattgttgacagaaatgtcacatttgttcattcagcgaacaccctgagtgcctaccaagtgccagatacttattgttgctcctgacagtggccaacacacctggatgtgttatcttggaattatgaacagattctgggtaacacaaagaaggggctggaagagttgagaaaatttcagagaagggaacatttgagttagggatagtaagtttttattaaatgaccacctaggctgtgtcacaaaagccagctggacatgccatctgctgccggggtagtggggggtggctaattaatgacaggctcctccagtgtattttcaaatgagctagcgccgagcctgttgagggcaagtggctgtaattcatcatgatcgttttctttttcagtttagaaacctgctgaagtggtatgctaaggagttcaaagacccactgctacaggagcccccagcctggtttaagtcctttctgttttgcgagcttgtgtttcagctgcctttctttcccattgcaacgtatgccttcctcaaaggttggtaaatggtgggaaaatcccatttttactcagaaatcaggtcccagaaatcttttgggaaagtatctccaaagggaaggggatggtccccatagtttgtgggagaatgctacaggatctggggtaaatagccagggtagatcttgtaaagggacattagtgtggctcaggctcatgtctgtggtcagcaggcctgcacggctgcctcagtcgtctggaaatcccttgcatacacatgaagcctgagaccacttaaacaatgagcttgttcccttttgttttgttccccaacagaattaatttctctttttgttggcttttatttctctgcgttggatagtatcatactgacttataagctgtagcatcaggctaatccctaatgtgcttctcattttaaaattattcttagtgttctcatataatcaatgcttttttaaaaaggtgaccatacacgtgtacttgataagctaaaaccactgaaaatgctcgtttcccattggcaccccctggggtcactgaatctgccttctgatcctctcacctatatataattactgaacaaacagatgccatggggcagggatttccctccccttggattttgtaccacacaggtttaaccggtaatggcagttttattgccctagagcttttccgagttatgttctgacccccattcttggttctttggcgagctgtcggtgagctgtcacgtaagtctgcatgttgggcagtgtggcacatccaggtttccagttccgagtttccacttggagaagggagtagaagaaagcaggcaggcagagacagtgggaaggtcatggacacctttgagtcatgaacagacctaaccatttttcttttcccctgactacctcaggaagctgcaagtggattcgaactcctgcaatcatctactctgttcacaccatgacaaccttaattccgatactctccacatttctgtttgaggatttctccaaagccagtggtttcaagggacaaagacctgagactttgcatgaacggttaacccttgtgtctgtctatgccccctacttactcatcccattcatacttttaattttcatgttgcggagcccctactacaagtatgaagagaaaagaaaaaaaaaatgaaggaaacaaccactggcccagggtagagatgcctacagggtggttgcttgttggatacaatacaaggaacactgctcagaacccacgtcttcagcagcatttgaaacactggcagcaatgcacaagagcaagatggtgtcaggaaccatgtcaaaccctcaccttcttccattttttttttttttttaagacagtctcactctgttgcccaggctggagtaaagggcagtggcatgatctcggctcactgcaacctccgcctcctgggctcaagccatcttccttagcctcccaagtagctagaactacaggtgtgtaccaacacgtatggctaatttgttttgttttttttgtgtgtgtggagacagggttttgccatgttgcccaggttggtctcgaacgcctaggctcaagtgatctgcccacctcagtctccctaagtgctgggattacagacgtgaaccactgggcccagcccaaaccttcaccttctaagggcactgggatgaacagaccgatcggcttgagggtgggcaaaggggtgtgggctaggttataaggaagtggtaccaaataactgtgtgcctgagttccaccgcaagattactaaaagcaggaccagaccagaaactgctaaagaacatggcctgtttgacatgttcatgagtcacctgacccacagcatatatgcttatgactaaaccctccactcctgattctcaagagtgtatcacctgtcagcaaaatgaatagtgggatattttgggccattttaaatgtgaaattttgcctctttaatgttaattcaaaactatatcaatgttttcttgttcccacctctaacccaaggaaaaaagagaaaacatactatgcaaaggaagtttaaacttaagttttccttaagggtcagcccaacaatgactttcagtcaaatggattaaactggaaaatgtttttgtttctgttgtaaacagatcatcctaggcgaaagttttttttgtttgtttgcttttaaattagtttatttctaaatcttagtcttccacatttctagaggccacctgacacaagtccctgtatctgaagtctagcatctcaaggctgatctggaagtgtgctagtatgctccctagtggataacttaatcttttaatacagttccgtcattcccatcttgttttcagaagagaaggtggctacagccaggcataacatatccactgtgtgcatagagggtctcttcacgttgatgcttggcattccatcagctttctctaagtctttgctcaagttcaaccttaaaatgatgttagacaacaggtcccagtcagttccctctattttcacccattttgctcacaagccatattggcccgattagtggtactgtctgactcacgtgtgtgatccaaataaaggtagctgctgacc

SEQ ID NO: 37673 - DNA, 35846 bp, Homo sapiens
cccgtccccggcgcggcccgcgcgctcctccgccgcctctcgcctgcgccatggccggccggtcccacccgggcccgctgcggccgctgctgccgctccttgtggtggccgcgtgcgtcctgcccggagccggcgggacatgcccggagcgcgcgctggagcggcgcgaggaggaggcgaacgtggtgctcaccgggacggtggaggagatcctcaacgtggacccggtgcagcacacgtactcctgcaaggtgcgcccacccggaccccggcctcccctcgcgacgcctgccgccccgccgggacccccgccccaggccgtgggaaccagccccggtcgctccgcagcccccgctccggctcccttggcgaccgccaagccccgggagggggggtcgccgggtcccgggaaactcgcgggcgccggggaaagttgctgcgccgccgccgtcctccgcccgccgccgcctccctcctcgcggagacaagtgcacctcgcccacggactgcggctgccgcgcgccctccctaccggccgagaaggagaggggcctggggagggggggcctttgcccgggcggggagcgggggctgggcctgggatccgcttgttcccctccccagaggcctttcccggggcgagaggggttggtcaggagagaaaaaggggcgcacagcctgagctcccaaccccgggagccaggtggggggtgccgcagtggtgcggggggggggcgtgcaggagcagagaggtgggcggggccgtcaccgggcctcgtgtgcttgggggcagggccggtgccccatcgcgctcctgcgggaaccggggctccccaccccggggaggggaagtttccctggtttctccttcaggtgcttctgggagcccccggggtaggtacgctgggacccccaccatcttctcctagtaggggctcgggggacccagagccggcgcccgtgtacccccaaaaccatctcctgggaccagaaatccactcatttccctccacggaggtggagaaggtggcagcttctttcagactggccggtgcgggctacagctgggctcccccgccggcccagtctcctccacagcggccagggcactttgccaggcccctgcaggattttcccgacttcctccccgctgctcctgggtgtggctggggtgggggaaggcgatgaaagccaccaggccctccccctgcctgggtcatctgcctcctggagcctactgttggggggcgtggaagaggctctgcctgcgcaactggagggggtccctgcggatgccgcagtcctgaggctcccagcaggggctgcgcagtggacaggccaaccattgtctctccccccatccggcagccccagccccccagatctgaggaaggggctgcttctcccggctttgttctcaggggagtgcgtgagtgcgtgggtccctgtccccgtgagggccgccaggtcggctgtagcctttaccacaggccaccgtcagagcagctgccctcagggccccaggagctgagaaggtggagggtggggcaccctgcactgcccaaacttgatttcgtggttcacaggctgccctgagtgcacagactgtagaagcccgaggaaggggcgtctcagcccagccacagggccaagctggccccttaccccaacgccccatccccctcctccactgcccaagcttgctgggaggtgggccctgagcactgggcaggtggggagaagtgtggaaggcaggcaccccaagccaggtgggcccccttcccaaattcggccttagctgatagggacgttattggagctggggtggctgaagttggttagacctgggggaggggatgtgttcacaggtgacgcatctctgagcgttcccgcatgggctgtggtggccagtgtgggcttcccccagcttccgcccagcgggctgactcagaggtctccccacatctctgcccagggcttgagtctactgtggacatttgccctaaacacctaaagcccccagtctagccccttccccaggagaggactaatgacacctaccgccatgtccaccccaggttcgggtctggcggtacttgaagggcaaagacctggtggcccgggagagcctgctggacggcggcaacaaggtggtgatcagcggctttggagaccccctcatctgtgacaaccaggtgtccactggggacaccaggatcttctttgtgaaccctgcacccccatacctgtggccagcccacaagaacgagctgatgctcaactccagcctcatgcggatcaccctgcggaacctggaggaggtggagttctgtgtggaaggtgcgtggtggggggctcgtgtgggggcctgtgggggtcagggcagtggccaagggggacaggttgcaggggtcgctgtgcggggtcctttcgtgctgtgccggaggctgcagcacacggtgtcttgtggtccaacctcattctctgcttctccgtccctggctccccagctgcatctccaagccctcacattagacatctttggccctggggcccaaggcaagtcccagccctgcaaacagatggcctcctgcctcctcccctcctcccagctctccatacttccttctggaggccccttctagggagaagctggacaggtgaatgtccccagctgttcaagcccctgtgttagcccagacctccgtctagacgggcccgcgtgtcgagcactcctcgccgtggagatcgggcgggagggcgaggctgtgcggcgagggcttctgcggatgtggagggtgtggcatttgccatcgtgaggtcttgcttgctgttcccatggctctgccgaagggccgaggagtggccctccctgaccccagcctggtgggggcagaaatcccatggcagcccccgcaggacaagtcccagttggggactgagatcgttggctggggaatgtggcagggaaaatataggaggtccctgtcgcccccacatcctgtctgctccctcatggctgcctgggaagggatgtgtcggtgggggggtctggagagtgcttcctcctcaaggcaacggtaagggtcctgacttcccgtctctccgatctgctccgttggccggcaggaaactttgctgccctgacactagcctggctcttgaggggtccttgtggggtcctggactgtccactgctcttgccttctctgtgcatgcctgggggctatgcagggggaggggcagcacccaaaataaggaacgctgcggccttttccccagcctgtggtcagtggtccccaagctgccttcagggtccagggcctcagtgcagcacagaggagggtcccctgggtcccccactgggaggacatgataaccttggtcctcttctgggcactcatggtctggggaaaagatgggggcatcgtggactcaggataggctgtcaggagctgaggaggggctggagaagggggttagggcgaggagaggttcctgtccctgcaagatcaggagagggggtcactaaccccacagccaggtgggtccagcccgagagtccgtgacttagtagctgaggacttgctctagggtcagagggcacatggcaggagagtcaccccggctgaacgaggctctgcatcttaccgaagccgctctacgggtgccaggcactggctctggagcgagtgcccaggcggagcagagcgctgggaggagggtccgtggggagcccctgccaggtgggtgtggcttagcccagctgtgggcagtcgcactcagggacgagctccaggtggggagcctgggacccacagccagtatgcagcttggggagcacccgggaggggctgtggccaccggaccccctggggtggggctggccaggggagggttagccagggaggactgtcatgggaggggccttgcaggtgagccaggggccaaggggagcctcaggagggaaacagcatgaggagtgggggagcccaggagcttccggtgggacatgtggagctctgctgtggaagtagaccagggatatctcgggtggctggggtccctggctgccgggacagggtaaatgcctcccagaagcctggggtgagccctgagggacaaggtctctggagccagtctggctggagaagggacaattctgtgtgcccacccctcccctcacactgggtggtgtgggaggtgggtccatctcctgctctgtaggagataaggacattgaaccccaccctgggccctctggtagccaaggcctcaccctagtgagggggatggatggagggagcttgagcctagctgacctctccccatctgactccgaccccacctcccagggcacaggatggcgtctgggcagcccctagtcttcagaagctacccctgagaccacagggtcccaccttgtatgggaaccccatcctggagacaaaggcccctccgagctccccaggtcggggagggccacgcccctcaccacccctgcccggacaccgcctgaggtgcacctgctgctgggccacacctggactcagctctactgaggacttcctttcctcagtttctcacctggccctgccagatcttcctggccctgcccagccaaggcccctcccccagtcaacaaccctcagaaaggctcctccccccttctctgcctagggagccacattcctggcataactaagacaggtatgtgtccctccctctgcgccacctttgggcgggggaggcccgctgctccctccggaaggagacccccgcccctgctttgtcagggaagtggcctggcctccgcagtgccagctgcccagggctggcggctgagcgggcgactcctccggccctcgccaccctgtcctgtctgggcactgcccatgccctcccagcccacctcacaaaggctggtcctagagcctccctgaagcccccaggagggactcctggctgagggccggccaggccgcccggggcccatccctccctgctaggagccaggagcagagaaagggagtgttgtctgcccctgccggggcctggcacagggacagggcagggggccagggtcagagtgagtctggcgccttcccagcccggccctgcccagctctgaagcccggggtcccggcggcctagtcccgggcccgcctgtattccggcgtgtgcaccctcccttcctccctgcctggccagctgcctaggcctcaggacggcagtcctaggggaagcccagagtcccacggcaccggggacagcatcggtgctggggttgaggggcccgacagccccagaccaggctcccctcagtgtggggcagtctaggagttgggggaggtttctgggatgcaggaggacctcccatagggctggggccagccccctctcctgcccagggctcagctcctgcccccaactcctccgcattcctgccaccctctcctgccccctcctgactccaggttctcatcctgccccctggttcccccacccccaccccatgagcccctctctggccctcccccaggcaggtctgggctcgaggctgctgccccaatctccctcctgcagctgggagggggtctgccgggtgggagggcggagggcctacctctgtccctccccactcacctctgtgtctccccacccaggggctcctggtaggaagttggggccccacctctgtttctcctggagctgggaggggggtctgccgggtgaagggcccacctctgtccatcccaaccccggggctcctggtgggaagtcggggctcggtgcttcccgcctgcgtgaatggacttgtcccgtctttgacttctcctgggcttgcccctgccttggcctgggggggggctttgctggctgaaaccaaagggagtgaggtggtgggaggggtaggggaatcgggttggtcagttctgtggagatgacctctttgagagggccgggctgagctggtggaaggaactcttggctttttccagaccccaccccactccctcactccccacccagagaacagccctggctccattgttcctgcagactagagagggaaggttgttttggaactgggctcgctcccgcttgtccacactggccgctctggtggggcctctgtgggtggtggtggggatggcacctgctgcagcctccaggccaaggtaggggagaaggaggttagggtgaggacaggttcctgtccctgcaagatcaggagagggaatcattagccccacagcctgcagaaggcgggatggggctgctccagggaagggggtgcccgtgcctcggggccacaggtccggccagaggtcattccagccaggcccatgcagcttccttcctgaagggctgactctgcccccatcactgcaggagggtggaaaacaactgcagaagcagacgccccacgcccagggctttgcttccacctgtgggacccaggtccacagccccaccagcggcctgggtggggcaggaacggaccccctccctgcagtcctggttctggcaccccctccccacttggactgggctccccagggcccccgaagcccagcggggctggggctgcagacggaaacaccgtggtggcctgcccacctcaggatggaaccccggggtcccaggaggtgcctgcccctcagagatgagaaaaaggaagtgcagggctgagatatcaccccatggacagtcgcccgctggaggaggaggctctgtacccctgcacctcctgcctgctgggtgagctgctgggagctgcactggggctcagagcagtcctgtgcgcccctcaggctgtggcaagattgtggctgggatctagggaatgaggcaggtctctagcggagcctgcagcactgagggaagcccccccgaaggggcctctccccccagcacagatcctgggaacttcctctgaggaaggccccctgccaggggcagctcacagcaggacctgggaaagggagacggcccctcccagccccctcctcctgcagtccccccacggagcagaggcgtgggagaaggggcgtgctgtgtcctacaggcagccggctgtttccagctgtgtggcctgcgtgtgtgcatgtgtttgtgtgtgtgtgtacacgcatgtgtgtgcacgtgcctgcagcctcagatgtaccagcctgtgcacttcagaattctgcctggagcctccactagtgggccatggttcttaccaccctatgtccctgggttcagcccgggctggtgctgcaggtgtgaggctggtggtgggtgaccctggcctgtccagggggcctcggagctgggctcttcctctgtcctcgtgcacgtgtctcgcctcagcttgctgttggttgtccactctcctgccccctgctcactgcgtccagcacgctgccccgtgtctggcaaagggcccaggaccttctgcaggtgctgcctctgagatgaccagtgtggtttctgaaggtttgagatgaaggcatgctgggtcccttggggcggcagtgaggacaggagagggtcctgggtcacagtccctcacatgcctgcgggacctcgagactgacacagatgcccacccctgcccagatgggactctgtctgggggcagcagggcagtctgggagtcagaccaggcctggtcagggtgggagcgggggtctgtcgctggcctgagcctccctgccccgccgtttggcagccaccttggccaccctcacactgggccctaggagaagcaagcccctgcgtgtccgcaggtgggaggctcccacgcaccccccgctggagaagcacaagcacaaacaccggcccacggccgccccggcccacagcagctggtggggaggggctgtgcccccttctctccccaggggaggctggggtgtgagcagggctcaccatgaccttcactgatttcatcatcagtgccttccccattcacacactcacggttggcacctccacggggcttcccagggaagccgggaaggagctgtgcattgaggggtgaaagcccgtgcagagaaccgtgggagaaagaggctgtggacacggggcggaagagagggctggggcgcagtcgtcagctgccgtgaccccacagctgggagcaagctgattcctgcctcggagctgccgtctcccctgctggccgttctctctcccgtggggaaacgccccccccccccccccgccctgcacctggctggcggcacctgtgggcactgaccactccacgccagctgttttccttggttggggttgggggcaccgagcgtttgggtggaccggaagtcagcgtctgcattcgagcctgtgtgcggtgcatgggccaagggcgcccacacccacgccaccctttccgaaggaaccgagccccagcccctcatgggccaagggcacccacagccacgccaccctttccgaaggaaccgagccccagcccctcgtgggccaagggcgcccacagccacgccaccctctcccaaggaaccgagccccagcccctcgtgggccaagggcgcccacagccacgccaccctctcccaaggaaccgagccccagcccctcgtgggccaagggcgcccacacccacgccaccctctccgaaggaaccgagccccagcccctcgtgggccaagggcgcccacacccacgccaccctttccgaaggaaccgagccccagcccctcgtgggccaagggcgcccacagccacgccaccctttccgaaggaaccgagccccagcccctcgtgggccaagggcgcccacacccacgccaccctttccgaaggaaccgagccccagcccctcgtgggccaagggcgcccacagccacgccaccctctcccaaggaaccgagccccagcccctcgtgggccaagggcgcccacacccacgccaccctctcccaaggaaccgagccccagcccctcgtgggccaagggcgcccacagccacgccaccctttccgaaggaaccgagccccagcccctctggggcctgccaattgccagagagccccagtgctccacccactccaggccccaacccccaccttctgagggcaggataagtacctgcgggtgcccaaccagagtgtgcctgtgtccacacgggaacatatgggtgggaggtgaggagaacgtgccttcccagtgtatgggtgggggttgagggacaaaattaatgttgcacaaagatatgggggatgcccaatatctatgcaggcaggtggggggatcagtgtctatgcaggcaggtgggggggacatcagtgtctatgcaggcaggtagggggagggggacatcccgtgtctatgagggcaggtggagggagagaattgaggctggggctggggtcagcagtggggctgaatggggcagagtgggggtcaaggagcaggggtggtgctgggcaggccaggaatacccattgtgtggccgtgtgtgtgtgtgcagtgcatggtgctgtgagatcagcatgtgtgtgtgtgtgtgcagtgcatggtgctgtgagatcagcatgtgtgtgtgtgtgtgcagtgcatggtgctgtgagatcatgtgtgtgtgcagtgcatggtgctgtgagatcagcgtgtgtgtgtgcagtgcatggtgctgtgagtgtgagatcgtgtgtgtgtatgcagtgcatggtgctgtgtgagatcagcgtgtgtgtgtgtgcagtgcatggtgctgtgagatcagcatgtgtgtgtgcagtgcatggtgctgtgagatcagtgtgtgtgtgtgtgcagtgcatggtgctgtgtgagatcagcatgtgtgtgtgtgtgcagcgcatggtgctgtgtgagatcagcatgtgtgtgtgtgtgtgcagtgcatggtgctgtgagatcagcatgtgtgtgtgcagtgcatggtgctgtgtgagatcagcatgtgtgtgtgtgtgcagtgcctggtgctgtgagatcagcatgtgtgtgtgtgtgtgcagtgcatggtgctgtgagatcagcatgtgtgtgtgtgtgtgtgcagtgcatggtgctgtgagatcagcatgtgtgtgtgcagtgcatggtgctgtgagatcagcgcgtgtgtgtgtgcagtgcatggtgctgtgagatcagcgtgtgtgtgtgtgcagtgcatggtgctgtgtgagatcagcatgtgtgtgtgtgcagtgcatggtgctgtgagatcagcgtgtgtgtgtgcagcgcatggtgctgtgtgagatcagcatgtgtgtgtgtgtgtgcagtgcatggtgctgtgagatcagcgtgtgtgtgtgtgcagtgcatggtgctgtgtgagatcagcatgtgtgtgtgtgcagtgcatggtgctgtgagatcagcgtgtgtgtgcagcgcatggtgctgtgtgagatcagcgtgtgtgtgtgcagcgcatggtgctgagagatcagcatgtgtgtgtgcagtgcatggtgctgtgagatcagcgtgtgtgtgtgtgcagtgcatggtgctgagtgtgagatcagcatgtgtgtgtgtgcagtgcatggtgctgtgagatcagtgtgtgtgtgtgcagtgcatggtgctgtgtgagatcagcatgtgtgtgtgtgtgtgtgcagcgcatggtgctgtgagatcagcatgtgtgtgtgtgtgtgtgtgcagtgcatggtgctgtgagatcagcatgtgtgtgtgcagtgcatggtgctgtgagatcagcgtgtgtgtgtgtgcagtgcatggtgctgtgtgagatcagcatgtgtgtgtgtgcagtgcatggtgctgtgagatcagcgtgtgtgtgtgtgcagtgcatggtgctgtgtgagatcagcatgtgtgtgtgtgtgcagtgcatggtgctgagtgtgagatcagcatgtgtgtgtgcagtgcatggtgctgtgagtgtatcagcatgtgtgtgtgtgcagtgcatggtgctgtgagtgtgattgtgtgtgtgtgtgtgcggtgcatggtgctgtgtgagatgtgtgtgtgtgcagtgcatggtgctgtgtgagattgtgtgtgtgcagtgcatggtgctgagtgtgagatcagcatgtgtgtgtgcagtgcatggtgctgtgagtgtatcagcatgtctgtgtgtgtgcagtgcatggtgctgagtgtgagatcagcatgtgtgtgtatgtgtgtgcggtgcatggtgctgtgagtgtgagatcagggaccagggggctagtactctttcctgcacatgagcctgcgtgggctggtcagggctgaatgattttgtctgaagatcccaaaatagctcatgtcgcctgagctccctccctggctgggcctggggcctcaatggccctttgtctttctgaaggcatctgggcctctgtggggggctcagacactgactggggctgggtggggccaggctgcctgcctggttccccttcccctggcccagcccaaggggccctaagcctcattccagtgtcggcctggggcagccaggccccccacgtgactttcagcttgttgggccccctttgctggcagatcccagggtctctctgtgtgggggcaaacttcccaggcagtgtttgaggccccctctgccagcccgtacctggggctcccccacccctcccacattgtggtacctgtcctcctcctgcagagcccgcccagagatcccatggctgaaggtggtggcagcaggcgggctggcgcgtgacctggtagcacggcctgggtttgaccctggcactgcccctgggactcagagctgggaggtgagaaatggggaatgcatgtgaaccacctgcctctgcacacagcaagtcctgttctgggttttctcatccctgggtcacaccctgcgctggggagataaaaagtcagaccctgcccggggcacccacagtcagcaccgccggaacactgtcagcctggtgtggacagtgccaaggtccagcagggtggggtggttggggtaggagctcccctgaggagagagtgaggccagcaggggtgggtctccaagtgcttcctttgacagctgctctggatgggacgtggcttggggtgggtgagaacccttggctgagtttggattttcctgcagggtttcattggaacaccaggttccagggccgtagagatgtggaggcctcctgtctgggtgatggggcatggtgctggtccctggctgtggggtggaaaggagtcccaagagagggagctggcaagacaggaccttcccagctaaggtggggttggtgggatttggctggggcccttggaggagcctgaccaggaggtgagacagggcacctggaaggaaggaggcgttggggagagtccagatggaggccatggggttgaggggcccagacacccggctgggggactccaggaaggcagcaggtgtgggcagtgggtcctctggggtggactgaggtgaggcctgggtgtgaccacgcggtggcactggtggctgccggcagctgtcgtctgcagagtgggtgagaccgagtgtggcagatggcttggtccgcggtgctggaggggactggcggagcagaagcgccctggcgccgggtccttgctttcctggagctggggcttggggaatggggtcggtcattgcagggacagaggagagggcagggtaatgggtgcgcaggggtcccttccaaaggctgcgggtggccaggggtgtgcgggggcgctgaggtgcggtcgccgagagattctggcctccagggtggtcgggcctggcatggactctaggggatggtgcacacaccggaccggacgggcccctcccttacccccggatcccccggctgggcagcggccagggagaggggcgacctacgggggcgggtgtggggacgccggactacgcgtcaggagtcccagatgggcccagacccccattccccgccccgggccgcagtgacgtcagggcccggacgttcccggaacggcctcttgggggcgttccagccccacggacccgcagggagtccccgccgcaatttgcatggggctcatttgcatgaccccgccccgcgcgggagtcgggggcgccggcgactggaggagccactgtcaatccccaggggaaagtgggcgaggcgatttctgggccgctcacctcactccaccctccagctcgcgccgcacctggggccctcccccacctacgccccgccagggcggggccgcgggcgcagacactcgcgggcacacgcacgacgacgcgcacacgcggtcgcacgcggccccccgagccccctgcggcgactccgattcacccccgcgggtgcggggcgcggacccgcccggcccagctcctgctccccaggcgcttcctcctcccgcgacctgccccggccgcacccgcctccgctccagcacgcgacgctgcccggcgcgacccctgctcccccggcccagccccaccgctgccctcgactcaatcccagttgaacgcccgcagcctcagtcccacccccggcccagccccagcgcccccagtcccacccccggccccagcttcagcctcagcgcccccaggcccagccccagtcccacccccagtcccaacaccttcaggcccaccctcggccccagcctcagccaccccagccccagtcccggcccagccccagccccagcgctcccggccccgggcccagccccagccccagccccagccgagcacccccggccccgcctgcccggcgttcccttttgtgcggcgctctcccgtccgcatccgcccgatcctctggaactccccgcggacgccggggtccctggaggcggcttcctttgtctctgctcccgccctccctccgcggcgtcttcgcccctcactcacctccccagccccgcggggacgaggggagctggagggagcccgggacccggcgcggcctccgcaggcggcgctttcttctcgctcccgacgcggccgcccctcctgcctgcccgctcctatcgccgcttccgcctctgccggggacggggacagcagaccctcggcgcccggcccccgcgcacctgccgcgcgcaccgcctctccggcctgcgcggctccgggggctccgggaagaccgagcgctggcggccagcccggggaggctgtgggcagcaggggtggctgcgggctcccagtccctcctccgcctacctcggagcccacatttgggatttctactccgggagaattctgccctcctcccacgatgagcctggaggactggagccgggacctggcacccccagggctgtgactgggtgaactctgagggcacagctgctgtccgccgccccaggggtcccaggatggggcgagcagccctgaagaggcccaagggcaccccgtgaggagcccccacgctctgagagtggggcgcagagccggagccccgggccatgcctccgctgccgctggcgcgggacacccggcagccgcctggcgcctccctgctggtgcgaggcttcatggtgccctgcaacgcctgcctgatcctgctggccaccgccacgctcggcttcgcggtgctgctgttcctcaacaactgtaggtggccgcgggcggggcgtcgcactggccaagccccaaccccgaggcccctgcacatagaggctggaggccgcggcgggtccgcggggctcccggcagcttcccggggatgggatgggtcactctgcggacccctcggtccctggaggccgtccttgggctctcagtgggcctggccctcacccaaagctgcagaaacactttctgcgggagctggggagggaggggcagccggctacactgagagccggcagttgggggtagggcaggacctgcggtggactcttccagggaagggggtcctgcctgcacccctgtggctggggccccatctgacaggggtcaggccatgactatttggctggaggggcagagaaaagcaggggcctctgtctcagacctcagccagcccatggggtcagggctggacccttcagcagcctggatccctggggctagcggtgggggggggggggtgggcaggggtgcccctttccaggctgggcaaagggatgggacagggaggagcctgctcagaggagcctaacttggggatttgttttcttccagataaacccgggacccacttcactccagtgcctccgacgcctcctgatggtgagtagggctgagttcgggggacctggatgggctgtggcactcttgggagtcaggggccatttggaggtgtgcacccagacgtgtggagtgtgtctggagtgaggaggaggctggacaagggcacctgcgtctgtcctgggagtccgcagcggtgggccgcagtaggaactcggggtctagaggccgccgcctgacggcactggacctcggctctcacttctctgggcctcagccccctcagcctcaaaactgggaacaagtcctgggacccacaggttgtgaggtgatgtcagacctgtagggcagggccagagtccggtcagggggctccgctctattgtcctcccttctccctgttcagcaaggggtggggctggacagaggctggaagtggacaggagcttgcagggaaggctgagctgggggagggccctgacctgatcagtgacagctgtctggggaggggcctggagggcggcagtctgtccctgggactctgcaggctgtcatggggggacacaagtgatggagggggcgggctgaccttgttgacctgctttgtgaggtggggcctgtcctccccggggtgctcctggtgtttgggccactgtcatcggggtggtgtgagggtgtgaggggaagagaggaagtggtcagctttgcagaggaacacagacggggggaccggtggctccctcgccaggcctggggtcctttccagcaggtggggaaggagcacctgccccatcactgggtctcacttgcgttcagttgtgtgtgcagggctgtctgtgagggctgtgctgaggccttcctgaccagcacatggggtgggaaggacgacctggggaatcctgaagtgatctgaagacagagccctgggctggatagatcgtctcggccactttccaggtcttgggagtgggggatgatggctggaggaggtggccaggccttggcagggggccctgtgatgcccgcctgtgctgagaggtgggggcagcttgggatgctcagtggtctgaaagatagggtggggtcttccctcggagtgtggagtttaggcacctgggaaccggagctggattcaggggtgtgagatggaggccctctgcttcctcgaccgcctgccaggctggggtgacctgtagtcagctgtgctttgctcctgaagccgcacaccagcaagtgggcagtggttctcccacacttggctactcaactcctggtcccagggactctggcctggggcagcgctgggcctggggtgaggagctgggcagcgggaatggggaatggtggctgtgggaacccgtcctacccctgggctctagccctgcaacctgtctgttggcccccagcccctgatggccctccaacacccgccccccaaccccaccaggctgttcctatgagatcccaaaggctcctcagagcaccaggcttctcttggactgtggggagaggagaccggtctgcgtggccaaggtgattgaggcctctgaggggcctcatgccggtggggttgctgtcccccttcctgagactcaggagccctgtgggtcagggcagcacagcaccatgggtggtttgtgacctgaggcatttgaggggacacgggttgcaggggcctgcaacaggctgggagagcaggtaggtgagcagctggcttgtcctggaagaccctctccctcctggcagccccaggactgggggcaggagggtatggactcagagaaggacccgagtcttgcaggaaggggcctgaaccctcccagtgggctgggtcctggggaggagacaggtctatgcaggtctatgctggtggctggggccgggcagggccagggcaagaactgcgtttccaccacctgtgagccagaggcctggagccaactggatttaaagaggtgctcaggtgggaggtcccctctcttagcatcctcagcctcgtttcctgacacccagaaggctggggagtgtctccttttctttacacactgcccccttcacctggccacagcccaccctgccacagagtcacggagggctccacaccaaggccatcgtgacccacatgccacctaactgtggtcatagttacgggccagagctcacagcagggctggggcatcctctccatcccccagcctacccaggaccaggaagggagttaaatatacccgctcctataaaaagcactgccgcctccagcgttgcacacagtgggaggacccgtcacgctgcgggagagtgggtggggaggccgagtggccggggaggggctcctgcaggaggtggagctaagacaggcgtggcaggacccccaaaaatgacccatcgggaacacagggctctcagggtcctaggtgtgtcacctgcatctatgaggggccatgtgggcaggtgaccggagcacagatgtgtctgagcccagtgctggcatttctagcagtgtggccttgtcaggtggcctaccttcctcctgccagctggcaggggagacatctcggggcgtggctgctgcaatgcgctgtgcctggcgggtacgtgcgtgtgtgccatcaccacgtgcacctgtcttcaggtgatctcgtgtggagcctctatgatcccctaggcctgtggagactcagcacagtggtgggagcggcccctcacctaagcccgcagtgtgagcggagaatgggggggtggggcttcccggaggccgtgattcctgagctcactcttgaggggcagatgtgtttccagcctggatggggataggagggagggaccagcactgtgacctttaaaccctgggctggccggcagtgtcacaccatcaaatgctgtgagggagatccacccccactccacagctggggccacattccaagaggagcggactctctgaggccctggaggcagaggggaaggggccaggacctggccctgcacaccagatggggatggggagccagtgctcagcctggcttcaaggtcccgccaggtacccaaggtctctccactgccctgccacattggtccagcagctggtcactcagagcctgtccctaaggtacctctaggctcccatcccagagcttgctctccatgcccctgcaagcagtccagccccgctcaccctggtgagctgccatcatcaccttcttccccaaggctctgtcttgggacgtagcaggacctcgggctggactatggagggagctgcgggtcctggtggatgaggagcatgcccgccatccaggaacagtgcccttggccatggtgtcagggccttgggagaggtctggctgagccaaggtgaccaaaaggggagaaaggctcaggagccctggtgcagggaggtgactgggtccttggccatggggttgggacctggggggaaccattggtccacaggtccagccgaagcccaggagaacagctggctgggcatcagcaggtgcccgttggatttggactgggagtcccagggccttggacaaggcagggccaaagggagagggagatgctgaggggagagagaaggggaaccagaagggaagtgaaagggccaggggtgcatgtggtttgagtttgatttgagccaggacgggggaaggccagtggtgatgacagccctcatgactatacttacagtggcagcagacgggccacatagcgctgtgtgctgggcaccctctaagctttgcagatactggcccatttaaccccacaatcctgggaggtaggtcctattgctcctattcaccgaaggggatactgaggcccaggcaggtgataacctgcccacattctcacagtgggtaatgcagagctgagcagcctggctgtaagacctgaggtgggagagtagcagaagaggggtgggggcacagccaaggtttggggaggaagacagggatctggtggggggagcatgggtaggttgcagggatggcaggcggatggccctcactcagccttctggggtgggggcagggacacccagacagacagcgccagagcctggggtgggctgttgctatagcaacagctggctccagctcccagtgcacccaccctccttggagatggggggggttcctcctgccccatttcacgagcctgctgggaagtgatgggtggtagccacccctctgacatgacttattaatgataattggacccaattaaacatttattaaatccagacagctgcagccgctaacggacccttccctgatcctgggtgggccatgctgggggtgggggtgctcaggatgggctgccgcaggggctctgggttttaacgtgcctgaggcagctttgttggccacgttgaggtctggtgatgggacgtgtgtcaggcgctgtggtctgcagctgtaagaactaaaatgagcaacagttcctgcacctctccaagaaggaagttcgctttgacagagagtgagggcgatggaggaggcaagagtgaggtggggggccgggggatgcccagggaggagggggcgtgtgggtgccccagggatcccagggagcgatgggaggctgcagaagggcacaggcctgccgcgggtggggggctggccagggagaataggagatagtagaggcggaggccaggaatttgcacttctccagggaagctggggaagagttggggagagggaggcaagaagattccccacccatcttaggcgcagggagcggtcagggaggcgccagaggtgggccagagctgtgacctggcctcacaccccgtcccggtggggctctcaggcccctgagggccagacgcgggacctgggtgcgacccgggcgggaggcggcagggctcagctgtgctggacgctgcagcagcgcgggaaggggctcccccggctccatggggtgaatcggtgaggggctccggtgccgatgtggaaggagctcctgagcagaactggggcctggactgcttgtgcccgagttggtttcgaggcgtctctgcttttcgctggaggcccacgaggtgggtgggaagtgggtgctcgcccgtcgcagaaacagagtcgggtgccgcctgcggcagacgcccctctccgcgcctgcaggtgcggggtgggggagaaaggtcatccctggagaggcccggggctggcgggaatcctcggcgggcggggtctgcgaggggcagggccggtcctgtgagcgcacgcacgcgtgtccgtgtccgtggtggacccccgatgcggcgcgggggcgggtgaatgcgcgggctgcgagcacggcaaggtctctcaggcttgtggacgtgggtacgggcgtctcggcaccctgagctttctcccctacccgccccagcgtgccggggaatgctgtgcggcttcggcgccgtgtgcgagcccaacgcggaggggccgggccgggcgtcctgcgtctgcaagaagagcccgtgccccagcgtggtggcgcctgtgtgtgggtcggacgcctccacctacagcaacgaatgcgagctgcagcgggcgcagtgcagccagcagcgccgcatccgcctgctcagccgcgggccgtgcggtgagcggggcggggccggtgcctggggcggggaggggcggggcctatgagatggagcgaggctgggaggggcttcggggccagtggggcgggggcaggggcggggcccggcggggaggagcggggctgggaggggcctggggggcggagcgggggagggggcggcccgtctgaccggcaaagccccgcccgcaggctcgcgggacccctgctccaacgtgacctgcagcttcggcagcacctgtgcgcgctcggccgacgggctgacggcctcgtgcctgtgccccgcgacctgccgtggcgcccccgaggggaccgtctgcggcagcgacggcgccgactaccccggcgagtgccagctcctgcgccgcgcctgcgcccgccaggagaatgtcttcaagaagttcgacggcccttgtggtgagcgcggcggcgggcgcacggctcgagctctgtgggcgcgcggcgacagcgtcctgactcctgccctcgacccccagacccctgtcagggcgccctccctgacccgagccgcagctgccgtgtgaacccgcgcacgcggcgccctgagatgctcctacggcccgagagctgccctgcccggcaggcgccagtgtgtggggacgacggagtcacctacgaaaacgactgtgtcatgggccgatcgggggccgcccggggtctcctcctgcagaaagtgcgctccggccagtgccagggtcgaggtgagcggctcccccgggggagggctccggccagtgccagggtcgaggtgggcggctcccccgggggagggctgcggccagtgccagggtcgaggtgggcggctcccctctgggagggccgcctgctcccctgctccctgcacatcccagggcagggatggagggtgctccagcctctccgtgactccctcacccctgcgtcctagaccagtgcccggagccctgccggttcaatgccgtgtgcctgtcccgccgtggccgtccccgctgctcctgcgaccgcgtcacctgtgacggggcctacaggcccgtgtgtgcccaggacgggcgcacgtatgacagtgattgctggcggcagcaggctgagtgccggcagcagcgtgccatccccagcaagcaccagggcccgtgtggtgagcgccccggggtggaggccaggcggggtgggctgctcctgcgtcagtccctgcctggacatcacatgccatcttcatccatcatgttcctcttggggtcctgggagtgggccggtccctctgggaaggctctggggagggtggagcctgtgtgcggagggtacctggatacctgggggctggtgaggcagaggcggggccttgtccaggctccctggtccctgacctcagccacgccctccctgggagtcctctggcctgtccgcatgtctccacgctgtaagcacaggctgttggggtgggcaggctggacacaacaccagggtcctcactcttgggacatgggcagccgtcggccgttttggaggcagtgtcaggacttgaagggccagggggaggcagtggccgtcgtgtcccgtcgtgttcgtcttggtcagttcgcccatcttctggtctttctctctgcgtctgtctcttctctttggtctcttcttccctgtcggctccgcctcttgtgtcttccagcctgacctgctggcaggatgaggtgccgtgcctgccctccaggagcccgcagcccgaggtctgcccctggtgcggcagggggggtggcttgctgctgcctggccttgtggtcctcagagcaagtggacagacacctcctcccccgtgcagccctgggtgtgactctgggggtgcaggctcctcccacccacagagagcccccccacatgcatgggtgtcctggggatgctggtggtcaggggtcagtggcctgggcaggctggggaagcctggccctcccatagcctgctgtggacaatcaggaagccccaagcttgggggcagcctcgcccgcagccaccggggactcctgggtgtgtgttccgctcgcctctgccgcgtgtctgtccctttctctgccgtgtctgctgtgcatctggcccttctcctgtgttctctcttcctccaccatcccctccctggaagagggactgctgcgtggggctgggggctttgcctgcagcggagggggggcttgtgggaccactgagcccctgtgtccttcccagaccaggccccgtccccatgcctcggggtgcagtgtgcatttggggcgacgtgtgctgtgaagaacgggcaggcagcgtgtgaatgcctgcaggcgtgctcgagcctctacgatcctgtgtgcggcagcgacggcgtcacatacggcagcgcgtgcgagctggaggccacggcctgtaccctcgggcgggagatccaggtggcgcgcaaaggaccctgtggtcagtggcgggtgaggggtctggtgggggtcggggagagagaggttcctggtcgcctggtgatggaagctcctccccagaccgctgcgggcagtgccgctttggagccctgtgcgaggccgagaccgggcgctgcgtgtgcccctctgaatgcgtggctttggcccagcccgtgtgtggctccgacgggcacacgtaccccagcgagtgcatgctgcacgtgcacgcctgcacacaccagatcagcctgcacgtggcctcagctggaccctgtggtgagtgaggccctggggccgggcgggccagggtcctgtgcctccctcagcctgggcctgccgacccctgcctggctctgtctcctgcagagacctgtggagatgccgtgtgtgcttttggggctgtgtgctccgcagggcagtgtgtgtgtccccggtgtgagcaccccccgcccggccccgtgtgtggcagcgacggtgtcacctacggcagtgcctgcgagctacgggaagccgcctgcctccagcagacacagatcgaggaggcccgggcagggccgtgcgagcagggtaggccgggggacgctggcgaaaactgctgggctctggctttggacaagaagcccctgggtgactctgctccccttccccgcagccgagtgcggttccggaggctctggctctggggaggacggtgactgtgagcaggagctgtgccggcagcgcggtggcatctgggacgaggactcggaggacgggccgtgtgtctgtgacttcagctgccagagtgtcccaggcagcccggtgagctctgtacccctggctctcggcgggcggcggggacggggctgcggccgctcacactgacaccaccctccaggtgtgcggctcagatggggtcacctacagcaccgagtgtgagctgaagaaggccaggtgtgagtcacagcgagggctctacgtagcggcccagggagcctgccgaggtgagccggctgcacgtggggtctcaggcacaggcggggcggcgtctgggtttccgtgtctggatgtgggcgtgcccgtgtgctgcgttgggcccctgtggacgtgtgtattgtgttgtaagtgagcatcgtccagtgttggtgcctgtgcacatttgtgcagctgcgtgtgtgggcgtgtgtgtccatcagtcagtgggcgtgcaccaggccaggcctcagtgctgagaggcagcgtgaaccatgcggggccccaccgtgtgggcactttctctgcatacgtccatccggtcgatgtatcacatcaattaggtaaaagtggtgcccggtgtgtgtgatgcgcgtgcacagatgtgtgtctgcagaggggcgttaactgtacggtttggaggaatgtgggtgagaacgcatgctgacgtcttcagatgtctgtttctcgatttgcaaggaagctcgcgtgtgtgtgtgcacagagctgcgtgtccgtgatctttggatgctctgtgtgttgtgtgttcctggatctgcatttacagacatgttcttgcgtaagatgtgggagcctcacctgtgtcctcagccccaggctcccgggctcctctgggagctgggatcgggacggctgagtggtgacagtgggggtaggtggaggcagactggctgggtccagggtgggtgtccagcactgcatgaaatctgagtcccgtaccctttcctgcaggccccaccttcgccccgctgccgcctgtggcccccttacactgtgcccagacgccctacggctgctgccaggacaatatcaccgcagcccggggcgtgggcctggctggctgccccagtgagtacctgagctcagccccgaccccgggcctggtgcggctgtgcggccacgtgaccttgtcctgccctggcctttcaggtgcctgccagtgcaacccccatggctcttacggcggcacctgtgacccagccacaggccagtgctcctgccgcccaggtgtggggggcctcaggtgtgaccgctgtgagcctggcttctggaactttcgaggcatcgtcaccgatggccggagtggctgtacacgtgagtgacagggcccaggactggccaccggctatgccctcctacctgttcacccccatcactgtgcttctcctcacctgcccaggccctggcctgacccacacctggctgggggctgggcagagccagggttggggaccaggctctggaggaggtggggaagcccgtccaggtgcggacatcacgttcctccccgattttccccaaagcctgcagctgtgatccccaaggcgccgtgcgggatgactgtgagcagatgacggggctgtgctcgtgtaagcccggggtggctggacccaagtgtgggcagtgtccagacggccgtgccctgggccccgcgggctgtgaagctggtgagtgagggccagcgctaccctggggcttcatggggtggggtggggtcacccgagccacagaggtttcccatgcccgtgccccagacgcttctgcgcctgcgacctgtgcggagatgcgctgtgagttcggtgcgcggtgcgtggaggagtctggctcagcccactgtgtctgcccgatgctcacctgtccagaggccaacgctaccaaggtgaggggtgtgggatgtgaaggggagtggggaggaggcctcgccttgaacatccttgttctctgccccaggtctgtgggtcagatggagtcacatacggcaacgagtgtcagctgaagaccatcgcctgccgccagggcctgcaaatctctatccagagcctgggcccgtgccagggtgaggcctgacggccactgccccagaactgaccaggaaggcctgacgctgccctaaatccagccccacccgccctgagccacctgaccctgtcccaaccggtccccccgccaacctccctctccttgcagaggctgttgctcccagcactcacccgacatctgcctccgtgactgtgaccaccccagggctcctcctgagccaggcactgccggccccccccggcgccctccccctggctcccagcagtaccgcacacagccagaccacccctccgccctcatcacgacctcggaccactgccagcgtccccaggaccaccgtgtggcccgtgctgacggtgccccccacggcaccctcccctgcacccagcctggtggcgtccgcctttggtgaatctggcagcactgatggaagcagcgatgaggaactgagcggggaccaggaggccagtgggggtggctctgggggtgagcagggatcaaggacttggggtgggtgggcaggcgccgagaggctccaccagagcctgggctcagagcgcgtctccccagggctcgagcccttggagggcagcagcgtggccacccctgggccacctgtcgagagggcttcctgctacaactccgcgttgggctgctgctctgatgggaagacgccctcgctggacgcagagggctccaactgccccggtgagtggacggctgggcgaggggagtgtgaggatagcctgggctcggccgaggtgctgccccctcgcctgggcagcaggtcagtgccgggggttatggtcttgggactcggccccctcaaacatgtgcgtgccggggaccccacgcctaacccgtctctctcgttgcaagccggtgtggcacactgctctgaggagtcctcctggtaaccgacaccagccccaccctggggtccccactaacctcatgaccatctgactaacatccaccttcccttgcacccttgtggcttgctgctggggcctgtgcctgggccagcctggatgccaggcagatgccaggcagggcctcactgtacctcccccacagccaccaaggtgttccagggcgtcctggagctggagggcgtcgagggccaggagctgttctacacgcccgagatggctgaccccaagtcagaactgttcggggagacagccaggagcattgagagcaccgtaagacgggggcgcagcccccacctacccactggccttcctccccagatacccagagcagcaccagggcagcccggcttgggcggccccccaagtccttgcctactccctgccacagctggacgacctcttccggaattcagacgtcaagaaggattttcggagtgtccgcttgcgggacctggggcccggcaaatccgtccgcgccattgtggatgtgcactttgaccccagtgagacctgcaccctggacccttcctgggaggcaatgggtgggggatgcctggggctctgccatgctcagagctccctcctccccagccacagccttcagggcacccgacgtggcccgggccctgctccggcagatccaggtgtccaggcgccggtccttgggggtgaggcggccgctgcaggagcacgtgcgatttatggactttggtgagcgccaggccacgagccacagcttacctgccccctcctctgcccatgcccctgcccctcaccccttcctggccctgctcccaggaaaccctaacagctccctgtgccggcagactggtttcctgcgtttatcacgggggccacgtcaggagccattgctgcgggagccacggccagagccaccactgcatcgcgcctgccgtcctctgctgtgacccctcgggccccgcaccccagtcacacaagccagcccgttgccaagaccacggcagcccccaccacacgtcggccccccaccactgcccccagccgtgtgcccggacgtcggcccccggccccccagcagcctccaaagccctgtgactcacagccctgcttccacggggggacctgccaggactgggcattgggcgggggcttcacctgcagctgcccggcaggcaggggaggcgccgtctgtgagaagggtaaggatgtccactgcagaggagggcggggaggcagcagggtgggggcaaggattgggggtggggctaagccaccatcaggctttgagttgggggcaggagcccggattaaggcggggtttcggccagatgcggtggctcacgcctgtaatcccagcactttgggaggccgaggcaggcggatcacctgaggtcgggagttcgagaccagcctgaccaacatggagacactctgtctctactaaaaatacaaaattagccgggcgtggtggtgggcgcctgtaatcccacctcgtgaggctgaggcaggagaatcgcttgaacctggcaggcggaggttgcggtgagccaggatcgcgccactgcactccagccggggcaaaaagagcaaaactccgtctcaaaaaaaaaaaaaaaaaaaaaagcagggggcggtttcagggataaaagtggggaatcctcggagcttttccagccggccctcccggtcgccctttgcagtgcttggcgcccctgtgccggccttcgagggccgctccttcctggccttccccactctccgcgcctaccacacgctgcgcctggcactggaattccgggcgctggagcctcaggggctgctgctgtacaatggcaacgcccggggcaaggacttcctggcattggcgctgctagatggccgcgtgcagctcaggtgggcggggaggggacggggccggggcagctcaggtgggcggggaggggacgggcgggggagggggggccggggcagctcaggtgggtggggtggggacgggggcggggcagctcaggtaggcggggtggggacggggccgggcgatggtcctgagcacctgctcctgccctcaggtttgacacaggttcggggccggcggtgctgaccagtgccgtgccggtagagccgggccagtggcaccgcctggagctgtcccggcactggcgccggggcaccctctcggtggatggtgagacccctgttctgggcgagagtcccagtggcaccgacggcctcaacctggacacagacctctttgtgggcggcgtacccgaggaccaggctgccgtgtgagtcccttggagggtggtgtggccccgaccccggccctttggggtcccggtgtacgaggtggctttgcctgtggcccctgagccctgacccggtgtccctcctggtggcagggcgctggagcggaccttcgtgggcgccggcctgagggggtgcatccgtttgctggacgtcaacaaccagcgcctggagcttggcattgggccgggggctgccacccgaggctctggcgtgggcgagtgcggggaccacccctgcctgcccaacccctgccatggcggggccccatgccagaacctggaggctggaaggttccattgccagtgcccgcccggccgcgtcggtgagggtggggccggggcgggtgggagtgggaccccggggcctgtgggcggtacccaaccgacgcctcctgggacctcggtcccggtcccgtcttcctccatccaggaccaacctgtgccgatgagaagagcccctgccagcccaacccctgccatggggcggcgccctgccgtgtgctgcccgagggtggtgctcagtgcgagtgccccctggggcgtgagggcaccttctgccagacaggtcgggggcgtggggctctcggggcagggggggggggggggttgaacgtttgggcgggtacaggttccaggtagcattgcagttaggatgcggctcagtctagtctgggttttgagttaggatccacacacggctggcatggggtgcaggaggccccgggggtcaggactgaggccttggtgactctccctacagcctcggggcaggacggctctgggcccttcctggctgacttcaacggcttctcccacctggagctgagaggcctgcacacctttgcacgggacctggggtcggtggggcaggagcagggggaagggccggcccccacctccgtctctcctgtggggaggggacagcaaagacaccccgactccccatgaccccagggagaagatggcgctggaggtcgtgttcctggcacgaggccccagcggcctcctgctctacaacgggcagaagacggacggcaagggggacttcgtgtcgctggcactgcgggaccgccgcctggagttccgctacgacctgggcaagggggcagcggtcatcaggtgggccggcaagggtggctctgggaggcctggggcactggcccggggccggggcaccagcaggtcgctcaggccctgggtggtcgcgtggccggtggtggacagagcccactcacgctgcccctcctcaccaggagcagggagccagtcaccctgggagcctggaccagggtctcactggagcgaaacggccgcaagggtgccctgcgtgtgggcgacggcccccgtgtgttgggggagtccccggtgagtgctctgggccgcgaggggactcccgctgctgcctgctcttcctcctcgggcggcagccccgcccctgccggcgctcacggagctgtttttctgtcctgttctcttggccgcctgccctgtcctctgcctcctctgcctccctgctctctgctctcgctctgcaaccccacccgctcttcggaggccagaaatcccgcaaggtactgtcggcctctcatccgctcaccgtctctggcgcctcaacccctagggtagctcctcccccactaaggaccctgccatttctgtgtgattaacgctgccccctagataggcaatgggcgggtggggcgggtgcgtgcaggtgcctgggccctgggtctgcaccgtgggtgggctctgcacagccacttacctggcgtccccgcaggttccgcacaccgtcctcaacctgaaggagccgctctacgtagggggcgctcccgacttcagcaagctggcccgtgctgctgccgtgtcctctggcttcgacggtgccatccagctggtatgtgggggcggggcgtcccagcagggcctccggggcgggcggggtggcaggcgggacaaggccctcaccctgccctgcaggtctccctcggaggccgccagctgctgaccccggagcacgtgctgcggcaggtggacgtcacgtcctttgcaggtcacccctgcacccgggcctcaggccacccctgcctcaatggggcctcctgcgtcccgagggaggctgcctatgtgtgcctgtgtcccgggggattctcaggaccgcactgcgagaagggtgagcctggcacagggcagggggcggaggccggatgggcccggagcccacgaggccccaccctcacctgcctatctcacagggctggtggagaagtcagcgggggacgtggataccttggcctttgacgggcggacctttgtcgagtacctcaacgctgtgaccgagaggtaacgtgccatcctctgctggctgtcggttccatctgtgccctcggggcgggacaccggacccccacaccaggagggcccaggaggggacggcccggtgctgccacctctgtcctcccgcctctctctcacctcccggtcctcccgcctctcactgtctgtctctttgtttccaagcgaactggccaatgagatccccgtgtgagtagagctcggcgccccccgctccctctcactcccactcctccatccttcctggtggggagcagagtccggagcccccggggaactttccatcccttgtggcggaggatgggggtccggcgctatttggctgcaagaggccgtttcctgcctcagaagtgcagtcgcccctcccagggcacaggccgagggtcgccccacagccaacccccaccactgaggctgtacacacctgtgcgcatatgcatgcatgtctgtgtccgtgtgcacttccgcgtgtgtgaacatgcagctgtgtctgtgcgtgtctatgtatatggagtggatgtgcaagtgtgtgtgaatatccagctgtgtgtgtgcatgggtccatgtatatgtgtgtgtgtatatgtgggggggacatgtagatatgcgtgtgtgactatgcggccgtgtgtgtgcatggctccatgtatgtgtgtgtatatgagggagacatgcaggtatgtgtccgtgtgtgtgtgtgtgcatatgggtccatgtatgtgtgtgtatatgagggagacacgcaggtgtgtgtctgagtgtgtgcgcacatgggtccatgtatgtgtgtgtataggtgagggagacatgcatgtgtgtgtccgtgtgtgtgcatgggtccatgtgtgtatagtgtgtacacatgggtccatgtatgtgtgtgtatatgagggagacacgcaggtgtgtgtccgagtgtgtgtgcatgggtccatgtgtgtatagtgtgtgcacatgggtccatgtatgtgtgtgtatatgagggagacacgcaggtgtgtgtccgagtgtgtgtccatgggtccatgtatgtgtgtgtatatgtgggggagacaggtgtgtgtccgagtgtgtgcatgggtccgtgtatatgcgtgtatatatggggggatatgtagatgtgtgtgtgtatgaacaggtgtaagtggggagcactcaggtgtgtctgtgtgtgttcgtgtacacgtgtgtatgtgtgtgaacatggaggggtgtgtgtgtccgtgtgtaggtttgcgtgcatgcacacatgcatgtgtgtactggggcatccaagcccctggtctccactccataccaccctacgcctacctccttgatctctgcgcccagccttggctgtgctcccctgctgtctgcacgtgggtgtctgcacgtgggtgtctgcatgtgggtgtctgtgccctcaagtgtctcgtgtctgcacgtgggtgtctgcaccctcacgtgtctcgtgtccgcacaagcatgtgtaggtgtccctgctgggctctttggtgggcggccagtgatcctcgaggtcacgcatgtcttctgtgggtgcctgctccttgcaccccacagtgttgagatgggtttgcattggccccgcctgtcccctgctcacccgcctccctctcttcctgcttctaagccccgaaactctggattccggggcccttcacaggtgagcacgtggcagcagtgcctgcagacccctggctggcccatctgtcctcccgcccgtctctctgatctctctctgccaggctgcccctgtctccatccctcttctccctcccactgtcggtgtctgcccaccagccacccctgggtcccgtcacagcccttgtggcctccgcagctggggcccttgtcctcccgcctcccccaccctgtcctgttgccaccttcctagaggccctgacctgccctctgccctccagcgagaaggcactgcagagcaaccactttgaactgagcctgcgcactgaggccacgcaggggctggtgctctggagtggcaaggccacggagcgggcagactatgtggcactggccattgtggacgggcacctgcaactgagctacaacctgggctcccagcccgtggtgctgcgttccaccgtgcccgtcaacaccaaccgctggttgcgggtcgtggcacataggtgagtagggaacccagcgtgccgagaatagtggcgagggctgcccagacttgcccagctgggctgtgtccagtcacttgtgaccaggggtcagggaggacacgccttgctgcctgagccgaggtcactgccagtgggaggaggaagggccaagaagatgcaggagaagcaatgatcagtttccacgtctgaaaggcatcccggccctgcccggagcctgccgggggtcgctccagtctgagcctggccgtcgcctccagcaaagcttgagctgcaggaatgtccccggccttggctcccagtgccctccttggggtcaaggccacctcatccttgcccccaggggtgatacctcgggggttctccaggctgaggcacctgcagggcataggaaggatgcagggcttatggtctagaggaggcagagggaactctgggccctgatggtctccccctccctgcacacccagggagcagagggaaggttccctgcaggtgggcaatgaggcccctgtgaccggctcctccccgctgggcgccacgcagctggacactgatggagccctgtggcttggtgagtgttttggggagactagagagggatgcccaagggtctcatgatatccgagggacagactccaccccccagcgcccacccttgagtcagggtgcatgtgagccggcgggctgggctctcttctcccgctgtagcccctgcagttcccagtgctgtggggccgggaggcgggtgcccaggtgtgggccccctgctggtcacctgctcgttggggtgcccatcagcatcactgagtcacagccgggtgactcccactgtctgtgctgcagggggcctgccggagctgcccgtgggcccagcactgcccaaggcctacggcacaggctttgtgggctgcttgcgggacgtggtggtgggccggcacccgctgcacctgctggaggacgccgtcaccaagccagagctgcggccctgccccaccccatgagctggcaccagagccccgcgcccgctgtaattattttctatttttgtaaacttgttgctttttgatatgattttcttgcctgagtgttggccggagggactgctggcccggcctcccttccgtccaggcagccgtgctgcagacagacctagtgccgagggatggacaggcgaggtggcagcgtggagggctcggcgtggatggcagcctcaggacacacacccctgcctcaaggtgctgagcccccgccttgcactgcgcctgccccacggtgtccccgccgggaagcagccccggctcctgaatcaccctcgctccgtcaggcgggactcgtgtcccagagaggaaggggctgctgaggtctgatggggcccttcctccgggtgaccccacagggcctttccaagcccccatttgagctgctccttcctgtgtgtgctctgggccctgcctcggcctcctgcgccaatactgtgacttccaaacaatgttactgctgggcacagctctgcgttgctcccgtgctgcctgcgccagccccaggctgctgaggagcagaggccagaccagggccgatctgggtgtcctgaccctcagctggccctgcccagccaccctggacgtgaccgtatccctctgccacaccccaggccctgcgaggggctatcgagaggagctcactgtgggatggggttgacctctgccgcctgcctgggtatctgggcctggccatggctgtgttcttcatgtgttgattttatttgacccctggagtggtgggtctcatctttcccatctcgcctgagagcggctgagggctgcctcactgcaaatcctccccacagcgtcagtgaaagtcgtccttgtctcagaatgaccaggggccagccagtgtctgaccaaggtcaaggggcaggtgcagaggtggcagggatggctccgaagccagaaatgccttaaactgcaacgtcccgtcccttccccacccccatcccatccccacccccagccccagcccagtcctcctaggagcaggacccgatgaagcgggcggcggtggggctgggtgccgtgttactaactctagtatgtttctgtgtcaatcgctgtgaaataaagtctgaaaacttt

SEQ ID NO: 37674 - DNA, 155976 bp, Homo sapiens
gctgtggagcggcggggaggaggagccgccgaggagaccccgggcgaggagctgcgagccggaggaggccgcgcggactccgggctttccgccgtcgcggggatctcggggggcaaagggatcgccggggagggggaccagagagccgcgcccgccgcgcggagcgccccttcgcgtcccctgcaccatgagctggggcaccgagctctgggtgagtgaggggctgggcccgcgggcagatgcggggcgcgcgctgcgtttccccgcggcctggggagggggcgcgggccgcgctgctgggcggaggcgagggcgcgctggtcggggtcctcgcggcctggggaggaggcggggttccaatgcccctcgtccgccttggcccgagcaggaggtgcgggccggcttgtccttcggaggcgaggggagttggtgcgggtccccggcggcctgaggaacggcgcgggcgggcctccctgtccccggcgccccggagcgggccgtgtgtgtcgggccgagccctaatcccccggggcgagccgcggatgcccggggagggccgggaccgggcgtgggggcgtggaggccccggctgcgcggcgctgcgttgggtctcggggcgccccggccgcgagttctgtcctggctccgcggaggcgctggcggatcgggcacttccccgggagcggggcggccggggcgagcgccgggggtcgggttttggggtgctggggcgagagtgcggtcttcgctctggaggcgaggacttctggcccgtggcggctccgggcgcacttgttctttcggggtagctcaatcctgagtgggatgtgggcactgcgacgtctggtctggaggggaaagtgggagttagggagagatcttacgtgatctacctcaggaagaggcgttcgcggggtcaatgatctttaacggttgctcggagaatagtttccagtggggaaagttggcggtgaggggcgccttgcggggatgcttggccgggggatgcgcacggtaaacgggcagccctcagggctgagggccgtccccggaaaggcgaggggctggctgtggatggagctcttttcctgccgtccccggattcctggggaaatcactgggcaggggatgggcagtgcggcggcccgggaaggagcagacgaaatctcagttactgcactgaaatgccctcaagatgagccatttcccaggatgaactctaaagtgcctgaactaccttttggaattctatttgcaaagggtgtggaggagaaagtgtagggtggtgttgctatctgagatgaggccaagaaatctcatatcaaaataaaacaaggttagagcaattacagaaacagagcacatcctcccttgttttttgttttgttttcttttgctttaattgtttttacataaccatttgttaggtacagaagcagctacggttgttattaccaaaatcctgagggcaatagctcccttaaattaagataattcattttataaacatcttctgcctaaaagggattcatgacaaaatttccgctgatgtttacaagtatccattttgaaaataaaatagtttaaaatatttgcacacaccagtttaggcaaaatctatgactttgagtaccgtattgaagtttctttcctcttctaatccttccactccctttagctctctttagcttatctggggtggggaagcaaatcagaagtaatctttgtcaagacagtagaaattgtggcacaatttttttttcacttgttcagacaggtggatggaattatggagggaaaatgtacaatatatttctgagtgaaatagggaccgaacacaataccttggtggacagttcagtgatgttggtgaatgggatagaatataattccaaagagaggcagtggctatgagcaaaactgctaaaacagcggcaattgcttgcattattctgtacatttctttttgagggtgcagaagtgggaaggaaggcagggttaggagtgattgaaaataaatgagagaggccgggcgcagtggctcaggcctatattgccagcaccttgggaggctgagtcgggaggatcttttgggcccaggagttcaagaacagcttggggaatatctggagaggcctcctcttaaaaaaaaaaaaaagaaaagaaaaaagaaaaaagaaaaaaataataaatgggaactggaatatatacaaatattaatgatatgaaatcttatatttgcttcacaataatttgggttgttagtagatgggagatagtgagacagagttggccattattgaagccaaatgctgagtacagaagtattcattacactattctttctagtatatatatttgacattttctacaataaaaataattggaaaatagttttaaaggagaaggatgtgaactatttgtaattttttcacttgacaattttatgaggaagaatgaatcagttaacagttctatatatgcaagtgtatggcaatgaggagtttttaaaaagacattctttttttttttttttctgagacggagtcttgctctgttgcctgcccaggctggcgtgcagtggcgtgatctcggctcactgcagcctctgcctcccaggttcaaacgattctcctgcctcagcctcccaagtagctgggactacacgcgcctgccaccatgcccagctaatttttttgtgtatttagtagagacggggtttcgccgtgttggccaggctggtctcaaactcctgatgtcaggtaatccgcctgcctcagcctcccaaagtgctgggatcgcaggcgtgagccaccacgcttgacgttaaaaaagacattcttatgagtaccagcatttgcctttgagtagcttacagtttaatataggaaaaggaatgaacacatgattgtgctactaagagaaatgcaaaatctaagttttcaggtgaaatgcaaagatgtataaggcttagtagcttttgagatttaaaaaaactagaataatgaaggattatgaaaagtaaaccccagtttctccggtggtcagagacttggtgatgtgcggtacattgggtagcccagcggagggcagtgattaagggttttccttgaatggtggctttggaatcatgcacatgtataatgagataatgatggggcgctcaagccaaacttggcagaattattcttctagatggagaaagagctatggtttgggtggccatgaattatttgtaacaggtggttgcagctttcagggaccttcacaaatactatcagattttacatacattttaggacttcaggttaaaatcaatataggcttttagaaactacaggtttctaatgtgcattttacactgaagacctgctcctaagccacatcctgctttgtagagggagtaaaacctttctcttcctctttcttttttactttttctttaacccctccatagaaataaactttctttttttttttttttttgagacaaagcttcgctcttgttgcccaggctggagtgcactgtcacgatcttggctcactgcaactttcacttcccaggttctagtgattctcttgccttagcctcctgagtagctgggactacaggtgtgcattatcacacctggctaattttttctatttttagtagagatggggtttcaccatgttggccaggctggtctcgaactcctgacctcaagtgatctgcccgcctcggcctcccaaagtgctgggattacaggcgcgagctacctcgcccaggcttacatggccattttgaagtgattgggttctaataaaatagtttacaactcttcataacatagctcttcataacattgccttttaatcaattttcaaaatttttattgaacaactatggtgtgcacaagacaccagtctgaatctgttgtaagttacattatatacattgaaagatatctacgtggaagcatagaaagtaggttttacctctagcttgtaacatcagagtcaaaagaaaaatgtttgtatgtaaaattaaccaaaatacatttactcaagacttgttaaaaaggcagtgttagtaaggtaaatatgttcactgacttgttgaagttgtggctggttgttggagaaatggcaaagcaagagttgcttacatttgaatgttttttttttcttgcctacttactgagggaagtgacaggttactgaagtgttagttcagctttttattagcttgcttattagtgtgaagtatgaataaatccattggaaaattaagccttcctcgtaattattctctttgcagctaacaaattattcagtgacagaacctggttttgctgcctcctagtatcctctctgtctttatttatttgctctggtgctaatgagaaatgaagtatgtacaagaaagagaacagagaaacctgaataatgcatattggttagcatagtaagaagccacatgtgggctgggcgcggtgggtggctgacgcctgtaatcccagaactttgggaggccaaggcgggcagatcacgacatcaggagtttgagaccagccggaccaagatggtgaaaccccatctctactaaaaatacaaaaattagccgggcgtggtggtccacgcaggtaatcccagctactcgggaggctgaggcggagaatcgcttgaacccgggaggcggaggttgcagtgagccgagatggcgccattgcactccgccctgggcgacagagcgactctgtctcaaaaaaaaaaaaaaaaaagagccacctgtgttgattgtatgtcttttttttttttttttgagacggagtctcactctgtcgcccaggctggagtgcagtgggtcgcacgatctctgctcactgcaagctccgcctcccgggttgacgccattctccagcctcagcctccggagtagctgggactacaggcgcccgccaccacgcccggctaatttttttgtatttttagtagagacagggtttcactgtgttagccaggatggtctcgatttcctgacctcgtgatctgcccacgtcggcctcccaaagtgctgggattacaggcgtgagccaccgcgcccggccgactgtatgtaattttttttacctgtgatttttagaaccatgccaggcatataatatacattcatctgttgaatatgttgaccctgatcgtggtgtgcactttcaagaggcagccgtttgaggattgtctaccaactgtactgggaacaatgcctgactctgtgtaggagttcaataaatatttattggataaatgaataaatccctttttttccttttgttttaacatttgctttttaaaaataatgggaagataattataacacctttctgcacttcggcagttgtaaaatatatatataattttaggtatctttttggaaaatagactattttttagagcagtttcggttcatagcaaaattgagaaggtacagagattttccatatcctttctgcccccaaatacacacagtctaagtaccttttttgcctttaaagtagggtttgaaaaattatcccttctctgttgttcattctacttaggcatgatatgtgtacatatctttatataagaacactttatagtgtgttgaatttttttccctagtgtgtcgaaattttaaactagttttttaatcttaaagtaacaaattattaacagttccaggtattggataattattacctcttcttactgcccttgaatgctaaattggagaaccctattaacaatcgtccctagctcttctactgctcttttttcttttttctttttcgagatggagttttgctcagtcacccaggctggcgtgcagtggcgcgatctcagctcactgcaacttctgcctcccaggttcaagtgattctcatgcctcagcctcctgagtagctgcaggcccccaccaccatgccctgccaatttttgtatttttcatactagagatggggtttcaccacgttgaccaggctggtctcaaactcctgacctcaagtgatctgcctgcctctgccttccaaagtgctgggattacaggtgtgagccaccatgcctggcctctactgctcctttttctttttttttttttgagatggagtctcgctgggttgcccaggctggagtgcagtggcgtgatttcggctcactgcaagctcggcctcccaggttcacaccattctcccgcctcagcctcccgagtagctgggactacaggcgcctgccaccgcgcccggctaattttttgtatttttagtagagatggggtttcaccttgttagccaggatggtctcgatctcctgaccttgtgatccgcctgcctcggcctcccaaagtgttgggattacaggcgtgagccactgcgcccggcctactgctcctttttcttaacccttcagagatttctgtttgggatgaacatggcaagaccaacaggggagataatactccctgaaccatggtgggtagggcagaactgcttcagaagagaaacaaaatcaacttagttttgccatccttacttctccatgagaacaaattttgcacatgtcttttctgtttagtggatattaaaagaaaacaaaccgtgggaggcctggagattttgcagttgatatttagatatcagttttgttgccctcactttgtacattagacagaatcctgaaaatttgtgtaaattgccattttggtaggcaaaactgtactttaagcacataaaagagttttataagtgtctatacttactatgtgaacacattacaactcatgctttacattggtgagacatggaaagtgcttctttgaaggactattcaagtatcacccactaagcagctaaagctaatattatgtttcctgcaagtattactcatacttgtttcatcaacaccacccacatttaaaaataaggctttattttgacacttaaaaattgaaagctactaagaatacatgaatgccctgggaaattaatctaattagattttagaatgtgggtgtgaagtcttctggaattagtgtttataaaggaatatttgtttcctgttttacttgtacactcatactagcttgagcctagtaatgtgtttagttaaaaaaacttttttttttaatgatgaggccaaatatgtgtattatattagagagtaatttgggggtatgtaagtttttgtttgtttgttttttgagatggagtttcgctcttgtcgcccaggctggagtgcaatggcacgatctcagctcactgcaacctccacctcccgggttcaagcgattctcctgcctcagcctcccgagtagctgggattacaggcgtgtgccaccacgcctggctaattttgtgtttttagtagaaatgggatttcaccatgttggccaggctggtctcaaactcctgacctcaggtgatccacccgccttggcctcccaaagtgctgggattacaggcatgagccaccgtgcctgacctctctattatcttaaagtctcgaatgattgttatcattactgccatttattgagtgcctactatgccccaggtgctggacaaagtgtttacatccatcatcttgtttatttgttacaagaatccagcaaggtaactaccatttgtgccaatatcctggaagaagaggcttagatggagtcattagtacagttttactggggagtaacacctgtgaaggggaaagagtggaagccatcagatcacgatgcagacctgacagagtccccaccaggccaatggggagctccagagcagacacaagaatcctctggcagaaatggctcggcctctgtatctctgccttcctttatcattggccagaggtcgtcccaagaagaggatggccttggctgccagcttgcttagtcattggctgggggtgctacaagaagagatgccctcgactcaaaagatgaggtggaccctaaaggaggctgcatgctagccacagtccttgcagctgggcagcgagtcattttttgccacttctccatgttgcccaggctggggtgcagtggcacgatctcgactcactgcaacctctgcctcttaggttcaagtgattctcctgcctcagcctcccaagtagctgggattacaggcacatgtcaccacactctgctaatttttgtattttttttgtagagacggggtctttctatgctgcccaggctggccttgaactcctgggctcaagtgatccttccaccttggcctcccaaagagctgggattacaggcattagccacttggccaaaaactggatcttctgtgttagtagtgcacagttccctttatccccaccactcactcatatttccccatcactgcagtagattttgctttataaaacagttgatgttattcatattgagaatcactgagaatcaatgactcacaccactaaatgctgcagagccagcagaaacagtcatgaatgaagctcgtactcaagcagatgcttcatagatgtctagtaatctcctaatcctttcaaagccagttattgtttctcttttctaatttaaataaatttgtgtggatattaattagtaggagtagtatcaagtttctgaatttgcccaacagaagtatgtcttggcgaaaactatttttaaggaaattgagaaagaacaaggaggaatacagagtctcactctgttgaccaggctggagtgcagtggcacaaacatggctcgctgcagcctcaatctcctgggcccaaatgagcctttcgcctcagcctcctgattagctgggaccacaggtgtacactaccacgcctgaccaacttgtttttttttttttttttgagatggagtcttgctctgtcgcccaggctggagtgcagtggtgtgatctcagctcactgcaatctccgcctcccgagttcaagcgatcctcctgcttcaacctcccgagtagctgggagtacaggcgtttgcccggctaattttttgtatttttagtagagacggggtttcacagtgttagccaggatggtctcgatctcctgacctcgtgatctacctgccttggcctcccaaagtgctgggattacaggtgtgagccaccgcagctggcctgtctaacttttttttttttttttgagacagagtcttgttctgtcacccaggctggagtgcggtggcgcaatctctgctcactgcaagctctgcctcccaggttcatgccattctcctgcctcagcctcccgagtagctgggactacaggcacccgccaccatgactggctaattttttttttttttttttttgtatttttagtagaggcggggttaccatgttagtcactgtgttagccaggctggtctcactctcctgacctcgtgatccgcccgcctcggcctcccaaaattctgtgattacaggcgtgagccaccgtgcccagcccggcctggctaacttttttaaaaaagttttttttgtagaggtgggggggtcttcctgtgttgcccaggctggacttgaacttttgacctcaagtgatcaccggcctcggcctcccaaagtgctgggattacaggcgtgagccaccatgcctggccgacattcagggttttaaagttttgagtcttcaggaacaagaaacgaaacactttctctattatctatagcagaagaaaacttgggacctgtaaaggaatctcctccccttgtacttctatttgcacagccaaaattgagaacgggttcctgaaatccatttaaagaccagacaggctctggggacaaacggtgtgggtgctcccagttgagtgaggcagtgctggagggctcagcctgggttgccttgcttacctaatctaatatttattagtatcgggcaagtccttgcatctctgttcctcgctttcccaatctataaagtatggtatgatgcttgcctttctcttgacaagaaggcataaaggtgagagattgttcgtaaagtactttgaggttgttggatgaaaggtgataggtaaacacaaattattataatcatggggaaggttaatgaaaaaaactctggtccctgggaacaaactgtagaactctcctgcggtaagcaggattcatgaaaaatgagctattttctgtcctagccttctgatttaaaatttggtgtacatgttaacaatacaataaacctaatatttggaaaatgcctggaaatcgttgctttggacaggaaatctggatttcaggaggtcatattaatagcatgtttatcttttcctccttgaagaaaaataaaatccactccaaaacactaatcatactaatttttagcagtatacttgggccttcttaagatttaagttttttctagggggaattaattttctttggctattattaccactttaaaaaaaaaaaagttccactgaagtcacattatttcctcacctaaaaagctggatatttgctgcttgaaacatctaatgaattattctgcctatcagcttagtttgggattgatttcttcttggcagagataatgaagaggtttagaagtatttgcattggaacagatatggaaatttctggaaatgtttgggcaaggacatttagatttcataagtgtatatgtgtatgtaaaatatattcttcaccatgactgacttttaaaatttacattttacttattggccaggcacggtggctcatacctgtaatcccagcatttggggaggccaaggcgagaggatagcttgaactcaggcgttcaagaccagcctgggtaacatactgagatcccatctctactaaaaattaaaaaattacctgggcatagtggtgcatgcctgtagtcccagctacttgggaagctgagatgggaggatcacttcagaccaggagttggaggctggctgcagtgagctgtatttgtgccattgcactccagcctgggtgacagagcaagaccttgtctgggaaaaaaaaaaaaaaagtttattttaacttatccttaaaaataggctatttacattgttcagtttcaaaagtaaggtgtacgtgtgaagtctccctgtcattctaggagaggtttagttcttgttacggccatttttggcaagaggagtagtggtggtagtgctcagtgtttataactttgtacataaaaggaaaccaaacaaaattgtaaaaatttcatcaggccaggcgcagtggctcactcctgtaataccagcactttggaaggccgagtcgggcagatcatgaggtcaggagtttgagaccagcctgaccaacatggtgaaatcccatctctattaaaaatacaaaaaacttagccaggcatgatggcgctcgcctgtaatcccagctactcgggaggctgaggcaggagaatcgcttgaatctaggaggtggatgttgcagtgaactgagattgtgccactgcactccagcctgggcaacagagcgagactccctgtcaaaaaaaagaaagaaagaaagaaagaaattattgtgtaataaggactaaggtagggtaactccatggaaatgtgtacaggagtgtaactcaggtggggaaatggcatccaagtggagtcctgaaggactagtaagttttacaggtgaagtggggtgttcagaagggtggaggggatctggacagagccttccgggaaaagaaggaggaaatggtatgtccaaagggtcatggagggcacagagctctcaaatgatgagcaggtgatggagttgtaataggagcctgaagaggcagactatagctaaaaaccatgtgaggactatgacctcaccttgagagcatgggaaatacccttgaactgctgaaagcaggtacctatggtgccagttttcagtgtggagaaggatggagaggagctcggtagcttcaggccacgctgggccgattggctgactggattactggagtgggtttcagtagagagcctttctatctattgcatttctcaacctgtttatatgtgggtggaataaggctaaaatggattgctggggagccttggacattcaagggaaggcctagtagtgaacaaagaaggcctaggagccaccctctgcctcctcccacttcaagatgttcaagggggaggcatgttccctgctctggcttgtggggtaaatcaaatataggccacaggtccttttttccaccagctgggtgcaaaacctaaacctaccagcactttattcttgtcctctctgtctctgctcagatgatacaaccttgttagggttatcagggtttgttccccagctcttttaagctagcaaatttcttattttcaatatgcctggaggtgactcacactaacctaattcccaagcctgttgaataaaccagaatgaattttaaacttatagtgagaagtatattcataagcagactgaatattcatgttggctgatccgtacgttctcgccctgtaggctaatctgggtggaaagctaaattctttatagcatttcttggagagcataaaatgaaaataggattggatgagtgtaatggctgatgacaatgggagccctaggcttctgcctcctctggaggacagtctacgttacagttagaatagagtctgttttatagatgctgtgtaggtgattcctttcctgttaacccattctttctttaggcagactatagcacagttagttatgtttagatttttttttttttttttggagacggagtcttgctctgtcacccaggctggagtgcaatggtgcaatctcggctcactgcaacctccggctcccagtttcaagagattctcctgcctcagcctcctgagtagctgggattacaggtgtgccccaccacgcccagctaatttttgtatttttagtagaggtggggtttcaccatgttagccaggctggtcttgaacccctgacctcaagtgatccacccaccttggcctcccaaagtgctgggattacaggcatgagccagtgtgcctggccctgtttaggtctttttaattccaatctctattcaatctttcatgcctgcgattatattcaggtacccagattgaatgctggatatttattatctcatcactttctagcattccccaaattggcaagtctgagaaatctgtagtttttttatgtgtaagaatctgtaatttttgtttgtttgtactccatcacccaggctggagtacagtggctcaatcaaggctcactgcaaccttgacctcccgggctcaagcaatcctcctacctcaacttcccaagtagctgggactacaggccggcaacaccacaccaggctgatttttgcattttttgtagagatgttgtctcgctatgtcacccaggctggtcttgaactcctgagtccaagcgatccccctgccttggcctccgaaagtgctgggattacaggtgtgagccgctgcacttggccgtttataagaatctgtcattttaaaagctcttctaggtagttttgatgtggcttaggtagcactgtttaacattttgattccttctcatgcattctcagtttttgctcatttttattctttatagcaaatctaaaatctagcaatattctacttccttacccagtcagctactgacaaacattatcatcattttaaggtactctttgttctctatggttttctagtaatgacttattcaggtacccagataagtcatcattcattaattcatttgaaaaagattatagggctgagcatgctggctcatgcctctaattttagcactttgggaggccaagatgggcggatcggttgagcccaggagtttgacaccagcctgagcaacatggtgaaactccatctctacaaaaaattagccagaggtggctgagttgggaggatcgcttgagctcaggaagttgaggctacagtgagtagtgactgcaccactgcactccaggctgggcgacagagcaagaccctgtttcagaaaaaaaaaagaaaagagaaagaacaatattttaaactacttatgtgccaagcattgttctaggcaaagggaaaatggcagttaaccaaatagtaaaaaatgttttgcttatatgtaatctgtatttacagtgtgtcagataatgataaatgctatggacaaaaacaagggaatgagacggagaacagtaggattgagcttgatggggagaagaagtgtagtgctggacattttacaagatgcctgttatataactaattatctaatattgcgtcgatagcctagtatatgcatctggagcccagggaagagatccagcctggagatataaatttggataaccagaaagctagaattaagttggtaaaatgctaagctcttggcagagttgcattcctccaagcactttatttaactttggaactctgttacctagcatagctgtcataacgtgttgcccttttggacagtaactctgcactctgtttgccaaagtgtttacctcactgagaaccattgtgtgaaccgtgttttagactgggaggggtatagactgttaagagtttattggtttgcaaattgttataacaacataataagtggagctggaggttctgataggcttagaagtagaactaatgtaccaagtcataagtggaaaaaaaaaaatgtccactgatgggcattcaatttttggtagtaatcagaagttaatatcacacatcattctaataggcttttgaagacagactaatagtgtaggcttttcctttgaaagctgcccatgtgcttattttgacatggagataaaaagagaaagtttagaattactcagttcacaccttgttgactgagatttctgttgtacctgatatcgtttaactttcctctttatctttcttagagatacttcacatgtgggacagattatattttggaaagatgtccacaacaatattgcccatcccacattgctcatcttacaatgtgatctcaagactcctcccactgagtgggtgagaagggacttataccactttcatttgaatctaggcagatctgtgtgacagccttgaccaatagagtatggttaaagtgatgcccccaggcatggtggcccatacctggaatcctggtttttccgggaggcccaggtgggggtagaggtgagggggatgattgtttgaacacacgagtttgagactaccctgagcaacacaatgagaccctatttttttttttaatgatttctgaagcagaatcacaaatagccgtgcgtttttttcttgcgcttttaggatacttacttttaaaacccagtcaccatattgttaggaagcccaaacagcacacatagagagacatacggagaagccaaccatagaggttcctgttgacagctcagtcgaggtctcaaccaacagtcatacttagctgccagccatatgagtgaagggcttccagatgattctaacgcccagcagttgggtccccccagcctgtaagccttcccagctgaggcctcagcaatgatggagcagagaaaagttgtccctgtccaaattcctgacccatgataaaatggttgtttcccatcaagttttgggagtgatttattatacaacaatagtaactggaacaatatccttagaagttgtaatagatagtattaacactaccccttcttcatttattcaaggacaaagctaccatgtatccttttattctagtttaaagataaaatgaaatcattgtctctttgaaaaaatgcttagaatatgaaatttaaaagttgaggaacattcaaagagttttatacttttttatctgaaaatgagaaaatagcaaaccaaaaagctctgatgtgaagacattaagacttcatgatggcttaatgtcttcataatgcaaactccataaacagttttttctaaggttcttgtcacatgatcatacactttgaatatggtgattctgtcatttttcataaaatctcagggtttttacattattgtcataaccacataaccactgagtcacaaaaggggacatttcattgcaatttcctttagtaagatatggttttgccatttcccccccaaatttcatttcctcttccttgaaatatgagccatgccaatctacttcagaagtgttgttttgaggaatataaaacaaaagacaaaacttttttttttttttttttgagacagggtctggctctgttgcccaggctggagtgcagtggtgcagtcttggctcactctaacctccacctcctgggctcaagctatctttccacctcagcctcacaagtagctaggactaacaggtgtgagcaccatgcccatctaatttttgtgttttgttttttgttttttggtagagacagggttttgccatgttacccaggttggtctcaaactcctgggctcaagtgatccacccgccttggcctcccaaagtgctaagattagaagcgtgagccactgcacctgacccacaactttctatagctttagttgtgaaatagaattactgttctggaggcagtaaatcagccagactaaagttaggcatctcagatctagttctgtctctgctgcttattcattgtgttcactcctcaaatcttgaaagaatatttattttaagatcttttttttgtttgtttttttgagatagagtctcgctgtgttgcccacgctggagtgcagtagtatgatctctgctcactgcaacctccgcctcccaggttcaagcgattctcctgcctcagcctcccaggtagctgggactataggcgcatgccaccctgcctggctaattttggtatttttagtagaaacggggttttgccacattggccaggctggtctcgtactcctgacctcagatgatcacccacctcagcctcccaaagttctgggattacaggtatgagccaccgtgcctggccaattttctcattcttaaaagatttctacaatttagtcagtgtgtcatattgttcaagagtgtggatctggagctagactgcttggttcatatcctgacattaactaactgattgattttggacaagtcatttagcctcagttccttcatctgtaaaatggagataatgatagtgcctactccataagattatatgcgaaataaactctactagtgttggctatcattatccacctccacatgttgctggttgtcatgatatttcattgatatcttttttttctttttttgagatagagtctgtctctgtcacccaggctggagtgcagtggcacggtcttggctcactgcaacctccacctcctgggttcaagcagttcttctgcctcagcctcccaagtagctgggattacaggcatgtgccaccacgcccggctaatttttgtatttttagtagagacagggtttcaccgtgttggccaggctggtctggaactcctgacctcaggtgatccacccgcctaggcctcccaaagtgctgggattataggcgtgagccactgcgcccggccttccattgatatcttgaattccatgtcgagactgaatgatcacttttttattaggggtattgtggacgtgatcaatgaatttggtataaactagactgtgtgacctcgagtcccttcaactcaagtgtttcaaggtaatctgagttccaggatcaactgacactgaaatagtgatcctaggagtactgattcataatgagcagataacatggcaatgccaattacaatagacgatttctaaagttagaaactttacttagaaattttatgttgagtcccacactgtagctcaaataaatgctaatgttaacaggaggtttgtaaagggttcaacaattcaaaaagtgacacacacctagaatcatcaggcacattccttaagttgtgaggcactcggtacatagattgaatgtcttgggtgtgactccataggcaaaaatgtcagggactatttttttttttgagatagagtctcgttctgtcacccaggctggagtgcagtggcgcgatctccactcactgcaacctccaccttctgggttcaagcaattctcctgcctcagtctcctgagtagctgggattacaggtgtgcaccaccacgcccggctaatttttgtatttttagtagagacagggtttcactatgttggccaggctggtctcaaactcctgacctcaggtgattcacccacctcggcctcccaaagtgctgggattacaagcgtgagccgcctggcatcagggagtagtttgctgaacagaaaccttttggctaaggtttattgtttattttgtcagtttggcagatcagcaagtgagtaaggtagataaacaatgtcattgcagaaaaattttaggcagtcaagtgctttatttgccaaaaagattcaaccacctgatggaaatgaaaaacaggatgatacgatggcttcttccttcactttctcactttccttggattatgaaatgccagtaattgagaaagcggaatgaacagtcattagagatggaagaaaaccctagagagaagttggaagtagttgggtgggataaagactttctgataacttcaagcagatctagaaattggcattggattgttagagaaaaattgaaaatgtaaaatgttagttgcatgagtgggcaacagatactctccattagcagtgttcaattacgtgtcaccaatgtgcaatagtctgagacaggcagggtcttgctctgtcacccaggcactgtcagagctcactgcagcctcaacctcctggcctcaagccatcctcccacttcagcctccccagtagctaagactcaggtgcacactaccacgcccagctaattttttaattttgtaaatttcttatttattattatttcctgtttttttggggggggtagagataggatctcactatgttgcccaggctagccttgaactcctggcctcaagtgatcctcctgcctcagcctcccaaagtgttgggattacttacaggcatgagccactgagcctggccaagttctgtttatttagataatatttgcttgtagtatggaccccacccagctcacaagcttggggtgagggacctgggggttaaatgacggcaaatgtaagccaacctaaaggttatatgtatgttgattcttcagatgtggccgagatcaggcaaggcagctcacagggagagtaaagggtactattttatacactaggtacttggtaaccagtctgaattgtgggccagtcctagggacatggggcaaaagtaaagaaaggaaaggaaaaaagactagagggaaatgtaggatacactcacgtggatggaagattgagtccagggaaactgagtaagatgccaaatgctcacgataaaaggatgacgtttccatgggatcctgtaggcatcaccgagagggtactgttgggagaacacttaggaacccagatcacctaacatggagtgagtggggctcagatctgagcagaaacccaacaaggacttcccaactccaagtaaagctaaatttagacaatccttttatgttgctggtccctcttgcaacacagtctcctccggccaggctgccttctccttctttatatgcaccagccttcttccacctcagggctttgaactcctttatcccagctctgccttgcccttggccggggaagtctctagccctaggtgcttcaccttcagctaaccctattgtgtgcaatcccgacctcctggctctctctaaagtcagttacacacgccagtgagctctgagggttcagccaagattgaatacactctgttaaagaaggggaattgggggaaaagccagattttaaaagcatgatttatttcttacttgtttatgtatttttgaataggccacacctggtgtgtgactgccccagtcattaggggatttttttttttcttccctggaggcaaccaccataactggtttcttgtgaattcttccagagagctatcaagcatttatgagtaaattcccccctcccttacaaatgttagcatactagtcacactttttggtaccttttaccacttataatatcttggtgggggtttcttttccttagccgcctcattcttcttaatgtaactattaatccttcttctgttttttgtttttgttttttgacagggtcttgctttgttgcccaggctagtctcaaactcctggcctcaagcagtcctcctgcctcagcctcctgaagtgctgggattacactgggcaacacggccaacccctgtctctatcaaaacaaaaacaaaaattagttgggcgtgctaacgcacacctgtagtcctaggtacttgggagggtgaggtgggatgatcacccgagcctgaggagatcaaggcggcagtgagcggtgattgagccactgcacaccagcatactgcacaccaggccacagagtgaaaccctgtctcaaaaaaaaaaagagcgagtgttggtatttgtgtgaaatttttattgaggatattaagacaaagtgttgatgttctatactttgaacccaaagctttgtaactcattttctacttgtaactatgtaaaatatgcctgcttagtataccaaacagtattcttaactgtattcttaaggtcgggcacggtggcttacccctgtaatcccagcacttcggaaggccgaggtgggtggatcacctgaggtcaggagttcaagaccagcctggccaacatggtgaaaccctatctctactaaaaatacaaaaaaattaaccgggcatcttggcgcgtgcctgtaatcccagctactcaggaggctgaggcaggagaattgcttgaacccaggaggcagacattgcagtgagctgagatcgcgccactacactccagcctggtgatagagtgagactccgtctcaaaaaaaaaaaaaagttaattttatgttagatgaatttcacctcaaattaaaaagaagagaaagaggctgggtgcaatggctcacgcctgtaatcctagcactttgggaggctgaggcgggtggatcacttgagcccaggagtttgagaccagcctggccaacatggtgagaccttgtctctacaaaaatacaagttagccaggcatggtagcctgcacctgtggtcccagctacttgggaggcttaggtgggaggatcacctgagcccaggaggtcaaggctgtagtgagccaagatagcaccactacactccagcctgggcaacagagcaagaccttgtttcaggaaaaaacaacaggttagtactgggcatcttagctatctcttagacgacaaagggctaatttgggatggacactccttggtgtttggaaatttaaaagccaatgcaaatgctgtataaaacaattgatctttaacggttcagcgggatctataaattttctcctgagtaatgaaagattgctgtgtttttttttgaagtctccttaatgattgtctgtgtacttactccctgttgcaaaacaggtaatgagagtatattaggtgctattttaaaatacacccacaacattaaactaaattcaaataattaattggaaattgttatttctgcaaagtaatttccaccaaatcagtcattaagctatctactaaaaccagtatttagtggcttttagtcaagttggctaatggtagacttctcatggcacgtgggagaagtaagctgaagtagcagaaaatggtatttgcagtgagtgttcaaggcgaacttttaaaaatactttacagtaattacagcatgtggctgaaaataactatttggttctttttttaaaccactatagttagatggactataaacatcattcagtttccctgtgttgtgattcatttccacaaacatgtattgtgccaggcactgatttaggtgccacaaaaaatagataagaaatggcttgacaactgtccttaagtttaataggcatgagatttctagatactgctctactaatgtgtcattgcctacaactcacctgttctgaatgaccactttttttgttatcctatatcagaagtacttggaaaaaaataaccagcaatttgacgttttggagaaatgttttattctcttctgtttttcaccaaccaagcaagcagcagtgatgttttgtttttttaaaaatcagaggcagggatctgagtatttcatagggatttcagttcgtttcagtgatagaggatgttggcactaagtctaagtaccacaacctaacggggccatctcattttacattccccgttgttcctgcaatgggaacgaaggcctgaaagctgcctgccacatgagaaaaatggcagcttttcaaagttctcgaatgttaacctcccttgaatctgttaaggcattcagagcacagtgcaagaaacttaaggtttgaattggactgtgtctccgctgagttggcgtagcatattaattttctatttctattggtaacttttgttgttgctaaattcttagtaccttttggttttatgttgatgcgaagtagtttaagtgttacagaaacagtggctttaaagttatggtattgcttttctcaaataggcagcacttagtaaaacaaaaagaaaaaaaattgcctaataagctgggcacgctggctcactcctgtaatcccagcactttaggaggccaaggcgggtggatcacttgagaccaggagttcgagaccagcctgaccaacatggtgaaaccctgtctctactaaaaatacaaaaattagccgggcgtggtggcgggcgcctgtaatcccagctacttgggaggctgaggcaacaagaatcacttgaaacctggaggcagaggtaagcagtgagccaaggtcgcgctacagcactccagcctgggctacaaagctagactccatctcaaaagaaacgaaaaagaaaagtcaaaagaccattctggagtcctctgatgaaatgagatctatgtcgttggtatgaaaatgaacatcattcacattgtttcctaggcagagtcactgcttttgatgctatttgtatcatggtagcgttttgacagccaacaggaatttccttcttagtattcacattgagaaatgtgattaaacatcattctgttgcctaaaaggcaaatcagcagctagaacagctttaaaagggaccatggcagccactctcaagttctgtagccttttttgttttgttttgtttttaatctaatgaggtcctgtgaaaatagcccagtgtttgcatagataaaataagcattgtgggccgggcgcggtggctcacgcctgtaatcccagcactttgggaggcactccaacctgggtgatgaagcgagactccgtttcaaaaaaatgaaaataaaaaataataaataagtaaataaaataagcattatgcatttgaccacttgaaaaaaatgaggtttctctctggctagccattactccaaagatcaaaacaaacaacaaaacaagcaagagtggttatcatttatttctttccagttaactattgccaaatttgaatttatatggcagattttggttccagatggagcagtcatgatgatctgcttttggaagttcactcattgatttttgtaaacttcagcaagttacaaaattgatattccaaaatattttcttaaatcactccaaagttgtatctttcatctgacatcactattgaacctataaagactttttatgaaacctatgcaatctaattgttagtttaatccaaaaaaaatcatttggctggcttatgatcatttttatctgggggagaaatataacaatttgatctttttttttttttttttgagacagagtcttgctgtgtcgctaggctggagtgcagtggcgcgatctcggctcactgcaacctccgtctcctggaagtctaactctcatccaggcgggagtggagtgccttgacgcagtcttggctgactgcaacctctgcctcccagactcaagcgatcctcccacctcggcctcctgagtagctgggaccacagatgcaggccaccatgcccggctaatttttttgtatttttggtagagacagggtttcaccatattgcccaagctggtcttgaacttatgagctcaggcgatccacttgcctcggcttcccaaagtgctgggattacaggcgtgagtctctgtgcccagccctaatcatcttttttgatatattattttactgtttctagctagcaaaagatgattcttgcttgcttaaaataaagtccccacttcaggttttcagggaacaagaatttacagtttgtagaaattctccttgtacaatttagctacactatattcttattttttatgtgataagcaactgtacttaaaagtagactatcttggctggacatggtggctcatgtctgcaatctcagcactttgggaggcagagatgggcgggtgacttgaggtcaggagttcgagaccagcctgggcagcatagtgagctgagatcacgcaccagtgcactccagcctgggtgacagagtgagactgtctctaaataaataaataaataaataaataaatacccaaatgagtaaactaaaaatttacagcactattggtcacaccaagtcttttattgcaaggaagagggaggtttgtaggctctacagcctgagacgctagagctggctgcctgcatgcctgtcacagggtttctgtcttactagtaggggtgaagtcacttcactgctatgttagtttcctcatcggtaaatggaaataataatagtattgtacttaatgcaacagaactattcacttaaaaatgattaacatggcaaattgtatgatatatatatacacatacacacacacacacactttaaacacacttttttttttaaacaaaagggaagagtattagccgggcccagtggctcaggcctgtaatcccagcactttgggaggccgaggtgggtggatcacaaggtcaggagatcgagaccatcctggctaacacagtgaaactctgtctctactaaaaatattaaaaaattagccaggcgtggtggcaggtgcctgtagtcccagctacttgggaggctgaggcaggagaagggcatgaacccaggaggcagagcttgcagtgagccgagattgcaccgctgcactccagcctgggcgacagagtgaaactctgtctcaaaaaaaaaaaaaaaagaagagtgttgtattggggaggtaaaaaaaaaaaaaaaaaaaaaccacgttagaccagaccatgatgtccattgttttttatttttttgatggagtctcactctgtcacccgggctggagtgcagtagtgcgatcttagctcactgcaacctctgccttccgggttcaagtgattctcctgccttagcctccagagtagctgggactacaggcacccaccaccatacctgggtaatttttgtatttttagtagagactgggtttcgcgatgttggccaggctggtcttgaactcccaacctcaagtgatcctcctgccttggcctcccaaagtgctgagattacaggcgtgagctaccgcacccagcctggatttgtttttaaaacatgatattagtgtgttaattacattcacatttgcctagaagaaatttgtaacagaaataggagctcaaaacattgaaatgagatgaagcaacaaataatttaaagccacttaaaaatagagccaaacatggtgggatttctttgaaatatctgttaatgtttattttttaaagctgaatactgttcagttattaagtagaaccaactacccgtgtataattaatgaaaagaaaacacttgtgctaggtttataggtatataaacacttagatatctcacattctttggcaacagcttagggaaggcagccatgtactagagacttttagcttttttttgcagctgatctcagggacttgaagaactccttatggtatgattgaattattttttaataggtaaaattctcacgttattgcatgctcttcataaattaccttttttttaaaagagatggggtcttgctatgttgctgaggctggtctcaatctcctgtgctcaagtgattctcccacctcagcctaccaaagtgttgtcattatagacatgagccaccctgctctgccaaatgacatttttaacagctccatgagatcaggggactcttctgttcacagttacatccccagcaccttgcagagtcactggcacattcctgaaacccaacataataaactacgtatgtgaacaaaaccaactctgaccacaggctagaaagaattcagtagaagtttccattgactcattcatgcattaagcaaatattttcttttcttttctttttttgagacagagttttgctcttgttgtccaggctagagtgcaatggcgagatcttggctcaccgcaacctcctcctcccaggttcaagcgattctcctgcctcagcctcctgagtagctctaattacaggcgtgcaccaccacgcccagctaattttgtgtttttagtagagacagggtttctccatgttggtcaggctggtgttgaactcccagcctcaggtgatccgccagcctcggcctcccaaagtgctgggattacaggtgtgagcccccatgcccggcctcagcaaatattttcaaaggacatctagattggtagtgcagtatgtcttgactgatagtgggggatgtgatgaatcaggtattgtgaagaagaaactcatgttagaactacctgaacaatgccaagagcacctcctggtaagtggagtttcacaaaaggagtattaaaagggcactaatcccattcacaaggggcccaccctcatgacctaatcacctcccaaagggcccacctccaggtaccactgcactggggattaggtttcaacatatgaattgggaaagggaggcataaacattcagtctgtaacaataatatataaaattttaaatcaaactagataaacatttattcaaaataagacagttaccttaatatataagaagtttatgcaaaacaataaatacaaaatttctaatagatgaatgaacaaagattaagaagagaacagttacaaaaggaattccaaattccaaatgaaaatgtctaaaacattaatttcatgaataattaaataaatgcactttgggagaccgaggcaggtgcattgcttgagcccaggagttcaagaccagcctgggcaatatggcaaaaccccatctctacaaaagatacaaaaattagccaggcatggtggcttgcgcctgtagtcccagctactcaggaggctgaggtgggaggatcacctgagcccaggaggttgaggttacagcgagccgaaattgtgccaatgcattccagtccaggcaacagagtgagaccctatctccaaaacaaaacaaaacaaaagaaataaatgcaaaaaaagcaatttgcctaccaaataaggtagtttttttgttttgcaaatggtagtattcagtcctagtcagggttcagcaagttagggatccttgtatactgttggtgagtgtgtaattggttcaccttttctagtaaagacctgggcagtagtcgaggctggatttttagccaggatgcttggtactgctggcctcttctgattggacagggagtctattgataatggattgttaaatagttttattatcattcctgctagaaggtatcaagacactttaaaatgttcatatacagagacctattggttttcctcatgggaatgtaaataaattttgaattaatctttctgatatttcttcatagctctgtactgtaaagacctactagtatgtgagctccatgagaatagagaagttgtgtcttcttttacctgctaggccctcagtttctagaatagtatttggcatagtaagtgctcaataaaatatttgttggaagaatggatgggtgtatgtgttttgggcatacagtagaaacagcatatgttgcttactgtaatgttttgtgttctcttttaagaacattttatttgacagtatttattatattaatattactgtggtggtatatgaaaaatatttttggcctttagacagtaatcgtccgggattttttttttttttaagaagtttttcccccaagggtgaagtcttttttgcaatcaatcatcaatccatagttgggtactaaatgatgcccattttctgaaaaatgtttttttttttaagggaagaaaacagaggaacatcaatcaaggaaaaagtaatagttcaatactttatgtaatagctttttctattcacttaagtttttccttcataaatgttttaccttcatttttgatctctaattggcagaggctcaagtgaccttaagtatctcttatcctgaagattttcctatcaaccaaattgtaaactaataaataattatggcatattacaaaagaatgtatgaaaatatgtatgtatagaataatatgtacaaaaatagcagtaaaatgcacatccatgtacatgccacccagcctaagaaatagaacattaggctgggcacggtggctcatgcctgtaatcccagcactttggggggccgaggcaggtggatcgcttgaggtcaggagtttgagaccagcctggccaatatggcaaaaccccatctctactaaaaatacaaaaattagccaggcgtggtggcgtgcacctgtattcccagctacttgggaggctgaggcaggagggttgcttgaacctcggaggcagaggttgccgtgaaccgagattgcgccattgcactccagcctgggcggcacagcaagactccgtctcaaaaagaaaaaaaaaaaaaaaagaaagaaagaaataagaaatagaacattattccagaatctcctgctggcccctccctgatcacatccctttctaagcctctgccaccctatttgagtgttcagaattttgcattgaacatattctgttatttttacagtttcatcctgtatgaatataccagtaaaatacattgtttagttttgcctatttttggacttcaagtagaatcagatggacaggtgggtttgtcttagtctattttgtgttgctatagcagaataccacaacctgggtaatttataaacagtagaaaattatttggctcatgaatctagaggttggaaagtccaagaatatggtgctggcaccagttgaaggccttttgccacttagggcaagagagcaagagggcatcaaactcccttttgtaacaagcccactcttgaaataactaatccactcctttgataatgatattaaaccattcaggagggctctgccatcttttatttggccccatttcccattaagtttctgacacatgaactttggggaacacattgacaacaaagcaggttgttgccaatattttttttagcatgaattatgctgctataaacattcatatgcatgtctcttggtgcacatgagcaagagttattgtctagctcctaaaccttaagatatatacctagagatgtcatacagaggcacaggttcacctttactaggtaaaaccaacctgttttccgaggtccccagcagtgtgtgaatgttgccattacaccacgtccttgtttacacttggtgctctctgactttaaatttttaccagactgatggatatgaaatggtatttcattgtggttttaatatgcatttccctgattactaattaagctaaatatatttattgcttaaaattcttatttatttatttttgccccttttcctgttaagttatttgactctttttagaacagttggagccaggcacagtagctcatgcctgtaatcccagcactttgggaggccgaggcagggggattgcttgagcccaggtattcaagaccagcctgggcaacatagtgatatcctgtctcttaaaaacataaaaaatagaacaattgaaggagtgctatctatattctagataccaattctctgttgatcatatgtgttacaaatatcttctcccagtttgtattttttatgttcactttcctcaatgctatcttttcgtgaacggaattttttagttttttagttttattgacttttttcattatggtgtacactttttgatgtcttgtttaaaaatcatttctggctgggcgtggtggctcacgcctctactcccagcactttgggaggctgaggtgggcagatcacgaggtcagaagatcaagaccatcctggctaacatggtgaaaccctgtctccactaaaaatacaaaaaattagcctggtgtggtggcacgcgcctgtattctcagctacttgggaggctgaggtaggagaatcgcttgaacccaggagatggaggttgcagtgagccgagatcgcaccactgcactccagcctgggcgacagagcgagactccatctcaattaaaaaacaaaacaaaacaaaacaaaacaaatttcctacctcaggatccaaaagatattatcctatattgtctcctaaaagttttatagcctagccttttacatttaggttcttaattcttaatccacctggaataagtttttgtatatttttaaaagtagaggttttatctcatttttcccgatagatatgcaattatccccgtacctcttattgaacagcttgttctttccccactggttgatgacaatgatgatgatgatgatgaaaatgatagcattaacacttactgagggcttaccatgtgccaggcatatgctaagcatgaggtaatttactaatccttttagtaactcagtgagtaggtcctgcttctatcctcttttgagttgagaaacagcaacacagaagttaaatacttgcttcatgtggcatacctagtagtcaaagagccagcattcaaaccaatttattctagttccagaatccagattcttagccattaggctctgcatcttttctacatggctacatctatcctaaatcaaaagtcatttttgcatggacctgttcctggcctttcaattctttgtatttgtctatgtctttgtccctggccaatagcacaaagcctcttaattaactttagaataagtcagtatctggtgtggctactattcctaccttgttgttcttcaagagtgttttggctattaattgacctttgcatcttgatttaaatcttagaattttgttctccagaaaacttgttggggttttaattgaactgcattgaatctgtagataatctaggggaggattgatatatctataatatatggccttccaatccatgaacatggtatatttctatatttattctgtttttctttaatgttgtcttagtccatttgtgctgctataacaaaatacctgagagtggataatttataaacaacagaaatttatttctcacagttttggaggctgggaagttcaagatcaaggtgccagcaggttcagtgactggtgaaggcccattcctcagatggtgctatctaggtgttggtgttgccacatggggaagggatggaagagcaacagcagctctctgaagcatctttcatatgggcattaatcccatccatgagggtggagccttcatagcctaatcagttcccataggcaccagctcttagtactgtcaccttggaggttaagttccagcatgacttttggaggatacattcattaaaaccttagcaaatgcattttaataaagttttatactttgctctattatgttcttgcacaccttttattatgtttgtttctgtctacttgtaattcttcatgctgttataagtaataatgttatatatattttatatatatatatatatatatatatttttttttttttttttttttttttttttgagatggagtctcactctgtcacccaggctggagtgcaatggcaccatctcagctcactgcaagctccgcctcctgggttcacgctgttctcccgcctcagcctcccgagtagctgggactacaggtgcctgccaccacgcccacctaactgtctcttgcttttccaccttccttccatctctgctgtctgtttggcttggctgatttttacttattcttctcatttcctcttagaaatccctccctctgaaaggccttccctaatcccatgtctatcttgagccctgcaagtctatgtttctactgctcttttagcctagagtgctcattagcactctactgttccctactctcattccagtgccagtacagagcttggctgagagtgagctctcaataagaatggttgaattatagcaacattttggaaggagacaaaaaaaaaaaaaagacccaaagaaaagtggcttagacaacaagggcacattttctatctcacatgacaaagagtccagaggcagggaaattccaggttggtgtctcagttcagtaatagctgagaaattgtcatcaaaaagccaggtgctttccatctctggctctgccatttcaagcatcacaggtagctatgaccacgtcaagtaaagaagaggagggagccgggtgcagtggctcatgcctgcaattccagcactttgggaggccgaggcaggcagatcactttaggttaagagttggagaccagcctttccaacatggtgaaaccccatctctactaaaaatacaaaaagtatccgggtttttttgggaggaaacctttctcagtacgtgtttagtagatatctgctacatctggttagccagggtaatgtcacatgcccatgtctgtgttgcaagagagatggagaaagtgatcctgtaataagacaggtgctctgccaaagggaagatgggatggatgggggatagctgctagattgtcagccaagatgctcagacaaaagtgtctgttgcaagggatatctcacagaaccagtggctggatgaacaggccagtctcacaagggacttaaattggccagtggaaagtccacaggtacattttgaacatatgggggtaataatgtcttgtgtttgctttcctcttcatctctgcagattagcgttttttccactaatttggcatgcacatggacaaaaattgcctcttagcgatttttttttttttttttttttgagactgggtcttgctctgtcacccaggctggagtacagtggcacaatctcggctcattgcaacctcctcctcttaaattcaatggattctcttgcctcagcctcctgagtagctgggattacaggtgcaggtgcgtgccgccatgccaggctaatttttgttttttgtttttgttatgagacggagtcttgctctgttaccaggctggagtgcagtggcacgatctcggctgactgcagcctccacctcccgggttcaagcaattatcctgcctcagcctcccgagtagatgagactacaggcccatgccaccacacccagctaatttttgtatttttagtagagttgggggtttcaccatgttggccaggatagtctcaatctcttgaccttgtgatccgcccgccttggtctcctgaagtgctggaattacaggcgtgagtcattgtgcccagccatttttttttttagtagaaatgaggtttagtagagatgcccatgttggccaggctggtctcaaactcctgacctcaagtgatccgcttgcctcggcctcccaaagtgccaggattataggcgtgagccactgcgtccagcccctcttagcaatttttaccttttagctctagcacctattcccatagagtttttcatgcaagtccttgagtcagatgctcaactatggcagtggggttgagaagtgggatcccttctcttagaaagggacatcacctatgtgtttgcagagccatcttaaagtgggaagtgaatgaattggcaagcgttttagtggaaaatctttttccttggtgttaactaagtttcagatgccagggccttaaacatttttttcctgtaatatttttgtaatattttgcacccactctaccactgccccctccaacttggaaatatttagagtttagaaataagtcaggactttaaaaatctggctttttcttctcattaataatttagcttgtatacttctttcttctttagtctttggattgcattcaaagttctccctggtatttagagtgagatttctttctctctctatcaccctcttttcttcctttcctgggtcggtcttgaacttgttttctgggggagagaatcacctatggagactagtgtgggatgtttgagaggcacagttggttttccagggctgagaagaatgcaggacagctagaggcggggaagctggttgaacctttgcacctgctgattgatcaagcttgggaaagagaccaattcatatttagacagctttcgtggtccaatctctgcatagaaatcaggaaatgaaccagaagattccgttttcaggttgaagccagacactgaggggcttgactaagctcctcttgcttacaataaaatggagcattttttaaattataaagagcaagattttgctttctgagattagcgtcgatctttcatcagtgttgatgcagccaaacacagttacaagttatatccatccttctaagactaattttataacttcattatccctaatacttttcctcttcaagttatttgacaataccatacctatctggaggagtaatttttaaactatttaaaaaattaggtggttttttcggtttgttttttgagacagagtctcactctgttgcccaggctggagtgcaatggcacaatctggctcactgcagcctcgacctccccaggcccaggtcatcctcccacctcagcctcccaagtagtgggacccacaggcgcatgacaccacacccagctaatttttatttttattttttgtgcagagtgggtctcgccatgttgctcaggctggtctcgaactcctgggctcaagtgatcctcccattcagcctccccaagtgctgggattatagtcattgagccatgacgcccagcagaaattaggtgtttttttttttttaatgaaaaaaagtaagcagtttaatttttttttttttttttgagacagagtctcactctgtcacccaagctggagtgcagtggtgcgatcttggctcactgcaacctccacctcccaggttcaagttcctgaatagctgggattacaggcgctcgccaccatacccagctaatttttgtatttttagtagagacggggttttgccattttggccaggctggtcttgaactcctgacctcaggtgatccagccacctgggcctcccaaagtgttgggattacaggcgtgagccaccacgccggccttaaaatcttatttttttacagtgtctttcactccgcatctttggggcagttagagatgtttgtttttgtttgttgcttttaccgcatccgtagaaacaagagaggaactgaaagtgactaaggtgttctaagaacgtcaaaataggctagaagtttattgctgctttttaaagggatacattccatagcagtttcccctcctaatctcatctgctcagactctagcacagtcaaaattctggcactttttctacaggttgtgattttcccctttctcttcatttcagaacacatttggctcagagcaccgctgcattcattagtcctgaggcttctactttctgagcccttccatttgttgcacatccaacaacagcctccttaatgcccttttacacaatataattattgttataaaaatatgaaaatgcaactttttgtactctatgtgtctttctgcattctttttttttttcttttttttttttttttttgacaggatctcactctgttgcccaggctggaatgcagtggtgtgatcacagctgtctgtagccttgacctcccaggctcaagtgatccttccacctcagcctcctgggtagctgagactataggcgtgcgccaccacacccagctaactttgtgtattttttttttttgtagagatgagggtcttgctatgttgccgaggctggtctcaaactcctgggcccaaatgatcctccttcctcagcctcccaaagtgctgggattataggcatgagccgccgcacccggcctccacattctttatatcactaacttcatccatatgcagctgcctcctaaacttcagctaagttttatttttttaacccacacatatatttttatcatatatttgcttacattcttatctcgtgttcagaatgcaactacaaagagccatgaacgtagtgttttcatttctacaacagaaacagactccttagtgttttcatttctgcaacagaaacagacttatgactaattataacaattaagcctaagtttgtacctgtttttattttatttacttatttgagacgaagtcttcctctgtcgcccaggctggagtgcagtggcaccatcatgtctcactgcaacctccgcctcctggggtcaagcgattctcctgcctcagcctcccaagtagctgggattacaggcgcctgccaccatgcttggctagtttttttgttttgttttgtttctttttgagacagagtatcactctgtcaccaggctggagtgcagtggcataatctcagctcactgcaacctccgcctcccaggttcaagcgattctcctgcctctgcctccagagtagctgagactacaggcctttgccaccatgcccagctaatttttgtatttttagtagagatggggtttcaccatgttggtcaagatggatttttttgtatttttagtagagacggggtttcaccatattggccaggctggtctcagactgctgacctcaagtgatccacccgccttggcctcccaaagtgctaggattacaggtgtgagccaccatacccagcctgtacctgtttttaatggcaagttctagaattgcattttaatgagatttgaattcagtaagacctttcattttgtgtgcttttcctttctaattaaaatctgttgtattaacttgaatgtacaactagggcactgtggtgctggagcccctttttgtcagttacctcacaggctcctgctataggagacattttcaacccagggagcacagcaccctaattcaaaaaccagtttcagaaacagcagatgaatatatgattttgtggaatctgcatctactcctattgtcaaaacataaggtatctgtgatccttgaaataaaccttctattcctaagtcaccatagtgtttggaagaaaaacaacaaaaggaaaaaacaaataaaccttctaattctgcctttcacatgtaatttattctttttgtgggcaagcaatgaagtcactttgggtaatcctttttcatcacttttaggttgaaaaatatatttgagtatttctgcttttaatattctcaatttggcagggcacagtggctcacgcctgtaagcccagcactttgggaggctgaggtgggcagatcacaaggtcgggagatcaagaccatccttgctaacatggtgaaatcctatctctactaaaaatacaaaaaattagccgggtgtggtggcgggcgtctgtagtcccagctactcgggaggctgaggcaggagaatcgcttgaacccgagaggcggaggtcgcagtgagctgagatcgcaccactgcactccagcctgtgcaacagagcgagactccgtctcaaaaaaaaaaaaaaaaaatctcaatttgtctatggaaattaatttaaatctttgttaaaagctcgagaagttaatttcaggtggtatttgtgatggcacatttttgtttgtaaagttcttttttgagacagagtctggctgtgtcacccaggctagagtgtagtggtgcgatctcagctcactgcaacctccacctccctggttcaagtgattctcctgcctcagcctcctgagtagctgggattacaggtgcaagccatcatgcccagccttttttttttttttttttttttttttgagacagtcttgctctgtcaccaggctggagtgcaatggcgccatctcatctcactgcaacctccacctcctgggttcaagcgattctcctgcttcagcctcccaagtagctgggactacaggtagctgccaccatgcatggctaatttttgtgtttttagtagagacagggtttcaccatgttggccaggctggtcttgaactcctgatctcaggtgatccacccacctcagcctcccaaagtgctgggattacaggcgtgagccaccacgcccggcctgtaaagttttataaaactttctacgtttctgtaagtgcagcttctttaatattcagaaccaaattgattttttaaaacattttaaatggatattttcttacagttactctttgagtaaatctataccctctgacacattttcctccacagtttgaggaagctaatgctagtaacataatcctaagggattctgtttaaacagagccatttaagtcctgcttcttaaaatgcccaagtcctcaggaaggtgaatttatcaaaaactggagtatacagaaatagcagtctagatagcacagaccaaagtagtctcagtagtgtggaggagatcattcccttcactgggtgaataattcactgcaggagagatttgcttgcagagggggactggcctcaggaccccctttcctggagtctgtgccacttacataggtaattttagcaacttagtctcttactagattggcttattccagggattttgaattaatgttggtttagtacactttttttttttttcgagatggagtcttgccctatcacccaggctggagtacagtggcgcgatcttggctcactgcaacatctacgtcccaggttcaagcgattctcctgcctcagcctccagagtagttgagattacaggtgtgagccaccgcgcccagccggtttagtacactttttaattacaggaaaacaccatattaaagttgacctagactttggaggaaaacttccttgtggatgacttgggtctcctcatctcaaagtaaatagcttttctgaatgtagttcctgtgacaactcttctgcataatttgagcaaaaaataggttacagaagactactttttttttttgaggcggagtctcgctctgtcgcccaggctggagtgcagaggtgcgatctcagctcactgcaagctctgcctcccgggttcacgccattctcctgcctcagcctcccgagtagctggggactacaggcacctgcctccatgcccagctaattttttgtatttttagtagagccggggtttcaccgtgttagccaggatggtcttgatctcctggccctgtgatctgcccttctcggcctcccaaagtgctggaattacaggcgtgagccaccgtgcctggccaagactacttttttgttagtttttgtttgttttttgagacagagtctcgctctgttgcccaggctggagtgcagtaatgaaatctcggctcactgcagcctccacctcccaggttgaagttattctcctgcctcagcctcccgagtagctgggattacaggtatgtacctccactcctggctcattttttttgtagttttaatagagacagggtttcgtcatattggccaggcaggtctcaaacttctgacctaaagtgatccgctggcttcagcctccctaactgctgagattactgctgagactacaggtgcgtgccaccatacccagctaatttttgtagttttagtagagacagggtttcactatgttggccaggctggtcttgaactcctgacctcatgatccgcctgcctcgacctcccaaagtactgggattacaggtgtgagccacgtgtgcccagccaatttttgggtttttattacagatttgtgagggcaagattttttttttgaacttaatgaagatataatgacccaaaccaatgccatagcccatgcttattgtaacttaatcagaatatagtacctaaaaccagacctgaaaataattgtaaaaagtagcaattgcatattgattaacacaataacactttcttcattcaactcttcagtttattcagcgtctcataactaacagcacctggcacacacctttggttggtttgaattcaaggagcagtgtgaggtcaaggtcaagggggagtgtaaggtcaaggtgaagtgtgatgttgggtgagtggttcagcgaggttcctgaaaggtaccatcaggttgtaaccaacagcttggaaacatccatttgtagtcctcttggcaatcttagagtgaatagttgaaagtatgggttatagtctgttcagtggtgcttacacaggagtgtccgaggctaggtaattaataaagaaaaaaatctttgtttggcttataattctgatgtctggaaaagttcaagataaggcacctgcatccagaaagggccacaggttgctccattcatagtagaaagtaaagaggagcctgcatggcagaggtcacgtggccagagagggcacaatagagaggggggaggtgctgggctctttctaacaaccagctctggccaggactcatagagcaagaactcacccattacgtcaaggacggcaccaaggtattcatgaaggatctgccgccatgacccaaggcctcccattaggccccacctctgacattgggaatcaaatttcaacatgaagtttgagggggacagacatccaaactatagcagtatgtatacacagtatgcacctataaaataaacattattttctattaggttgtttattacctaagtttcttaatgtttagaatgtgcaactttgaaatataaattttattttatttatttttttagatggagtcttgctttgttgcctaggctggagtgcaatggcgcgatctcggctcactgcaacctccgcaggttcaagcgattctcctgcctcagcctcccgagtagctaggattacaggcatgggtctccatgcccggctttttttttttttttttttgaggcagaagtcttactctgttgcccaggctggagtgcagtggcgcgatctcagttcattgcaacctctgcctccaaggttcagatgattctcctgcctcagcctcctgagtagctgggattacaggcgcccaccatcatgcctggctaattttttttttgtatttttgtagagatggggtttcaccatgttggccaggctggccttgaactcctgacctcaggtgatctgcctgccttggcctcccaaagtgctgggattatagccgtgagccaccatgcccggctaggaagaaatttttgtatttttagtagagatggggtttcaccatgttggccaggctggtctcgaactcctgacctcaggtgagccacctgcctcagcctcccaaagtgctgggattacaggcctgagccaccacacccaacctgaaatagaaattttagcatatatgttatatgatagtggttctcaaagtgcagtccctggacctctggagtttcctgaaaccttctcatggagtttacaaggtcaaaactattttattaaggattgtctttttaaccgtgttgacatttgcaccaacgttacaaaggaaatggtgggtaaagctgatgctttagtatcagttaaatcaaggctgtggctccaaattgcactggtaactactatattcttcaccattagctgtttttttttgttttgttttgtttttttgagatggagtcttgcactgtcacctgggctggactcattgcaacctccgcctcccgggttcaagcaattctcccatctcagtctcccgagtaactgttattacaggcgaccgccaccacacccggctaattttttgtatttttagtagagatggggtttcaccacgttggccaggctggtctcgagctcctgaccttgtcatccgcctgcctcggcctcccaaagtgctggattacaggcgtgagccaccatgcccagcccaccattagctgttttaaaaaatttcagttttacttgaaaatgttcttaatgaaacagtgaagattattcattttactaaatctcaaacccttgaagatacatctttttaatagtgtgtatagtaagatgagaagctctttagtgcagactaaaatacatgatcctgagttgtaagttgaactagctgcttttttcatgaacaccatttttacttcaaagaatgagcgacagacaaacttttgagtatctggcaaacattttctcaaaaataaatgaagtgagcctgtcacttcagggaaacagctggcaatgtttgttgccaatgataaaattctagctttaaagtgaaaattagaacttggggaaattgtttttccactgtgagtttgacagcttccaaatattaaagactcatcagaaaagatgagattggtactgatataaacaaatgtgattcaaaaaaaatattttacaagaaatgtttcaacagttggaagatctgcatatatctatgatataatattttctttttttcttttttcttttgtttttgacatggagtctcgctccatcacccaggctagagtgctgtggcgtaatctcagctcagccgagatcagcaacctccccttcccaggttcaatcaattctcctgcctcagcctcccgagtagctgggattacaggtgaccaccaccacacccagctaatttttgtatttttagtaaagacggggtttcaccatgttagccaggctggtctccaactcctaacctcagacgacccgcctgcttctgcctcccgaagtgctgggattacaggtgtgggccaccatgcccggctgagataatattttctaaatgatcaatgaataatttacatgatcatatacaggtaaaagatccattcaaaatgtaaggtggaccagtggatcttactgtagctgagttggaaactgcatctctatggtttcagatttcatattgcaactagcctttgagaagctatgatttgtcaagttttggtgtggtatcaaaggagaatgtctgcactgatctaaaaagggccttgaagtgtcctttgttttctagctacgtatctgtgtgaagttgtgtttttttcacatatttcagccaaagtaaagaatcgtaatagattgaatgcagaagtctctatgataatccagctgtcttctattaagctagacattaaagagatttgcaaaaatgtaacacggtgccattcttcttactgttttgttttggaaagtacagttttaaaaaataaaaacatgctctttccattaacatgtaatggtaatgggtttgttttctttttaaatgaataaatacctttaaaaatctctccattttaaatttctgattgagtaaatattgatagatgtaactcacacaaaagctcttcggaattctcaatgattttttttttttttgagacagagtctcactctgtcgccccaggctggagtgcagtggtgcgatttccactcactgcaacctctccctcccaggttcaagtgattctcatgcctcagcctcccgagtagctgggactacaggtgtgtgccaccatgcctggctactttttgtttttcttttgtagagatgaggtttcaccatgttggccaggctggtcttgaactcctgttctcaagtgatccacctacctcggcctcgcaaaatgctgggattataggcatgagccactgtggctggctggttctcaaggatttttaggagggcaaaggggcccccagaaccaccgtgatgtgacatcaggcaggaagggatgcatttttgatgacaccatccccaaagtagcaaaggctgtttttaaagagccgtttataatatttgttcacaaaggagtccttttaagatttggatttttttttccattaacttttccacattttagtcaagaatgtaagtgggttgattcgtttttcatctgtcttgaattttcttctagctgctgtcaagtcagtgctgcagcagttcatgtgatagtgagagcgtgggggcatcctcaggtttcacagagcatcaaaagaactctgctatagtcacaaacaagcaccagctcatttgttactgagtaaggtttttattattaagatcttctatcttatttgggctctgtcatcttggtaaacgctttattatagcttgtagaatggtcctgaatagagataactttatggaaaacatattgttggattgaggccagtaatttttaaggtggactcagttcaaatgtagatgggctttttctgttgttttcaagggctttggtatcgaaagctgttgctttgtatagtatacatcagtttgaatgcaaagtgatatggtggggggaaatctgtagtcaggttgttaataggccaagaatgaaacctaagagcatatcctctgggcaagttttcaaggtggcacctatgactgctgaaaacaatcaaggctttggagattatgggaaatcatacagggagagggcttttttgtttttttttttttgaggtggagttttgctcgttttgaccaggctggagtgcaatggccccgtcttggctcactgcaacctccacctcctgggcttgagcgattctcctgcctcagcctcccaagtagctgtgattataggcgtgcgccaccaggcccagctaattttgtatttttagtagagacagggttttaccatgttggccaggctagtctcagactcctgacctcaggtctcaaactcctgatcctcccgcctcagcctcccaaagtgctgggattacaggtgtgagccaccgcgcccggccattttttttctttttttttttttttcgagacagagtctctgtctttcgcccagactggagtgcagtggtacaatctcggctcactgcaacctctgtctcctgagttcagtggattctcctgcctcagcctcctgagtagcttggattacaggtgcatgccaccatgcctggcaaatttttgtatttttagtagagatgaggtttagtaaagatgactgtgttggccaggctagtctcaaactcctgacctcaagtgatccgcccaccatggcctcccaaagtgctggaattttggatgtgagccaccgcgcccagctgggagagggcttttaaataaaggaaagggtgtttatgtttttggtttttgttttttgagacagggtcttgctttgatgctcaggctggagtgcagtagcctgatcatgactcactgcagccttgaagtcctgggctcaagtgatcctcctgcttcagcctccctagtagctggggctacaggcatgtgtgccatgatgccctgataattgttaatcattttaaaaataaatatgattactgtgaaactagatccacaaagggttactgataagcagagggctttgacgaagtcgtgctctcaatttgtaagaatgatttgtagtcatagcttgagttgtgtgtatatttgttctctcaagtagtttaaggtgatcttcagtctcgtttacactattagcttacttgatgacccttgactttataaataacataatctagtgtttcttaaactgaaatctaggggtttgtggaatatatattattgaggaccaagaatcaactttaaatattaaaaattattagtcataaagacaaacattttgcacttttgttttataattttgtatttaattttttgagacatagtctcattctgtcacccatgctggagtgcaatggtgtgatcttgactcactgcaacctctgcctcctgggttcaaacaattctcctgcctccctcagactcccgagtagctgggattacaggtgcctgccatgacgcccggctacttttgtatttttagtagagatgggatttcaccatgttgtccaggctggtctcgaactcctggcttcaagtgatccacccgccttggcttcccaaaatgctgggattacaggcgtgagccacctcacctggccaaaatctcagtcataccttaataaagtggttttaaaaaaaaacaggccggccggaggcagtggctcacacttgtaatcccagcactttgggatgccaaggcgggaggatcacttgagcccaggaattcaagaccagcctgggcatcatagtgagacctcctctctgcaaaaaatacaaaaattagtgaaggcatggtggcgggtgccaatagtcccagttactcaggaggctgaagtgggaggatcacttgagtctgggaggcagcagcaagctgagattgcactactgcactccagcctgggggaaagagcacgactctgtctcaaaacaaaccaaccaacaaacaaaaaacagtctgaagtaagacactgaatgtatactgttagattgcacaagcgtaggattaaacactagctttatatttttatatttgagttggcacttccccatttcgcatgatcctcatgactgatttgtgaaattaggaaattagattatagctgcgtcttacaggcaaatgactaaaacttgaaacatttgggggcctgtctctgtgaaatccctttgctggggctagaaccctcatttatgactgttacctctcaggaggcagcaaattttccatggagaattccatttccactggaattctctcttccctgtgatgtgctcatgccccctctggctcgcccccttagtcctttctgggctctgcttcctgggccaggccctctttgctaattctgtgtatccttgctgtcgtctttggtgttctgatcctcggctgttgcttgagatccacctactcacttgatgcccttcttgagttctaaatccttctgtgtttccagctctcttctggacaggccagtccctcattcaacatgtcaaaacaacatttaattttcaccccaaactgtagctctttcttatctggatcttctgtttaattccgggaagcagaacctgaaagtcactctggaatcctccctccccctcatacccttgccagcctccacgtccaaccggccactcacacactagttgattgtgtttgttaaatgtccctagaattcttcccttctgtgcctattttgtctcatctagactgttggagccatttcctggctttctcttccaagtcctcttgtgcctgctggagagtctaaactcctaagctcgtccttcaaggccttgggtgatctagctctgagctgtctctagtttcatcactcgccaactccacttcccttctgccccacccacctccaccttgcactcaaagacaaattcacttgattcctggatatctccatgtctttgcattagctgttgctagcatacctgtcccctctcattctttatttggggggacagagtcatgctcttatacccaggctggagtgcagtggtacaacaccatgcccagctaatttaaaaaaattgtttttgtagagatgggttctgtgttacccaggctccctcttgttcttccagaccagaaaccccaaggcacaatgcaaactcaggctgtatttttgttcattttggttccccagctccaggcactgttcctggctcacagtgtgggtttggtgtatgtttggaagaataaaatccatgtgttttattttaatcatttgaagaaagcaaaattttgtaacacttccccccgttcctcggctcagattcaatcagctgttttgaatgattacccagagataacagttaaggtgcaaaccgtgtgtggctgtgtttgtgtgtatgtttcacctgtcggtttttggcgtctgggaatgacatttttccttgcactgagacatcagttatatctgaaaactatgtttctaaaaggaataggaaatatgaatgaataggtcagagttcagtactccaggcggttttcaaaccaaatttggtaatgttgatttaaaatggctcaacaaaaaagcaccccaagtataatcatggaaaatattagtactactttgtatgtagtaatatgttgttaagagaattattcattgaaattatgttaatcacagggaaagaccataacttctctcttggtttgtttcaacaggatcagtttgacaacttagaaaaacacacacagtggggaattgatattcttgagaaatatatcaagtttgtgaaagaaaggacagagattgaactcagctatgcaaagcaactcaggtaagttgatattgaaaaaggttatttgttaactgcaaaatgatgtaaggataacgtatattctcattttacagtataaatgtatattttaaatatttttccttttatgtaaggtaatatttcaatagaagtgattgtttttcatacagaaaattaattttcatagaacattaaaaataaaaactaaattactgctttaaggcccagttttttttttcaacaagatatttgctgagttttggagcagcttgtttctcagtaaactttttattgaaatatattaataacatatgtacagagaagtacacaaatcataagtgtgcagctccatgaattttgacagtgtgaacacactcatgtaaccgggcacccaggtcaagaaacagaaagaccagcctggcaggccccctggccccctccagctccccactctccccccagcggtaaccactctcctgacttctaaccgcgtggattagtagtgcccacttttgaactttacatgagtgtaatcatttggtatgcattcttgtgtatctggcttcttttgttctatattacgtttgtgagattgaccatgtggtagcatgtggtgggatctgcttattttcattgctgttgagtgttttggtctgtgaatgcaccagaactcatccgttctgactaggtgattggttgtttctaatttaagctataatgagtagcgctccaacgagcattattgtacaaggctttttgtgtgtatctgaacacatttcctaggatctacgtaggcatctaattgcaaggtcacaggctactcatatgcttagctttggtggatagggttcagccatttccagtgtgcttgtactaattcacactcccttctgtaatgtgttgaggggtcatgtggaatagtattttaaaagtacttcgggccgggcgcagtggctcacgcctgtaatcccagcactttgggaggcaaaggtgggcggattgcctgaggtcaggagttcgagacccgcctggccaacatggtgaaaccccgcctctactaaaaatacaaaaattagtggggcatggtggcaggcgcctgtaatcccagctacttgggagggtgagacatgagaactgcttgaacccgggaggtggaggttgcagtgagctgagattgtgccactgcactctagcctgggtgacagagtaagactccttctcaaaaaaaaaaaaaaaaaagtgctttggggccaggtgtggtggctcatgcctgcaatcccagcactttgggaggctgatgagggaggatagtgtgagcccagagacttcaagaccagcctgggcaacatagtgagccccctgtctctgttttttttttttttttaagtactttggatctccttacatcttttaatgatgagattatccaagaaatttgtgtttttatagaatatatttaaaagttcttggtagaactaagcttgaacttgaagtggcatgcaaagtccttaatgatttcatgttgtatagttgtagttgaattggtttgtggatattgttttaaggcctgttaaagagctagatgattttgatttagaaacatttactttcctttttctttaattttttttttttttttgagacagtctcactctgtcgcccaggctggagtgcagtggtacaatctcagctcactgcaatctccgcctcccaggttcaagtgattctcctgcctcagccttccaagtagctgggattacaggcttgtgccaccatgcctggctaatttttgtatttttagtagagagagtgtttcaccatgttggccaggctggtcttgaactcctgacctcaagtgatccgcctgcctcggtctcccaaagtgctgggattacaggcgtgagccaccgtgcccagcccttttttctttttttttttttttaattttcttcaagctccctcaccattgagttttaatccaaagagcatctgcataaaagatatgtgttcttggctgggcgcagtggctcatacctgtaatcccagcactttgggaggccaaggcaggtggatcacgaggtcaggagtttgagaccagcctggtcaagatggtgaaaccccgtctccactaaaaatacaaaaatgagccaggcatggtggcgggtgcctgtaatcccagctattcaggaggctgaggcaggagaatcgcttgagcccaggaggcagaggttgcaatgagccaagatcgcgccactgcactccagcctgggcaacagagcaagactccatctcaaaaaaaaaaaaaaaaaaaaaagagctatgtgttcttataagggtttctgttgttgtttcagcaagctgggattacaggtgtgagccactgtgcctggccccagattttgtttttattgagtgaataacatgtaaaacatcacacaatgaaataatttttataagtggagaatccagatcagtttctagtgccctgtgtgcatatcagtctcgtcaacacgtcaggggcttttcgaactgaaagtaggaatagaacatggtctgtttcacgttgattatttgaatgctgcactattagtcatgcaatgttgtctttcatgtgaaaatgggctacgtgcgagctctcaagcgggctactggtattcttcccacgacagtctcccttgctggcccctgctcttcccctgcctcttcacattgctgtgcccagcatctgcttctcagtccttctcccttcccagtctgtactctcctggtgacctcaactgtctcatggctttaggtataatccatatggcaatgactcacagatatggatctctaagccagacctctctcctgaattccagaaacagcttgctcaaagtctccacttagaaatgtctaaaaacttggctgggcgcggtggcttatgcctgtaatcccagcactttgggaggctgaggcgggcggatcacgaagtcaggagatcgagaccatcctggctaacacggtgaaaccccatctgtactaaaaatacaaaaaattagctggaaatggtggcgggcgcctgtagtcccagctacttgggaggctgaggcaggagaatggcatgaacccagaaggcagagcttgccgtgagccaagatcacaccactgcactccagcctgggcgacagagtgagacgccatctcaaagaaaaaaaaaaaaaaggaaatgtctaaaaaccatctgaaatgatctgaaatgtaacatgtctgaaactgaactccggatctccccaacttaaaaatccacatgtctaggccaagtgaagtggctcacacctaaaatcttagcacttcaggaggccgaggtgggtacttgagcccaggagttggaggccagcctgagcaacatagcgagaccctgcctctaaaaagaattttaaaaaattagccaggcatggtggcgcacacctgtagtcccagctacttgagaggctgaggagggcggatgcttgagcccaagacgctggggctgcagtgagccatgattgcactactgcactccagcctgggcaacagagcaagaccctatctcaaaaaaaaaaaaaatctgcatttccacgacctagattttcctccactcacctgagggtagctgcatccttcctggtttaggtcaaaaaccctagcatcacccaggtgcagggggatcactggaggtcaagagttcaagaccagctgactaacatggtgaaaccctgtctctactaaaaatacaaaaacattagccaggcgtggtggtgggcgcctgtaatcctacctactcaggaggctaaggcaggagaatcccttgaacccaggaggcagaagttgcagtaagctgagattgtgccactgcactccagcctgggtgacagagcaagactccatctcaaaaaaaaaaaaaaaaaaaccctggtgtcatcatcatctctgtctgccttcttttctcacacactcacactccccagctcaagccatcaggaaatcttgacttctctacagatttatccaggatctgacacttgttatcacctccactgctgccactgtggtccatgtcacatggcctacgtggtccatgatcttttgcctggttatgatgagtctactaactagtttcccttattctacctctatcccctattccctgatttctacagagcagccagattacagtattcctctgttcaaaattccagtgcgtccccatttcattcagagtaaatccaaaaaccttacggtgaaagtcctccaaaaccttgtataatctggttcccacacctttctgacatcatctgttttaactctcttcctcctcctctctgctgtaaccatacagaggcctccttcctgttttttgtacatgccaggcatcccctcacccgagagctattgcgctagcccttccatgtagatatcacctatgtgttcttccccaggctccaagtggctgactccctctcctgcttccagtttctgctcagtgaggcccacctcgtcccttagcccacttagcctgctttgctttttcagttttcctatattactggtaactttctaccattttatatagttttcttgtttagttttgaaaattgacaaaatatgtatttctatattatttgtatataaaattgtatatatttatggtatacatgatgtcttgaaatatgtatacgctgcagaatgcccaaatcaggctaattaacatatgcattactactcaaacttaatattttttttgtgggaagaacattaaaatctactcttctagcaatttagcaacccctcccctcccctccccttccctctttcttgagacagggtctcactctgtcaccctgggtggagtgcagtggcacgatcttggctcacctcccgggctcaagtgaacctcccaccacagcctcccaagtagctgggaccacaggaatgcgctgccacacccggctaatttttgtatcttttgcagagacagaatttcaccatgttgcccatgctggtcttgaacttctaggttcaagcgatcctctgaccgaggcctcccaaagtgctgggattacaggtgtgagcacccggcctggcaattttcaagtatacaatacattgttattaactggagacacaatgttgtacaatagatctcttgaacttatttctcctacaattttgcctcatttgaataacatctccccaaaccttcccagagaaatctgggtattatatttactgcgcattgtctcctgcagcctctcagctagaatgcaagccccttaagggtggagatctttgggttgtgctcactaatgtgtcatagtgcagaacagtgcctggcacatagtaggtgcccagtaaatatttgtagattgtgagtgaatcggtagggtacaggcctaagatatttagccagctttgctttatggggaattatgtgtttgcaccggcctgtgagagctgatgagattttaacaacaaaaagtagaacaacaaggtgccagccgagtttcaatcactagggatgcttgaatgaacgagacacaggaagtgcctgaacctggagtgctcacctttcacagcagaaaacagaactgcatgcaaattagcaaagaattcgagcatttaaagatagcatgtatgactccaaatatgtaaacgcagtgatgtgatagagattgaagtgggggtggttactgagctaggctggtcagggaaaacccatcacttgagaagtgaattacaaaaagaagccagacatgtaaggatgtggggggagagagtgcaaaggtcctgagacgggaacatgtagaaggaatagaaaggccagtgtggctacagaatattcaacagatacttggttgaaatagtaatatgatgttgaaaaatcattgtggcctttgggagagataactatcattaaatattttttttctgcattgcaggggagaatgctaacttattttagacataaacgtgagactttgattcctgtaggtcaggtcttagcatgggccaaatccatccactacttggttttgtaaataaagatttgttggaatgttgccgtgcccatgtgtattgtctatggccacttttgcaaacaattggcaattgagtagttgcaaaagagatgcatttacctgcaagtctgaattttttttttctcttcgagatggagtctcgctctgtcacccaggctgaagtgcagtggtacaatctcagctcactgcaacctccacctccagggttcaagcgattctcctgcctcagcctcctgaacagctgggactacaggcgcacaccaccatgcctggctaatttttgtatttttagtagagacaggatttcaccatattggccaggctggtcctagactcctgaccttgtgatccacctgcctcggcctcccaaagtgctgggattacaggcatgagccaccgcacctggccctgaaatatttactttctggtcctttacagaaaaagtttgccaacccctgaggtcactatctattcaaggtagtataggttgaaattcctaatataatttttttttctgagtctgaacaacctaattttatttatttttgagacagtttctgtcacccaggctggagtgcagtggcatgatctccagtccctttccagaaactatggcccatgacactccattagcagagtaacagggcctgctcaacctcaccctcactgctgctttctgtttccaaaccgatctttgtcaatttgctacttaacaactggtacatctaggtcttaaattgcatttctcttagtatgcatgggggttgaacatcttttgatacatttgagccatttatggttttaaaaaatgaaccattcaagtcttggtctgtttttaattggagctcattgtatatagagggtaactaggtagaaatcatattatacaacaaattgcatatcgtatatatcatatatataaagaaatgaatttaaatttaacagtacaaacgacagtaaagtgaaactgagggatgcgctaagctttaaatattaaactcttaggccaggcacggtggctcatacctgtaatcccagcattttgggaggccgaggtgggcagatgacctgatgttgggagtttgagaccagcctggccaacatggtgaaaccccgtctctctactaaaatcacaaaaattagccgggcgctcctgtcatcccagctactcaggaggcagaggttgcagtgagccaagatgacgccactgcactccagcctgggtgacagactctgtctcaaaaaaataaatattaaactttggtaaaatttatcaaaaagattatgaaaaacttacaggatgtcattattgtgtgtgtgtacttccatgttgaaattctaaacaggctcaattgactcactgctataaaagattaggaaaataatatatacatgttttgctccttcttctagttgagttatatgactgggttctgaaacccgaggccctcagttgatttgtcgtggttctatatttgaacgtagagtcatctcagcacttctctctacaacagcctctctccttgactcttggcattaaggaagaatattctccccctcgttagagcttgggacgtgttccctgcgttctttcttgcttgaaaatgccaccatactttacggcactttgacttggttgtctctggtcacactttctctctccatgtggctgcatcgtcttttggaggaaaagtctggggccagccagatgtttctctctgtaggcaacatggctgtttctgagtaaaaatatgaataattttagttcatcttagcagtctgataacttcactaagcaatgccttggagttgatcatcctttatcagatagtttttcttagtgctctttcctgtgtaaattctatgcttcatttatttcaggagaaagttctttgattatgtctgaatgttttttctattctacttactgggtcatatacttcagagatatgagttatccttatgtttcatcttattcttatttttatttttttatttttaaaattttttttcttgagacggcatctcgctctgtcacccaggctggagtgcaatggcgtgatctcagctcactgcaagctccacctcccaggttcaagcggttctcctgcctcagcctcccgagtagctgggactacaggcgcccgccaccacgcccagctgatttttacacttttaatagagacggggtttcaccatgttggccaggatggtctcgatctcttgaccttgtgatccgcccacctcggcctcccaaagtgctgggattacaggcgtgagccaccacgcccggcctatctttagatcctttttttttctgattgttttcacattatggttatttcagacctttcctctattaaatttgatatccaccctcatttattgatgggttctatagtggtatattttagtccttagttcatttcctcagctttgtgtcttccttctcattccattttattttatcccatagtattgggattcttgatttattgcctttgtgtttttactaagtttgtctatagtataaataatctgaaggagggtgatttttgcttattttccttatatgttttcttgcagactggattttggatttttcttttgcttctgtattacctgtcatatctttcactttgcttatatttattatttaatttttttttaagacaaagtctcactctgttgcccaggctggaatgcagtggcacgatctcagctcactgcaacctcagcctcccgggttcaagcaattctcctgcctcagcctcccaagtagctgggattacaggcacacaccaccacacctggcgaatttttttttttttttttttttttttgagatggagctttgttcttgttgcccaggctggagtgcaatggcatgatcttggctcactgcaacaccgcctcctgggttgaagcgattctcctgcctcagacttccgagcagctgggattacaggcatgtgccaccacacctggctgattttgtatttttagtagagacggggtttcaccatgttggtcaggctggtctcaaactccttaacctcagttgatccacctgcctcggcctcccagagtgctgggattataggcatgagccaccacacctggcccacggctggctagcttttgtatttttagtagagacagggtcttgccatgttggccaggcttgtctcaaactcctgaccccagttgacctgcccacctcggcctcccaaactgctgagattacaggccaccacccctggccatgttgcttatatttaataggggcagtttagtgaagtggttgagttcagactcaagagtcccaatgcctgggatgtaatcctggttcttccacttaacagccatatgaattgagttaaattactctccttgtttcatgattttcatctgtaaagtgtgaatcatcatcatcatcatcattctcaccttataaggttgctgagtgggcttaataaggtaataaagagcataaaggtcttaggccaacacctggcgtgtgtttgtttctaacgtgagccgcaccagtgccctgtctgctctgatggagtgtaggtgagtgttccttgccacacttcgttccatttctggtaccattggtctttccctttgagttccacttgaggctggggtattatatgttctgcttggtttgctgaaggccgaggacaggtgtttatagagtcagggtcgcgaaagggcctggcttcgagactctgagctctgtcatttcttctgaaactttgttagaggttctgttatggggtttacgccattaggtcaaagattgccctaattgtattagtccattttcacgctgctgataaagacatacccgagactgggaagaaaaagaagtttaatttgacttacagttccacatggctggggaggcctcagaatcatggctgggggtgaaaggcacttcttacatggcagcggcaagggaaaatgaggaagaagcaaaatcggaaacccctgataaacctgtcagatcttgtgagacttattcactatcacgagaatagcacgggaaagaccggccccccccatgattcaattacttccccctgggtcccttccactgcatgtgggaattctgggagatacaattcaagttgagatttgggtggggacacagcgaacccacatccctaatcctgtggaatccctgggtttggggcgaacccccagggcactcagcctggaggtctggaaagtggacctccggggggtgagccccggctcctgcccaaggccttgggtggtcagcatagatgtcttcctctcagaatttttctgtcactattccctgagcgcttgcctcccagtttacttctgtctgggctgattttcagggtttgtggacgtatttcccttcctgtgatggggaggaaggagtcagcacccattctaagctgtcccagaattttctgttgctcttcttggtcatcattttctaaagtgtatggactgagattagactcctttcttcattttttttattttttttattttctgctgttaaaattttccctggcttttattttttcaccttttgttgttgggaaagcacaattctctggctggattttattctgccatcttgatccagaaatcttgtggtgagctttaaaaaaataagagtgaaaaaaacacaaaacattcttgggccccaccctagaccttctgttgcagaggctctggaatagggccgagtaagtcatttttaaagccttcctgtggttcttcaaatcagccaggtctaaatccaccatccttataaaagaatgtttattttttcttttaccttttagtcaggctacctgaaaaacaagtcgagattttctacctgaaaacacatcagatttctcagaaagaccccataaatcaaaagtttttttaagtggtttatttgcttgttcatttttgttgttgttgttgtgggtttttttatttgattgttttgttttgagacgaagtcttgctctgtcacccaggctggagtgcagtggcatgatctcggctcactgcaacctccgcctcccaggtttaagcgattctcctgcctcaccctcccaagtagctggggcttcaggtatgtgccaccactcccagctaatttttgcatttttagtagagatggggtttcaccatgttggccaggctggtctcgaactcccgatccacctgcctcggcctcccaaagtgctgggattacaggcatgagccaccgcgcctgaacgaaccgtgttcattttttaaataacggtaatacaaatagggcaaaaaccttgtcccaagagaacagcaatggaaagttgatcttttttttgtagcagttcttgagataaatatcctttgaaatgaagttcactttgagatctctttagcttcttggtttatgctggtatttatagagtgaattatttattagtgcttttaagaagcattttgaatgctatatatgccagtattgtcaaagtgattcccattcatcagaactcgatggtcttttcagtatatcacctacaagggatctaatttaatcctgtttagtatttgactggtaaaagagaactataaagaatactggtttacctggatcaatagattcagagtcacgtaaggcttccttcaactagatataaaacttacatgatttttatggctgctaaggactgaaaggaggctacaaagaaaatgtggatttaacattttggaataatttttatatgaggtgtgaatttagaagtggtattttcaatttgtaagttacaggtaacagaagaaatgattaatatttaaaatcatgcagtagtctgggcacagtggctcatgcctgtaattccagcactttgggaggctgaggtgagaggactgcttgaggctaggagtttgtgaccagcctcagcaacatggcaagactctgtctctacagaaaataataaaaatgagctgggcatggtggtgtgcacctgtagtcctagctacttgggaggctaaggtgggaagatccctggggcccaggagttcgaggcttgcagtgagccatgatcatgccactgcactctagtccgggtgacagaacaagaccctgtctctaaaaaaattaaaataaaaaataaaaatgaattgtaaaataaaccacgcactagaaatatctcacatgcagccactacgtttttccaatactctaatcacccatatgtgctgctctcaatatatttggaaaataacccattgattatgtagtcatctgttttgcgcacatttccctttctttttttctttctttcttttttctttttttgagatggagtctcgctctgttgcccaggctggagtgcagtggcacagtctcagctcactgcaacctctgcctcccaggttcaagccattcccctgccccagcctcccaagtagtttggattacaggcatgcgccaccatgcccagctaatttttgtatttttagtagagacaggatttcaccatgttggtcaggctggtctcgaactcctgaccttgtgatctgcccaccttggcctcccaaagtgctgggattacaggcatgagccaccgcgcccggccccctttcattcttgatccttgtgatggtgtttttaagaagtgattgtgatcataatccaactcaaagacctgtactgtgcttttaacataaaatatttctcttttttgcattgttttttctacaagggacattctttaaggaaataattgctttttcacattattttgcatctagaattattaaactctgctatgtatcctcagtatcagcagagaaagcatgtcatagttgatatgttgacgtgtatgccaacatgatctcagttttgaattaactacattctttcatcagtcggtctaattataacttttaaactattatatatacatgcctccattttttgaataattgcagcagttaatattctactggatgttatctagtcccacagaatttcaaaacaagaaggacaatggaggtcatgtcgtccaacccctgctgacgtacacattaggaatgggaagcacagactggctcatttgctgaggtcatgctgtccgggcacatggtctcttgattcccagagcaatgccctttgtactgaagccggtggcctctcccgtcatctagtagcatttgttacagatgaaaccacatgtcacttggtatgcaaaacataccatgatcaaaattgtaaattgattatcacatatttttctaggcacatctgtagatttgggggaagtagaagaaataaaagtaacatgtgaaataataaagaggaatagcaacagggaattaacaaggaagtgaggactgagatgctgacacatggagttcctactgtggattactgctcagcatgctctcgctatttcttggccgggtgcagtggcactttggggggccgaggcgggcagatcacctgagctcaggagtttgaggccagcctggccaacgtggtgaaaccccgtctctactaaaaagcacaaaaattatctgggcgtggtggtgtatgcctgcaatcccaggtactcgggaggcgaggcaggagaatcacttgaacccaggaggtggaggttgtagtgagccaagatcatgccactgcactccagcctgggaaacaagagtgaaactctgtctcaaacaaacaaacaagaaaacatgctatggctatttctctttttttttttttttttgagacggagtctcgctctgttgcccaggctggagtgcagtggcgcgatctcagctcactgcaagctccgcctcctggattcatgccattctcctacctcagcctcccgagtagctgggactacaggcgcctgccaccatgcccagctaattttttgtatttttagtagagacggggtttcaccatgttagccaggatggtctcgatctcctgacctcgtgatccacccgcctcagcctcccaaagtgctgggattacaggcatgagccaccgtgcctggctgctatggctatttctctaactatagtcacctaaagtcaggacccaggagaaatcagtcagtagaaccagtgttagtgagggtttttttttttttttttttctgtgattacctcttagtttttgtgtctatttgtgaatataaagaaaaatatttagattcttaacatggagatgagattaggaagggaaactaggatgattttggctaatctgaatgtgttcaatgcaaacctgctaggcaggttaaaagtttttctagttaaatgtcttagcatcaacacccccaaaatattgtcttgacttccttcaagaagatttattcacaggtggttttcatgcgctcgctggtagagcagccacacagccttagaaacatgcccttggcactctgattttttttttttttttggagatggagtttcgctcttgttgcccaggctggagtgcaatggtgcgatctcggctcaccgaaacctcctcctcccgggttcaagcgattcttctgcctcagcctcctgagtagctgggattacaggcatgcgccaccatgcccagctaattttgtattttttagtagggacggggtttctccatgttggtcaggccagtctcgaacttccaacctcaggtgatctgtctgccacggcctccaaagtactgggattacaggcgtgagccactgtgcccggccggcactctgatttttaaacatttggacacagttttccttggatttgaagaaataatgccccaactcaggatgaccacgagagaatggtggcctgagaagaaaaacagctcagtgctacaaatgaaagccactgcacagccgggcaccgtggctcacacctgtgatcccagcactttgggaggccaaggcaggcagatcatttgaggtctggagttcgagactagcctgaccaacatgatgacaccccatctctactaaaaatacaaaaaaaattagccagatgtggtggcgtgcacctgtagtcccagctacttgggaggctgaggcaggagaatcgcttgaacccgggaggcagaagttgcaatgagctgagatcacgctaccgcattccagcctgggcaacagaatgagactccgtctcaaaaaaaaagaaagccactgcatatttacacatggtctgtcctctccaattaaataattctgttcttatttgctctgctttgagacaaaagatgaaaagctgtgcacgttcttaataacagtagcttcatcacacatgttgaaagattgaaggaaatggatttcagctgtggactttttttgtttgttttaaacttgtaacaaaagcactaatgttatctttcattcctgatttcttaattctctttctatataaagctgacatgtctgcatttttatttcaggaatctttcaaagaagtaccaacctaaaaagaactcgaaggaggaagaagaatacaagtatgtttaccattgaaaattgtcttgtaatagacacatgccattgatgactacacacggaaaggagaaatacatgtctataaaaataagttgcatttcccattcattttgtgtcagtttttaaattggaggagagaacaataaaaacataattaacttttcttatatggagtcactggacctatgccagattgtttcaattaaagtaattaggaaaactttagaatgtaattaagcaaaaacaggaagtatggaatctgcattctagagttgatttggtttggcactgtcaggagtccctgtcatgctagtcattcatccaagaaatatgtcaatttcagtcagcaattaaggcatcttaacacagaccactcaaatattacatctctaatgtatatctaaatatcctttacattagtacatatagcatgtatatgaattttggattatatcttgactaagtatcaatgaagccaaatattacattatgcggagcggttcagttttgcaaaatgaaaagtgtttcaattgtaattaattctgagccattttgttgagaacacttgatgtgtaatgaatactcaggatcctatgggaggtggatgccaattaacctgattttaattaatattttcttggtgtaaagcagaatatgaatgaatgtggccttgtgtgaaacagagtggcgtgtgttctgttccataggtatacgtcatgtaaagctttcatttccaacctgaacgaaatgaatgattacgcagggcagcatgaagttatctccgagaacatggcatcacagatcattgtggacttggcacgctatgttcaggaactgaaacaggagaggaaatcagtaagcaaaactttattctttttcttcctaaaagatggaccaaacacagtgggaatatccctagaagattaaaattaaataaaaccatataagactatgggtcttaaactcatacctttgagaatcatataaaagttatggaccccagctgggcacggtggctcatgcctgtaatcccaggactttgggaggccgaggcaggcggatcacaaagtgaggagtttgagaccagcctgaccaacatggcgaaaccccatctctactaaaaatacaaaaattagccaggcgtggtggcatgtggctgtaatcccagctactcaggaggctgaggcaggagaaacgcttgaacctgggaggcggaggttgcagtgagccgagattttgcacctgtgctccaacctgggcgacagagcaagactccgtctcaaaaagaaaaaaaaaaagaaaaaaagttacagaccctgttcctagaaagtgtttctaggtctctacgtaaaatgtcaagggtccttcagacactctgaaactcatctgtggacccatattcaaaggaatatgcatccctttgaggaatttaaatatatttcagggtatcagacatttaaaaaacaagtaagtaatataatatggtgtatgctctgtggaataaatggtattaaaattagtacttatcagtcgggcatggtggctcacgcctgtaatcccagcactttgggaagcctaggcagatggatcacctgagctaaggagttcgcgatcaggctggtcaacatggtgaaaccccttctctactaaaaatataaaaactagctgggcgtggtgacgggtacccataaccccagctacttgggggtctgaagcacgagaattgcttgaacccaggaggtggaggttgcagtgagccgagatctcgccattgcactccagcctgggtgacaagagcaaaactccacctcaaaaagaaaaaaaaaaaaaaaaaattagtgcttgtaagtaggtcaaaaaaatggaaagatgtccccagttacatccattcttttcctcagctcattcattgctatctaatgaagcaaaccttattgttcctcttgccaccattatcgtcttttcataaataggttttgttggtaaccaaagagaaaaatggatgctcaaagtctattcttagtcatgattttgccttaagggatttatctttaagccatggtctgtatcattgtacttcgattgcatgtgaagtgcggaaaaatttgttactagtaataaagtaatcacgttggccagtgataacattttttttttttttgagacggagtttcaccctttggtccaggcccgagtgaagtggtgcgatctcgactccctgaaacctccgccccccgggttcaagcgattctcctccctcagtagctgagattacaggtgcccgccaccatgcccagctaattttttgtatttttcgtagagatggggtttcaccatattggtcgggctggtctcaaactcctcagaccaccgtgatctacccgccttggcctcccaaagtgctgggattacaggcgtgagccaccgagcccagccacaacagttcttttaatgccctggggatacatgagccaacaagattactatggcttctgctgaaatggaggagacattaagtaataatgacaaaagtgattatttaattgcaattatggtagttgccacaaagtaagagtagaacgtgctatgagagcatataataggatttctgatatgctcatgctctggggtcaggaagaagcttcccaagggacttcgcagttaaggccttaacaagacttgagggatgattaggacctgcctgggacaagcattcaatagagagcagccagggcgcttgggcaggaaggtgtttgaaaatgtctcaatttagttctttctaaactataaatgtgtagcatatggccttggataggtttaaaagttaggaagagataaatgccttaagatcaacccattggtttaaaacaacaatatgccaataaactgagatgaatcttcatctgttgacattagcacagtggttctcaactagggacagttttactccctactccagccacatttatcagtgtctggagacacttttggttgtctcagggattgtggctaaggggttgctactggtatctagagagaagaggccagggaggcagctaagcctcctacaatatacaggacagctccccaacgaagaatgacctggcccaaaatgtctatagtgctgagagtgagaaaccctgcactggagccctaaattagatgacagtttctgctggaccattcattaaagatttctttagtgacagaaaggatgcagtgaaacagaatactaaggttcagaatgaagtacaaatatctaatataataaaataaataccagaaatcttaacatgatcctggactgcttccctggaccctgaacttcccttgaccttgcaaaggtttatatttttttcctggttgtttcttttgtcaatgctttgtctctctccttttttttttttttttttttttaagatggagtctcactgtgttgcccagactggagtgcagtggcacgatctcgcctaaccacaacctccacctcccaggttcaagcgattctcctgcctcagcctcccaagtagctgggattacaggcacatgccactatatccggctaattttttatatttttggtagagatagggtttcaccatgttggccaggctggtctcgcactcctgacctcaaatgatccacccgtcttggcctcccaaactgctgggattacaagcgtgagccaccgtgccccctcgtattcctttgctgtgttatggtcaagttgttttatattttatttactcactgttaatgatgacttttttatagtctgtcatatctgtatttcggatttagttccttttgttaatcaaaaattacagtaatttatggaataaattataggtggtacagatacacattaaatatcttgcaatacatagtgttccttttattttaagaagaactgcaagtacaggtttctgagtcagatgttctgttgggaggagctgtaaacatcatgctcttttgaaacattctgttattaaattaaaatgacattttagaaaatcatgaaaccttttgaaatattagaacaaatatcagtaagcaaatgtgtgtatttgtgctatttaatttatttatttaattttgtttgagacggagtctcgctctgttgcccgggctggagtgcagttgcacaaactcggcttactgcagcctccgccttctgggttccagtgattctcctgcctcagcctcctgagtatctgggattacaggtaccccctaccatgcccggctgatttttgtatttttagtagagatggagtttcatcatgttggccaggctggtctcgaaatcctgagctcaggtgatccgcctgccttgacctcccaaagtgctgggattacaggcgtgagccactgcacctgacctgtttgtactattttaatataatgcttcatgagcattttttttctttttccttttttctttctttcttttttttttttcttcagggtctcattctgttgcctaggctggagtgcagtggtgcgatcatggctcactgtagcttcaacctcctgaagtcaaatgatcctcctatcttagcttcccaagtagctgggaccacaggcatatgccaccatgctcagccagtttttaaaaattttgtagagacaaggtcttgctgtgttgcccagtctggtctcaaactcctgggttcaggcgattttctcacctcagcctcccaaagtgctgggattataggcataaacccccatgcctggcctgttttttcttttctctacataatcgttgccattattttgaatgagtaaatgatgaattagcattatggtatactaaccactgtaatttaaaaaatgattccaataatattggaggcctggcgtggtggctcacgcctgtagtcccagcacttcgggaggccgagtgtttagcctcatgcttgctatagattataatagctaacctcaatggggactgctggttctccagattttacccaagatatggaccctggagcacaggaaggtgcagtgagctgggtgtgttgctctgttgcagagctggggggtccccaggctgcttccctctcggggcagtgcgtgtttgtaggcatggttttttttccagtgagtttttttcgacataccttcaaggatgctggagtaaacagtatgaacatcctcatctgcagctagtcttagaaaaagagctgtttggctgggcgcggtgactcacgcctgtaatcccagcaattgggaggctgaggcgggcagatcacttgaggtcagaagttcgagaccagcctggcaacgtgatgaaaccccttctctactaaaaatataaaatacattttaaaaaattagctgggcatgatggtgcatgcctgtaatcccagctactcaggaggctgaggtacaagaattgctcgaacctgggaggcggaggttgcagtgagctgagatggcaccactgcactctagcctgggtgacagagtgagaccctgtctcaaaaaaaaaaagaaaaaaaaagaagaggccaggcgcggtggctcatgcctgtaatcccagcactttgggaggccaaggcaggcggatcatgaggtcaggagatcgagaccatcctggccaacatggtgaaacccgtctctactaaaaaaaaaaaaaaaaaattagccgggcatggtggcgggcgcctgtagtcccagctacttgggaggctgaggcaggagaatggcgtgaacccaggaggcggagcttgcagtgagccgagatcgcgccactgcactccagcctgggcgacagagtgagactccgtctcaaaaaaacaaacaaacaaacaaaaaacagaaaagaaaagaagaaaaggagctatttaagaccttctcgtaataaccaacatttctcctttagagcttttacttttggctaccctgacttgacttagtaaacactattttattgtaaggatgattcttaaaacaacagtggaatgctatcatttctgtcttctggtgaggttaattattggcgcacacagcataacagagttagagctcaaatccaggttttctgaggccagactcagtcgccttcccactatgctgtgatgaggggctgacagcatgcttcaggtctgtcttaaaagacagggagaggccacataagttctgtgttcacagagctggagccccctgcttggtggtgggcagcgagaggaaaggatgcaagctttccagccaacaaccctgctcaggattcctggcagccctgccctaggcaggttatgaaaactctatgagcatacacttaggaatctgtaagctgaggctgattatagccaccttaggaagttgtggggacaattatgagaagacaaatatgaacctcccagcacaacgttccagtatactgataaatagatgctgcatatccagtttctcttgctgtaatcattctgttacttaatgcagaatctcatttccatcccagagcttctcgatcagggcttgttacagaaaacggagcacctataatcccagcacattgggaggccaaggtgggcagatcacctgaggccaggagttgaagaccagccttgccaacatggcgaaaccctgtctctactaaaaatacaaaaactatccaggcacagtggcgcgtgcctgtaatcctagctactcgggaagctgaggcaggagaatcacttgaacctgggaggcagaggttgctgtgagcggagatcatgccattgcactttagcctgggtgacagagtgagactccatctcaaaaaaaaaaaaaagaaaaagaaaacggagcatgtttaggccttctgtgagcaggtgtcatacggtagttgttcagtgattttaaaatgacctttctaaaaatgtgtaattgggccaggcacagtggctcacttgaagtggtaatcccagcactctgggaggccgaggcgagtggatcacttgagaccaggagttcgaaaccagcctggccaacatggggaaaccccatctttactaaaaatataaaaattagctgggcgtggtggcaggcacctggaatcccagctacttgggaggctgaggcaggagaatcgcttgaacccgggaggcagaggttgcagtgagctgagattgtgccactgcactctagcctgggcgaccgagcaagactccatctcgaaaaataaataaataaataaaatgtggaattggttgatggcataggaaacaagaagctgcttttaacattttagacccagctactatttttcgtggctgactagaaataatgccttacttaagtaccatccttaaccatcagcacagtacagattgggccatttgatacagcggcagaatcctggctgcccaaagggatgattttgaatttacaggattagtgctggatctcattactgcatatagaaagaatgtccaagttcagtggacaatactggttgaaaattactttttatctacattttgctgtgtttaaatggatgaatctctgacaagggtaagcgtgatgaaaaatggctctctgtgcaaagacgatgtttccttcctttttgttgtacggcattcttgcctttgtagccctaccagctgtttgatctttaagtcttcaaatctaactgtaggatgggcacagtggctcacgcctgtaatcccagcactttgggaggccaaggcaggtggatcacctgaggtcaggagtttgagaccagcctggccgacatggtgaaaccctgtctctgctaaaaatacaaaaattaaccaggcgtggtggcatgtgcctgtagtcccagctactctggaggctgaggcaggagaatcatttgattccaaaaggcagaagttgcagtgagctgagatcgcaccactgcactccagcctgagtgacagagtgagactctgtcttaaaaaaaaacaaaaaacaaaaatctaactgtaaaataggattactacttctacttaagtatctaggagaaaagatgctttttattctgcacatatactgtatttttgtatcacaacgcagttcattttaatgttatgaatatccattgtttttcctgatgaacaaaactgtaggctcattttggtgaaaatgttggtttttaaaaaatgcagattcacggccaggcgcggtggctcacacctgtaatcccagaactttgggaggcggaggtgggcatatcaaaaggtcaggagttccagaccagcctgaccaacgtggtgaaaccctgtctctactaaaaatagaaaaaaaaaaaattagctgggtgtggtggtgtgcgcctgtaatcccagctactcaggaggctgaggcaggagaattgcttgaacctggaggcggaggttgcagtgagccaagattgcaccactgcactcaagcgtaggtgacagagtgagactccatctcaaaacaaaacaaaacaaaacaaaaagcagattcactaaaaagagaacctttctcccctgcaagaacttagcagtttaggttcttccttgcctgacatctgagcctgcatctgtctctttaggaaaacatgagcagtcctggaagccctggacaaggaggtcctatagcttcttcacctagtgggttccacttagggcaattgcattttcagtgagatgttcgccatctctttagacataatggaatcagtggccagtccttggggtgcatataaaaagaatattactaaaacggaattaaaggacaaaatctcacaatcccttataaatcaaaaatcctcatttttcaaagctttcttcctgatatcatttgcagatatgtataacatttaagaatattggctgggcgcagtgtcttatgcctgtaatcccagcactttgggaggccaaggcgggtggattgcttgaggtggcgagtttgagaccagcctggccaacatggtgaaaccccgtctccactaaaaatacaaaaattagctgggcttggttgtgcatgtctgcaatcccagctactcgggaggctgaggcaggagaattgcttgaatgcaggaggcagaggttgcagtgagccgagaacgcgccactgcactccagcctgggtgacagacaggactcagtctaaaaaaaataataaaataaaaggccaggcgcagtggctcacgcctgtaatcctagcactttgggaggccgaggtagggggatcatgaggtcgggagatcgagaccatcttagctaatatggtgaaaccctgtctctactaaaaatacaaaaaaaaaacaaacccaaaaacttagccaggcgtggtgggaggtgcctgtagtcccagctactcaggaggctgaggcaggagaatggcgtgaacctgggaagcggaacttgcaaggagccgagatcgcgccactgcactccagcctgggccacagagtgagactccacctcaaaaaaaaaaaaaaaaagttaggaatattaatcctactatagctataatttatattcttcttgattctccatttaatattgtaagcattttccatgtttctacctcaaaaagtatacgtttttgtttttagatttaaaaaaaaatttttttttaattttttttagggatagggctggctatgttgcccaggctggtcttgaactcctgggctcaagcaatcttcccgcgtcggcctttcaaagtgctgggattataggagtgagccgttgtgcctggccaaaagtgtagtttaaataattggaattttttcaaagttattggaagagatattaaaaaagaaagaaaaatatttggaattttagtagctgtgcattgttctaacaaagttataatttgcctaattgtgtattgtttgatttatagggtattaccagtttttgactcatttacttagttagttgtgtaaacaatacagcagtaaactctttacttccaaagctgtttgcattgtgtgtgggctgagattacttccccaaactaaattcccagaagtgagactgtgaggtcaaagcatacatgattaaacatacatgatttatggttcttgataaaactctgataatttatgttcagataattatagtagaattacagatagaattatcaatagatttacagacttatagatagatttccaaatgtcactgaaatgatcaacatgggtgtggaattagcttatctgagatgtgggtaattcagagttgataacacatatattcctccataagaactactgtaaatgtactcttatcagcaacttttgaacattgagtcaagttattgaagaaaagagttttagaggttgtttggtgtagctgcagcctttgagtacgtctgggcttttccacagcgattaccactaatcatatatgagaaatttgtgaagatttatagctccagaaggagaaccaggaggttcttgccaacattttctggaattccaagaaaacttctccctgcaggtggaaaatatggttcattactcacaaagtgttggccagaagcagaatcactttttggcagcagttatctgaagagttctagaggaaacaattatacaatactttcagtgactcactaaaatgtttataaacctcagacctgtatgcttacagactccacattacttagaattgaccatttaaaactactcgcgaggtttctgaaatgtttgaaaatggatactgcactaaaacctataacattcttttcaaagttagatattcaataggtcctatttatggatcttatgaaggggcttaatttcctataagccagttctgcagcatggactgactccaatacatttaggaaaacaaaatgttgttataagagatgacagcaaataggtaaagcttagcatgaaggaaagcaaaaactaaaaggagtttatgtatataatctagctacttacaagtccatttctgattttttttttttttttttttttgagacggagttttgctcttgttgcccaggctggagtgcaatggtgcaatctcggctcactgcaacctctgcctcccagggtcaagcaattttcctgcctcagcctcccccatagctgggattacaggcgcctgccaccacacctagctaatttttgtatttttagtacagacgaggtttcaccatgttgactaggctggtctcaaactcctgacctcaggtgatctgcctgcctcggcctcccaaagtgctgggattacaggcatgagccaccatgcccagccatcttctttgttttgaaagaacatgtaaaagtggcattctgttcattaaaagtgggccctttcaccactgtggttgtttcacctgcaaaaccactggtctggtgacccccccgccaaaaaaaaaaaaaaagttttccagctacctgaaaggctgaggcaggaagattgctcagggccggggagttcaagaccagcctggacaacatagtgagatccaccccccaatctcaaaaaaaaatttctttttaaattttatcattcatgggataacatacttagtaaacaggacactcaaattcttttcttcatttcatgggcttgaaatgtgatcttggattttgtgtttctcctttgcaagctagaattaatgatttccttttcttctgggaattgtgagaattacttgactcacatttcgtatctcacatgattcttgttcggccacctgtttgacatctctccttagatgcctaatacagcatcaccattgcacctttgtcagcagaggactggagtccagcaagtgtgaatgatggctccagagtggtgtagtgcagtgaccctgttagcccaccccaaaacaaactttttttttttctgagacggagtctcactctgtcaccagtctggagtgcagtggcgctatctcggctctctgcaagttccgcctcccggttcaagccattctcctgcctcagcctcccaagtagctgggattacaggcacccgccaccacgcctggctaatttttgtatttttaatagagacgggattttgccatattggccaggctgatcccggagtcctgtcctcagctgatctgcctgcctttgcctcccatagtgctgggatcacaggcgtgagccaccgctcccggccccaaaaccaacttctgatcccccaaagtccttatccatgttccattccagtctgcactccctccagttctcaataaatgggacaccttttcttacactcaggtgctctggccaaacacatagtcacccagagcttttctcttttctcttacacaccatctcttatctgttaacaagtctagctggctctgccttcagtaaatgttctgagtccaagcacttctcacccctcttccacatctaccccagtcctgtgcctcattatctctcatctagaggactctgctgagcctcctaattcatttctctgcttccatgcttaccctgtggccagtggtccaactgtccatctccatgtcagagccaccaccagctctcccttagagagagtgcaagtgtaacagcctccccctgcagcagccagcttgacattgaaataatgtagatcaggccatgtcacttcctttcttttgttgttgttgttgttgttgttgttgttgtttagacggagtctcgctccatcacccagacttggaatgcagtggtgcgatctcagctcactgcaacctccgtcacccaggttcaagcaattctcctgcctcagcctcccaagtagctgggattacaggtgtgtgccactatgcccagctaattttttttgtatttttagtagagacggcatttcatcatgttggccaggctggtctcgaactcctgacctcaaatgatccgcccatctcgacctcccaaagtgctgggattacaggcgtgagccactgcatccggctgtcacttcctttcttaaatcttccaacatgcttaccgtggctggtgaggctgtccatggtcaagcccctgcctgccctccgtccctgtgccctttaccttggtctagtggcactggcatccagctgttcctcaaacagggcaagccccttcacactcagagcatctgcacttgctctgcctgcggcttggagggtattcctcagacccttgtaagttcactcccacgttttatgcaagtctctactcaaatgtcatcccagactgcccttgtctaaaatagctaccttcacctacacccatccctccttattcctttaccctgtttgtcttacttctggatccactcagtttcactgggacaggggactttgttttgtttacacagctttcctcgtgcctggagcagccctgttcacaagtgggcatgtcagtgagcatgggatgatcaccctggcactctatctaaaaatcttattgatgggagattctctgtatcagatgctgcaagtaacagctttatatcctcagaagggatcaggcaagaaaatgagccattccatgagaggaattaagatttcttgattgatttccttccttccttccttccttccttccttccttccttcctccctccctccctccttcccccctccctccctccttccctcccttccctcccttccttcacttccttccctttcttcttttctttttctttctatgtgtgtgtgtgtgtgcgcgcgcgcgcgtgtgtgtgtgtgttttaagagagatggggtttcaccatgttacccaggctggtctcaaactcctggcctcaagcgatccccctgcctcggcctctcaaagtactgggattgcggcctagggatgcgaatttcaaggaatgtgaagacaggattgctttgaaaaacagataaaagatcattgctgcatgtggagccttctgggtgagaataaccgaggaacagtgagcagaggagtagccagagaaggagggagggaaaatgctgctgcttaggcctgaccctggcccattgcctcatgctgctcagtgttacgggtaaagtcaagcaactgagcatgcctctgagaggtaggcatttagaaaacttcgaacacgttcattaagaaggtatttttactatggataaacttggaaaaataagccttgctaagtaaaaatagaatgtgtgtcccttagtgaacgtttctggtttctggtttgggttttaagtggggtacgacatacccacttgaacaggactaaggcgttttgccattacgccacatggtccatagaaatatccacgccgcttagagttctagctcaattaaaactgggagtcctgattcagacttggaagctgctcctgttcaaacccactactacgctgtgagtttagaggaaacaggatttgtcacaggcatgtttgctggaagctccctctttctttgcccttttcaagtctttttgtttctttgtttgcatctgtggaatctgagttttatttaaaattccagatggttgactgttctcagttgagtgtttattcttatgtttttttctacttttttttttttgaaagggctgttctcacatcagtgccatattttgctcttttaactgttaatggtttaatatctatataaatagcaaaaatgagcagctgttgtacctaattgcagtgtgaatactaaacattctcatagcatttgtgtgagtttgtctgttctgtctgtgatttcttgcagttcagtaaaattgtctcaaaagctttgccattgtcgtttttcttaaagttaatgcttgcttattttagattctctgtgatttttttttttttttaatctcagccacctctgttcactgggaaatttctttaaaaaatttgaagggtgatttgatctgtgtagacttttatttcaactaaaaagttgaaataagtaagtgtagctgtcaccccagaaactattagggtttgggtttttttgtttgtttgtttgttttagcttattattatgttttaaaagaaactaaaagcatcttatgacagcagaaagtaagaagcatttctctgggtctctagagatggcatttcctgtctcttttctgataggagagaaaggagctgtgatgacttcattctatggctccaaaagaagcactttttatctttgtccggagaacaattcctccttctttagtgcttgcaggcacactttttagacacacacttgctcactgtccagaaaagaaatgttcggccattgttggtaaacaacaaatacatctggcaaagctggtttatttgtttaactttgtaactgttaaaatagcttttccggtgaaagcagcgaagatagagctagaaacaaaccccagctattcaggtcatggtaggcacagagcacaaaggagggcttttgttccctcccttaatttcctgaaggatcccccagcacggatagtttttcgtatgttatggccaaataaatgatagagggacaggtactgtgaaaaaggctggggctgggcatggtggctcatgcctgtaatcccagcactttcggagtctgaggcaggcatatcacttgaggtcaggggttcgaggatagcctggccaacatggtgaaaccctgtctctactaaaaacacaaaaattagccgggcgtggtggcgcatgcctgtagtcccagctactcaggaggctgaggcaggagaattgcttgaacccaggaggcggaagttgcagtgagccgagattgtgccactgcactccagcatgggtgacagagacttgtttttttaaaaaaaaaaaaaaaaaaggctggaaggaaggaagatgggcatcacccacaatctcctaagccccatgaaatggtacgatgataattgcagttttcaggtagtggtttaataatgtggggagaggtgtggctgagcagtcttcatgagagataacttaccagtaaattcaaggtgcacaccgtgccttaaacacaaatgcatatttattatatatttacactaaggagtggcaagggaaccactctatggatttttcaatcaaaatcatccctcgtgtttttaaaataagacttttttttttaagactcttgtcttcagagatttattttatatgaaagtcaggtgacatgtcccaggcaatgcctgtcattgtctgctgggcttctgtgcatttcctgtctccacccacagcattgccccaagctggagggagctttcactttgttaaaacattcactttcagaggtgctggagagatagatcgtcaacctcgagtacagctctgaattggtgctggggttttctctttttgttcctgtctttgaatctcaaagtaaaacttttgggagcggctgcatctcttcagcaaactgcgtaactcggtgctccggcttaggaaatgggatctttctcttcgcagagaagtcacccgataaagactttcaggaccagaggtgccttccaaaaagggcacagttgagcccagatggtttgaaattgacgctctggtctctggggggtcctccctgaaagcgtggctttcagaaaacccgcttgtattttctatacgttctccactaaggtccagagtttccctaaccctgtccttggctctacttcttaattctcccacagcctggatcccttcttttctgttctatccttatgtccattacaagagctgaaaaacgaagccccaaggggctccccctgggtttgcagagaccaaaaaattgctggatagataaaactgactgcaaagaggcgcttaaaacagtgaaactcgacctcaaaagagagacaagaaaacattcccttataaaggagcactgttctaaatctgatgttgtctctgccttcccagcctttccagttgtcagctccattttctgactccgctaaatcctaggttctgacgaggtacgggaaaagctccgaggctctacctagtggacctctttgtttttatccttccttcacctgaccttctctgcagtgcacccctaacaccaatgcttaccttgtgagccagaaaacagacagcacattcaaactcagtaattgaaggaaggtcggttattaaaaggagcatttacaacgtggcggatagagtttaggaaaagcagtgaggatggttcagtaccctggagcaagtcacagtggggagctgatgttgcccccaggcctcacagggctggaggagccttccaggaatttcacagatgaggaacttctgaggttagctgcatgcggggcactgcctgactggagctgtgccctttggtccaaggacccagccaacctgtatcatctcagtgaggagaagctgcaggtacagtttcctgccctctgatcactcagaacatccttgtggcaaatctcatcagaaccagagggcaagggttcatgagatccctgcatgtcagtctctggggacccagacagggtggagaatgcacctgggaaatttgcaggacattgaccaagtcagcgatggtacagtgtggaaggatactaaaagatttaggggccgggcacggtggctcacgcctgtaatcccagcactttgggaggccgaggcaagcggatcacttgaggccgggagttcgagaccagcctggccaacatggtgaaaccctgtctctactaaaaatacaaaaaattagctgggcgtggtgggtcgcacctgtattcccagctaccagggaggctgaggcaggagaatcacttgaacccgggaggcagaggtcacagggaggcagaggtctcagtgaaccgagatcacgccactgtcctccagcctgggcaacggaacaagactccgtctcaaaaaataaaatatataaaggatttagggaactggtgattttaggtcactgaacaaaaaaaagacaccattctcttaacatttctgcatatttctagcacttccttccttgggatctttgtcttctttggtctcctggctttaactatccactttatactgaagactcccaaactggtctttagtacagaccgctccctaagctcagatccacaagtccaagtacatattagtctctctacttgtttgtttgtttgtttttcgggggtttttttgagatggagtctctatctgtcacccaggctggagtacaatggtactatctcggctcaccgcaacctccgcctcccagttcaagtgattctcctgcctcagcctcccgagtagctgggattacaggcatgcgccaccatgcctggctactttttgtatttttagtagagacggggtttcaccatgttgcccaggctggtctagaactcctgacctttggtggttcgcccaccttggcctcccaaagtgatgggattacaggcatgagccaccacgctcggctagtctctctacttgggagtctcatagaaatatcagccttaacacatgtgaaactacgtgtatgatcttcctcctcagacccacttctctcagtcttccttctcctaaagctcagactgacaacctcggagtcaccctgggcagctcattattgcacatctcatcttatctcccagaaaatcctggaagtttgggtgatcaaaaggtgcccaaaacctgacccctctcaccacctgcactgctcgctacctacaacctgtccaagttgcagtaatctccaggattgttacaaaagcctcccaccatctgaaatctttccttcacaacatcttagagttactcatcgactctggttcattcaggcaaaaaagcctacaagaccctatacaactccctctttcttctctgacctcatatgatattctccccgaggctcctccagatctggccgccaggttaacaccacaccagagcctgcctcagggcctttgcagatggccaggagggaaatttatctttatatttaaaataatctaataatgaaaacagccatgcacacaaaacactcaaaactcttactcaagtgtttatagcagcaattttctttttctttttctttttctttttcttttttttttttttttttttgagatggagtcttgatctgtcacccaggctggagtacagcagcgcgatctcggctcagtgcagtgcaacctccagccccctaggttttaagcaattatcctgcctaagcctccggagtagctgagattacaggtccacgccaccacgcccggccagtttttgtatttttagtagagacagggtttcaccatgttggccaggctagtctcaaactcctgacctcgtgatccgcccacctctgcctcccaaagtgctggcctggccgcatttttcataatagcccaaacctagaaacaactctgatgtctatcaactgttgaatggataaacaaaatgtgggatagccacatgatggaataatcatttggcaataaaaaagaatggagtactgatacatgtgacaatgtcgaccttgaaatcatgcgaagtggatatgaggagataatgaacacatcccagttaccaaaggcctcagaccatgtctccattcataggaaacagccagaataaacaaatccacagacagaaacaggctccctagggctgaggaagatggagggtgacggctagtgggtacaggtttcttttaggggtgataaaaatattctaaaattggtcgtggtgatggttgtacagttttgtgaattgcttagtttaaatggtaaatcagatcatatctgaatcatatctcaaagcagttaaaaaagatgaagcgatcgctgtcttaaaacattcctgtcgtttttccaagtggcatatatgtcttcaaattttattttatttttttattttttgagaccgagtcttgctctgttgcccagagctggagtgcattagcacgatctcagctcactgcaacctctgcctcccaggttcaagcaattctcctgcctcagcctcccaagtagctgggattacaggcacgcaccaccacgcctggctgatttttgtctttttagtagagatggggtttcaccatattggccaggctggtcttgaactcctgacctcatgatccacccacttcagcctcccaaagtgctgggattacaggtgtgagccaccgtccagcctattttatttttttgagatggggtctcattctgtcactcaggctggagtgcagtggcacgatcacggctcactgcggcctcaacctcccaggcttaggtgagcttccaacctcagcctcccaagtaactgactacaggtgtgctcaccaccatgcctggcctgtcttcaaattttatacagttgtacctaaagctgtaaagggaactctgtgactgctttttttccccccaagtgaaacttgtttcatctgtgatgactattcttgttttcgtttccacattaagctttttattcccttttccttttttttttttttttttttttgaggcagagtttcactgtgtcatccaggctggagtgcagtggtgcaatcacagctcaatgtggcagtgtcaacctccctggacttaggtgatcctcccacctcagcctccagagtagctgggactatcagtgtgtgccaccacatccagctaatttttctatttttttgtagagtggggggtctcactgtgttgcccaggctgtcttgaactccttggctcaagcgattcttcttcctcagcctcccagggttctgggattacagatgtgagccaccgcacccggctacccctttcaactcttaaatttctttggagcatacatactagaggttcaatatttagatgttgtttaagtggatgaaaatgtttcctcctgggttcataagagaagcagagggtactaatcaccagtgtgttttcccctttgcagaactttcacgatggccgtaaagcacagcagcacatcgagacttgctggaagcagcttgaatctgtaagtgaacaatgcacagcaaaagaaacggctttatagatttttttttctttttttttgagacggaggctccctctgttgcccaggttggagtgcaatggtgcgatctcggctcactgtaacctctgcttcccaggttcaagtgattctcctgcctcagcctcccaagtagctaagattacaggcacacgtcaccatgcccggctaatttttgtatttttggtagagatggggttttgccatgttggccagggtggtcttgaactcctgccctgaagtgattcgcccacctcggcctcccaaagttctgggattacaggcgtgagccactgcacccagcctaggaaatgtctttatagattttccagtttcaatttaatttaagcttgagtcaatcagaaagtaaaaaacatgcacataaaaacactaatgaaacatctttatagatttttctcatttaatttgtttctagaaccattatctaaagttgagccaaaagagctcaagttgagtatttttctaaaagtcacgtggaaataataaagattagacagttttgatggaaataaatgcagattttaaaataacttctagaaattatgacatataagaaatcaattcagagaagagtattcttgggccagacacattggctcacgcctgtaatcccagcaatttgggaggcagaggcgggaggattgcttgagctcagaagctcaagaccagcatgggcaacatgacaaaacctagtctctacaaaaaaatgcaaaaattagctgggcatggtggtgcatgcctgtagtcacagcagctagtgaggctgaggtgggaggatcacctgagccgggaaggtcaaagctgcagtgagccaagatggcgccactgcactccagcctgggtgacaaagtgagaccctgactgaagaaaaaaaaaagaaaaagaacaatgctctttgggagctttagataaaattacatcttctcgtaggactcttatggtttcataattattttcctctgattttagagtaaaaggcgatttgaacgcgattgcaaagaggcggacagggcgcagcagtactttgagaaaatggacgctgacatcaatgtcacaaaagcggatgttgaaaaggtgaggtgaaagctcaagtgtgggccgggcacggtggctcacgcctgtaatcccagcactttgggaggctgaggtgagcggatcacctgaggccaggagttcgagaccagcctggccaagatggtgaaaccccatctctacgaaaaacacaaaaattagctgagtgcagtggcaggcacctataatcccaactactagggaggctgaggcaggagaatcgcttgagcccaggaggcgttggctgcagtgagccaagatcacgccactgcactccagcctgggtaacaagagcgaaactatcgccaaaaaaaaaaaaagacaaaagaaagctcaagtgtgtctttcatttcccctgtgagtgttcatcaccgaccacccatccccaagttctcatttctaatgtagccacaaaaggcgctacatggggaatcattttcattttgtgtcaaccattgtggggaccagaagctcaagtgtggggaatcttcggtgttagaatttgagacgttttatctgttgagtcaccagggtgataaagtggagacttagactatgaacagtctgggaacaacgttccagaaggttgtggctcttaatggcttttcaaagagaaagtcaatttcttgagagccggaggagacaggacagggccatctggaagagcttggctgcttataatggttcctttagagcaatagtctcactgcttgcctgacttctaattgattcctcctggttgataacagtgaggttgtagttgaagccttgcatatttcagtcctctcaaaagcttttctctaaatggacttgtattgccaactagaaatattataaagtgtatactgtttctcattgtggctcaatatgcgttttttccctagaagctgaattttatttttattaaagtcatcaatacaatgtaaacaaaattaggcttttacataacaaggactcattcatgatgcccatggttgtttgggcattcatagcttcatgctgtatgtgggtgaaagcactgagtttttatagatttgttgagcttttgacagatcagttagagttgagtttagttgggaaatggtgtgaactattatttgccaaattctgccaaattccttgcttaaagactaggtatacgttaatattagtatgcctttctctaaaattattaaatatattaaaatacatattcttgccaggtgctgtggcacatacccctagactcagctacttaggagactgaagcaagaggattgcttgagcccaggagtccagactgggcaacataacgagaccccatctcaggagcaggggagtgttctcaatatctgtatttgatctcaaaatggagatacttactttaccaaaagacattaatttgctgctaaagttaaatatttaaaatgttattcaattaaaataagttagattagcccaaagtttcaaaagatattttatgttgaatgaggcaaatcagtgtatgtatcattcatatatgtgtgtgtgtgtgtgtgtgtgtgtgtgcgcgctaaaagaagtatatatgtatatattttagagataccgagatatggtctctttttattttattttttatgtttatttatttatttttattttttattttattttattttttgagacagagtctcgctgtatcgcctaggctggagtgcagtggtgtgatcttggctaacaacaacctctgtcttcagggctcaagtgatcctcctgcctcagcctcctgagtagctgggactacaggagcccaccacaccctgctaatgaccctgtctctaaataaataattttttttttttttttggtgtggtgtatgggctcatgcctataatcccagcactttgggaggccaaggtgagcagattgtttgagtccaggagttcagatccagcctgggcaacatggtgagaccctttctccataaaaaatacagaaaaattagtggagcatggtagcccatgtctgtggtcccagctactccggaggccaaggtgggaggattgctcggtcctgggaggcagagtttgcagtgagccacaatcctgctgctgcactccagcctggatgacagagccagaccccgtctcaaaaaaaaaagcactcagcctctaaactgtcatttcatttctgtttttttctgtagagatggtcatatcagcagcaagtaatgatagttgcatttcttttccaatcttcatgccttttgttaattttttcttatcttaactctgctggttatgccctctgttttgctgagtcatcattgtggacttcctcagcttgttcctgattgcaaagagagtgcttcaaaaggttccccattaagaatgatttttttttttttgggacgaagtttcactcttgttgcccaggctggagtgcactagcgcaatctcggttcattgcaatctccacctcctgggttcaagtgattctcctgcttcagcctcccaaattgctgggattacaggcgtcaccacgcccagctaattttttgtatttttggtagagatggggtttcaccacgttggccaggctggtctcaaactcctgacctcaggtgatccaccagcctcggcctcccaaagtgctgggattacaggcatgagccactgcgccagccaagaatgattttaatataccctttattggttaaacaattttccttttcctgtgttgccaagagcttttttttaagcttgacttattattgaatatcattaaatatttgttctgcttcctttaattcattaacgtggtcaattacattaatcagttttttttacattgagccaaattagtgttcctgggacaaattcaactagattatgatgtattatgtttttatgtgtagctgaatttattaatattttatttaagatttttcattgaaatggtctgtattcattgaaattgatctataattttcctttcttgtctgttctactttgcattacttatgagttttggagtgtttgctcttttttctgaaataatatatgtaaaattaaactcactatcccttaaatgttttatgatacttctttgcgtaaatcagttacaaactacggattccatattttattgtctacttctgggttgatcctagtgggttacctttttatagtaatatatccatttcatcataaattttcaaatttattggcaaaaagttgcccataatatgttctcaccttaatttttgctgcatatatctcccctatttactcctaataccttttttaatacttttttctttttttctggatacgttttttaagaaattatttatgcttattttattatattattattttttgtatatagagatgggatctcactatgttgcccaggttggcctcagcctcagcctcctaaagtattaggattatgggcatgaaccactgtgcccagccttaaaatcattgttactagtatcagattttatctttgtggagcctcccttttctatttttattttctatttatttaacttcttcccccaccacccccattcccctccttctccttctatcattacctttggatttattccattacccttttaaaaagttctttctttagatgcttacctcagtctttcttcttctccattataaacattaagattacagacttcccacttaagtactgttttctctgtatcccacatattttggtatgtggtattattaatgttgtccatttccagatatttgtcctttcttttactgtttaatctctcacctatgatcaatttagaagcatggttttaaatttccaaatgtatgacatatttcaacttttgttacagatatttatttatttatttatttatttattttttctgagacgtagtctcattctgtcacccaggctggagtgcggtggtgctatcttggctcattgcaacctctgcctcccgggttcaagcagttctcctgcctcagcctccctagtcctgggattacaggtgtgtaccaccacgcccggataattttttgtgtgtatttttaggagagacagggtcttaccatgttggccaggctggtctcaaactcctgacctgaagtgatctgcccgcctcagcctcccaaagtgctgcgattacaggcgtgagccaccatacctggcaagatttctaactaaattgcattatggtcctgggaaatctgtatgagtttgagtcttctctatttgttgagattcgttttataccctagtacacagtcagtttttagaaatattctgtaagtaattgaaaataatatgtattctctagtatttttattaggccaaacttactgttttatccaaatattcctatcattaaggattttgtttttcaacttgttctaacactttctgagaaaaatgtgtaacatccttatgtcttaatttccttgtctataaaatagggacactgaggaacaggattgatgcgaatattaactgagttaatatgtaaaaggtgcacaaaaccatttatgggatgttgccagtgatctacaactattacagtgataatggtagaggattattgatgttctgtctattttactcttttattatggagttattctattaaacaaatgaagtttagaattgtaatatgttcaagtgatttcatttttcatcaataaaaagtggccccctttcccagtcaagcttaatcccctaaagtctattttacctgatgtaaaccagatatctttaagttaacattgcctggcagatctttcccatactttgactttatacttttctttgtcctcatatttacatgtgtcttttgcaaatggcatgtggctggtttctggttttttgtttgtttttttctgttttttgagtctcactctgtcgcccaggctagagtgcagtggcatgatctccactcacttcaacctccacctcccaggttcaagcgattcccctgcctcagcctcccaagtagctgagattaaggtgcctgccaccacacccggctaatcttcatgtttttagtagagacgaggtttcaccatattgccaggctggtctcgaacccctgacctcaggtaatctgcccacctcagcctccgaaagtgctaggattacaggcatgagccaccgcacctggcctgttttttgttttgtttttttgttttgaaatagagtctcgctctgttgcccaggctggagtgcagtggtgtaatctcagctcatcgcaacctgtgcctcccgggttcaaaccgttctcatgcctcagtctcctgagtagctgagattacaggtatgagccaccacacctggctaatttttgtgtttttagcagagatggggtttcaccatgttggccaggctggtctcgaactcctgccttcaggtgatcctcccgcctcggcctcccaaagggctgggattacaggtgtgagccaccacacccagccttagcttgtttgtcatgcttttcacggtattgttcaagttcactgttaaaagaaagcttactgtgattgcatccaaacctgaagatgctgtgtaaaactgcaagatagaccagcaagacttctgggttatactaaaataattcccccatataagaagtcatataaagctgggtatagtggctcatgcctgtaatcccagccctttggaaggccaaggcgggaggatcgcttaagcccaggagtttgagacaagcctgggcaacatggtgagaccttgtctctacaaaaagttttttaaaaattagcctagcatggtggtgtgcccttggagtcccacctactctggagggtgaaatgcgaggatcacttgaacttaagaagcagaggtttcagtgagccaagattgcaccactgcactccagcctaggtgacatagcaagatcctgtctcaaacaaacaaacaaacaaataaataaataaataaataaatagaaattatataagaaggtacaagtcacctgggcatgatggctcacacctgtcatcctagcactttgggaggctgaggcaggaagagtgctggaggctaggagttcaagaccagcctgggcaacatacagaaacccagtttctacaaaataatcaaaaaattagaccgggcatggtggctcacgcatgtgatgccagcactatgggaggccgaggcaggtggatcacctgagatcaggggtttgagaccagcctagccaacatggtgaaacttcatctctacaaaaaatacaaaagttagccaggcatgatagcatgtgcctgtaatcccagctactcgagaatcgcttgaacccaggaggtggaggttgcagtgagccgagatcgcacggctgcactccagcctgggtgacagagggagactcagtctcaaaaaaaaaaaaaaaaaaaaaattaaaaattagctgagcgtgatggtttgcacctgtaatcccagctacttaggaggctgaggtgggaggatcgcttgagctctggaggtggaggctgcagtgatcagtgatcgcaccactgcactccagcctgggtgacagagcaagaccctgtctcaaaaaaaagaaaaaggtacaagtcgtagtagagaaaactgtgaggttcagagcagactgtgtgtaattatgaatgtgtgtttcgtggatctttaatctatggtgatggaggcctagacttaaagtgggttctcccgaagcgggcattacctgggttcattaccaagctgcattaatgtcagttttcaacttagggtttggactccacacatgctctgagttctggctgtttgtggttcagaaatttccaggatgacttttttctttgtttttctccctgaggccagatccaaggcagttttaacttttaaaaagtgcacttgctgaatccaaaggtgattttaggacttttaacttgtgctgccaaattgaattgctatcctcaactatttgaatatttccaaagatctagtactttttcttacactgggagcatcgttttgctatttttatgaaagtgccacttacctcctttccaaggatatgatgaattacccaattttggcatcacaaacattgaagctgagggagcagcaatgtctaaacattgaaattcttaagttattttgctttggatttgacttgaaacactgtaatttcccaaaacacccagtactttgactgttctgtcagttttttactttgttgcctgtgaaggcttatgtcagcgtcaagctaactggaggcagttttagttcttatcattatttaatgtcatctcccattatgatttctgacagtctctgaatctaacataaatgtttctcccccagttcccgcaaatgattaaattatctaattgtattcaaagcagcgcatcctcctttttttctagcagccagccacacagcactgggaacggtaagcctgtgcttacaaaagccttatttgtacatgtgaactttgtcttgtgcttgatacaattgatatgaactataagcatacgttcattttttaaactacctaggatcctgggtataagcctgattttcttttctttttgagagttaatgcccagatatggattgaaaccacattttgaaaccacatttttattagcactgtgttcactgtttttttttttgttttgtttgtttgtttgtttttactttttgtggtgatcgaggttttgctatgttgcccaggcaggtctcagactcttgggctcaagctatcctcacacctctgcttccctaagtctggcaatgcaggtgtgagccaatgtgcctggccagcactgtgttcaaatcacctccattcatccacatccatgctcagacttcggtacgctttggcattgtgttagatgccagcgtgtgaccagatgtttagtagttcccttataagacagtatatgtcatccttaaggcacccagtttaattaaaagtaagtttacagtataaagtagatataagaaaaagctagcagtttttatctctgggcaagagtgcagatttggatgccatgaggatgccatgttccttagaggaaaaatgaagagaggaaatcagcttaattgaacaatttttattggcagggaaaactcaaggaaccatgcagtctctttttcttctttgacattttgcagctgtcatagagttttgaacttgaaggctttgaatgagctcgagtgatttggaattagttaatctgggtttgtacaagaagcagtacatgttgggataggtcatcctgcagctcatgacccctgtgtttcagctgaaggtgaaacaggctcccctgctgccctttcaacgaggtggactagacatccttactctctgttttgggatattgagagggaaactgcaaaggaacatgggaaaattataccatgtccgcatcttactcttgtaaaaaaaaattaattaaaacaccgagataaagtattctttgccattcttctcagaggtagttactcttaaccccttgaggtatgtccttctgaacccttttaaaacagctgttttgggccaggcatagtgactcacgcctgtaatcccagcactttgagaggctgaggctggcggatcacttgaggtcaggagttcaagaccagctggccaaatggtgaaactctgtctctactaaaaatacaaaaattagccgggcatggtggcacgtgcctgtaatcccagctatttgggaggctaaggcaggagaatcgcttgaacccaggaagtggaggttgcagtgagctgagatcatgccattgcactccagcctgggggacaagagcaaaactccgtcttgaaaaaaaaataccaaaaatacaaaaaatgagctgaatgtggtggctcatgcctgtaatcccacttactcaggaggcggaggcagaagagtctcttgaacctgggacggggaggttgcagtgagccgagatcacgccactgcactccagcctgagggacagagcaaaagtccatctcaaaaaaaaaaaaaaaaaaaaaaaaaagacaccaaaataggtgttttgtatgagcaatagcacagacaaataaattaaattaaataggtattttgtttgtttgtttgttgagacagggtctctccctttgttgctcaggctggagtgcagtagtgtgatcaaaacttattgcagcctcaacctcgtggattcaagtgatcctcctgcctcagcctcccaagtagctgagaccacaggggcatgccaccatgcacagcgtagagacggggtctccctatgtgttcccaggctggtcttgaactcctagcctcaagtgatcctcctgcctcagcttcacaaagtgctgagattataggtgtgagccaccacacctgcccccctccttttttttttttttttaaatttaagggaattctagtagaattatgacttcatggacttatcttttaaaaaatgcaactcagccaagtgcagtggctccctcctgaaatcccagcactttgggaggctgaggcacgcagattacctgaggttgggagttcgagaccagcctgaccaacatggagaaaccctgtctctactaaaaatacaaaattagccaggtgtggtggcgcatgcctgtaatgtcagctactcgggagactgaggcaggagaatcgcttgaacccgggaggcagaggttgcagtgagccgagatcacgccattttactccagcctgggcagcaagagcaaaactccacctcaaaaaaaaaaaagtaactcactggtgggattcctaagtcgtgaagtattcacatgtatccattcattcccttgcccgttgttcactgactatctactggcaaggtatgcgggtatagatgccagcacataatcacacgatccttgactctgaggaacttgccttttgttttttctttttttcttttcttttttttttttgagacggagttttactcttgttgcccaggctggagtgcaatggcgcgatctctgctcactgcaacctctgcctcctgggttcaagcaattctcctttctcagcctcccaaatagctaagattacaggcgcctgccaccacacccggctaatttttgtattttagtagagacgggatttcaccatgttggtcagactggtctcgatctcctgacctcaggtgatccacccaccttggcctcccaaagtgctgggattacaggcgtgagccaccgtgcccagcctgttttctttctaatgtttggtttactgtattgtgaattttcccacttgcccacccaaacaactcttgaatggcattctggtgacaaagactttaaaatcacagtttgtctgtcactctgctttgaaataacaccatgctatacaaacttggatgagaggctacacctaatctttgtgttctgatagtgtagcaatgggtttagtgtggtattgggatgagaaaggaaaaggttatcaaaatgagtggaatgtgaactaatatttctgaacagagagaacagtgttttctaaatgcatgcattaaactgagttcatccatgtcaggcaatgaataattccctttttctaattctcccttgccttatgactgttggctcttacataatttctaaatgcaaaataggatattgtctaacagaatctgcagttagtggttacaaacagctgcagaaattgttagttaagttcaagttatgttttttaaacgccagtaacaatttcttccttttcttatcggtctagtttcatttaacttgtatggttctttttctgctagagtctcaatttatgagccgatgttttccaccaaaagttaatggtgcctcttcattctaattcattgcaattaattctgagtactggatggccagaagagctctctatacagtgcgagaggtttccttatttctgactaattaggagtttttattatataacccgatttgaggaaatgctttaaaacttaagttaaaatctgaccatgagcactgaacagtgtatcagtttctttgggagtttgccttccattttttgtatacagacttctcgaagtatttggctttgaatatgattaactttttaattctacatatagatgtccctgttgtgaagcagaataggaaatcctgagttatttatgaattaaagtagaattctgtgatgtaaattataaaaaataaaatttcatttctggttttttgtttttttttgaaacagagtattggtctgtcgctcaggatggagtgcagtggcaccgtctcagctcactgcaacttccacctcctgggttcaagtgattctcgtgcctcagcctcctgagtagctgggactacaggcgtacgccactacacccggctaattttttgtatttttagtagagataggctttcaccacattgcccatggtggtcttgaacttctgggctcaagtgatccgtctgccttggcctcccacagtgctgggattacaggtgtgagccaccatgcccagccacatgtaatttttaatgtgttatatattctataatagaatattttaaagagaaaaagaaagttatagataggaatctgtcaattttaagcaagaatgaaggagtttactttaaatgatgatcagtttgataattatcttaagaaaacaaacgaaatttagtagtttaggttttcttcggttggaatcagtgttgccaactctgtgaagccaacaggatggagttggctctattctaagtgaagccagctgcgtagcagagtgttaaatttttttaccatttggggaaacagtctctagcacaatgaccactttagttattgtacatataaggaattgtactattgaatattttggttaccattgctgtagtactaggttgacatctttatggaacatgttaatatcttcagtgccttccccacgtttctgtttcttctaaaatgtctgactgtagtcatctgaaggaattgttcactataacaatttagagaacatttttttttaaaaaggaagtggttagtataaatgcaggaaataaattttgcaactgcagcttaatctttttaggcttaaaaaagtttcaaatgctttttattgcaaagaagagaaaagtataaagaattttattataagtattaccaaaaatggatattgttgctataactgttcttttataagtggatcaaggttcaaatgaaagattctagaaaagacacgtttattattctcttctttatgtctgtggagtttatatttactcctaaaagcataattattaacaagcctataagttaatgtacaaaatagcaatcaagcagcatcgttctcataccctagatctgaagatagaaatgaagaaatgaattccctgaatatatatgtatttatttatgtgtgtgtgtgtgtgtttagcttcaacacttggcacttagtatgtggcctgaactgttctaaaggcttttgtatggtaagtcatttaataaggtattttaattttcaatgatagtaaatggcctagcccatggctaagagcttgttcctgatctttgtattacgtggaagtgggttcaaatcttgtttctgtcgcttacaaatggcatgacatgtggcaacttacttcatctctggttcctgttctgtaagtaaggatgcatatgcacctcaagggctgggtgtgaggtttcagtgggtgtgatgtatgtgtagtggcctatttttgaactgcaattgattggctgacactgttattgccatctgtattttgcctgtatccttctccttgcattatttctgcctccttcctcctcatctcttaccctttagtctactttttttttttttttttgagacgcagtctcgctctgttgccaggctggagtgcgggggcatgatctcggctcactgcaacctctgcctcccgggttcaagcaattctcctgcctcagcgtcccaagtagctgggactacaggcgcccaccacgacgcccagctaatttttgtatttttagtagagacagggtttctccaggttggcctggatggtctcgatctcttgacctcgtgatcctcctgcctcagcctcccaaagtgctgggattacaggcatgagctaccgcacccggccatatttttaacattctaggcattctgggcatctagacattcaacaagaatatttatttgacaaagagtgtgaaacaccagtaggactgtaatagatacctttcatgaagtccccagttagcagactggagagagaaggatgagagaagcatgagacggagagagaaggaaaacttgagtcagttggggaataaggtagagtatgatatgtagcatgccaacttgtgtgaagatcatcagaacgatagcaggtttttttttttttttttgagatggagtctcgctctgtcgcccaggctggagtgcagtggtgcagtcttggctcactgcaagctctgcttcccaggttcacgccactctcctgcctcagcctccctagtagctggggatacaggcccccgataccacgcccggctaatttttttgtatttttagtagagacagggtttcaccgtcttagccaggatgttctcgatctcctgacctcgtgatcctcccacctcagcctcccaaagtgctgggattacaggcgtcagctaccgtgcccgaccacaatagcagtttaaaagcaattaggccgggcgcagtggctcatgcctgtaatcccagcactttaggctgccaaggtgggcagatcatttgaggtcaggagttcgagaccagcctggctgacatggcgaaaccgcatctctactaaaaatacaaaaattagctgggcatggtggtgcacacctgtaatctcagctacttgggaggctgaggcaggagaatcgcttgaagctgggaggcaaaggttgcagtgagccaagatcacgccactgcactccagcctgggcaacaagagcaaaagtccatctcaaaaaaaaaaaaaaaaaaagcaattaatgattgctctacatacttgccagtgagataaaggaaaaaaaattataaaaacgatcaatgaggtccatcatatatgaaatcacctggtcctttcatcagcaaaacactaggagctcagcagttgctcctgcattctgcatctgaaaaaggtctgtgcagactgtaggttgttgggacaggcctgaagtcggaatcaggacttgaacctgaaggatatgtagaaacagaaaagagaaagcgccactgaggtagagacaacttcatccagggcactgagggagcatgttgccgacgttgacctgcctgccaggacaggggactctgtgggacctagctggagaagtaagatgagaacagtttgtgaaagatatttaaagccaaatgggccggatgcagtggctcatgcctataattctagcattttgggaggccaaggcaggaggattgcttgagcccaggagttcaagaccagcctgggcaacatagtgagaccaccccacccccaccccaaccaatctcagaaaaaaaaaagaaagaaaaaagccaaatggcaggatgaatgtgaccccgataaaatgctattgaacctactcctcaaaaaacctacactggaaagtgttttatattttccaaagggcttttagtcctctccatgtttcctttatccctttatagataaatagggtaaacctataaaatgtgaaattaccattagcctaaagtggccctgctggataaggtacagccaagactgaagcatgtttctgtgcctcaagttcagtgttcttgccagtttaccattcagctttactactggattgtattaaataagctccttactcttagccaccgctttttcctacagaactaggcagataatagacatgtgagactggcaggttgaggtaagatgacaaatagctattagcacagggcctcagtatcaggacccaataaagagaggtgggggttgtactggcctaggaggcccaagtcagacgtaaagggggcggccattattcaccatccatttacacatctgtagctgtgtggtaatgcagaccaagtgttgtcacatcttccatgtcactccttttggagttaaatttccttcttcctggaagatgggttgttttaatttttttccatgagagtttgtgactggtaaattttctttatttgtttgaaatgtctttatttttgtcctccctctaatgtgatagtttagctagatatagaattctaggttgacaattgttttctctaaacatttcatttgtttgttttggttttggttttttttttttggagacagagtctcactgtctcccaggctggagtgcagtggtgcgatcttagctcactacaacctccgcctcccaggttcaagcgattctcctgcctcagcctcccaagtagctgggattataggtgcctgccaccacacctggctaatttttgtatttttagtagagatggggttttgccatgtcagccaggggggtcttgaactcctgacctcatgtgatccacctgcctcagcctcccaaagtgttgggattacaggcgtgagccactgcacccagcctaaacttttaaaaaatatcattcaggccaggtgtggtggcttatgcctgtaattccaacactttgggaggccaaggtggaaggatcacttgagcccaggagttcgagaccaggctgggcaacgtaggaagaccttgtctctacaaaaaatgaaaagtcacctgggcaggctggtgtgtgcctgtcgtcccatctactcaggaggctgaggcaggatcattgcttgagcctgggaagttgaggctgcagcgggctgtgatcataccactgcactccatcctggttaacagagcaagactctgtctcagttaaaaacaaaatgtaatttcattgtctatcattgtcagttgttcttgggaatttgacattctatttaatagcatttatttatttatttatttaagatggcgtctcgctctgttgcccaggctggagtgcaatgacgcagtcttggctcactgcagcctccacctcccatgttcaagtgattctcctgcctcagcctcccaagtagcctggattacaggcgtgggccaccatgcacggctaatttttgtatttttagtagaagcagggtttcaccatgtttgccagactggtcttgaactcctgacctcaggtgatctgcccgcctcagcctcccaaagtgcggggattacaggcgtgagccaccacacccggccttgacgttctatttaatagcatttctttgtagatattttgctttctcctgtagttgtgaagaccttgtatttccctttggtatccatggcatcaatatgatgtttcaaagcacagactttttatttttaatttattctgtttggggttcctagaggatttgttcctttcataaatatatgaaaactcagtgtggtggctcacgcctgtaatctcagcactttgggaggccgaggtgggcagatcacgaggtcaagagattgagaccatcctggccaacatggtgaaaccccgtctctactaaaaatacaaaaattagctgggtgtggtggtgtgcgcctgtagtcccagctactcaggaggctgaggcaggagaatcgcttgaacccgggaggcagaggttgcagtgagccgagattgtgccactgcagtctagcctgggtgacagagtgagactccatctaaaaatatgtatatatatgtatatatatatatatgaaaactctccagcattaactcttcctatattatgttgttattaatattgttggttttgggattcatattagatgtgtgtgaaatttctcattctgttccccacgcctcataacttctttttcatagatttcatttcctatatattacatatgatgtaactttgtcagctacttcatgaagtctcttcaaattattctatttaactcatctattgaattttaaaatttcaatgactgtattttttatttctagaagttccattttattcttttgaagatatacctgatctatatttagagcatcttattattttcttatgattccttttgcatcttttactaacttaatccttcaaaatgttgttttgttgtcattgttgttgtcgttgttttgttgttgtttttgagagagggtcttattctgtcacctaagcccaggctgaagtacagtgggacaatcatagctcactatagcctcgaactcccgggctcaagtgatcctcccacctcaacctctggaatagctaggactacagctgtacaccaccatgccctgcttatttttaatttttttttagaaatggagtctcactatgttacctaggctggtctcgaactcctggcctcaagtgatcctcccacgtcagcctcctctagtgctgggattacaggtgtgagccgctgtgcctggcctgttgttcttatattttctttcacattgttcttttagctcaggttctcatttttcttactatcgcatcagctctcatggtggtttatttccttgtgcatttatattattactaccttttttgtatgagcgtaactttgacagagattgttttttctccgggaatcttataaaaacaggattgtagaagtatccccccagtgaggttttatagtgtttctgccagacaacctggaactaatttttatgttaatttcttggcttggggaatcttgcaccatctgtactagcacaggctgaagcttttgtattttagaagacactcttcccccactccacagcttgagacctacataagcttcctggtcttctgtggtcacaagaagtttctctaattatttcccatctaaaagaagacaaaactaacattgaggttagtgcaggaagggcttatagtcttacatatttacttcattgacagtatattactgaataacatgtgataacatatgcaagatttttttatttttcgggacggaggcttgctcttgttgcccaggctggagttcagtggtgcagtctcggctcactgcagcctctgcctcgtgagttcaagcgattctcctgcctcagcctcccaagtatctgggattacaggcacatgccaccatgcccggctgatttttgtatttttagtagagacggggtttcatcatattggtcaggctggtcttgaactcctgacctcaggtgatccacccgcctcagcctcccaaagtgctgggattataggcgtgagccactgcccccagctacttgggagactgagacaggagaatcgcttgaatctgggaggtagaggttgcagtgagccgagatcatgccactgcactccagcttgggtgacaagagggatactctgtctcaaaagtaataataatcaatttcaaacctaccataatgaaaaactcaagtctcttgccaatgaccatgcgtgagaaaccaggggggaaaggggggccaagtcttggaaaccatcatttacatcttagcaggatctccaagctcgtgctgaatttctaccagcctcccttggaggcttgccaacatcatgatgagaaatatcagcattggcctcttctcttttagcagaaattgtcactcaccttgagtaaatagatatttcaaataaggcaaccagagcatagggaaacagaagaccttttcttaaaactgtttagcaagtgaatgggccatgtgggattgagatgctggtctcactggctatctttctgcattctctccttctatttcagtggccctccacctacaatactggagctagaaagttgtaagactgttttcaaaaaaaaaaaaaagagtcaggaaattgctggaatagttcaagcatatttctttggttaacttattttgaagtttttctctgttttgtattctagctgcccttataatttatcaaagacagactcattgttttggcaagctcctggcctggaagtctccaacaaaaactcacagcactctatctgaaaaggaatttttaaatgcattcttagtcttgaaattgaaaatatattctagatacaacagtttgctgggaaatttaaacaatgccgtttatcatccaacaactttgctctggacaaagagctttttcatctcttccttagtgtcccttctactccattagcttttcagagctttttttaaaaaattaattaatttatttatttttttgagacagagtctcactctgttgcccaggctggagtgcagtggctcaatctcggctcagtgcaacctctgcctcccaggttcaagtgattctcctgcctcagcctcctaggagcagggactacaggcacgcaccaccacactcgactaatttttgtattttttagtagagatggggtttcaccatattggccaggctggtctcaatctcctggcctcaactgacatgcccacctcagcctcacaaaatgctgggattacaggcatgagccaccgcggccagccttttttaaaatttggttcacttctaggttatataaagcatatttctttggttaacttattttgaagtttttctctgttttgtgttttagctgcccttataaatttgtcaaaggcaaactctgataaactttaaaaattcttttttttttttgagacggagtctcactgtcaccaggctgaagtgcagtggcatgatatcttggctcactgtaacctctaactcctgggttcaagcgattctcgtgcctcagcctcccgagtagctgggattacaggcacgtgccaccacacccagctaatttttgtatttttagtagagacggggtttcactgtgttggccaggctggtcttgaactcctggcctcatgatccgcccgcctcagcctcccaaagtgctggaattacaggcgtgaaccactgcgcccggccaactttaaaaattcttaaaagttatatatacatttacttcatcttattaaatatggctttacattgttaaaacaggatatacatagctcatcaaaagtgtgacataatatttaaccaatgatttgtttgtttcaaattattttaaattattggctattataaacagcactgttggatatcttttgttattatatcattaggataaattttcagaagcagaatttttgggtcaaagactagagtaaaattcgtttgattccttttatttttttcccccccttgagacagagtctcactctgtcccccaggctggagtgcagtggcgtgaccttggctcactgcagcctctgtctcccgggttcaagcaattctcctgcctcagcctcccaagcagctgggactacaggcatgtgccaccatgcctagctaatttttgtatttttactagagacagggtttcatcatgttggccaggctggtctcgaactcttgacctcaggtgatccacctgcctcagcctcccaaagtgttgagattacaggcgtgagccaccgcacctggccattagttttattcctaaccattgacaaatcctagagaaatacgaataggattttcagggatttccaacaggttgctattttttctgttctcaaaaatacctagaaatagaaaataatatccagtggcctctacctcatttgtgtgctgtaaaaataccagtgcttattctcatttacctggccacgtctgaaagtcatgatcctctagtggttatcaggagctggaatgtgcagaaacttttatttcttaaaccatacaattctgtaagtttgaattacctacagcaaaattttttttttttttaagcaggagaaaaaagaacaaaaggtggctagataacacaggttgtgaaagtggcaagtttaattttgtccacaaaatgaggtccatggctcaggtagtttggggaggagggaatcgggatcggtgctgtgctggattcttgctgtgtccccagcctctgggtggccgccaggcccatctgccagtcaggaggagctgctgcaggttgctgctcactgaataatgattacaggcatcctgtctgtgggcaaaagagtgcattcttagaggaaagggaataaaatctagattgagcccccatttccatccatcctaacatataattggtctcttcttgtgataacgacgttaaatactaaagatgcagctgttccaaaaaacattgactgttgtttgggctaccagcgatactgtaaaatattccacatggctttccccaaacttttggtgacaaaaggtgggcatttataatttgttatatcctttcaacaaaggaaaagcagctttccaaaagctctggacactgctgctttaagtatcaggttgctgcaaaagtaattgtggtttttgcccttccattcaaatgacaaaaactgcgattacttttgcaccaacctatatagtttatcatttaaggaacagcaatgtataaaactgagagatctggggccatgttaaaaacttagtaagtctctttatttattcattcgatcaatgtataaatagaaccagtctatatttgctcatctagttaaaaggtcaaaagccataggcagccttgaaaaatgatgcaagagggctgggcgcggtggctcatgcctataatcccagcactttgggagaccgagacaggcggatcacgaggtcaggagatcgagaccatcctggctaacaaggtgaaaccccatctctactaaaaatacaaaaaattagctgggcatggtggtaggcacctgtagtcccagctactcaggaggttgaggcaggagaatcacttgaacctgggaggcggaggttgcagtgaaccgagattgcaccactgcactccagcctgggcaacagagtgagactccatctcaatagaaaaagaaaagaaaagaaaagaaaaatgatgatgcaagagtggtaagatgcaaggttataactcggttataccacatgcctcatgtgaaatgagcaagtttcttagtacacttgtattctctgcttatgacaattgagacactgccaagagtgttattctccttaatattttgaaatattaaggaaaaagtaatattgaattaaacaggcctggcatatggtgcctcatcatgcctgtaatcccagcatttggggaggctcaggtggcagggtcgcctgagcccaggagtttgaggctgcagtgagctatgatggtgccactgcactccagtctgggtaacagagggagaccctgtcttaaaaaaaaaaaaaaaaaaaatgagctaaacaggaaatagccacacatttaggccatgctaataatctaaatttagctaactgaatggatgacggtatttttgtctttaaacccattaggatttcaaaatattgggctacagttcagtttctaaaatattgttttctttatttagaaactgcaactctgaccttttaggcagtatggcttagttccataatgatattgagaatggactatgttaagaattaccaagaagtgggctgggcgtggtggctcacatctgtaatcccaacactttgggaggctaacgcaggccgaggcaggcagatcacttgaggtcaggagttcgagaccagcctggccaacatggtgaaacgctgtctctactaaaaatacaaaaattagccgggcgtggtggcgggtgcctgtaatcccatatactcaggaggctgaggcaggaaaattgcttgaatctgggaggcagaggttgcagtgagccaagattgtgccactgcactccagcctgggcgacagagtgagactctgtctcaaaaaaaaaaaattaccaagaagtgaaatcatgtataagccatacatccttaggtctgtttggatttatttgagggagattcccaagggtttgtcaaaaaattctcaagtttaaattctgtcttcctgttggacaacaaaagcagcgtagatctgattctaagacgtctgtgacccagcctaggcagcgggggttattctggactttttagaacattatcttgaaattctgtgacactgactcgttgcaagtaaaacaagccaactctctgtacatctttctgccctgtagtaatattgctgtaagatgcagtgtctttattctcagaatgggaaatttaatttaattgaaagaatagcttatggtctggtttagaatggaaacactatctctttgaggtaatagttgctatttttagactgacttttaaaaagagatgagaagtcatgatgcttattagctccacttagtcttagacattaggagatagtctccaaaataccattaactgttatcccaaataagttctccaaaatacaagatattttaaaggtatttttgtcataatgagtaattgattcaacactagttttagcgactcttaaattccattgtcaaataaacaatttgctaaacagaaatagattttccatagtgaaatttggttagaacaatggtgcattcctaggccagagtttcagaagtggatattaattcaaagcagctggatgcagggactgagaaaaagacagtcctgtctttttgctgcggctttggagaatctgatgtatcacagtattttgctgtttttgaaggtttccctatccttgtagtcagtgagagtgagtgagactgtagaaatagatcgtcctttgcaattgtatgtccaagcatggaagaaaaactcctggagagacagtgttcctttaacataaaaggcagaccgtctaaaatatactttgatttattatcttctacacagcttactttctaggctggactgtagacatgttggtccttattcagcgtcttccacagttcacgtctagggcccttgttatgttttcaggattactgcatagaaacagggcaaagggcattatgaatctattaggaggtaatatgcttacagaaggaattatgcagctaaagctaaaacatgattagggattctgtggagctacaggaagaggatcacagccacttccaaccaaatggtgctgggtggggtacctctggcaccagctttcatgggtaaaatattctacttgggtaaaatattctaaaatattggcgtgagtggatttattgtcagaaagcttttatctgctctcatgggttgtgtgtgtgtgtatgtgtgtgcgtgtaagtacatgcatacatattatatataatgatggcattctgatgtgatgcctgtttgagatcttaagttattttaaaaactcacttagatagaatcttcaaaataaacggggaaactacctcctgagctcttgctgttctttacagaagagatgaagaaatcccccactggatttttgtgagactttctgaggaagccttgtgaataaaatagagactgttttagaaatttgaggtctaatgggaatttttttttaaacattcatagcgaaatgatacatgatgaaactcagcagctgaagagttaatagggcatttgtgctggacgggctcggggaacagatggaatgcatgtaggtgggaaagctattatttaaacagaggagggctactgtgtgttggaagggggtggatttttgagggtagctgggtacttaacattttggggctagactaatatatttactagtggacacaggaagaagcagacgccaaggcatatggtcaggaagggagttaacaggccaccaacaaagaggaagaatgcggcagctgaaatcaactgagggtagatgaaaagaggataaaatggcaccgacagatccaaaggccttaagaaactcaaaaaacctcagtaataaggaaatgtgtttggaaatactgatattgttaccttcatttgggaagtgttcacgtgtgaatagggaagaaaataagggaagcaactgtgaattaccttaggctttcaccagatgagtatgagtaaaatgtgtgaagtgaaattcaggttaacccttcaagtcacataggcaggaaaccaataaagaagattgacatgaaaaaaaaagccaatactaaatgttcccatcaagaagaaagtggaacaaatacttcagctttcctctcatgtgtttcttttcttttctttcttccttcctttttctttctctctttcactttctctttctttctctttcattcgtttgttctttttttttcttttcttttttttgagagagatagtctggctcagtcgcccaggctggagtgcagtggtgcgatctcggctcgctgcaacctccggctcctgggttcaagcgattctcctgtctcggcctcccaagtagctgggactaaaggcgcccaccaccacgcccatctaatttttgtatttttagtagagacggggtttcaccatgttggccaggatggtctcaatctcttgacctcgtcatccacccgcctcagcctcccaaagtgctgggattacaggcgtgaggcaccgcacctggcctctttcgttctttcttccctttctttctctcttttcttcttttctgtctttttcttgtgtttctgattttctttctttcatgattaggtcttaattttcttgtttttgtttgtttggtgttttgttttgttttttgaaacagtcttgctctgttacccaggctggagtgcagtggcgcagtcacagcttactgtatacttgacctcctgagctcaagcaatcctcccacctcagtctcccaagtagctgggaccacaggcacacatcaccacacccaactaatttatttatttatttatttattattttattattattattttttgagacggagtcttgctctgtcgcccaggctggagtatagtggcgcgatctcggctcattgcaagctccgcctcccgggttcacgccattctcgtgcctcagcctcccgagtagctgggactacaggcacccaccaccacacccggctaattttttgtattttttttagtagagacggggtttcaccatgttagccaggatggtcttgatctcctgatcttgtgatctgcccacctcagcctcccaaagtgttaggattacaggcgtgagccaccgcgcccagccaatttatttgttattattattttttgacacagggtctcgttctgttgcgcaggctggaatgcagtggtagtgatcacagctcactgcagcctcagcctcccaggctcaagcaatcctcctgcctcagcctcctgagtaactggaactataggcacataccaccatgcccagctaatttttgtagagagaggggtctcaccatgttgcccaggctggtctcagtttcctgggctcaagcaatctgcccacccgagccttccatagagctgggattgcaggcgtgatctaccacacccagccaggtcttagttttctgaaacattggttcagtaaaacaaaacaaaaacaagcaaacaaacaaatagttgccctggttatgttggaagacagcctatttcctgttgtgtttctggcttactgcagtgaatttgccaggtcacttaaagaccaaaaaccctatcttcatctggcaggaggtagttttttgccttgtgtggacctcaaattgtgttagagattcacaagattatatttatcaaaataacaccacaatgctatgtgaatctaaggtggtattaacggcacaacctcttgtacttctggatgactttagaatttatagacattcctgtttgaactttaaaatccattctgcaactagtcaacaattgttgccccttttttaggtatgtgatcaatcagaatatgaattagagaaaaacaaatgtgtaaattattgattttttaggagaaaagcaatgcagtaaaacataaaatagcactcctcaaaaaacataaaaagcataaagaagttgccatacttattccctctttagcatatatactaaatataaacatgctagagagctttagaaaagtctccttaggtcagtggttcatatgcctttttagtgcatgaaccccattgagaactgggtttaaaaattcatggatttcccagccaggcaccgtggttcatgcccataatcccagcactttgggaggctgaggcgggtggattgcttgagtcaaggagttcaagaatagcctgggcaatgtggtgagacctcctatctacaaaaaaaatacaaaaattagccaagcatggtggtgcacgcctgtagtcccagctacttgagaggctgaggtaagaggattgcttgaacccaggaggttgaggctgcagtgagccaggatcgtgccactgcactccagcctgggtgacagagcgagacctggtctcaaaaaaagaaaaaaaaaaaatgaatttctcatcccctcctcaaaaaaaaaaaaatgtgtatatgagatgagcagaggttcccacaagggtcatccaaataatgtaaattggcccaagtgcagacagtatagaatggtgtgtcaaactagaaggtacacgccacgttaaggcagtagggaatggtggaggtttatacaaactaggatgcacattgcttacctaaagtcaattcaattcagaacattaaaaagcacccgcggaatacatttgaggtaaatctggcccctaggcatcccagtgtgcagttctaggcttttattgattgcacccaggcttttatctatggtgtataaacgtaggagtattcttgtttttgccctaaggcccgacaacaagctcaaatacgtcaccaaatggcagaggacagcaaagcagattactcatccattctccagaaattcaaccatgagcagcatgaatattaccatactcacatccccaacatcttccaggtaagtcctgaacatctctcagatttcatgttttatgctttgctttccttagaaacatgacacttctgaatcgtgattgctgggtttgtattctgagtctgagtctttatataattccaaatttccactaattttttttttttttttttttttttttgagacagagtcttgctttgtcacccaggctggagtgcaatggcacagtctcggctcattgcaacccctgcctcctaggttcaagtgactctcctgcctcagcctcccgagtagctgggactacaggcacgtaccactgggcccggctaatttttgtatttttagtagagacggggttttgccatgttggccaggctggtctcaaagtcatgacctcaggtgatctgcctacctcggcctcccaaagtggtgggattacaggcctgagccaccatgcctggcccttttttttgttttgttttgtttttgttttttgagacagtctcactctgttgcccaggctggagtgcagtgcacaatcacgacccactgcagctttgaactcctgggctcaaaggatcaagggatcctccaagttcagcctcctaagtagatggaactacaggcatgcaccaccatgccctgctaatttttaaattttttatagagatagggtcttgctgtgttgcccaggatggtctcaaattcctggactcaaacagttctccagccttggcctcccaaagtgctaggattataggcatgataaatcattttttaaagcatctagatcaagcattgactagcaatatgaatgaaatataataatctcaagattaatcaataactttgcaaatttctatagtttgcacctgcagccaattatttgtcagtcttttttctttttttctttttttcttttttttttttgagatggagtcttgctctgtcacccaggctggaatgcagtggcatgatctcagctcactgcaaccttcacctcctgggttccggcgaatctcctgcctcagcctcctgagtagctgggattacaggcacctgccaccatacctggctaccttttttgtatttttagtagagacggggtttcaccatgttggccaggctggtcgtgaactcctgacctcaggtgatccgcccgccttggcctcccaaagtgctgggattacaggcgtgagccacagcgcctatttgtcagtcttaaactatgattctgtgattaatgctgtctttgctaaagggatgattgtggttataaaaatgccaacttaactatagaagtcaaagcagcattcatagagttataggatttaaacaaatgacagttctttcttttggattgttttcttttgctcatgttaggttgtcaaaaatggtatgagaaaagatagacatatgttcttccattttacagattttttgcaactttgagtccaattgtagaaaaaataaataatatatttgcttcttggtgtctacacacacagcaaacaagtccttgtaaattatagttggaagatacactagcatgtattgggctgaggcagttaattaaatactgtgcttttggtaaaaggtaaagtagtagattaaagatggagaaaacgtttgaggtagattacaaatagtgttagtaataaaactattggccaggtgtggtggctcaagcctgtaatcccagcactttggaggcctaggcaggtggatcacctgaggtaaggagttggagaccagcctggccaacatggcgaaaccccatctgtactaaaaatacaaaaaattagccaagtgtggtggcggggggagggggggtggggcctgtaatcccagctacttgggaggctgacgcaggagaatcacttgaacctggaggcagaggttgcagtgagctgagatcacaccactgcactccagcctgggtgacaagagcaaaactccgtctcaaaaaaacaaaaagaaaaacaaaaaagaactattgagtttggcattcttactaaaattagaatggaattgtgcaaagcatatatttgggcagcctaacatgtctagcaatttataaaataaatgtacagctgggtaatatggaggctccgtgtacttagagccgctctaactctaacccattttttcctcaaagagaacttgttagaggtaacaatgctgccgaaaaacaactttgtttaataataatggaccaaacttactttatacaaaatctaatgttgcagaaaatacaagagatggaggaaaggaggattgtgagaatgggagagtccatgaagacatatgcagaggttgatcggcaggtgatcccaatcattgggaagtgcctggatggaatagtaaaagcagccgaatcaattgatcagaaaaatgtaagtattgccatttggacttcattgataactatttgcagatccattatttctccccatcccctttccatttgacctcatgtcatcatctcatggtggatggttgcttttggtggtcacacatgctctgtgtcttggatttagctgtataattccttttttggtaaacacatttaagtggtaaattgtccgagacatgacagaattgaattgaagtatttcctggaaaaaaggtaaaggctttgtttcctctaaggcagggtttctttctctttttctttttctttttctttttttttttttctttttgagatggaatctcgctctgttgcccaggctgcagtgcagtggcgtgatcttgggtcactgcaacctccacctcccgggttcaagcgattctcctgcctcagcctcctgagtagctgggactacaggcgcccgcaccacgcccagctaatttctgtatttttagcagagacggggtttcaccatattggccaggctggtctcgaactcctgacctcaggtaatccgcccgcctcagcctcccaaagtgttaggattacaggtgtgaaccactgcacccggccaaaacagggttccttcagcacttttgacattatctcaggccagatcatttttcttgttgggggcatttcagaatgtttagcagcatcctggcctctacccagcagaggccagtagcactccccgagttgtgacaatcaaaaatgtctccacacattgtcacatgtcctctgggagggcaaaagcttctctggttgagaatactgctttagggcagtgttctccatttgaattcctagagacctatttctcaaaaaaatataaactagaacaccagcataggcttttactgttaatttgaagacacaaatattcaacataaaagttatgctgctggctgggcacagtggctcacatttgtaatcccagcactttgggaggccggagcgggtggatcacttgatgccaggagttcaagaccagcctggccaacatggtgaaaccacatctctactaaaaatacaaaaattagctgggtgtggtggtatgcccctgtagtcccagctactcgggaggctgaggcacgagaattgctggaactcaggaggcagggattgcagtgagccaagatcacgccactgcactccagtctgagtgacagagcgagactctgtctcaaaaacaaacaaaaaaatcagaaaacaatagttctaaattctaaaagctcggatgaaaagctcaaatgatggcttttgagaagaatgaaaaaagctggccagctgtggtgactcaagcctgtaatgccagcactttgggaagccgaggcaggcggatcacctgaggtcaagaatttgagaccagcctggccaacatggcgaaaccccatctctactaaaaatacaaaaattagctaggcatgatggcacatgcctgtaatcccagctactcgggaggctgaggcaggagaatcgcttaaacctgggaggcggaggttgcggtgagctgagatcacgccactgcactccagcctgggtaacagattgagactgtctcaaaaaaaaaaaaaaaaaaaaaaaagctactaggaaaaaagttattatcaatcagtacaatttcgttagttatcatctgtatgagatcatcataattcattgtttttttgagatggagtctcactctgtcgcccaggctggagtgcagtggcgcgagctcagctcactgcaacctccgcctcctgggttcatgccattctcctgcctcagcctcctgagtagctgggactacaggcgcccgccaccacgcctggctaattttttgtatttttagtagagacggggtttcaccatgttagccaggatggtcttgatctcctgacctcgtgatccacccgcctctgcctcccagagtgctgggattacaggcatgagccaccgcacctggccaattcattgtttaaaaagtgtttgcatgcttctgaatgtatttatatgcttgtgggtataatttcaggattcacagctggtaatagaagcttataaatcagggtttgagcctcctggagacattgaatttgaggattacactcagccaatgaagcgcactgtgtcagataacagcctttcaaattccagaggagaaggcaaaccagacctcaaatttggtggcaaatccaaaggaaagttatggccgttcatcaaaaaaaataaggtactgatggttggcgtgaaatgagttttctaaggtgtggagattttgacttgatcttttagtcttagaaaaactaagatcctaaacctgtagtttcagaatgcaaaagaagaagctagtgtgctaccttatgttgagacagtatttctttttggtggtggtatctttgccatggccctgtgtcttatttcagatgcattatcctcgtaccgtgactcccacactaacagagtactgacctctccaccgtttcgcctcatgcctttccctccttcctctcctagactgctggttaccttggctgggagagaggatgtagtgggacattcctgtaacactttatccgcacatctactggaaatcgttaccatgttaataacttggttttgaattcatgttaacatgtgtacccatgaacatttttcattttcttttcatagtgcgatacataggtgcatgacagcattaacctggggacgtagaatatgatcaaggcagcattactgctttaactttagaatgacttactatttattaatttaaacagactgctgtttccacaaccttagcattgaaggtctttcattttctcccatcaagctatgttagtttaggtaatgtagaaatatttaccctctggcttaagctggtttagagtaactaactagagctatagtttgcatgggaaagtctgcacgagcttcttgtcagatatttcttgctcttctgtcgcattacttactaaacctcccaactctcatcatattcttcatttaaccacctcctacatgttttcttttggaccatggcctaaaatttaattgtttgtgttttacttgcgttggatttcaaatattatttgatgcttatttttgttttgtgtcttcttgtttctgatttttactctgtcacggctccatctcttacatgtagcttatgtcccttttaacatccccccatcagcctccccctccccctcctgcctctgcctcaccctctgctgttcccaacggcccccagtctcccaagcagcaaaaggaacccctctcccatcgcttcaacgagttcatgacctccaaacccaaaatccactgcttcaggagcctaaagcgtggggtaagttctgctccggaatcctgtctctctggcgtgctttggttgcatgtttggttctgcataactaattttgtttgtgaatgaatccattgtgttttcccataacatataaaaaagttaaaaaaaaaaaaacaaaaaccattatagctagaaagaaaagccagaaagaggaagaaagaaagaaggaagcatggtggttggaagaaaggagaaaaccagacagcccagagttctttctatttgtttctttcttttttttttttttccagacagagtctcgctctgtcaccaggctggagtgcagtggcgtgatctcggctccctgcaacctccacctcccgggtttaagcgattctcctgcctcggcctcctgattagctgtgattacaggcatatgccaccacgcccagctactttttatatttttagtagagacagcatttcatcatgttggccaggatggtctcgatctcttgaccttgtgatccgcccgcctcggccttacaaagtgctgggattacaggtgtgagccactgcgcccggcctttttcttttcgtttctagtacattttggaaggactttacccctcttcctctttaaagcatccaagtcatgcattttctaccttaattttaccaaaaaaaaccacttagatttcatttctaaaactagcgacctgagactgggcgtgatagttcacatctgtaatcctagcactttaggaggccaaggcaggaggattgcttgagctcaggagttcaaaaccagcttggacaccatagtgagacccccatctcttaaaaaaatatataaaaattaataggacaagcgcagtgtctcatgcctgtaatcctggcactttggaaggccgaggcaggaagattacttgagctcaggagttcaagaccagccagtacaacatagtcaaaccccatctctaaaaaaaaataataaataataaaaacataaaactagcaacctatgagatgaggaattggaagtcactgtgtaagtcagaaaatattgccttaataactactgaagcaatgtgagtgtaatgaagatacttgcctgagctatgcctcagggtcgaaaggagaagagtcataagtcacagtggtttcattcgctattttagtgagattatataagatgttgataaaatatctgttgattggaaggggcctgatgcagaatttctctttaaaggatgaaacaataaaagcagctgacacttactgagcacttattgtgtgcaaagctctgttctgtgtgctcatttacttttttccagccaccctatgaagcccaggtagtactcatatttccttattttactgtaaggaaattgaggcataaaaaggtgaaggtgggaagatacagagccgggatttagatccggggagtctgattacagagtctgagattctgtgacatccacattcagggagaaactactatattgactcgtaagtggttgttattaagattgaagtccgctgtcctcattaagattgatgtgcgcttacatcatagagataatggaattgatgcagccatccaatgtagataccagtttcgtttacagagaaagattggcataaagcaatgtgtagattcccaaatcattctcaatggccagtctagtctaagccttcccaaaatatcttttataatgaatataatgagtaaacagatctttagactgggcccagtggcccacgcctgtaatcccagcagcgttaacatatccagtaaggttttctccttttttttttttttaaatcctaccctgtgggagttgcaatacagttgtagtggaatgctttcttgtacaaacataagttttacttttcccttctcctggactctccagtcaactgacggttgggttacttctttccaaatagtacctggtagtgccccaaagccagaggtggatgccatcctttcttgagtgtcaactgacacattggcctgggaaaagattctaaactacaactaattaactagaggagagatgtccttcttagacttggaatcaacagctggttactagtaaaagaataacagtagtcattgttaacctgacaatcgtatttccacaaaaacaactctgtgtaaaaaagaggcctggcacagtggctcatgcccgtaatcccagcactttgggaggccgaggagggcggatcacctgaggtcaggagttcgagaccagcctgaccaacatggtgaaaccccgtctgtactaaaaatacaaaaattagccgggcatggttaatgtccggctaattacaggcgggtgcctgtaatcccagctactcgggaaactgaggcaggagaatcgcttggacctgggaagtggaggttgcagtgagccaagatcacgctattgcactccagcctggacgacagagcaagactctgtctcaaaaaagaaaaaaaaaaaacccatgaaaaaatagccaggcatggtggcatgtgcctgtagtcctagcggaggctgggatgagaggattgctggagcccagccagggcaacagagtgagaccctttctccaaaaaaaaaaaaagtaaagaatgtaaattcataattgataacaagtttattatcaatgctttttaaaaataggggacaaaacaatatttcctcacatgcagagttcttttaatatgagaatctcaaatttatagttggtagaattatcttgaattatcttgctttaatgctatctatcatatcaggttaagaattagaaatgtaatttcctaaagatgtgaaaaaagccgttggtggaaggcagaatacagcttcaaaagtggatgatggattgagctgagatgtataattaggacttgagtaatctgcagcttcttggctcaacgatgctggcgtttagaactccactcattgttaatccaagaatttccaagacaagggtgtttttgctagactgaaagtttcatatgaactgtcagttaacccatctctgccgctttaccaagcactcatgtgttatatttatatattatctctgtatttttttggactctcatgatgaatattcatgattgtttaccatttgtttatgtgtctattccagttttctcttaacattacacagtctgttggccaaaaatggtttgtgaatctgtggttcatgatattctctaactatttagaaaaagaccaaagaattcagtaatcaataaatgtaagaaaaggatggttagaaaaagataagctgggcgttgtggctcacacctgtaaccccagcactttgggaggctgaggtgggtggatcacgaggtcaggagtttgagaccagcctgaccaacatggtgaaaccctgtctctactaaaaatacaaaaattagctgggcatggtggtgcacacctgtaatcccagctacttaggaggctgaggcaggagaatcacttgaacccaggaggcagaggttgcagtgagccgagatcatgccactgcattccagcctgggtgacagagtgagactccgtctaaaaaaaaaagattaacacttaaaacagtgaaatgggaatcggaaactggttcttttgatgatttaaaggaaaatctctgttttaccataatcagcagtatgaattttatttcttactcctcaaacgtgtgctcagcaaatctttgttaaaaaaaatttcccaaatgatgtgtttattttcctgaggttaaaccacatacatatacccactagaagcaatcgtaaagaaatagagaaatagttttgcttccctcacttttggtcattctgttcttagggtcagaattaatgttccttcctctaggacatagcagtgcaaaaaaagaggaagcacaagctcaaaaagcaaatctaaagtttggagaaatagatttcatttttaagcagtctcaacatggatcttgcatgggacatccatggcatggctgacagcttccgtgaccaacatggtacagcccttcctaccttctcatttattctactttgtaacttaacagcattatgccaacgataatttaactagaaaaagttcctgagagaataacaaatctgtgattttattatgtcttttatcatgttttgcagctttcagattcagatgtcaataatttgtttctatgatcagagtatataaatcccatgcaaacatatctcagcataactgattttgtttctaaataattaaacaggataaaatgttatttgttgtaagctgttgacatttgtaaggaaattttgtttcactgaatatgtttagagatgccgccagaacattaaccattgtttcatttttatgtaagttgaagaaaaatgaaactagatagcatgttctccatttgcagtctacaaaggggaattttattgcttaaattaaagtttcattttctggcctgtgcaagagacttttatatctaaaatatggatgtacgtttttcatattttagagttcattgtatggaaaaataccatcaaagttgaccgaaagattttgaaaatccttaccagttgtttgtcatatgttaaagtcttatggttaattttatttattttatcttgttctcttgctggttattggcagactcagtctttctgttttcacaaagaactcatgaagaggacgatagggaaacccacgtatgcctttgaggctagggactatgttgtaagttcacctgtgatggccaggtcatacagtcatggcacagccactaaccccattcacagcaccaagactggggacccagaggcacttgttatgcttccacactacgaaatgaaattcttaattgagagaactggacaccaggaaaaaaaaaaaaaaagaaaagcctaattgtataaattcaaccatacggaactttatccgaaaagcttgcatgaataaaggaagcaaactttctaataacagtggtgagctgagcttgtttttttgtttttttttttgtttttctcttttcattctagttctggtaaaatctttaaagggactgtgactgccgtctgagatgtcattgggtatgactttaccgcagaatttcacgcataaaacacagctgcagtgcgtggtcacgggagagtgacgctcttacagacggcagtgtagctcagtcacccatatccatgtttgtaacaaatggatccataagggagttatgccctaaagcttggagaacaaacaaacaaatcaaggaagcgtgagcgatctcctagcacagtaaaatgattttgcttctctctatatatatttattttcactgtcccctttctttgtacttgaggttagtactgtgactgtccaataacacatggactcgcctgggctgtgttccccatgtgttattgacgcttgtggctcccacggctctttaactgtcgcctgaaactgacagctttttaattcttcaggtgtctagcaatgcacttaatgaaatcttcaaaattattattttagccaatgatttcgctttctaattttaagagaaattctaattggctggcttacaacttcagactgaaaaccagtatataatgattaaaaagaaattccacgtactgtgatggcacttcttgtattaatagatcatccatcacaaataaagtcgaatttgtctgagaatttggtatttcctattcaatggggatttctgttcaatcctaatgactcgtttttactatgaagtgttaataatcttcctatacaatattttgaggtgagaactctgtctgtggaatgcttaagaaagaatatataactttgcgtaaagaaagtagccgagtagagagcaaatagtgtatctagttgaaatgttagttctttgaattagcaatgtttagacaataatgtgtgagaaaatatctgtatatgatagtgtgccttgtaggaaagatacttggagttttctgctgtgcaccataagtcttgtctgtgcgtacaatgaattccagttgtgataagtagatctatgctcaagttcacaggcgggctggaatcactgtagactgcccatgtcagacagtcaggaatgtgactgtatgtaccattttccccctgcaaaagtttgtctttctggttctttcctttaaaatctcatgtttctatatagggacaatttatttaaaaggttattttttatttacaaggaagtgtcaactttgaatcaatcttaaattaagaattagttttttaggctgtgtgtggtggctcacacctgtaatcccagcactttggaaggctggggtgggtggatcatttgagctcaggagttcgatatcaacctgggcaacatggtgaaacccccatctctaccaaaaaatacaaaacttagctggacgtggtggcacgtacctatagtcccagctactcaggaggctgaggtgcgaggatcatttgagctctagaggttgaggcttcagtgagctgggattgtgccaccatgcaacctgccctgtctccaaaaacaaaaccaaaaatcagcaaattgataagtaaataaatactttaaaaagagcagtcacagctgggcacagtagctcacacctataatcccagcactttgggaggcgggcggatcacgaggtcaggagttcaagaccagcctgaccaacaaggcgaaaccccgtctctactaaaaatacaaaacattagctgggcgtggtggcaggcacctgtaatcccagctactcaggaggctgaagcaggaaaatcgcttgaacctgggaggcggaggtggcagtgagccgagattacgccactgcactcctgcctgggcgatagtgtgagaccctgtctcaaaaaaaaaaagagcagtcacagtggataattctccaaataacccctgtggacagggctgagtttcatagaaagcatcagcagacaccctccacggagcaaggggtggcacacacttctcgggtgggagagaatgttggcctctagcctggctgcgagaggcattctgggtcctgcaggtagtttcttagagcaatgctagtcagccctttgttaccaattcaccaatttcagactttgccttcatgtcaatgtttatatttattagagctccttaagattaaaatattactttcctgtcatggaagtaattggtgttcagacttgttttcgtctgtataaaactttccatgggaaatttggagaacaaaaggttgtgtgattatattttttcttttttttttgttttttttttgagatggagtttcactcttgttgcccaggctggagtgcaatgcgcgacctcagctcactgcaacctccgtctcccaggttcaagcgattctcctgcctcagcctcctgaatagctgggattacaggtgtgcaccaccacacccggctaatactgtatttttagtagagacagggtttctccgtgttggtcaggctggtctcgagctcccgacctcaggtgatccacctgccttggcctcccaaagtgctgggattacaggtgtgagccactgcacccggccctgtattttttcttttatagtcattatgtgtcactgactataagcttactttaatttacatctaggctgaggtggccagtacaggcctgtaacagaaaccctccttttctatctgatctttggctctggcaatgtggagcctaagaaaaatgttattagggagcagcccttcttgtgaacttttgcacagatctgctacaagtcatttttataaatcagcgggtagacgtgtgtgttattttaatatggcggaactgaccaagttcctcttcttctgatgtgttgttgtttttttttctctttctctctctctttctctctatttttcccatacctctccaatttttacatgaagctttctctcaagctggtaagcacaattgttccatgcatgtcctgagtctaatcaggttttctggcgtgtcttttatgaatgctatgccatgcacaacgtatcttcaaagttaacttggtttgtgtttctcttacgtgtgcttttgttggtgtttccttattagacttcttggatacaaaggtccagaatctaatagaggtgatcttaatcttttcaagttgctaagaaaattaacatttaactcacgacttggtgttattcctggggccttgagaggaggacaaatgttaaagtgtctatataaatattaacgtaaaggccgggcgcagtggctcacgcctgtaatcctagcactttgggaggccaaggtgggtggattgcctgagctcaggagttcgagaccaacccgggcaacacggtgaaaccccatctctacaaaaaaccaaaaaattagccgggcgtggcagcgtgcgcctgtagtcccagctacttgggaggctgaggcagagaactgcttgaacccgggaggtgaagggtgcagtgagccgagattataccactggacttccagcctgggtgacagagcaagactctgtctccaaatatatatatatgaacgtaaatattaaatcttggggggtgtctgttggatcattttgaataaaagtaaattaatagttgaaaaatgttgctattagagaaccatagaagtagatgaaaaaatctgggagcctggaggagctgtgcaggaatgatcccagccagcagctgctacccaggtttgaggccacctgtgggaatggaagactgtggaatctttatggtgcgacgtagatatgttggtgccttgtgcatagctgattcaagaggccacaagatgatttcatggacagtgaaaagagcctcctaagcctttttagaattattcactcagtgttttgtgtcgtttctacttaattgtatatgcctagtcaacagtcaaactaatcattaaatttattaaaagtaactaacataacctataactatacttcaaatatgtataatagtttcatagtcttctcaaactccacagctaagaatatcctaaaataatggacagtgatcaactgtgacagttctactaggagtaagatcagcactataagcacactattgataacctaggatagtattttatggtgagatatatatatatatatatatatatatatatatatatagacatatgtatgtatatacataattttttcaacatgacttagtatttggtaatggacccaaccttaaagaaaaagagtattttattaaattaaataaacatttcttaggctgtgaaataaaatcctgagaagagtctttgattaaggtctctacatgaaggaaagagatctagatacttaaatgaactacaagttcatctgcagtatgaacttgggagaaactggatctattgactaggaggccttctcagctgccagggtttccttatttccctttattcattgtttgtctgggtgctaggagcaaaaggtaatatttttaggcagtctttctgtttgaaatacaaattattttaccaacttggtattgaattgttgctttatatcattaccttgaaggcaacaaagaagtgaagcgctggctgggcacggtggtttgtgcctggaatcccagtgctttggaaggctgaggcaggaagattgcctgagcccaggagctcaaggttgcagtgagctatcattgcgccactgcactccagcttgggtgacagagtgagaccatgtctgaaaaaaaaaaaaaagacaaaagaaaaaagatgtgggaccaggtgtggtggctcacgcctgtaatctctgcactttgggaggtgggggcaggcagatcatttgcgcccaggagttctagaccagcctgagcagcatggtgaaacctgactctacaaacaaatacaaaaattagccaggcatggtggtctgtgcctgtggtcccagctatactggaggctgaggcagaaggattgattgagcccaggaggttgaggctgctccagccttgggtgatagaatgaaaccctgtctcaaaaaaaaaaactataaaacaaaacaaaaaacccaaaatctgaaaaagtagtattacacggagcttgtgctattttggggtggggggaagctgtcaacaagcaagggtttgatttttttttcttttaggagacagagtctcgctctgtcccccaggctggagtgcagtggcgcgatctcggctcactgcaacctccacctcctgggttcaagcgattctcatgcctcagcttctcgagtagctgggattataggggcgcgccaccacacccagctaatttttgtatttttagtagagacggggtttcaccatgctggccaggctaatctcgagctcctgacctcaggtgatccgcccacctcagccccccacagtgctgggattacatgcgtgagccaccaggcccggccaggtttgattttattagtacatagaacaagcttctcttacagaactccagccacttaaaacataggtacatgtgtatgaccctctcttcccataccaactcctcctgttatggcctgtctttgttgttttcttatctatttataagttatcagtacaatgtgttttactgatagatttctttgcacctgtttatacacctgcacagaggctaaagctgttgtccagtgtggtagccactaccatatgtagctattgagttttttgtttttgtttttgttttgagatggagtctcgctctgtcactgaggatggagtgcagtggcatgatcctggctcactgcatcctccgcctcccgggttgaagcgtttctcctgattcagcctcccgagtagctgggattacaggcaactgccatcatgcctagctaatttttgtagagacagggtttcaccatgttggccaggctggtcttgaactgacctcaggtgatccgctcacctcggcctcccaaagtgctgggattacaggtgtgagccaccacgcccaaccgctgttgagttttaattaattaaaattaaataaatttttaaaaattcagttccacaatttcaccagccacatttcaaatgcttcacagccacacatggcttctgtgttggaaagagcggccatagaacattgccatcactgtagaaagttctgttggactcacagcacatagcaaggctcagcacatattaacgaggtgaatgttgaccacttgccagattttgtgactttttttttttttttttttgagatggagttttactcatgttgtccaggctggagtgcgcagtagcgcaatctcagctcaccacaacctccacctcccgggttcaagcgattttcctgcctcagcctcctgagtagctgggattacagacgggcgccaccacgcctggctaattttgtatttttagtagagacggggtttttccatgttggtcaggctcgtctcaaactcccgacctcaggtgatccacccgcctcggcctcccaaagtgccaagattacaggcatgagctaccgcgcctggcctagatttcctgatttctgaagcagtgtatcttagcattgtgttttgctgtattccagcttttaaaaaattctcagttctggaaaacatgctcatttgataaaactcaaaccgtttttcctctgctgttccactatgacaatcaacagagaagatttctgtgaccaaatatgtggaggcttccgctatatatcaagcagcagacactagctgggtgtcctttaattcaattccattctgatgctatctacctggagatagtggctgatcctgggggttgagggctcagtcctgaaggactgccccctccttcccaccagtcgcaagtccaggcttccaggacttctgatggactagcttcaagttggggttcccctgaccctctctttgggttcaattaatttgcaggagcagctcacagaactcagggaaacacttatatttactggtttgtttttgggtttttttttttttttttgagacagaatctcgcccgtcgcccaggctggagtgtaatggcgtgatcttggctcaccacaacctccgcctcccaggttcaagcaattctcctgcctcagcctctcaagtagctggaactacaggcgggtgctaccacactcggctaattttttgtgtctttagtcgagacagagtttctctatgttggtcaggctggtttcgagctcctgaccttttgatctgcctgcctcagcctcccaaagtgctgggattacaggcgtgagccactgcgcctggccaccacatttactggtttattacaaaggatattattaaaaatacagatgaagagatgcttagggcaaggtgtgggggagggggcacagagcatccatgccctccccgggcagccactctctaagaatctccccaaaaaccctgtcctcttgggccttttatgagacttcatcagatagacatgattgaagcatggacaaccatgtggaaatgagattggtcagaaactgcctgatcgcatcctaatagatcaggtagtgacacccagcagggcctgtctgtgcagattcttcttggcctccctgtgcagccttccttccttcagggtatggggcacgatcctcatgaagcctcttgaatgaggatcatatggccacaatcagaatcctgccttgggcaggtgaaagaagggcacgtggaggtcagatagagagattctgttttctgaggtcgaaagtgctctgatattttaacaaaagactgtagcaagaggccgcgcatggtggctcattcctgtaatcccaggacgttgggaggccgaggtgggcagatcgcctgaggtcgggagttcgagaccagcctgaccaacgtggtgaaatccataatccagaataatccagttttcaaataaatattgtagcaccatagtatacggaaaacaagtctttatttttatattaaaggttagttttgcttcatcttagatttagagtcaaacttctttggtttgctattaggaatagtcacttccattctggtttcactcaactcttatctcacacacatacacacacacacacacacattagagagtcagtcagtgtgtctgatgggtgtgtctttgagaacattagctgaaaggtctttgcgtggccttttgtggtcaactatttgctgaatcacacacttcccagcacatcaccctggcattttatcataatcagcctaggaacccagtcataagcccacatgtaagctgcttggcaaatgcaacttgcttctggaattacattaactgggtctcctctttctaccctgccccaagcctgccttgcccttgtttcaaaagaattgagggtttaaagtaaaatctcttttctaaatgccctggcttatccctggttatttgaagaaatttctctctctcttttttttttttttttgtttttttgagatggagtctcgcattgtcgcccaggctggagtacagcggcacgatctcggctcactacaacctccgcttcccgggttcaagcaattctcctgcctcagcctcccaagtagctgggattataggcgctcgccaccacgcccagctagttttttatatttttagcagagacggtgtttcacattgttggccaggctggtctcaaactcctgaccttatgatccacccacctcggcctcccaaagtgctggaattacaggcatgagccaccgtgcccagcacgaaatttctctctctttatgaacatagcctcacttaagtaaaagcacttgacatcacaatttagccagagctttctaacaagtaagcatatgtcaaagcctgaaactgttgatactttctccttaaagctcatgcacagtgtaaagagagcagctgcttctgaaaagggaatcaagatatcaaaatgcagttcttctgacagattaaaaaccgcggagatgagtttcgtacactgtggaaaactgattttgaggtcagggagggcattctctctgaactctgagaggcttcctaaaggcctaaaagaagtcactaggctgggcgcggcggctcatgcctgtaatcccagcactttgggaggccaaggtgagcagatcacctgaagtcaagagttagagactgtggaaaattagccgggcgtggtggcacatgcctgtagtcccagctacttaggaggctgaggcaggagaatcgcttgaacctgggtggcagaggttgcagtgagctgagatcgcaccactgcactccagcctgggcaacagagtgagactctgtctcaaggaaaaaaaaaaagtaactagacttttagaggcagcagagggaggtgtgcatggggtaaggagaagagattttttttttttaatgttctttttcacccacattctctgaggaatgtgatgtcccatctgtcactttacaggggtggagacttttggcctcagcctgtgtgaagagactggcaggaatactcacgctagggaaaaggcagcagctaggcgtgcagtggttgatggggtttgtattaaggaaacataaatttcattaacacttcagtgttgccactgacattgatggtaacacttggtaggaaaaggaagaagactgtctcaaaatgtgtttttcatggattctccctagagtcagaagtatctcttactctcctttactgtagcgttgctcactgctttttctggggcattctggccagcatccatggaactgggaatggtttatgggacttatgcagtttgcatgcattgatttttgcatctcggctgggtgtagtgggaaagagcttaatctatttcatgaagccacatgcagatgtctgcaccccccatggctgcaggctttgctttcagccttctttcaaggaaagcctggggctttctggtttctcatttatatttgtgtctgcagggtgcaacaccggaggatttcagcaacctcccacctgaacaaagaaggaaaaagctgcagcagaaagtcgatgagttaaataaagaaattcagaaggagatggatcaaaggtatagtgcatcaatatgacttattaagaaattcaaggccaggcgcagtggctcacaacctgtaatcccagcactttgggaggctgcggtgggtggatcacctgaggtcaagagatcaagaccatcctggcctacatggtgaaaccccgtctctactaaaaatataaaaactagccaggtgcagtggcacacgtctgtagtcccagttactcaggaggctgaggcagcagaattgcttgaactcaggaggcagaggttgcagtgagccaagatcatgccacttcactccagcctgggcaacagagcaagcctctgtctcaaaaaaataaaaaataataataattaaaaataaaataaaaattaaaagaaaagaaattcaagttcaggctgggcatggtggttcacacctgtaatcccagcactttgggaggctgaggcaggaagatcgcttgagtccgggagttcaagaccagcccaggcaacatagcaaaaaccctaaaaaaaaaaaaaagaaaaaaactagccaggcatgatggtgtgcacctgtagtcccagctatttgggaggctgaagtggaaggatcacctgagcccaggaggtcctggctgcagtgagctatgatcatgccactgcactccagcctgggcaacagagtgagaccctatctcaaaaaaaaaaaaaaaaagagagagagaccagccttggcaacatagtgagaccccatctctacaaaaataaacaaaagtagctgggtgtgatggcacacctgtagtcccagctacttgggaggctgaggtggggagaattgctttagcctgggaggtggaggctgcagtgagctgtttgcttaagaatcaaaacccagctgggcacagtggctcacacctgtaatcccagcactttgggaggccgaggcgggcagatcacaaggtcaggagatcgagaccatcctggctaacacggtgaaaccctgtctctactaaaattacaaaaaattagctcgcatggtggcgggcgcctatagtcccagctacttgggaggctgagacaggagaatggcatgaacccgggaggcggagcttgcagtgagccgagattgcgccactgcactccagcctgggtgatggagcgagactctgtctcaaaacaaaacaaaaaaatcaaaacccatttgccataaagcagagatgccatagaggaggagggcctctgtgaggggaaggtgcattcattaaaacagctgtaggaaaagccagtcaaataacacacacacacacacacacacacacacacacacacacacacacaccctcactcctagcaagagctaaggatctgtctcaagaggtataccactgcattccaccttgggcaacagagcaagaccccgtctccaagaaaaaagcacaaagtaggatgatagatgttaaataccaagcactccagataccctggggtcaaatctggctctatcagttactactgctgatgtgtcagtgtgcataacatgcttggaaccgtgcctggcacataagtgtctgcgaaataaaatgaatcaatatgttaaaggtaaacaaactacgtgtttcaattaaaagatattctcagaatggaccaaaaaattaaaaacccaatacacaaagcaatgtatgctatctacaaaagacacatctaacttataagctctagaaatgtagaagtaaaaaaatgggagagaagatataccatgcaagggccaatcaaaaggaaactggtgttacaaggctggcttttgggctgaataaaaggaaagaaaaaaaaaaaacgtgcttgggccaggcgcagtggctcacgcctgtaatcccagcactttgggaggcggaggcgggcggatcacgaggtcaggagattgagaccatcctggccaacatggtgaaaccccatctctactaaaaatacaaaaattagctgggagtggtggtgtgtgcctgtaatcccagctactagggaggctgaggcaggagaatcccttcaaccagggagtcagaggttgcagtgagccaagactgtgctgctgcactccagcctggcaacagagcgagactctgtctcaaaaaaaaaaagtgctcaaagttagtatagaagacttaaattatacatttagtaacattgacctaatacataaacatctaacaactgcagggcacacactgtattagcccattctcatgctgctaataaagacatatttgaggctgagtaatttataaagaaaaagaggtttcatggactcatagttccacatggatagggaggcctcacaatcatggcggaaggcaaaggaggagcaaaggcatgtcttacatggtggcattcggcagagcttgtgcaagggaactgccctttataaaaccattggagctcataagactcactattacgagagcagcctgggaaaaaccgcccccatgattcaattacttcccactgggtccctcccatgacacatggggatatgggagctacaattcaagatgagatttgggccagggcacagctaaaccatatcaacactcttttcaagcccacataagaacattttcaaaattgagtatatctttgtttcacaaagcaaatctcaataaatatcaaaggaaatgtatcattcaagctatattatctatattctgcaattaagctggataccaataacaaatattaagaaattggccaggcgcggtggctcatgcctgtaatcccagcactttgggaggctgaggcaggcagatcacctgaggtcgggagttcaacaccagcctgaccaacatgaagaaaccccatctctactaaaaatacaaaattagccaggcgtggtggcgcatgtctgtaatcccagctactcgggaggatgaggcaggagagtcgcttgaacccaggaggcagaggttgcagtgagctgagatcgcgccattacattccagcctaggcaacaagagcaaaactcagtctcaaaaaaaaacaaaaaaaaaaagaaatatgcctctaaataagccacaaactaaacaaaaaatcatagtagatattagaaagtatatgaaatagaattgaactttaacatacattctatatatagtttgtgggatgtccttaaagccacgcatatagagagatttattgctctgaatgcatattaaaaacagaggtaaaaatcactgagccttagctcacttagatcctcacttacgatctatctcaagaagtcggaaaaagaacagcaaattaagcccaaaggaaatagaagcggctgggcatggtggctcatgcctggaatcccagcactttggagactgaggtgggtggatcatctgaggtcaggagttcaagaccagcttggccaacatggcaaaaccctgtctctactaaaaatacaaaaattagctgggcatgatggggcgcctgtagtcccagctactcaggaggctgaggcaggagagtcgcttgaacccgggaggcagagggtgcagtgagccaagatcataccactgcattccagcctaggcgacagagtaagaccctatctcaaaaataattaacaaaatatatatatatatatatacacacacacacacacacacaattcaacagatccaaaagttcttccttaaaaagatcaataaagttgataaacatgtggaaagattgattaggaaagactgggaggagagaagctaaagataatggatatagacaactctgttgagggcttttgctgagaaatagggaggtagtgggaggtgtgggccatgaagtcaagagacgagacgggtttcggaaaggacatcataagggtggacaacattacacttggcttgtcatgtttgttatttgttaaataaataaatgtttatttaaacatttttaagaacatttaacattatttaaaaatgtttaaaaattatttataaacatgatttttaaatgtttatttaaatatgtatttatttaacaaatattcattgagcatctactatgtgccaaggatggcttcgacacttgggatccatcaagttaacaatgtaacttgagctcatagagcttcctccaagagcttccattgtaacaggaggagacagacagtgaacaataagcataataataatgaatgatgcatgctgtgggaaagaaggcaggaaggaaataaggaagataggaaggaaggaagagaggaaagaaacaagataaagcggctggaagtccaagtgggtctcagcctcttaggtggagggtggtgaggacttgtagaagctctcttcctgttatttctatatttttagttaaactatttctcatgactcagaatgtatcttttggtttgtcttttggccttctattgtattgtatggcctgctttggattttcttttgctgacactcatcaaagttggcccttaaccctggcagtcatttgctctaaatttttaatgactcgaagcctaccaaaagtgccctgcaacaagggtaaaattagtagagctctttggtcttcaacccaaacatgccccaaacttctctagggatgcctgcccgggctaccatgggctgcttccagacatgatttcaggaaggatgtgggatccacagtgtgtagctttaaggctctgtcacttacctgtcgtggataccaactatggattcagtttcttaacagtggaaatgggtgtgtgttaacatttccaaagcaattgactgtgcttcttcgtcaggtgagcacatgcagcccgtgagacccaggatgccagctgtagctttggtttgcatgaagaatgcacacgtggaaatatttgggggtttttgtttgtttgttttgttttgtttgagatggagtcttgctctgtcgcccaggctggagtgcagtggcgtgatctcggctcactgcaacctccacctcctgggttcaagtgattctcctgcctaagcctcccaagtagctgggattaaggggacatgccatcacgcctggctaatttttgtaattttagtagagacggggtttcaccatgttggaaatacttgggttttgaagccagattcggtggctcatgcctgtaatcccagcactttgggaggccgaggcaggtggattgcttgaggccaggagttcaagaccagcctgggcaacatggcaaaacgcagtctctaccaaaaatacaaaaattagccagtctcataacctggtctcaaaaataaattaattaattaaaaatttttaaagtattggcttttatttatttatttattttatctgtgtggcaaagggaagggcaggattaatttatgcttctcagttattggggacaataaggagataaccattagagaagagaactgaaattgaaaaatcagcttctttatttatagccattggtagcagaattcctatagagaatttccagaatggaagctggcccaatagtcccttatccatactctaatcttcccacgtttccattcatatggctttcaaagtggtagaatattggctgataagagtaacctttgccgggtggtgcggtagctcacgcctataatcccagcactttaggaggctgaggcaggcagatcacctaaggtcaggagttcaagaccagcctggccaacgtggcaaaaccccatctctactaaaaatacaaaaattaggtgggtgtggtggcatgcacctgtaatcccagctattctggaggctgaggcagcagaattgcttgaaccctggaggtgaaggttgcagtgagccaagatcgttgcagtgagccgagatcgcaccattgcactccagcctgggtgacaagagtgaaactgtctaaaaaaaaaatggagtaacctttacagcattctactcgttctttctttcagagatgccataacaaaaatgaaagatgtctacctaaagaatcctcagatgggagacccagccagtttggatcacaaattagcagaagtcagccaaaatatagagaaactgcgagtagagacccagaaatttgaggtatgaaacttctgttgtggaaagctttgttggaaacgaagaacaggtgttcctcggtgtagaatggtgtggggccctgacgatcctctcactgggaggtacacagtgggaatggcaggctgtttcaggagttatggtcaaaggaaaaatacactcttcgccgttgaacattctcctactcatcatagcctatcttaatcgtggctgtaaaacctgacaatgtttaatgttgtatctgtatacggtgcggggttggcggggttgttttttaattttagagacaggattttgctttgttgcccaggctggagtacagtggcatgcttgtagctcactgcagccttgatctccttggctcagcctttgaggagctgggattacaggcacatgccaccatacctggctaacttttatttttcaattttttatttgttttagagttgaggtcttgctctgttgcacagactggtcttgaactcctggccttaagccatcctcccaccttggcctcccagagtgctgggattacagctgtgagccactgtgagccactgtgcctggccagtattttttgtactttaagttattctgcttcatctcatggtaataaaattgggagtatagagcgatccgttatcccagtgaatcaaagaagcaatgaaaaaaatcccctgaaatatacaattgttctctcagcaggcccattatggaaagggtgtgtgtgagaaccagcagcaaacacaaaggagaaacaagcaggaaacataaataatcaaagcttgagggagggagaggagcactcaaaagctgtcaacaaaagcctcctgaacccactctccctaccacgtttaaagactacagagcatggaaaaatacattagcaaccgattctaccagtcagaatagattgtttccagcaatgaagggtcaactatggcttttttcattcttttttttgagatgaagtctcgccctgttgcccaggctggagtgtagtagcgtgatctcacctcagtgtgacctccacttcccaggttcaagtgattctcctgcctcagcctcctgagtagctgggactacaggtgtgtaccaccacacccggctactttttgtatttttggtagagacagggttttgccatgttggccaggctggtctcgaactcctgacctcagatgctccacccaccttggcttcccaaagtgctgggattacaggcgtgagccaccacacctggccagctttttccattcttttcagaatccatcattaatgttcatttgagcatttagaacttagaacggtccttttcttattattattcttttttttgagacagagtctcgctctgtcacccaagctggagtgcagtggtgcagtctcgactcactgtaacctccacctcctgagttccagtgattctcgtgcctcagcctcccgagtagctgggactacaggcatgtgccaccatgcccagctaatttttgtatttttaatggagatggagtttcaccatgttggccaggctggtctcgaactcctgacctcaggtgatctgcccacctctcccaaagtgctgggattacaggcgctcaccaccacccccagctaatttttgtactcttagtagagacagcgtttcaccatgttggccaggctggtctgaaactcccaacctgaagtgattcacccacctcggcctcccaaagtgctgggattacaggtgtggccaccgcgcccggccttctcgtcatttttattcctttgacttgtttatactgtttcaaatgctgaaggtcattttatctactttaatttttaagtacaagtttcatttctatcaaaaaaaaaagttacactcctaaaaaataggaagtgtggctttcaaactgagtcactgctttaagcatggctgtaccttcaggtatcacagggcgacctcatggtcaagaaggaactagaagtgacttatccaagactgcactgctgcttaaaagcccaaggggatagcatagtccagtgtgctttctgccccatcgtgggcaaccacataaatatgagtttgtttctatgtctccaacttcgggtgaaatggaagcaaccgtccttcagtacatttgaacagtcgaaggcagaaaacgtggccattctgcccccacgtggacttcctcacattgggttaaatggccaagagtagcccctgagtttgggaccttaggatgctccgggctggccctcagatggcctttgggaccttaggacactctgggctgaccctcagatggccttaggttggagtctctcattgcttttgtctccaggcctggctggctgaggttgaaggccggctcccagcacgcagcgagcaggcgcgccggcagagcggactgtacgacagccagaacccacccacagtcaacaactgcgcccaggaccgtgagaggtacagtatctgcacagcgcctgcctctggcaagggagcctgttggctttgtatttatttctaaattttggaatctggaatgaccataaggcacttgttcaatgccaaaatgtctgttgcgattgacctgtcactttttccatgatgcagatttataattccacatgggatgggtgatctgagcgtgcgatgatttaccatggcctcagttacagcactcgctgaggggcggggttgcaagtgctctccagtcgcagggactcaatctgagtcctccctggggtcagtcgctttagttgctttgtgttttcctttcttgagcagcccagatggcagttacacagaggagcagagtcaggagagtgagatgaaggtgctggccacggattttgacgacgagtttgatgatgaggagcccctccctgccatagggacgtgcaaagctctctacacatttgaaggtgacatttcatgtctgctggattcccctgccttttataaaccataatatctgagttactcttctttcacttttccttccttccttccttctgatcatttttattcctttgtccttccttccttccttcctaccttcccttccccttccccttccccttccccttccttccttcccttcccttccctcccttcccttccttcccttccttcccttccttccttccttcctttttttcatacagggtctcgctctcttgcccaagttagagtgcagtggtgcaatcatggctcactgcagccttgacctcctgggctcaagtgatcctccaacctcagcctcctgagtagctgggactacaggcaagcaccaccatgtccggctcatttttgtacttttgtactttttgtacttttcagtagagacagggtctcactatgttgcccaggctggtgttgaactcctggattcaagcagtactcctgcctcagcctcccaaagtgctgtgatcacaggtgtgagccactgtgcctagccacactcttctctttctgtgaccagaactttctttagaagccttccagatctggccgggcatggtggctcacacctgtaatcctagaactttgggaggctgaggcgggcaggtcacttgaggccaggagttcaagaccagcctcgccaacatggtgaaatcccatctctactaaaaatacaaaaactggctgggcatgctggcaggcgcctgtaatcccagctgctcgggaggctgaggcacgagaatcacttgaacccgggaggcggaggttgcagtgagctgagatagcgccactgtactccagcctgggtgacagaacgagactctgtctcaaaaaaaaaaaaaaagctgcagcagcagccttccagatccttctctactatgcttttatcctactcatggtatgattattatttggttgtatattttgacttttggttcgtataacttaacagcttccagagagcttgcttcactgcagcagacgatagggaggatgatcatttcatccattcatttaatatctagtatctatagcgctcctgtcttgtaaaggcccatgaagtggggggatgcaggtcgtatgatatggcacctgcccagagggaaatcaggcagacacacttaaggagcaagcagcggctgggtgcagtggctcacgcctgtaatcccagcactttgggaggccgaggcaggcggatcgtgaggtcaggagatcgagaccatcctggccaacatggtgaaaccccatctctactaaaaatacaaaaatcagctaagcgtggtagcgcatgcctgtaattccagctacttgggaggctgaagcaggagactcacttaaaccaggagtcggaggtggcagtgagccgaggtcgtgccactttactccagcctggcaacagagcaagactccctctcaaaaaaaaaaagcaggcagtttgcagtgtttgccagaagagggatacagaggaacggggaggacaggggagaatgaggtcgcttccttaaggaagtttggagaacttgccatggcatggggggtgtggccagaaatgggtgtggtgtggctggagcttagatgtcttaagtcctaatagtgaaatgtggcactaaagagtgggaagtgccaatgggggcgaggtagggaaacatctgggttttatgtggcaaacattgaggagctatgggaggtcccctagcagggtgtcgatgcagtcagagctgtaccttaggaaagtcatcgtcagatgtgtaggatccactggaagacatggaggatggttagaaagactagcccaggccgggcatggtggctcacgcctgtaatcctagaactttgggaggctgaggcaggcagatcacctgaggtcaggagttctagaccagcctgcccaacatgatgaaaccccgtctctactaaaaatacaaaaatcagtgaggcgtggtggcgggcgcctgtaatcccagctactcgggaggctgaagcatgagaattgcttgaacccaggaggcagaggttgcagtgagccaagatcgtgccattgtactccagtatgggcaacagagggcaactctgtctcaaaaaaaagaaagaaaagataaactagcttagtgtttctaaaccaatgaaccttgaaacgatgtcctgcagagcgttaataaggaggccatgaaagaagctctcaggccaggctcagtggctcacacctgtaatcccagcactttgggaggctgaggccaagagttcagggctacagtgagctatgatcgtaccactgcactccagcctaggcgatagtgtgaaaccctctctaaaaaataaataaataaataaataaaattacgaaaaagttgcattttaatataatgaataaatttttaaaactagcaatcagagctcaagtaagtttgggaagccctgggataaataaattttacagatttctttactacaggacttttcagagcctttaatagactaaatgttcattgtgacaaaataagaaagacgtaccagtttaaacgttcccagttttacttcatattccaaccatcccccaccgtaccctgttgccctgttaacagctccctaaactctttgccttgcagaaaactggggggtggtgggcagcctttgaaatgatcctagcagaaggtcttgggggccttgttcaaggaatggatacagagatgccgccattgacaaactgcatatattcggggctgatcaaaagccaggaacaaaaaggagaggaaatccaagacggctcccagagttgcattcctgggaggacagagaggtctagggaagtggaaaagcaggaggatatagttaggaggaagaacagtgaatccaggttcatctatgttgtttcaggtgttggggccatgtctaggtggcagtgtgctgcagacagtgggaaaagtggaatcttggctgcagaaagtaccagaatggaagcaatatgtgaggacagtgtttaaagaggagcagttgggccgggcgtggtggctcacgcctgtaatcccagcgctttgggaggccgaggcgggtggatcacctgaggtcaggagttcaagaccagcctgaccaacatggtgaaacctcgtctctactaaaaatacaaaattagccgggcgtggtggcacatgcctgtaatctcagctactcgggaggccgaggcaggagaatcacttgaacccgggacaagtggcatcacactccagcctgggcaacagagcaagactctgtctcaaaacaaacaaacaacaacaacaaaaaaattgggaggctgaggctggtggatcacctaaggtcaggagtcagaccagcctgaccaacatggtgaaaccccatctctactaaaaatagaaaggttagccgggtgtggtggtgcacacctatagtctcagctgctcgggaggctgagacaggagaatcgcttgaaccggggaggtggaggttgcagtgagttgagattgcaccacagcactctggcctgggcaacaagagcaagactccatcccccacaacccccccaaaaaataacagacaaaagagaagcagttggagccacgagggtacctttctcctgagagagatccaagtgagacagaagaagactagagaagagaaccaaagatttatccagtgagaaatacttaccattctgggagggaggagaaagagggccctggaggacttagagagggtccctagagagacagaggtaagaacctggacatttctgtgcagaaggagatggttttgaggcagtgggtgaggggtccgtgcatctgagaaggtccgagtggggtgaattttgtgtggacttcatcttcgacgacacttgtttcattgcgaaggccactgtttgcttcctccctgcatttgccaagacatctaacatatcctgatattgctttttcaggtcagaatgaaggaacgatttccgtagttgaaggagaaacattgtatgtcatagaggaagacaaaggcgatggctggacccgcattcggagaaatgaagatgaagagggttatgtccccacttcatatgtcgaagtctgtttggacaaaaatgccaaaggtgctaagacttatatttaataccataaaaaaaaaaaacttaaaaaaaatggagttgtttctccccacaaccatgactgttacaggcagttcctcaagagactggctggcaagcaccataatgcacgttctcctgtagtctcacgtggacttcagggtctgggcacctgaattgccttgtctagtttgggctgtaatcaagtttcacttgctgatgaaattttatgtggaaagctgccaaccgccaacttacagctatgtcattcaaaatctgataaacatttcttcttttggcggtatctgtagattaaaaaaaaagttgcattgtagcttctcatctttctgaatttaaaagccggcacgcatcatgcaggtgccaaagacttccctactcttgtttatatctagtatccaccatacactgagctacattaggtggttacagattgtaacttaataaactgaactgtgttagtttgttaaattgtatactcattcacttgggaggaagtcacaagtgaaataacatctccttcttgactaaagcagtaaataagattcttatattggcaccaaaagtgtgtgtttttacttaaacctggtcagcatccttggtagggcatcacgagtaccctgttccatctacatgatcccagacaaccagctgaaatctggaaaagtttggtgaattgaccacttgatttttacattgcattgctgattttccaagtgtcatcaaattgacaggtttttgttgttgtgtttgtgtttttgttgttgttgttgttttgagacagagtctggctctgttgcccaggctggagtacagtggctcactgcaacctccgcctcccccaggttcaagcgattctcctgcctcagcctcccgagtagctgggattacaggtgtgcaccaccacgcctggctaatttttgtatttttagtagagacgggttcgctctgttggccaggctggtctcaaactcctgacctcaagtgatctgcctgcttctgcctcccaaagtgctgggattataggcgtgagccaccgcacctggcccaaattgacagttgatcagatgtgctagtgctgtttagatggagttacttaaaaggcagagcgtgtccctgcatcagctccttttggctgtgatttcctctcacacttggttcggtttctgttggttttccaagtagagctgcactcacgcttgcccaggtggggctataaagagaacgtggtgtggcagcaaatgcttctccccacagacacagatctcagcacattgctgttcaaagactttgggggtttgcttttgtttttttgttgttgttgtttttgttttgttttgtttctgcttttaatcattggcaaggtttggatttactggaaattattttagaatttctggctcattttatacaattaactgtagccagaatgaagtaaaatgtctcaccacatcgaaaggaatctaggccacatgagaatttgcatttttaaattggcattgatgtgggaggggagatagtgaagttggtcacatgcgtagatggttgccaggcatttcactgtgcccatttccagaatccaccccgagatcatagacaacccactacaaatgggtcagaatgaaggtgttgggtcagattctctttttatttgattttgaaaattatttccttgtgtccttcctactttcaagtaggaaattagcccctgcctgcctctacattgtgggttcatttgatcagctcaagtccatttaaagctgattttccaagcagtagctgcacattcgggctctagaacctagtaggggttctggatgctaggggccgtgtttcaagattctcacagccagttaacctttatttagtgacagcctgattttttaaaaaactttttttttttttttttttgagatggagtctcgctctgtcgccaggatggagtgcggtggcacaatcttggctcactgcaacctctgcctcctgagttcaagcgattctcctgcttcagcctcccaagtagctgggactacaggcgtgtgccaccatgcccagctaattttttgtatttttagtagagacagggtttcaccgtgttagccagaatggtcttgatctcctgacctcatgatctgtccacctcagcctcccaaagtgttgggattacaggcatgagcccgtgcctggctttttttttttttttttttttttttgagacagagtctcactctgtcacctagactcaagggcaatgatacaatcctggctcactacaacctctgcctcccgagttcaagtaattcttgtgcctcagcctccccagtagctgggattacaggtgcctgccaccacacccggctaatctttgtatttttttttttttttagtaaagacaggttttcaccatgttggccaggcttgtctcaaactcttgggctcaagtgatccgcccgcctcagcctcccaaagtgctgggattacagggtgagccaccgtgccaggcccaaatttcttttggatacttttgctggcatagtatcaataaagccacccatcccgaccccaggcctctttgtagatattgcagcaagaaaatcagctgacccttcaaccacaaggatctgtttaaatgagcagtaggaagtttccagctttacccagtaaacaagtgaatgggaaacctaaggtattaaaatctgacctttctatccgatgacaaactcatttccagtctgtgaactcctggacaaagcaaactaaccactgaaaaactcgaaaatagggcaagacgacattaaccttgtgaaagtctgctttgaaaaaaggcattctgtcaagctgtgtatttttttcttgattattcaaatttatttcgttattcaaatttaattcagaaaatagctcagttggtttcagggggaatggggtgggaggggtttgggcacataaatttatgatgataattttaaatgtacgatcattaagttgtatgcctcagtactataacaggtgaatctctgtaatattgactaaacagttaaaagatattttgtaaatttcaggtccatcgcatcaatgcatgaaatattagaaaaccaaattccaaagaatcaggaatttccatttccacccaaagtatactttattatcttctagcagttgtctgttaatataaaagcagcaaaatctcagctacttatataattttctccttttatttgaaagttacacttagagattaataatatgtacagagaagcttttcctgcctactctgtttataactctgtccaacttgcccacaaacactgccctccttcaacccatctgatgtgggcaaagccactgttttcttaggcccataactcagtgcagctgttttatttttataatgccggtcaacctttttgtgtgtgtgtgtgtgtgtgtgtgtgtgtgtgtgtgtgtgtgtgtgtgtgtctacgatgtgcttatttaataattgccaaaatatttagactagagtaacttccggtgggtcaattggattgtgactttcttttgtggttttttggttcttcgattgctctctgttaaatattttcataattccccccacagaatacgtgtgtatatactgcaacttaaaaactaaaagcagtactcgaatgagttgttttaatgttgtacttttatctgtttgttttatgggttctcctgctgcctaatgacctttctgtttttataactgccggaaagccgcgaagcctctcgcatggggagctaggtccccgctgcggctccgcacttgagtttattataaactctggggttctgagtaagttttgtttgaatacagcaacatgattgtctctttctattcttatcctaaaagactctgtctggcatcttttagttgtaccctcgtatctgcttctctaataaatgttatattttttctcagtattgtgtattttaagtgacttttcatgtttccaagaaaattattctgtgtaatatgaatatttaactctttcatctccagtaataggggattttctagcccaatgcttttttaaaaattctgcctcccacccctacctcctcctttaaatgatggcacctcccctgtttctgatcttgcgtgcactcagggcctgagaagtctgtgtttcttttgtttcttttctctctccttgagatgaagagcttttcacggtttattgcggaatgaatacagaacaacaggttttccttttcaccaaagattttacattgtactgctgaagagccaagagtttccttctgagagaattggaccttcatgttccttgtaccattctaggaaattgatgcatttcttttcttttcttttttttctggagttgaattctcactctgttgcccaagctgaagtgcagtggtgtgatcctggctcgctgcagcctcgacctccctgggctcaagccatccttccaactcatcttcccgaatagccgggactacaggcgcatgccaacatgctggttaatttttttttaattttttgtagagatgaggtctggctatgttgtggcccaggctggtcttgaactcctgagctcatgcatcctccctcttcagcctctcaaagtgctgggattacaggtatgagccactgcacccaacctccgtttccttttttttttttttaagacggagtcttgctctgttgtccaggctggagtgcagtggcccgatctcagctcactgcaacctccgcctcctgggttgaagcgattcttctgcctcagcctcccaagtagctgggattacaggcacctgccaccacgccaggctaattgttgtatttttaatagagatgggttttcaccatgttagccaggctggtcttgaactcctgacctcgtgatctgcctgcctcaggctcccaaagtgctgggattacaggcatgagccacggcgcccagccccggcctccgtttcttactttctctcaaaactaaacttatgagaaagacgagttggggcggatggcctcatcagtctcctgtttgggcttctcttaactctgaaggaaagaccagctaaaggctagagagaaaaccgtgaaagttcctcatctcagacccgccctgtggtaaccgattgctctaagacgccccctcccatccctcccctcccactaccctcccctcccagggcggtgcagtttgtagccaagagcaaaatgcccgcctggaacccgcgccttcctctctaacagagagtttctctttctgtttctctttgtgttgtagattcctagaggggagtgcctgcgagcctcgggtgagccttcctggaggagcctccgtctgcttgttcccacaggcctccagcgccctgccctgtggacagcccacccctccgcagccccatccctgcggggcggtctctctctctctccagcatgctccctgcggccctgccctcccgcccagcccgggccacctcgtgggggacaagtctcgccagcgcccacccccatggctcgggtcagtcctcatcgctccccctccccaccccgcgcaggccactgagacggtgggacacacgcccctacctgctccttcctgggccctcagtccacccgggctcgtcctggcagcccttccgcgcttcacacagtgccttttgtgaaagtgtcatcacgggtcccctgaggagacaaggcaggtccagcgcacatcaggcggactgagcactcgatgtcatccgtgtcgatgtcatccgtgtgtcccagactgtctgctgtagaaaacacttcctcctctcctgagtctgtgaagtcctcagtggtcctttttggattctaggcttgcacctcatactaaacattgaccctttcactatgccctcaacctgggagcatctggcaggcaggggggcaggtacacacacacccacaggcacacccaccagtacacacgcgtgcgcatacacacattttggtttgacgccctgttttcagtggcctggggaggtccacactggaagtcgaattccagctcgccttgttgactcgcctgtgtccaccggccatgaggagcccacgcctgtcctccccatcactttcctgtccctgagaactgtagatcatgcgcttgtgagcgaggccctcccctctgcaccagctcattgcaaagcgaacatcctctcctttccaggagccccaggattagcatctgaaaagggtagcacttccttttttgttgttgttttttttttttttttgagacgggagtctcgctctattgttcagactggagtgcagtggcatgatctcggctcactacaacctccacctcctgggttccagcgattctcctgcctcagcctcccaaatagctgtgattacaggcgtgcaccaccacgcccggctaatgtttgtatttttagtagagacagggtttcaccgtgttggtcaggctggtctcaaactcctgacctcaggtgatccgcccgcctcagcctcccaaagtgctgagattacaggtgtgagctaccgcaccccgccgaggttagcactttcatcaccaaagaccccgtgcctctcgtggtcctttgagggatcccgccgccaccacccttgtattttatcacgtgctcttcagggcatgtggaattcgttgagtttgcttttagagccaagtttctttccctgtgtgggtttttgaggaaaacctgaggtcccctaatctgtggccaccaccccccccccccgccacgccttagagcagagcagcccctcctctcatttggtgcagaaacagtcaagaggaaccattggcctagagctcctgtgaccgagagcgccacggaagcctggggatgacgtcgggcagctttattctttgcttggctttggtaactaggtggtcccctcaagcatcctcagttcctcttgctgtttatgaatctaagacaaggaagtcctatagaagccaaagggacagggacggaaaggacaggtcccaagggatggggctgtctttacttgtggaaaccaggaaattgctcctctcagccaaccaaggttgaccacacaccacccttccggagcagctcagtcagccctcggggacgagaaaccacaagcgcagagacgctgaggcccaggcaggtgaagaggaagtggctttgggtttttaaagtaggtgagcgtgagcctctctgactgcttcttccccgggggggactgcaaaccgctcagggttgcggcagagccatggacttccggtccctgcaacgggtgacctaagcgtggtgcacccatcagtcacgcaggaggactgacttgacagacgaaagacaagcccggatgacacagggtgagaagagtcagggccgcacctctgtccctgcaaaccaacaggtgcatggtgagtgtggcagtccccacagctccacaatgggctcccccgccaacggggacgacagggatcttcaggaacttctgacctcaccaagtcaagtggaccactctccactccacgaggatgtgaaacggttctttaaaatgggattttagagcctcgggaatgcatgtgcgtcacatctttcatattatgggtcaggatagattcatttcttgcaacatagtggaaaagatataagctgcagtaatttgctctttgaatgaccgtcacccccagtataggatatgcttgtatccccccgtcactcctccgcctgttttttaaacttttccaccacctgcgtccaaaaagaatgttatagcgagtgctcttaaatgttgaacctgggtgttgcttccgggccagtctgcgtggctccatgaaaagctcactgctgccccagccgggcttcttagaggaggtcagttgtcctatgtatcatcatttactctgggaatcctactgtgaaatcatgtctgtatttttctggagcagttcacatagagtagaatgtggaatttcccgtgaacgtctccttcctcccccgtatctgccgcctgtcacttcgccaccgtgctagaatactgttgtgttgtaagatgactaattttaaaagaacctgccctgaaaagttcttagaaacgcagtgaaagggaggaacttgtcctttacccagtttttcctttgtaggatgggaaagtataaaaaggcacagaaggttgtcatgggctgttccttgggggtttttatcctgctcaccgtggagataagcctgcggcttgtctaaccagcgcagcgcaaaggtctcgatgccttttggtaacatccgtcattgcagaagaaagtttacacgacgtcaaaaagtgacgttcatgctaagtgtttttccagaaatattggtttcatgtttcttattggctctgcctcctgtgcttatatcatccaaaaactttttaaaaaggtccagaattctattttaacctgatgttgagcacctttaaaatgttcgtatgtgtgttgcactaattctaaactttggaggcattttgctgtgtgaggccgatcgccactgtaaaggtcctagagttgcctgtttgtctctggagatggaattaaaccaaataaagagcttccactggaggcttgtattgaccttgtaactatatgttaatctcgtgttaaaataaaatataacttgtg

SEQ ID NO: 37675 - DNA, 44909 bp, Homo sapiens
gctgggctgacggatccgcgggccggcatctgaagcgagcgggacgcagcgcggccagggcctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgccagtcaggggccgcgagccggcggcggcgcggcggagcaggaggaactgcactacatccccatccgcgtcctgggccgcggcgccttcggggaagccacgctgtaccgccgcaccgaggtagcggccctcggcgccggccgccctgtctggcgctgtcgggtcgccccgagtccctccttctcggccccgctttcccagcgtcgtgagcttagtgctttaggcgcccacggggtatatgtcttagggtcttcaccactcttcccactcaccggcactagaaattggctagatcattggtttgactagtcatttttgattgtcctaagtcacctaaccgtctcttgagctttagtttccccatctgtaaaatgggcttactgataataccttgaaatcatctttttcttttttttttaagattatcttgagaatcaaacgaaggctctgttctgtaaattaaagtggtatacgaatgtgaggtattgccaaaacttccttcctctcatgctgtatatatagttctccaaggtcggggtgaggaggaggggcatagcttcaaaatccccacacccgtggcaactccgttatttttgtcattatctttaagttcagcagtgatcactcagttggaagcttttcttgaagctcattgggaagatctttgtgtgttggttctttatcagtgtttatcttgcagggtttatgcatgggaaatactttgttggtatattctaagccattagttcttaatttggggggcacaaggacccctttgataacctaagcaaagtaatcttgccccctccatcaacacatttgcacatatgcacatcctttggagagatccatggatcacggaatcccaagttaatatatactagtgtaaaaccctgcagtgattattctacttccaaaaactaacgatacactagatttgatcataaaatcttactttagggtaaacatttaatgagaacttgctggggttgctgaaggtgattcatccgtcggaaatccatctgcagttctggtgtgtgttccaagccagcatacttttaaggctgaaagatggagaaggagagaagtggttgcaagagaatatttttaagtgttcttttttatcctgatgccacgttaatgtatgatgttagagttagttattcttagtagtctgttttcttttttgcactcaaaatgagaaagaggagataaggattgttatttctatattttagttagagaaactaaaacagtatacttaagtgacttgctcacttaagttacaagtaaatcttggactagaactaaagtctcacatcttgcccattgcctttttattattatcctgttgaacttgattactgggttggttttgagttaaatttgattacacttcccaaaaattgcatagcgttgtccatatcaccaaatatttattagatctgtgaatttacaaaagttcagaagcactctttttctctagaagcttatatttcagtaggaaaataagttgaccattgttagtaaacaaatagcattaagttgcatatgtagagatatgaaaagaatgaacaaatatcatttcagtgtatggggtctaaaaattaaagacatggttacagtaaaagcttcatcagagtcttttcaaaaacactgtaaaggcttggcagaggcattcaaaaggatggggagggttacataggtggagatgctcctgggctaggaagcagggtcagcaaagaatgaggcgaggcacagtggctcatgcctataatcccaacacctgggaggccaaggtggtcgggtcgcttgaggccaggagttctagaccagcctgggcaacacagtgataccccatctcttaaaaaaaaaaaaaaaaaatttagctgagtgtggcagtgcgtgcctgtagtcccaactactggggaagctgaggtgggaggattgcttcagcccaggagttcaaagctgaaatgagctatgactgcactctagtttgggcaacagagtgagaccctatctcttaaaaaaaaaaaaaaaaaaagatagtagacatcaggagctacaggatacataaaagtatgagaggagattatagagttgcaaaaggggtcatgacttctcttatccagaaagggtaggtgaaaatcactagggaagtctaaatttataaaactagaggcaagtttagtattttcattttagaagctgggaccagctatagataattgctccccagttctctgcttctccagtattcttgccctgccataatcaccatcatgattagcagtctgtcatagtatcctcaatagaatctttttgagatctatccccagcccatatttttacctggaactgacatcatgcaaattaagtatgacaacaacgttttaatgctttacttcccctgtcctgcaataaattataatgctaaattgtacacataacctttaaagtctgttaaaaggaaaaaataagaggagtcagtctgtgcccctctaggaagttttccttctaggcttacagatctaggtgtggattcatttgctgccaggcaagaggaaaagcacgatacctctgttactgtgtttaggatgactcactggttgtgtggaaggaagtcgatttgacccggctgtctgagaaggaacgtcgtgatgccttgaatgagattgttattctggcactgctgcagcacgacaacattattgcctactacaatcacttcatggacaataccacgctgctgattgagctggaatattgtaatggtaagatagagttcagtgggacttttccagcaagactttcttagactcataattacgttgaggagaagaatataagaagagacatatacagtgataaaaactttaaatgaatttctagagtttaagagaaacttttcaggccttggagaatttttgaagtggtgtacgaaataaggagagggattttcccctgcatacccaaattttctcttgtgattacagttccattttcaaactatcttttctttggttggattttacctttatttttcaaggtttttctttatgaaatgacattagttaaccagagtgtggcttggcagcacttgatacagtatttaataagatcttataggtgatatttatttatattgtcttcagctaaagctatcctattgaaaagtggtccaaagatcataactgagtgaaagtaatatatagtaaagcatggccctatttatctggtccctgatttcttcacatcattttgcttgtaagatagcaatatagcctagttgttaagaaaatagactctaaaaccaagtttctctactttctagctctataaccttggcaagaaacttaacttctctgtgcctcagtttcctcattttatttttattattattattattttttttgagatggagttttactcttgttggagtaaaggctggagtgcaatggtgccatcttggctcaccacaacctccgcctcctgggttcaagcaattctcctgcctcagcctcccaagtagctgggattacaggcatgcgccaccacgcccagctaatttttgtatttttagtagagacagggttttgccacgttggccagactggtctcgaactcctgaccttaggtgatccgcccacctccgcctcccaaagtgctgggattacaggcttaagccaccatgcccagcagttttgtcattttaaaatgagtttgttggccagggacagtgcacacctgtaatcccagcgctttgagaagccaagacaagcagatcacttgagcataggagtttgaggaaagcctaggcaacatagtgaaaccctgtcactaccaaaaatacaaaaaattagctgggtggtgtgcacctgtagtcacagctacttgggaggctgaggagggaggatggcttgagactgggaggcagaggttgcagtgagcttgtgagctcagaccgctgcactccagcctgggcgatggagccagaccctgtctcaaaaaaaaaaaaaaaaaaaaaaaagctgggcgtggtggctcacgcctgtaatcccaacactttgggaggatcacaaggtcaggagatcgagaccatcctggccaacatggttaaacccagtctctactaaaaataacaaaaattagctgtgcatggtggcgcgtgcctgtaatcccagctactcgggaggctgaggcaggagaatcgcttgaaccagggagttggaggttgcagtgagtggagatcatgccactgcagcctggtgacagagcgagactccatctcaaaaaaaaaaagtttgttgataacagtacctactttctaggattgttgtattacatgcatagtgcttggtaggtagaaagtgtttgctacatactgtactagctgttaatcatcttattgcacaggagaacctccaaagcccttttctgaactgcatgctaaagaggtcccagcatattcgtcacttacgacttccttgtgtaaactcttgtatattatgatcattggtgatcaatgccatatacaagattctgttaaaaattttcgaagtagcagaagccctaggtagttaacttcttttgtggttaggaagaactggaacaaatgatacatttattgaaactgagttattaagttgcaggggaaaagaagttgtaaaaacttacccagggctaaagtgtaagttatagttgcaggtgggatgtaagatgaaccatgattacttgcagtctgtattacttggtaaaggaaagagagaagtaaattcacacttattccacaggaagaaattagtaaagagagtaatgataggaaacagtctaggggtagaccctaaattttgggaaatatttcggtgtgaagtagaaaatttgtcaatatataccctataaatacaaaacattgcatcacaggtgtaacccaatttttttctttttttcctgagatagactctcactgtcacccagcctggagtgcagtggtgcgatcccagctcactgcaacctccgcctcccaggctcaggcgatcctcccacgctcaggcgaccctcccaccttagcctcctgattagctgggaccacaggcacatgccccaacagctggctaactttttgtatttttggtagagacaagggttttgccgtgttgcccaggctggtcttaaattcccaaacccaaatgatttgcccacctcagcctcccaaagtgctgggattataggcgtgagccaatgtgcccagcctaatccagatgttatagtagtcacaactgggagagttgttacaaaaatattgtagagtccttaaaggagagttctagaaaagaaatctgattttgaatatacttcacttgttgggaacaacaagaatggtctttactcacatcttttctaaaaatgtcttttttttaattacgcctcttgtgttagagagggagatctttgaagaatatttctgatgcggtccttgagagatgggaagagttttgtgcccatgtgaaaagtcaaaagaagtagttgcctatggagagaaagcagaatccttcatttccttgtgtcacctaaaaaaacctgttacaggagccaagctttgatctgtattaagcaattcaaatctgtgtcttgtttaattgcaggagggaacctgtatgacaaaatccttcgtcagaaggacaagttgtttgaggaagaggtaattcatatttctgtggaaggaagttagaattgtagtgttgtaattcttgcattctagttctgtatttactcttccaatagtgaagagtgtttttttccttttgttcagactccttccaggctctgatattcatgagaaaggaaacctctaacaaggaagctgtctatagctgcttcctaaacgttttacctccacatcatgattctctgtgggctttctttcctggttctattactgcgtactggtatgcccagttttctataactttgcattcttcctgaattttcctacatgtctgctttaccatactatatattataatgacattggaactattttatgaggaacctgttttttgtggttttttaccccttcacttttctttgcctactcaacctgcaaggaagagatgtcaagtcatgttgaatcataacttctggttgcagttttctttgttttgtttgtttatgtgtgtgtgtatttacttaaatggagctttttgtttctaatccaaatatttattttttctctgcagatggtggtgtggtacctatttcagattgtttcagcagtgagctgcatccataaagctggaatccttcataggtaagaagtaaaaaaaattatggatggattcttccctaccaattcagcccctaccgtggatacccccccaacaacacttttattttcttggttaagcagccaagagtttttccattgatatcactaggaaaggaaagtaatgagcaatattattttcactccctgaggttaaaccatgtttatgatctaggaagagtctcctcagtagccaagtactactgaagtcattttacagacaaaaattttagagttcagtttgttaattcatcagtaaagcctagaagggcactatgagaagtagtatttggtaagaattcacagcaataataattggcaattctttttaattctataattaagatcttttaatttaaataaaagcctcttcactctgtatatttacttgtacaaatttaccagatctttaaaaacaagcatgattgcattcatttctagctatagaagagaagcatctcaataacattttcacatcattatgcccttcttaagtgagtcattgactggtgccagagattaattataatacactaagatttctttttttattggtttgttcattcagttaacatgtatttcttgatagctattaaatggcttctgttgcatgttgttattttctttttaaaagtaacaaagtatattgttctggtttattcgcatctttcaataaaggaagacatagtgaaccaggcacagttattttgttttacatatggtcaatttatctttagaaaaatagcctgtgattttatttagatgactaaatggcctaatcatatcattgcagggacatgtaggcctcttctcttgccttaacagattatttgaaactttgacaccaaccaagtttgttaaagttgccttgatatcacttaattcaaggcataagtgatagttgaagaggtgtggtatcttatgggaattatggttacctagagcaccattttcctcatctgaccgtctcaacttttcctaatagcttcagtagtatgggagatatttctatgctgtgaagccctagaggatgaagttaattctctgccttcactcctttaaagtccccacttcagtgttaaatagcatgtgaaagtgatgaccactgtgggatgtttaggatatcctaaatgaatgagcaatggtaacactctttttttgttttattttgttttagtttttgagacagggtctcaccctgttgcccaggctggaatgtagtggtgcaatcatgactcactgcagcctcagcctcctgggctcaactgattctcggtgctttaacctcccgagaagctaggactacaagtgtatgccaccactcctgactaatttattttttgtagagatggggtctcaccatgttgcccaggctggtgaagaactcctggcctcaagcagtactcctgccttgccctcccaaagtgctgagattacagatgtgagccactgtacccggcccacactcatttttattctgtaataatcctgggcaaggcgggggatgaaataaaacaattatctgtgtgaacttaatttgcagcatctttttttttcagagatataaagacattaaatatttttctgaccaaggcaaacctgataaaacttggagattatggcctagcaaagaaacttaattctgagtattccatggctgagacggtatgtgttgcccttgtcttaatttttattttattttctagcactgtgaaatataactgtactccctaaatcttgcatacttttctcaatattcttgcaagttctccatacttttaatgcatgtcttcagaagtctttttcctgggcccactagcaggcatttaagtcattgcccacgttacagctctgacctcatagcctttttccagcactgattagggacttatctaaaagcagcaaaatgctttactgttttgtccaggttaggatctttagtagatttcactttatctcttatttaatgtttgagctcaaggtgttagacatctctttgtttttcctttgaatgcttctggttcaaagagaaccctatatttcaagtgaaggctgatgctcagagaacaatccattctttaatattatacacagtctgaactgcacaggggtcccttctcacatgattttgagaaagatcattggtaaagagtagacataagttgatctttaggacagtaatcttatccttttaggaattataaaacccagttgttattcttctagtttcacaatgctctgtccttaaaagaaattgaaaactgattttggccaataattttttttttaataatgtcaaggtttgcctgcaagcaatttagatgtttagggtttggagtctctgcttcagggactcagatgtttctatgatggaggccaaagtgagcttctgaagaagcaatcatatctttatatggatttttctcatcaagaacaatctgataaaaccaagacttgactttttttagctagttaaatgcaaagaaggaatgatatgaaaatttataaaagccatgtaagccatctgaaatttgctttgctttgctgcttaaagctgactatgaattttattagagctgctagggcattcattatatctcatcttgggagaggcatgacttcttaggacatttttatttccaaatttatttttgaagtcagaaaatctttttcaaattcaaaggaaattcgctagctgtgttagtataacagatgccaaattgggcattttaaaagtttcattgcgcgtattttagttagaacatctaattccttcattgagttaccatctccccactgccagtgtttggatttttttcccattggtgaacttctactaagtatgtctttaagtttgtgtaaagtcttcagtaggccttgaatgcctgaagcctctgtgatctaggaatcacagagctattgagcccctcaagttaccacagttcctttgtcacagagattgtccctttataattgacccaagaggtttgatatgaataagatttctttccatagtggcatcgtctcataaaaaccattttggaatctgctgatgaatgttttatggttgttatgactagttcctaggaaatttaattaagctgttgaaatgttaacatagttacctcagaaaagaagttattctttgattgtttctttgttgctcagcttgtgggaaccccatattacatgtctccagagctctgtcaaggagtaaagtacaatttcaagtctgatatctgggcagttggctgcgtcatttttgaactgcttaccttaaagaggacgtttgatgctacagtaagttggcatattatccccatattgcatttagcaggttgcaaatggtacagcttgactaagcagatcaactctattcccaggcttctgatttctggcaaaaataacctgtattcaggtacaagattagtaatctattactaaaatgctatagacccagccaggcgcagtggctcacgcctgtaatcccagcattttgggaggccgaggtgggtggatcacttgaggtcaccccggccaacatggtgaaaccccgtctccattagaaatacaaaactcagccgggtgtggtggcgcacacctgtaatcccagctatttgagaggctgaggcacaaaaattgcttgaacccaggaggtggaggttgcagtgagccaagatcatgccactgcactccagcctgggcaacagagcaagactctgtctcaaaaaaatctccaacttgaattccctgttgaaatgatcacttgaacccgggaagtggagactgcagtaagccaagatcgcaccactgtactccagcctgggcaacagagcaagaccctgtctcaaaaaaaaattaaaattaaattaaatttaaaagttcatctcttaaaagcaaaaaatggaatatgatggttcactttttcaagcagtaggaattggaacattattaacagcagccagatgatcatgcagctactgcatcactttcctagaaacgtgtaaaagaatgcaaatctagtgaacagaatggaagggagcaaaagataattgttttatttgggtctcactctgttgcccaggcctggagtgcagtgtcgtgatcatagctcactgcagtctcaaactcctgtgctccagcagtcatcccgcctcagtctcctgagtagttcgaactacaggcatgcctcaccacacctggctattttttgtagagatgggttctcactatgttacccaagcttgtttcaaaatcctggcctcaagtgatcctcctgccttggcctgtgctaggattacaggtatgagcccccatgcccagcatatttatgcctttttctaaattgttacttctttgtgcctttattctatcttgtaaacacttctgacatagcaccagtatcactttattgtacttactttttttatatagctgtggttttgccaggtagtctaaaacccttccaaatgtttgctttattttctgcaatacctaacacatcgtgggtgttaaaaatattcattaactaggaaaaaaatgtttatctgttaaaaaataaataaagattgtcattgctttatggacaatgaatccctttaagtctttttttctttttttaagtaaattaaagtacaacctgatataaagcagtgcttctcaaactttaatatgcatacaaaatcatcttgttgaaatgcagatttttttggggggtggggttgatagtctgtgtttctaacaagctcccaagtgatgctgatgctgctggtccatggagcacactgaggggctaaagtggattcatatccagttgcctctaccaaccaggtgtgagaatttaggcaaatcacttcatctctttgatcctctgtttcattatctataacatggtaacaatatatattccccacacggagattctctcataatgtatatgaaaaatgcaaatgtaagataatgcaaattcattgccctttcataagacctattcatttttctaaatcctgaaggttgttctagtatatcatctaattctcctaaatagtatggtggaagaaaaatgacttggagtcagaggctgggcgcggtggctcatgcctgtgatcccagcactttgggaggctgaggcggacagatcacctgaggtcaggagttcgagaccagcctggccaacatggtgaaaccctgtctctactaaaaaatacaaaaattatccaggcatggtggcgcatgcccgtaatcccagctactcaggaggctgaggcacaagcatcacttgaacccaggagacagaggttgtagtgagtggagatcgtgtcactgcactccagcctgggtgacagagtgagactctgtcttaagaaatgtgtgtgtgtgtacgcacacacgtgtgcatatatgtacacacacgtgtatatatgtgcacacacgtgtgtgtacatgtacacatgcacatatacatatatacacatatatgtgtgtgtatatgtatgtgtgtatatatgtgtatatatgtatatgacttggagtcaggctttggttggaattatagctccatttttactatctgtgattttgggcaagttactttacatctctgagccccatttttctcatatataaattgataatgataataatttccttgaatggtgttagtgaggctaaaaaatatcatatatgtaatgtgcctgtctagtttgtagtagtctctcaataatgtggtggtggtattaccataatattgttagtattatcatcttattattattactgccttatctgttgcagcagagtattgcctgtacagccacaattaggatatataaattaggacgcaagttagttggcaagggaactacatgaagccaacaaggatggctaatcttgctttcctttttcttgggattcagttgaaaggtcagattataatatactctgagcatcatattattggccacatagttatagattgtatggccagttggcttcattctgtctgatagcatcagtgcatccctaaccatttttttttgatgcatactagtagttataacaagaagtcagacctattgccaattctttaaataatggtcacagacacctgagagcccctaccagtagagtatagcatcatctttatataaccaggaacaatgcagtcatcattttctcatagaacccacttaacctgtgtgtgaagatcgtgcaaggaattcgggccatggaagttgactctagccagtactctttggaattgatccaaatggttcattcgtgccttgaccaggtaggtgtgacttaaacattcacttcagtttcgtatttccccttccagcctcagtgtttggtgtatggcatagctataaaccatacaaaaccacatccacttccccagggtagagtgtatttgtggctatacccagaataggtattggtaattcattatagttgtgtgcttcagtgaacaaattcttacttcattctgttttgtaagtgttagtttgtgaaatgaatttcccatctaaattgtgctcgattttttatgaccaagagtaatttctgaatatagatttcaaaaaactgcaatgaaagataatttaccacttctaatacagaatgtctgtatttctcatatctcatggttcccttgctgtgtagttctagtattattcaaagtatgtttcatgaaacactggagtcagaatcaccagggaatgggggagttttgtaagtaaaaagaagattcctgggccccaccccagacgaactcaatcagaatctctgtggataaagcccagaaatctttatttgtaacaaacacctcaggtaattcttctgttctgtatatattgaggttcaagagccactgccctaactgaacaagtgaggaagatgcattataaacattctccttcatgtacaagtgttgattataatgaggtgagaagcataaaatatggagtatcacataagaaatgatttttaaaacaaaaggataatgcagtggtctttgactaattaacatctttagatccgatgtcgcccatttccattaagtgaaaactaaccctatttttactttttaggatcctgagcagagacctactgcagatgaacttctagatcgccctcttctcaggaaacgcaggaggtaaattatgaagaagtcactccattgtcttttctgagatagttgacttttagaggcttgatcagagtactaaaagaaagagtagtgtttcctgacttggttgcaatagtgctattttctaccaacatccctgcttttattgcttaggggtggcatctgacttttgcctccttagcctgtgctgttttgttgtaaatttgtactaatgaggcccaagagcccttcactccccaacccattggttttaaaccttagagttgaggcattagagtgcagtaaggaagaggggtgtctggactcagacatccttatgtttgtatctgaattttgtcattatctttgtcaagttatttaacatcgttatttcttggctttctcctctataaagtaagatgaggtcaggattaaagaagataacgcataaaaagtggtcagcccagggcctggcatagggtgcctatcaattgtagtgtgagttggactggtcctttggtttttttgttttttgtttgttttctgagacagagtctcactctgtcacccaggctagagtgcagtggcacagtcctagctcactgcagccttgaacttctgctgcaagtgattctcacacctcagcctcccaggtagctaggactacaggtgtgcaccatcatgcctggctaatttttctatttttatagagacggggtctcactgtgttgcccaggctgatctcaaagctgttgcctaagcaatcctcctgcctcagcctcccaaagtgttgggattacaggcatgagacactatgcccagcctgagcctttgtttttcactgcatttgtttaggtggtaggttggagttggaggaatcctcttcaggtacattttgcccatatttgaagtcgagttttattgactcctcagaggttatttcctgagattattctgtcagatatctttagagataggaagaacatcctttatccctctgttcctctaggaggtttcataccttaatttaaaacatttatcttcgttaaatatttgagtctgtatttcatcctattacactatttttgccttgctacgcttcttcctccactaccagttttttgtttttatatcttccaaatattcacatacaatgctcttttcaagtcttgctcttggatacattctgtacatccctaattgcatatttgctgtttcatcagtacttttattctactatgccatttaattaatcttttctggttcttctctagttggtctgtagccagtgttttagtgcctgaaattatgtacagtactccagatacagcaccatgaccttccatttatgttttgtgcacgtgcaggcagtatcacccttttggtctggtgaagcatatttaaaatttttgtctggcttatttcacagcaatataatgatttattttattttattttatttacttttatttactttatgagagtctcactctgttgcccaggctggagtgcagtggcgtagtctcagctcactgtaacctccacctgccaggtttaagcagttctcctgccttagcctctcgggtagctgggactacaggcaggcgccaccacgcctggctagtttttgtatttttagtagagacaaggttttactacgttggccaggctagtctcgaactcctgacctcaggtgatctgcctgcatcggcctcccaaagtactgggattacaggcatgagccaccacacacggcataatcactattttaagtcactattttaatctcttatttcttgagtgtaggcatgaaatttttactgagataattatagatttgcctgcaatactttgttggaactttgtactttgatggaaaacataagacagagttttccagacagagaatatagcataaacaaaatcatagacacaggaagttgtggaaaatattcaggaaacacaaaattctatttggctagattagtggttctagacctgggatttttgatgcaaaatatcaggagctttcaaaaagtactgatgcctgagcactactctaggagctcagctataattgatttaggtaggatgacagccctgggctagaacgtggggtgcaaacaaaaggaaggaagtctggaaaaataggtaggaaatcttgcatgccaggccaagaaaattgtggttaattcaagaggtagtgcaaaagatagagtgggtatcacatccactgttgagagatggtggatgtttgcgagagggcagttcacgtgatgagaggcatacctaaggaagagttatttggcaatattagtatctgtgttaaattagtatagtaaaatgattaagactgtagtaagtgaggctgattaggaggtattatcacagtacaggtgggaagtagagctacccagaactaaggtggtgagactggaaaggaagaggtgagtacaaaaagtactatataggtagaatctgtagaacctgaatattaaagaaagggagagagatgaatcagagatgactgaggttttaagcccagttgactgggagaattggggaagggtgttgcggctagttacagaaatagaggagtcagaaagaaaagctcatttgggaaaaagctaacaagctcatatttggagatactgagtttgggagtcagtgggcagactagatgaaggtgtccatcagatactaaatatgtacatcagaggttctcaaggctctctgttccagcctggaccatttctcagagacagaaagcaaatggccccaaactgctggcctttgggtatttaatgaattgtctaatgaaaggactatataactgttttgagttgtattgaggtactttgctaaaagtattgtgatgttgtaggatgcatacagtttataagaggattaaatctgtgaaatgtattaaacagacacctttgcaatataaaaacctattatttcactcatgtatctttgcttttcttttggtagagagatggaggaaaaagtcactctgcttaatgcacctacaaagagaccaaggtaatgttcaagagactcttaaaaactaatatatccgaaattacaaccagggggttctttcttgagtgtaggcattatttgatccgaggatactttggcatcctttcaggagccagcatctgcttaaatgtcagacagtcatttctaagaagaaagctataatttcaccctcacactaaagtggccatcattaccatgatgaatgtggaaaagtgtaggtgttatgggtcagactggaatctgatctggccaagctgtgatgaagccctgaggcaggaattgcaaagtctgctgtgatagagcacattgaaacaagttgtcgagaaagaacatactttctcataccataattggcagttcttctcagggaacagactggaagcatttttctttgatattgtttttaatgttaaatgttcctttgttctgggggttgttggcaggtcaagcactgtgactgaagcacccattgctgtagtaacatcacgaaccagtgaagtctatgtttggggtggtggaaaatccaccccccagaaactggatgttatcaagagtggctgtagtgcccggcaggtctgtgcagggaatacccactttgctgtggtcacagtggagaaggaactgtacacttgggtggtaagtgaacgctaagcattttggaacagtgctgtaagcctaattgtttactgggcccacgatgtctaagcattttattagttgaacctatactaagggagtggcaacatggggtgatggaatggaagctcttataagagcagggattttgtctgtttagttcactgatgtatgcccagggctggtacatattaggtcacctataaatgttttttgaatgaatgaatgagagagggagagaaaaattgaaagactcaggagactggggtttcccatttacagctggatgatttcagacaagtcactcaattactctgttatattaccatgaggttcagagcaactattacctgtgaaatagctttgtaaacaaaggaaggactataccatgtcaggaaacccctgaagcccacagcagtgattgaagatggctaggtatattttgtgtagaatttgtttgttgccctctagattctcccctctcaccttccttaacaaattgtctgtgtttgctgtctgtttccttatctcccactctctcttcattcacctacaatgcagcttccatctctgccactgccactcaattgaaactagtcttgacaaaatgacccataaattgctaaaataaaacagatgctttttagtccttacctagcttgacctctcggcagcatttgacatagttgaccactccctccttcttgaagctttgtctttacttgccttctgtgatagcatgttctcttggctttcctcctgtctcttgctatgcgttctcaggctcatttcaggctgctggagagaaattagtatcttaaacatttattggctgggcgtagtggctcacaactgaagtctcagcacttcgggaggccaaggcgagtggattgtttgaggccaggagtttgagaccagcctggcaaacatgacaaaaccccatctctactaaaaatacaaaagttagctgagagtggtggcgcatgcctgtgattccagctactcaggaggctgaggcatgagaatcacttgagcctgggaggtggagattgcaatgaaccaagattgcaccactgcactgcagcctgagtgacagagcaagaccttgtctcaaaaaaaaaaatatatatatatactgtcacacacacacacacacacacacacacacacgcacacgcacacacatatatatataaaatatgaggacttgtagtatactcatttaatagaattatttttctctataaaactgttgaaaaggccagacatggtggcttacacctgtaatctcaaaactttgggaggccgaggcgagtggatcacctgaggtcaggagttcgagaccagcctggccaacatggcaaaaccccatctttactaaacatacaaaaaattagccaggcgtggtggcgggcacctgtaatccctgctacttgggaggctgaggcaggagaatcgcttgaacccaggaggcagagcttgcagtgagctgagatcgagccactgcgctccagcctgggtgacaagagcgaaactctgtctcaaaaaaaaaaaaaaaagttgaaaagtcatcaaggactagtctcattgctgtatagcagcctctttgatgtagccagattctttataactcttccatgtttcagggaaactgtgaccaaaatttatgaaacttctagtacagattttcaagaagctatattcctgtagaaagcaacaaagttagactatattataaagaatttttttcaccatcacctgtaattaaatatatagtttaccttagacttgaaggacaaagattagattaatggatattaatctggatactttttaagttttctttacctgttggcaggatctgtatactacttgctattaaaatgtttaatccctttgcccatttttttctaatttctaaatttctagctctttttttctactgtttttcttcatatgaagttccattaaagatcagcttttggcatgaaaaattaaaacttcataagacctctcagccggggatggtggttcatgtctacaatcccagcactttgggaagccgaggcaggaggatcacttgagcccaggagttcaagaccagcttgggcaacatagcgagaacccatctctttaaaatttaagtttaataaaatgtaattaaaaaaaaaagtcataagacctctttatttcacagaacatgcaaggaggcactaaactccatggtcagctgggccatggagacaaagcctcctatcgacagccaaagcatgtggaaaagttgcaaggcaaagctatccgtcaggtgtcatgtggtgatgatttcactgtctgtgtgactggtaagccatcagcagaaagtgtcttaagtgcatttaatgtgggggtattttgcttaatgctgtgcaatcttagttgggattttaaaacaaaagacagtatacaaagaaccagaggaccttgagcaaatatactcattaataataacataccaaatttgctatagtattagggggtggtgagcaaggagaagacaggtgggtaacagagaagaggtgggatcaggagaaaatgtgtgtcgtggttggcaggaaaaataatcttaccacctcatcaggctatgaataacacaaaattaggatcaagacctaagtttagttttggtcttgtcattacttagttaatgattccttgggacttatttttttatctatataacaaagatggccccattaaaattttaagtccttttaatgtgataatgctaccactttttaaattgtttaatatagtagtagtagtacacatgactctctgacatagaactctagacttgcacagtctgtccttttaatttcttggatataatcaattcatgtgagatcatttgctggggtagtcctcattccagccctgcccaactttctgattagataaaataagtcagtcctttgatggattctgttttcctttcttttgcagatgagggtcagctctatgccttcggatcagattattatggctgcatgggggtggacaaagttgctggccctgaagtgctagaacccatgcagctgaacttcttcctcagcaatccagtggagcaggtctcctgtggagataatcatgtggtggttctgacacgaaacaaggaagtctattcttggggctgtggcgaatatggtaggggtagccttgtctctgtccacttcttcacaggtatacaacctgacttcaaagttgtatgcatctaaacccatcatgcagcccctaaatgagaagtgttaattcagtaaatcttttttttttttttttttttttttctcgagacagagtctctctctgtcacccaggctggagtgcaatggcatgatctgggctcattgcaaccaccacctcccgagttcgagtgattctcctgcctcagcctcccgagtagctgggattacaggcacacaccatcacacccagctaattttttgtatttttagtagagatggggtttcaccacactggccaggcttgtctcgctcgaacttctgacctcatgatccacctgcctcggcctcccaaagtgctgggattacaggtgtgagccaccgcacctggcaaaagagaatcttacagaacctattcactgggaaggaagccctcattataatgattttcattcttatgtgtgtttcaggacgactgggtttggattcagaagaggattattatacaccacaaaaggtaaaatcagaagcaacttatttctaaaacctatcttaagtcgcacagactccaataatatgtcctctttccttggctctgttgtatcaaggtatttatttccgaagtgtttcctgtttgggagactgacaatttaggattcctgatttagcaccctgtggtcttgtcatctgaccaaatcacagaaaattgagaaagtggatacagcgactgtggacattgtgaagtcacatcttactcagggatgacagctaaaatcagcgtgtacagcagaaaagtcacatatagctacaaataccctggaaaactcgagaagatactgtaaagcagtatactgtctcttaacccaacacagccattttcctctcctgtttctacagttgaccaccagatgaaatattaatagttgtttttgtttagcggtcatgttgcatgaaacatattatctaattactctcagccttgccagagctggccctgtgagaggctcacagaggctgataccagctgggggaaaagcacagtcacatctctcccacctaccctagggcacaggcttacccattggagggttggctaaatcagctataccatttattgttagcagtgttttgggttttctgttttcttttttttttttctttccttgggaacttttagccaaaccagtttttatttatattttaaaaattaaattattatgcatttctagggaccatcctcaatgggattcccagctgttccttttctcctggaaaggctgtggcagaaactgagggttgaggtttcaggttttacacacatccattgtgaccccacacatgcatcaccccaccttctccagtcctgtctagttagctgtaaaaagatatgagcatttggaagtcctagatattacctcagtactctgtcacctctcctataaaatgaccagattgggaccccacagggctactgaatttctgtaactgtcaagcagccttccatctcaaaggacaaaatcagcaatgaattgaagcttctttctcaactttttgacaggtcaccctaagtaggacctattactaagacaaactgagagggtgctgtcttgtttagttgacctggaactgtcaccttttctttgatattgtaaaacttgagctcttcgttgacaacagtagccttgaccgagcacaatggctcacgcctgtaatcccagcactttgggaggccgaggcgggcaaatcacttgaggtcaggagttcgagaccagcctggccaacatggtgaaaccctgtctctactaaaaacacaaaaattaactgggcatggtggcacacgcctttaatcccagctactcaagaggctgaggcaggagaatcgctttgaacctgggaggcagaggttgcagtgtgctgagatcataccactgcattccagcctgggcgacagagcaagactccacctcaaaaaaaaaaagaagaaaagaaaatagtagtctcagccaggcgtgatggctcacacctgtaatcccagcactttgggaggccaaggtgggtagatcacctgaggtcaggagttcgagaccagcctggcctacgtggcaaaacctcatctctaataaaaatacaaaaattagctgggcgtggtggcatgcacctgtcatcccagctatttgggaggctgagacaggagaagtcgcttgaacctgggaggcagagattgcggtgagctaagatcgcacgacttcactccagcctgggcaaaagagggaaactctatctcaaaaaaaaaaaaaaagaaaaagtagtctctaagacactgggcaaacctgaaaagaatagagcagtcctcactttcctgtagtcattctgctaaatgcagcatgtctcttttgaaagaatttgagagctttttttctaatacgaattatatatttgggatttctttttctgatttttttcttgcaggtggatgttcccaaggccttgattattgttgcagttcaatgtggctgtgatgggacatttctgttgacccagtcaggcaaagtgctggcctgtggactcaatgaattcaataagctgggtctgaatcagtgcatgtcgggaattatcaaccatgaagtgagtgtcctgattggtgttctaaccacatcatcagaatttctctaggttggaatttctttgagatgccattattggttagtgaccatggaatttgactttagttatggtctcataggcattgtgtgcagaaaaagaagccagccacaaagagtacatgctatatagctctatctgtgtaaaatttaagaacaggcaaaattaacttatactggcagaaatcaaaactgtggctacttattgaaggaggggtattaacagaagaggtggaagggatcctagagtaatgggaatggtctatatcttgatctgtaatggttttaccagtatatgtatatagaaaaatgtgtcaagctgtgtgatattttgcagtgtgttatacttcaacaaataaattgattacaaagaataaaatgatgaaattcagcttttaccttattgaaataggaacaagcaaattaatgttataaaaaaaaacatatttccatgcatcaccttcctggagtttttttgattgattggagttttttagatttctcccaaatcactgatcctgtttaggcttatcgaatgtaattaccattctgtcttcaaaaatgttagcaaattcaccactgatattgtcttagtttccttttttttttttttattatacttttaagttctagggtacatgtgcacaacgtgcaggtttgttacatatgtatacatacgccatgttggtgtgctgtacccattaactcgtcatttacattaggtatatcgcctaatgctatccctccccccttcccccaccctatgacaggccccggtgtgtgatgttccccttcctgtgtccaggtgttctcattgttcaattcccacctatgagtgagaacatgcggtgtttgattttttgtccttgcaatagtttactgagaatgatggtttccagattcatccatatccctacaaaggacatgaactcatccttttttatggctgcgtcttagtttcctttttgtgttaatataatgagttttgtcattttccaaagaataaaattaagagacagaagttttctgactcaatgaaaaaggtaagaattaatttttaagcaatctctaaagtagtgattttcaattaggagagtacaaattcagggcaaggctggagagagtgtctttgtagtttgaaaagaaatattcagttgccgggcacggtggctcacgcctgtaatcccggaactttgggaggctgaggcgggcggatcacgaggtcatgagatcaagaccatcctggctaacacggtgaaaccctgtctccactaaaaataccaaaaaaaaaaacagccaggtgtggtggcgggcaccggtagtcccagctacttgggaggctgaggcaggagaatggcgtgaacctgggaggcggggcttgcagtgagccgagaccgcgccactgcactccagcctgggcgacaaagcaagactccgtctcaaaacaaaacaaaataaaaaaacaaaaaaaacaatattcagaattactattacttgatttatgttttcattatagcagtggatttgttgtgaaattttaaacttaaatgagaggattcttttttaatactaattcaaagggaacatgagttttaattaagttgagaaacactaccctatagatgaaattagatcacagtaagctgattcctttatgggctggagacagtcctcaggactttaattctttgccctgcccttgttagatatgcagagtgtataaccaaggtaaatgtcaacgattctctccttatataaataccttctgggatggaaagttcatgttttataaaccctaagtcagaatctaaaactttggttgtcagaaagttctgcctcatgtgctgcattctctgattacatattcagcttatttcctcttgttttctgttggagatggaaaactacctggcaccctcttcttagtaatataacttacttgaaaggccttttggtcaccaggacttttttccattctcagcctgattttccttcgattttcttacctcatgcatctgctttgtgttttattttgtttcaggcataccatgaagttccctacacaacgtcctttaccttggccaaacagttgtccttttataagatccgtaccattgccccaggcaagactcacacagctgctattgatggtaagttgatttacaactgtatcacatgccttagtagctgagcctcttttattctatcaggtattaggttttctttatatgtatatcatcccgatttcccctgaaaatctagtattatttcattaatgtattcaggtacatatttttattgataattattataaatgcataataaatacatccttttatgagaacaccacacctatgattccagacatctgttgtctctgattagcaccttttataagtattctaaggtagtactcatttttctcactacaaatacagtactggagagagaatacaatatcgagtcgctgactggatctaattggttatagtgcctagatactgtatttgtcctaggtccaggatcatgtggctagttttatatttgtatattctaacaaccggaagctaatccatgaagtctgcttggctgcatcttctctgggttccaggactcatttgtgccttgttatttctttttgcttctctctcagagcgaggccggctgctgacctttggctgcaacaagtgtgggcagctgggcgttgggaactacaagaagcgtctgggaatcaacctgttggggggaccccttggtgggaagcaagtgatcagggtctcctgcggtgatgagtttaccattgctgccactgatggtgagtctgtacatatcatttcaagctttctggacacatggctgtgtttcagttcttggctgggaaagaaatggactagttatttgtatagctgaattgtggatgtacttttttatttgtattaaattggtggccggttatatatattgagctttattaacttttcatgtgttcaacatagtgattgtttttaaaggccagatttctagataatgataggttaatgttctacattcctccttttttcatttcagctttcacttttttggtaaaatgttataagaattattaagtacttctatataacttgcccagtatcttgttgattgatttcagtaaacattgattgggtagctggagagaacagcatattttctctgttggctggggtcacctgtactgcagtgatgtccatagggactgctaaggtttgaagggctgctttccgctatattatgtatctctcagatttctgagttggtctaattgatttttctcctctcttttctctgagacgatttttttgtttgtttgttttgttttttgaaacagagtttcgctcttgttgcccaggctggagtgcaatggcgcaatctcggctcatcacagcctctgcctcccaggttcaagcgattctcctgcctcagcctcccgagtagctgggattacaggcatgcgccaccatactcggctaatttctgtatttttagtagagacggggtttctttatgttggtcagctggtctcgaactcccaacctcaggtgatccgcttgcctcggcctcccaaagtgctgagattacaggcgtgagccattgtgcctggccttttttttttttttttttttttttttttttttttttgagatggagtcttgctctattgcccagcctagagtacaatggcgcgatcttggctcactgcaacctccacctcccgggttcaagtgattcttgtgcctcagcctcctgagtagctggaactacaggcacaaaccaccacgtccagctaatttttgtatttttagtacagacagggtttcaccatgttagccaggctggtctcgaactcctgacctcgtgatctgcccacctcggcctgccagagtgctgggattacaggtgtgagccactgcacctggtcctctgtggctatttctttccgcagtattgtctggttcctcactcctcttcttttttttttttttttgagacacaatctcactgttgtcgcccaggctggagtgcagtggcgcgatctcagctcactgcaactaccgcctcccaggttcaagcgattctcctgccttagcctcctgagtagctgggattacaggcactcgccaccatgcccagctaatttttgtatttttagtagagatggggttttgccctgttagccagactggtcttgaactcctgacctcagatgatccacccgccttggcctccgaaagtgctgggattataggcgtgagccaccactcctggtcactccttctcttctgtactgctgctgttgctatcctacattcccttccttctttgcttgcttttttcctcttttttctttttcctgtgtcatcatctgaacttctaaatttttgtagccacttttttcacttgactggtaacaactcacatttcattttctctctttttctttttgagacagagtctcgctctgtcacccaggctggagtacagtggtatgatctcggctcagtgcagcctccacctcccgggttcaagtgcttctcctgcctcagcctcccaagtagctggaattacaggcgtgtgccaccatgcccagccaatacatttaatcttcttatcttttgactcatcaacttttttgttgttgcttgtgctctgagatatccttgttttcttttggtccatgcctgttctgtactcatgaggggtctcagggatattgtgatctgttaccatatttaaataaaccagcattcagaacagcacattaactctctctgcttgtcccaaaataagggactttaaggagcaaactgtttaggtcagacttggataaatggaaacgttacacaggacagtcaggatgtcactgaagataaatttagtgcagcaactgcagtagcactttctgacagggcttcagagagctcatgtttcttgaatagatctgtgtagttcatgactttaacttcagaatgaggaatgtaaatttggattctgtggctgggcatattacctcttgatgttcctatactcctctgaactgtacttgatggcctcattcatgtccaagtcctcttttaggctctaggaatatagaaatgagtctcagaaaactcctgctttcaaggagctcacactctagtagaataggggactagcacaggcaggtgttaggtgctataatagcagcagcctagtcttctaagtcctggagtaccccaaggctcacttgtctctccaaagtgagcttgttcccttaaattccccctatacattgactgctttatatcaccaggcttgaccttcagactcatttattcaacagctcctcaacttgatgtctaaatttagggtgggccatataacccagttatcttagaccaatcctgattcatgccttcatgcctgttgtcctggcttaatgattaatagccaccctgtttcatttttttttaaaagcctgatttggataagaagttataggcatctcagacaaacttagtatactcaaaatcaaacttctgattttctgcccagatctgtacctcctgcagccttcctgtctcagtaaatggcaacttcctcctacactccacatcccatccatattggttatcttcagaataaatccaaccacttctcaccatctccactacaactggtctccctgcttccatccttgctcccctgccatcagttctcctcagtagacagagggattctcttaaataactactgctcaaaacctccagtggtttcctctatcagtcagtaagtgccagagtcatcacagtggcccgactggccctatgtgagcaggacctcagccacctcctgaccccttctgttattccgtcccttcctttactttgttctagctgcaggggtctccttgttccttgtttgtgctgctgacattacttttgctgttgctcttctctctgcctggaaactcttcgtcactccagtagatctctgttcaagtgtcagaactcctctgacctaccctatctaaaataatgatatcccaccccactgttactctttgtttccacttatttttctccaccatttatcttcatagcatttatcaccaccttaaatattaggtgtatatttattattatcagtctcccctactagaatgtcagttccacagggcaaggacttggttttgttcactgctctatcaccccatgcagtacctgtcatgaaatagatgttcagtcactgtttgaatgaatgaccaataaaaagttgttgaagaaaaaggtgaatgattggatgaatgaatgagtgaatggcagtacataggaagagtgggcatttttacccaagtggaatcaggaagagtttaagctttatataggagaataaacagctttcccttgtttagtacatagtgggaagtctttctagctctaggatataaagatggggaacccggagaattgggaagccagtgttctgttaaatggtctactgtttaacttttttcctagataatcacatttttgcctggggcaatggtggtaatggccgcctggcaatgacccccacagagagaccacatggctctgatatctgtacctcatggcctcggcctatttttggatctctgcatcatgtcccggacctgtcttgccgtggatggcataccattctcatcgttggtaagagtttcatatgtctggggttgggatggctttgacagaggatggacccacatctgagtactgttagtcacattgttggaaacagaaatgtcctgaagaagccatttctgtaagtcttgtaatggtcaaggatgccatgcctagtggtgggaacagaacattgtcatttcctggagctttgctatctgccatctcttgattattttttaatataagtttgggctctgcctgcccccttagaattgatttttttggttgtttttttttgtcttttttttgagttggagtttcactcttttcgcccaggctggagtgctatggtgtgatctcggctcactgcaacctccgcctcttgggttcaagcaaattctcttgcctcagcctcccaagtagcttggactataggtgcctaccaccacgcctgactaatttttgtatttttggtagagatggggttccaccacgttggccaggctggtctagaactcctgacctcaggtgatccacctgcctcagcctcccaaagtgctgggattacaggcatgagccaccgtgcctggccctagaatttgttacttctaatcatccaccaattaatttgttgtctgtgctcatgctttcatgagaaacattcagtacatcctttaaaagaaactttaaattataagcactttctgcataaagattactttgttaggaactactttataaatgcctgtgtaagggtttataagtctacttttagatcagtggtttgcaaccttagcagcacatacattagaatccttgagaagctttttttttttttttttttttttttgagacgaagtctcgctctgtcgcccaggctggagcgcagtggtgcgatctcagctcactgcatcctcccaggttcaagcgattctcctgcctcagtctctcgagtagctgggactacaggagtgtaccatcacacctggctaatttttggattttttagtagagatggggtttcaccatattagccaggctggtcttgaactcctgacctcatgatctgcctgcctcggcctcccaaagtgctgagattacagacatgagccactgaacccggccaagaagcttttaagaataccacggtccagaccctatccctgaccaattaaatcagaatctctggggtggaacctacagacctatgcaatgttacttcctttttttaaattttgagacagagtctcactctgttacccagagtagagtgcagtggcacagacacagctcactgtagtttcgctctcccaggctcaattgatcctctcacctgagcctcccaagtagctgggactacaggccagtgccaccacacctggctagctttgcatttttttttagagattgggttttgccatgttgcctaggctggtctcaaacacatggttactttttaaaacttcccaggtgattccagtgaccagccaaggcagacagttgctaatgtagatagtgaatatacttagaatagcaagtggtgcttagcttatgatactaatttctaaaactgtaagttatagttctaaagttatctggagtcaaggagagcaattatctccctatcctagtcttctctcatttttcttgcctatatcagtatacagtgcttacctaccaaatattttttctcagagaaagtattgaattctaagaccatccgttccaatagcagtggcttatccattggaactggtaagtaccaatgtttcaggtaccagtggttttctgaagtgtgggtcttttggttagattccatgtagactccaaaacccaaaggaaaatgggaaatgtctttgggaagtgaggaatacagtggttaagagagaagatcatattttgtttggttttgcagtaagttataacttttacattgtggtcagagagacactacatcatctttgcctccaacgcatatgcaagtaattaagtagcttgcccagtactgtaatatgacttatgtattattcctttccttactattctagggggtaatgagtcctctacttccacggtattcccaggggtattccagtctaaagaaatagttcaccaaaacaggcactcagaataaaactcggctaaactttcagtgtggttaggagaatcatcccaaagatctctgatagatttcctttgactgctgtcttcatggttctctattattggggaccatgctaggaaattgaatctattttcctttttggttttctacctgctagagtccctgtagtctttgatgtctcagaaccaggattctgatttattttatttatttattttttttgaggcacagtcttgctctgtcatccaggctggagtgcaatggcgcaatctcggctcactgcatcctctgcctcccaggttcaagtggttcaccttcctcagcctcccaagtagctgggattacaggcatgcaccaccacactcagctattttttgtatttttagtaggtttggccaggctggtctcaaactcctggcctcaagtgatctgcccacctcagcctcccaaagtgctgggattacaggcatgagccaccatgcccagcccagattctgatattgtttggaatcaaaacacataaacacccagaataaaagcagattaaagctgggcacagtggcacagccgttagtcccaggtactcaggaagctgagtcaggaggattacttgaggccaggagttcaaggttacagtgcactatcatcatgcctatgaatagccactgcaatccggcctgggcaacatagcaagaccctatctcgaataaatgaataaatacataaacaatcggtcaatcaaacagattaaacctccaaaaagaaacagctgaaaacatgatctagacttgttgaacttcagtttacacatatacactgacttattacaccatattatatatagttaagtagcccattgcttggcatctctgtttatgtatattaatatctgtcaaaactgactgaagatctttcgctaagcacagcagttctactacaagtttgttttactagaacagtatttaaaggaaaaacataaaattaaaagcaaatgtccattggtgggaagatgtaaactcgaggaagagcagggatttttgtcttttttatttatcaattttatctacttccctagaacagtgcctggcaaatggtaaatgctcagtaactatttgttgattaaatgcgttataaccatccattggagtgaaagtgaacatctccaaatatttccataatgtgaaatgtaaaaagcaagttgcagcagactacatgcctttttataaagtttagaaacaagtaaaataggctgggtgtggtggctcacgcctgtaacaccagcactttgggaggccaaggcaggcagatcacaaggtcaggagattgagagtatcgtggccaacatggtgaaaccctgtctctactaaaatacaaaaaaaaattagccaggcatggtggtgcacacctgtagtcccagctacttgggaggctgaggcaggggaatcacttgaacctgggaggcaggggttgcagtgagccacgattgcgccactgtacagccagcctggcgaaagagtgagactccatctcaaaaaaaataaataaaagtaaaatgaatagtaatgtattatttaaggatacataaaggcgataaagtttttaagaagaaatgataaatataaaattaaacagaatggtttcatctgggtaggaggccagagaaggaaggaattcacacggcaaatacagtgatataggtaatgctctagttcagcagtgtccagtagatctttttgcaacaatggaaatgttccatatcggtgctgttcagtatagtagctaccagctttctgtggctattgagcactccagagagtggcttgtgtgactgaggaactgaatttttaattctctttaagtttaagcgggcacatatggctagtaactcatattggatagtgcaattctagttctagtggcaaatagacctatgtttattgttaggcatgaaaatttacacgtatgttaaaatagtcttaggtatatctaaaatgcagcataatcttaaaaagccatttaaaacaaaaagtaagcttcagaactcactttggtaactatagttctgctgcttccgtaggatctcagcatgacccagttagtccccaggccagcacagcaggtgataattaacccttctttacatttagcctcagaaaataccaggcatcagaacaaggatccctgaggagtaagagaaaaaaaaaaagaaaataccaggcaatttttctttaactttgacagattaatcttcttaattatatttttatttggcccatattaaaattcagtttcatttcctgaccacacatcagctagtcttcattaaggttgcttggaatatgctgtatgatatgaaagaatcagccattatattataaaaatggatacagatagtcgtcagagaatgtaatattcacattaaattttgaagaattggccgggcgcagtggctgacgcctgtaatcccagcactttgggaggccgaggcgggtggatcacttgaggtcaggaattcaaggccagcctggccaacatggtgaaaccctgtctttactgaaaatacaaaaattagccaggcatggtggcgggcacctgtaatcccagctactcaggaggctgaggcacgagaatcacttgaagccaggaggcggaggttgcagtgagccaagatcgtgccactgcactctagcctggatgacagaatgaaactgtgcctcaaaaaaaaaaaattgctgggtgcagtggctcacgcctgtaatcccagcactttgggaggccaaggtaggtggatcacctgagttcgagaccagcctggccaacatagtgaaaccccgcctctactaaaaatacaaaacttagctgggcatggtggtgtgtgcctgtaatcccagctactcgggaggctgagacaggagaattgcttgaacctgggaggcagaggttgcagtgagccaagatcgggccactgcactccagcctgagcaacagaagctagactcggtctcaaataaaaaaaaaaaagttgaagaattcaacattcagattttccccggacagggagttaatggtaagtttatctggcaactttaagaggagtttggctcaaatattaaagacctttttatataagataagtgtctatggaggatgctggaatctgaatgtatctcttaaagaagcagagtaagcatgggtgctagatttggtgggctgtggttggggggattgtttggtaatgcttttagaatattgataacctgctatggatacaagataaacaaagttggtaaatggaagtgaattatcattatgagcatcctgatatacaaatacaactatacaaaattacaaaacatagtttgtatgaaaaccaaaaatttagtccctaacatttgacttgcactgttgccattgcacttcatgcagcttataggcacctttccagggtaagtagggttgtcaaatggtaaatctgtcttgctgcatagcaaagctgtctatttctgtgctgtatatctgtcagtgtttcagagctctagcccgggaggaggcggcgggggcggcggtggtgaagaagaggacagtcagcaggaatctgaaactcctgacccaagtggaggcttccgaggaacaatggaagcagaccgaggaatggaaggtttaatcagtcccacagaggccatggggaacagtaatggggccagcagctcctgtcctggctggcttcgaaaggtaattcctttggaagaagtaacttggataaaatatgtggccctttgcaggaactagaaagagctgtcagggtctctcagttttccaagtacctagtaaactgttgtgcatcctgaatccagccttctgatttctacctggaaagaaattgcctaatcactaatccttttttctttccaaaaagataaaaaatgttctcatacccttgttacttaagtgaatgtattataagttactataacctaccttgatggcagtttttgtagtacatgtatataaagattaagcttacagattttatactgtcatttatagaaatggaatattggagcagttggaatgccttacaataggaaaatggttgatgaaagttgagatacagaaagtaaaaatgttggattgggcacagtggctcatgcctataattccagcactttgggaggctgaggcaggaggatcacttgagcctaggagctcaagaccagcttgggcaacacagcaagaccttgtctgtaccaaaaatttaaaaaattagccgggtgtagtagtgtgcacctatagttccagctactcaggaggctgaggcaggatgatcacttgaacctgggaagtcgaggctgaagtgagccgagctgtgccatgattgtaccactgcaatccagcctgggtgacaaagcaaaaccctgttcaaaaaaaaaaaaaagtaagaatgttgaagtatatttattttcatggaaagttactcacaacatatggctatgcagaagaggatgatatatctgtatgatctcattcttttaggaaatatgtaacacacaaaagaatgtcaacaagactatgtattgacagtttttaaagtggttgtctgtaagtgatggaattgctggtgaattttattagtttcctttgcccatttgtattttctcattttctacagtaaatatttatggtttgtgaaattttaaattttttaccaaaaaaaaaaaaaaaaagaccgagcatgatggctcccagctgtaattccagcactttgggaggccaaggcaggaggattgcttgagcccaggagtttgagaccagcctagacaacatagggagaccccatctctataaaaatttaaaaaaaaataaggccagggccaggcatggtggctcacatctgtaatcccagctctttgggaggccaaggcgggaggatcacctgaggtcaggagtttgagaacagcctggccaatcatggtgaaaccccatctctactaaaaatacaaaaattagccgggcaaggtggctcacgcctgtaatcccagcactttgggaggctgaggcgggcggatcacaaggtcaagagatcaagaccatcctggccaacatggtgaaaccccatctctattaaaaatacaaaaattagccgggcgttgtggcgcacgcctgtagtcccagctgctcaggaggctgaggcaggagaatcgcttgaacccaggaggtggaggttgcagtgagccgagattgcgccactgcactttggcctggtgacagagcgagactccgtctcaaaaaaaaaaaaaaattagctgggcatggtggcacgcacctgtaatcccagctacctgggaggctgagccaggagaatcacttgagcccaggaggcgaaggttgcagtgagccgagatcgcaccactgcagtccagcctgggcgacagagtgagactccatctcaaaaaataaatagataaataaataaggctgggcgaggtggctcacacctgtaatcccagcactttgggaggccaaggcgggcagatcacttgaggtcaggagtttgaaaccagcctggccaacatggtgaaactctgtctctactaaaaatacaaaaaattagccagttgtggtggtacacgcttgtaatcccagctacttgggaggctgaagtaggaggaccacttgaacctgggaggtgaaggttgcagtgagccgagattgtgccactgcacttcagcctggtgacagagtgagattctgtctcaaaaaaataataattagccgggcatggtggcacatgcctgtggtcctagctactcaggaggctgatgtggaaggattatttgagtcccaaaggtcaggactacagtgagtcatggttgtgccactgcactccagcctgggcaacagagcaagaccctgtttcaaaaaaaaaaatctgtaggtttaaagctccctgtctaataagactaaacttgctagtgatttgaggagcgtgaacagaggaagcagcatgctgttctgtctgcacctttagcctcagctttcagcagtgttgcagccagcctcactgacacttccttggagcgccccagctcactgaatagcctgtgtagaataagcgtgttggagtgacacaccagaaactccagcctgtgttctttgagtttgcctttgcatcactgtttctctgatgaaggggtggcagttttttcacaggtaggctgtgatatgttgttaaccacaactgtcttgcccactagagggtgctgaagtcatgagagagggaaaactatagcaaaaagaagggaatttgggaggaagcaaatactgcaaacagactaatgagattctttctcatatacataggagctggaaaatgcagaatttatccccatgcctgacagcccatctcctctcagtgcagcgttttcagaatctgagaaagataccctgccctatgaagagctgcaaggactcaaagtggcctctgaagctcctttggaacacaaaccccaagtagaagcctcggtaactgagctttttgcctttgaatcacaactaggtaaacagtcactgcaagctctgcctggttcttctggcctcgctctagcttttgggtttcagctgccctgcatcaactcattatactgtctattcagcagtacttaaagcctcaacccaagactaaactgagttgcctcagaaaggtatttacccttccacatttctgacaggctaacacctttctaaagggattgtcttttccctctgcctcagaaataccaaaattcaaattcagtttttcatgacactggcagggtaggttagaggctctaaatataagaaagaagtaatactggtagtctagtgaggaagcaacacatgtacacctaaccttggtaaaaatgacattgtggtaaatacctcagtaaaactataatccaaggtcatgaaactttttctataaaaggctacataattattttagacttttcctattaaaggccacatagtaattattttagaccattttagacagaaatgtgtacagcctcttttgcaactactcaactctgacattgtagcacaaaaagcagcttcaagtaatacataatgaatgggcatccttgtgttccaataaaattgtatttacaaaaacaggcagtgggccagaattggcctatgggctatttgttgaaccctcctataaaaaaagtacagtagaaaagagaaaaatccagactaggatcatcagaaagcttcccagaagaggtaataatacctttgaaacttcaaggtgaatgttttaatttctctgtcagttcaccttcttaaattgtgttggtggtcctgtttactgaccacctctcagatcttttctaaagtgtgattcactgcatatcatgaatattgaccctttgggtctgtgatctgaaagacttgttccaaaccaaatcatgcttttccctacttcagcattttaaatgagaagataccaaggtgctttaaaatttttcacaaagtcctccaaaatagatgattggtctcccaccttggcctaatggggactgaggcagagagttcactttccatgttatgtcagtgcccatcgctgttataatcctagcatttctgtttctcgtacatatattcatgtgtatatatgatttatcttgttaatttaaaagtaaaatccgattgcacttagaggaagtttggattgaggagctatgacacctgggcagaacctcctgcaatctccttcttgtctctctagtcacctcggctgaatcctgcagtaacctgtgctgggaagggaacaccactgactcctcctgcgtgtgcgtgcagctctctgcaggtggaggttgagagattgcagggtctggtgttaaagtgtctggctgaacaacagaagctacagcaagaaaacctccagatttttacccaactgcagaagttgaacaagaaattagaaggagggcagcaggtgagagcattaaaagaataatccaatttctaagcctgttttgaagaatcacagaaacaaaacacaaagtactgaaatagacttgttcctttgcaggtccttactttttttttgagacggagtctcgctctgttgccaggccagagtgcagtggtgctatcttggcttactgcaacctccgcctcccggattcaagcaattctcctgcctcagcctcccgagtagctgggactacaggtgtgcaccaccatgcccggctaattttggtatttttagtagagacagggtttcaccgtgttggccaggatggtctcgatcacttgacttcatgatccacccgcctcagcctcccaaagtgctgggattacaggtgtgagccaccacgcctggccgatccttagtttttaatgataccatttttgtaattataatcccagaagccttgggccttgttcaggcacctagattgaatcattttcatcacttgcattgctttttcttagtgtatgttttttcttttacaatacttaattacatacctctgaaaatagacattctcctgaacaaccacaatactataaccacacctaaaaaaattaatactagtattgtcaattctcatctagtatccagctgatacctcaattttcccagttttcccccacaaaaatgtcctttataaccattttttatcagactagaatccagtcaagaatcccacattatatgtatgtctcatttcttttcatctaaaacagctccctccaccaccatcaccttttttaaattattttatttttatttttatttttatttttatttttattttttgagacagtctcactctgttgcccaggctggagtgcagtggcgtgatctcggcttactgcaacctccaccgcccgggttcaagtgattcttctgcctcagcctcccgagtagctgggactatagacgcttaccaccatgcccagccaatttttgtatttttagtagagatgggatttcaccatattggccaggctggtgtcaaactcctgacctcgtgatccacctgcctcggcctcccagagtgctaggattacaggtgtgagccactgcgccaggccttatttatgtatttattttgagacagggtcttgcattgtcaccaaggctggagtgcagtggcacaaacatggatcactgcagccttgacttcctaagctcaagtgattctctgacctcagccccccaagtagctggaactacaggcatgttccaccatgctctgcttcaccttttaaaaaaatacttttatgacattgacttgttgaagaaaccagggcagttgttcaacagaatgtcccacattctagatttgtcttgttttctcagggtgttgtctaacttgtttttctgtcaccctgtcttttctgaaaactggaagtttaacctaaggcttgattagattcacattaaacatttttagtgaaaatacttcaaaggtgatgctgcttgcattatttttcgagagccatgctattgttttatatagagggaagtagaagcagagaaatagggttaggcccttggctttgccatttgccagctgtaggtgtttgggctactttgttttctctgagccctggtttctcacctgaaagaaaataatagacaccttgtatggttctttggaggattaaatgaactaatgtttatgaaattactttagaaaataatatacaggctgagcacggtggctcacacctgtaatcccagcactttgggagattgcttgagcccaggagttcaagaccagcctgggcaacctggtgaaaccccatctctaccaaaaataaaaactaactgggcatgatggcacacgcctatagtcccagttattcaggaggctgaggtgggaagatcacctgaatctggggaggtcaaggctgcagtgatccgtgatcacaccactgcacttcggcgtaagcaacagagcaagaccctgtctcaaaaacacacacacacacaaggtaagattggcagctatagcagggagaagattgttttgcccaggactttttccattttaaaactaagagttctgcatcccaggaaaccccgcagtcctggacaaacctggatagttggtcaccctacctgcagtaaatataaaggtatggactgtatctaaaatagtgccatgagcgtctcacaagatcgtggctacaaatccttagccacgccttagccaatgccttagaagttggcattgaaaatatagtactgaactacttctgtgactaggtggcactgttgctaatgtggaaccgtgttttatccggacaggtggggatgcattccaaaggaactcagacagcaaaggaagagatggaaatggatccaaagcctgacttagattcagattcctggtgcctcctgggaacagactcctgtagacccagcctctagtctcctgagcctgtagagcccccaggagactgggacccaaagaacttcacagcacacttaccgaatgcagagagcagctttcctggctttgttcacttgcagaaaaggagcgcaaggcagaggctctgaagcactttccttgtacatttggagagtggcattgccttttagataggatctaggagtgattttattgttttggagaatggaagggcccccatggccctggctttgtcatcagtgactgccatagcaacagcagctctgtacctcatctgttgatcccacctttgaagaggagacacagtgctcaccttaattgcgctggtagcagcttatatcccatgtatcattttcaccattgattggaagctgccttgggaattcagtaccaggcattacccctctgggtgggagagggagaagtgtaaagttggagtgggctggaatcaggtgtggcccgcccagtgtcctctgcagagtggtgaagtagtctggccctcttgggagccctgagtccaggaaaatatgtctgatggagtcaatctagggcttgtttcgaaaaagttcagttactctgtgcagctaaatgctttaggaggaaaggtaggcttaggttgcttttcctctgagggttgattgaaatttcttcagtgaggaatagagaaagggcaggaccctcctcatcacacagctggtgtttcaggctgtgaccaatgcagggtgggatttcctaactgtggatgaggggatgaggtgtctctgagggatgaggtgtctcagagaattgagtccatggggcagtcagaatagccttaagagaaaatcatgaaggagaagaggtcctcctttagctgcctctacttggtatcttagagagggcttagagggctctcagtcttctgcccatgaaaagacttctttgagcctctgccttcatggctcttagggttctgatcttgatatcagcagccccaaccactttctttctgaatgtctagtcagtatttttccccttttggtgttttatgaagccatgtggtaacgaatgaatctgtatcatttttcctacctgagtggcccaaagccagcaccaaaccctgggagtccctgaagcctaacagaacaggtagaacttgcaaaaggaatttggctgagagctcacttctaatcctgtactcactgtgtctttgtagatagaaacaagctagctttaccaaagagaaatagtgtcatagaagaacaaaacttcatatagaaagttctaggcaagtatttgatggtttccttaaggatgtgagctttgtatttccacctagccttgtaaaatgttcctgtggtattttgtgtcacacatcctacctttgatgagtctcacatcccaccttcctataaacagctaaattaattttgtttcatcttccccagaccaaaatgtttgataatcttatcaacattgtgggaggtcttgtgcaatggaaattttgccatttctccaaaactggtggcataaaggctgatgcttggggagaaccccattgctcgggacaggcaactctgttcaatgggatcttctttggtttgatgttcccattgttttctcagttctgggaagcctagtacattagtactaatgtaatcactgaaaccttttcttgaaataagggaagcagccaaactttgattaaagttgcaagttctggggacttgcgggggttgtcataaactgtaacagtgggttttggttcagcatgtaaatgcaactttgattttcttgaggaccgattgacctgtcatgtccctgtatcctcatgctcatcatctcagcaggcctgagaggctgggtcagtttgggtgttcatcatgaggattgcttctgccatggagctgatggacatgggcaggttgctgagaaggtggggtgaaagtgagtgccgggggtgggtgagtgccctggtcttgttcataggggagcctttccctagcagtggaacgctgtggtcattttctctagcatattcccttgggaagtctagatttgctattaatctggctgagaatctaagttctgtgccttagagacagtttgcactttcccatattgtgcctgggacagccatatgattttttttcccaccaaacaagtatgcaaacagaaaccagttcaaagggggatggagtaaaagatgaggcagtagaaatgcctttgaatggttttctgtagctaattctctttaaattttgtcctgctttttttctttatgcagtgctaggtgttttaagttttctagtagtattgcttttgagttacagtataacctgagttactcctctgctctaacattgttgcagaagaactagtttattgttagccaggttgcttgaaaggttgagagtggagtggtttggcatttctgttttaaataaacatttaagctcttaatc

SEQ ID NO: 37676 - DNA, 65841 bp, Homo sapiens
cgagcagcggcggcggcggcggcagtggcggtcccactggcaggcgggcaagaggggagtccgggcggcggccggcgtgggagccgggggaccaccatggtaaagaagcggaaaggccgcgtcgtgatcgactcggacacagaggacagcggcagcgacgagaacctggatcaggtgagggcaggccgcggaggcgcgggccggcggagccagagggctgtcggggccgcgggagccggagacggccgggcctggagccttcctaccagagcgcccagctcgccccgtgccctgggcaccactacagcccctttcccgtcttcctggagtgtgcggggccttggagaccggcccgggcctggagacggagccccgaggacttggcgccttgggcggggaggcggggcagggaccgggccgttgggcctcgggctcgggggtagcgaaaggggccgcgatcttccggggccagatcggggcggcgggctgtagtccaggagatccgggctgggagagataggaagtatcgcccgccaacctgggaggctgggaggttttggaggaggtgcaagggtgcgcgtcgagcagttgggggcgagggccaagaagatccggactctggaagatggaagtttttcggacaagggatgtggacagaggaaggacactcgtaaatgttcctaggagcctctgccatgcttgccaaggatgacttagctgtgggcacgagtttatttggcgactagggtcgtttgtgtttgagaagggcccttgttgaggtgtcagacccaaaaaaacactcttgggtggaggaaagagggcagatactggaagaaatagagaactatgtagggcgacatggagggactgtgcatagcccaggcctcctcttggccctttcacgcagcatcccagaattctttcttacttgaagactgcaggaagcactgaaagtaacttttggcctcagtgtcttggggttgaactgtttatatactctagaaaacattgtagggaggaatctgctctttgtagcagtgctctagtgataccaggcgatacaaagatggtctcctttctgtttaatgagcaaatgatgtaaagaaagaatatgcaagagatagtagcttttgagtagaaagagtattgaacttggagtctgaaaatttgaattctaggctgggcttatgctattttctagctatatatctttggtcttaaatgtaaaatgaaaatgtaacatcagccttgtgtatctaattggtttattgtaaagatcaagtgtttgtaaaaattgatggcagtgcaagcatttgctaattgtaaagtttttctatgaatggcttcttgggggtcttttatatgaagccagaggtctcagtttgaaagtattaggggctgggcgcggtggctcacgcctgtagtcccagcactttgggaggccaaggctcatctgaggtcgggagttcgagaccagcctgaccaacatggagaaaccccatctctactaaaaatacaaaattagcggggcgtggtggcacatgcctgtaatcccagctactcgggaggctgaggcaggagaattcttgaacccgggaggcggaggttgcagtgagcctgggcaacaagagcgaaactccatcacaaaaaaaaaaaaaaaaagaaaagaaagaaaaagaaagtattaaggcataaaaggggaggactttttatttatttatttatttttttttgagacggagtctcgcactgtcgcccaggctggagtgcagtggtgcgatcttggcttcactgcaagctccgccaaggggaggacttttaagaagaaaaggattgaggaggtgctgtagaaagaagactgctttgaaaatggtggtagggagatggagaagtaatggggcctgtgtaagactatctaaggaatagaaactttgttttggggtaggaattgaaaatgttctcattgaaaggctcctgaagtttacaaaaatatcaaaagtataatttcgactgtaaaagtttgattggtagataattttagactggcaattagaaggagtagaatctatttttttctgtcttttcatctacaaatgtgaatgtttcagacaataacaacattggctaccatttatatagtgcctagagtaggcactttaattgttttgtttagattttcaagttttcacattatggtaaatttggaattatttcctctactttacataaagaaaatggaggttgaaaaagttaaataactcacaactagtaagtggtagcattgggatttgaacccagatctgcatgagtacaaagcctatactgtttccactataccaactcaatctgttagttttaaatttttttcatactgcaaaatgataatgtttcacagtcatttttcatggtgctagagttcgtgtttataaagtacactggatagtttagaggaaattggtacatacattaaaaggattatttggggggatttcttggtaaagcactctcaagacatctgttcaagtgatgaatgaactgaactgcaaattattgtccttagtagtttcccacagaattctgatgaataaaataagttgagtgcttcttttcgtggtagagatatttcacctgatccacaaaaagctttttcaaagtgggaactgcagagaattgccactttatttatttatttatttttgagacggagtcttgttctgttgcctgggctggagttcagtggcacaatctcaactcactgcaacctccgcccactgggttcaagcgattctcctgcttcagcctcccgtgtagctgggactacaggtgcctgtcaccacacctggctaattttttgtatttttagtggagacagggtttctccatgttggccaggctggtttcgaactcctgacctcaagtgatatgcccacctcggcctcccaaagtgctgggattacaggcatgagccaccgtgcttggccggaattgcaattttaaatccaattctaaatatctatttgtaaaaggaaattaacataaaatgtgtaatacctaatacattttaacaacaaatttaacttcctccccttcagcttcttatttgcattcttgttatcagatgggaactagatcaaaattccctttccctgcacatcctaacaggggtattgatgccttcagtttgtctgttcagcactatgccagactctcagaataatcaaagaggaagatctctgccctctagacattttcacgaaagacctttagcacaagttcactgtcagtgctgcttgggggtctttaggaatcctaatgcattctggatctttcctgccccaaataccttgtgctgctccatctggttctgagtcttcactgggggtataacattagacttgctgtctagcgtatggtacttgtggaaggaacaaaccatgacagatcactgagtatctagtgtggattggaatgcagttcgtaaggaggccttttgtccctgggtttttcagatgggaatctgagccattatgtcaaaaattttacctccaatttattccttactgaaggtgagatatatgggccttctaggctggtttttcctggtggtaggggcagacctctgtgtcagaagccacctgggttgcttatttaaaatgtaggttgggacttagagggtgcagcagttcccatcctagacctactgaatcagactctcaggggatagaggtctggactctgcatttgtaacaggtatagctcaagtaattatgatttatgttagtgattaagatcactgcctatatgcaggttaatctttttagtaacacactataagtatttagaagagaaatagcttcctgtgtctgccatagtacttccaaattaagcgtacatgtataggctgggcatggtggctcatgccctgtaatctcagcactttgggaggccaaagtgggaggaacacttgagcccaggtgtttgagatcagcgtaggcaacaaagtgagacctcatctgtacaaagactttaaaaattggccaggtgcagtggctcatacctgtaatcccagcactttgggaggccgaggtgggcggatcacctgaggttgggagtttgagaccagcctgaccaacatggagaaacctcgtctctactaaaaatacaaaattagccaggcatggtggtgcttgcctgtaatcccagttactcagaaggctgaggcaggagaatcacttgaacccaggaggtggaggctgtggtgagccgagatcgtgccattgcactccagcctgggaaacaagagtgaaactctgtattaaaaaaaaaaaaaaaagaatttaaaaattagctgggcatggtggcgtgcctctagtctcagctacttgggagtctggggtgggaggattgcttgagcctgggaggttgaagttgcagttacttgtggtcccaccgtttctcttcagcccaggtaacagagtgagaccctgtcccaaagaaaaaaaaaaaaaaggcacttgtataactaaaagaacttgacagggaggttttaagatggcaaaactactggttctttttttttttttttttaggcagggtttcactcctgtcacccaggctggagtgcagtggcacaattacagctcacggctgtagcgttgacctccctagctcagtgatccttccccctcagcctctcaagtagctgggactacaggtgtgcaccaccacacccagctaatttttaaaatcatttgtagagatgggggtcccactacattgcctaggctagtctgaaactcctgggcttgggtgattctcaggctttggcctcccaaagtgctggaattacaggtgtgagctgccacaccaggccttatttatttatttgtttgtttgtttatttatttatttttgagatggagtctcactctatcgcccagactggagtacaatagcacgatctcgactcactgcaccttccacctcctgggttcaagcaattctcctgcctcagcctcctgggtagctgagattacaggcgcctgccaccacacctggctaattttttgtattttcagtagagacgctatgttggccagactggtctctaactcctggcctcaggtgatccagcacctggccttattttaacctttgaaagtttttaaaactaagacctagtttgagagtttgaaagcttttcttttagcatttgacctgatagtgactctgtccttattttgaccacaccctttcttcaacatttttaaatttcaagatacttgctgttggtgcctattgggaaataataatttgaggcaaacctctgggctctatgtcatctccctttatggaataatatttatgcagtaagtcctataaaatgaaaagcattcaagataataaaggaaccagagttctcaattcaaatcagtacaactccgtatttataaaaattttactctacctttctaaaaaactaaaaattgagctatgtgcacactgggatgctttattttataggtttcttatttaaaatggagattatattgtcatgtcctgtttttctctgtttatctaacttgaagtagcaataattaaatttgtctttgagagaataggcccccctaagtattttcttttttcttttttttgagacggagtctcgctctgtcacccaggctggagtgcagtggcgcgatcttggctcctgcagcctccgcctcccgggttcaaacaattctctgcctcagccttccgagtagcttggattacaggcgcacgccaccacgtccagctaatttttgtatttttagtagagacggggtttcaccatcttggccaggctggtcttgaactcctgacctcgtgatccaccctcctcggcctcccaaagtgttgggattacaggcgtgaaccaccgtgcccggccagccctgtaagtattttctaggagctgtttttagatactacatgtaaagaatattattattataaagtatacttctataaaccttccccataaatcttgagaaatttaaaagttgtgcttcttgttaatgtagtgttttccgcattaatcagaggcaaattttgaagtgtaggaagagtttgtgagaagtgtcagtgttaatttgtgaaaactttaatttgtgtcatgttgcatctagcttgatgtaattcgcttgttaatttcactcttttcaaagagtgagtcccatgggagctccctccccacccagcccccacccaagatggagtcttgctctgtcacccaggctggagagcaatggcacgctgggctcactgtagcctccgcctctaggttcaagtgattctcctgccttagcctcccgagtagctgggatgacaggcacgcgccaccactcccggctaattttacatttttattagagatggggtttctccatgttggtcagtctggtctcaaactcccgacctcagatgatccacccacctcggcctcccaaagtgctgggattacaggggtgagccaccacgcccagccctgggagctttaacagtgaggcttttaggaaaaatacaaaactgatcttcagacacaggtcatattggtgtatttatttttatttatttatttatttattttgagatggagtctcactttgttgcccaggctggagtgcagtgggacgatctcagctcactgccacctccgcttcccgggttcaagcaattatcctgcctcagcctcccaagtagctgggattacaggtatgcaccaccatgcccgactaatttttgtatttttagtagagatggggtttcaccatgttggccaggctggtctcaaactcctgacctcaagtgatccgccctccttggcttccccagggtgctgggatttcaggcatgagccaccgcatccggcctgattgttcatcgttcaacagatgtattagacagcgttagacactagagctattgggtgaacaaaatggaagcagtttccaccttcaaggagtgtaaagtggaatgagagagagatgaggtggggagattgctcagagagagtaatttccttacaattgcactacaggccatgaagcaaggacaagaatactgtggaaatattaaccagggaccctattctagcctgatgagagtgacattgaaacagacctggaatatgtgttaaggagaagcagattagaagactgaagagtaaagggaagagtgttgaatgttcatggttgaggcaccagcatatataaaagaaatgagacaggaaggacctcgaacccttatgaaactgaaagaagcacagagtgagtaacataaactagttgcatagttggagagagaatagtacaaatgaaactgtagaggtagattctgttttgaccctttgaggatggagaagtcagtttacggactacactcagcagtaaaaataaaattgaattgatagaaaacatcaaatgtgtcatacatagtaaatataagtgatgaaatttgtgtgtctcatatgtacatgtagatgtatactgggttgtgaggtataatttatcttcctgtgggctgcgttaaaaagagaaaagttttttggccaggcgcagtggctcacgcctttaatcccagcactttgggaggccgaggtgggtggatcatatgaggccaggagttcgaccaggcgggccaacatggcgaaaccccatctctagtaaaaatacaaaaattagccaagtgcggtggcacacacctgtagtcccagccactggtgaggctgaggcatgagaatcccttgaacctaggaggcggaggttgcagtgagccgagatcaccactgtattagcctgggtgacagagagactccgtctaaaaaaaacaaaagaaaaaaagaaaaaaatttaaagccactggagggcgtcagcctccccggtggctgggactgcaagtgtgtgccaccacacttggctaatttttgttttttatttttgagacggagtctcgctcttttgcccaggccggactgcagtggcgctgtctctgccactgcaagcttcgcctcccgggttcataccattctcctgcctcagcctcccgagtagctgggactataggcgcctgccactgtgtccggctaattttttttttgtatttttagtaggcacgggtttcaccatgttagccaggatggtcttgatctcctgacctcatgatctgcccgcctcggcctcccaaagtgtgctgggattacaggtgtgagccaccgcgcctggccaatttttgtatttttagtagagactttggagtttattctgagagtaataggaagccattgaaggattttaagttggagaagattttcagatttgccttacccagactattgtggagagtaatatggagggggacactaatgaagtggcagagagaggagtccagatgagagatgatggagaacataagttccattagaatggaagcgccaggagggtaaccgtatgtgttcactatgctgtccctggcatctagagcagtgcctatatgcagttggcacccagtcagtatttattaaatgaaggactgacttggattgatatggttgttatagagatgacagatagtggaattggttggacatgatgttcagtatgtagaactaaaaggccttgaagactgaggactgattagatgttaggatgagaagaggagtatttaggattgatgccaggcactggcatgagatggggagtgctggaggagcaggtttagaggtgaagatcctgcattcagtctgggatatgtggagttcgaagtgactatgagatgtctaagtggagacatcaagtaggtagttgaaaataacacttgagggccaggcacaatggctcatgcctgtaatcccagcactttgggaggctgaggtgggaggattgcttgagctcaggagtttgagatcagcctaggcaacatgatgatgaaacctgatctctacaaaaaaaaaaaattttttttggaggtggagtctcgctctgttgcctaggctggagtgcagtgacaccatcttggctcactgcaacctccgccctgggttcaagcgattctcgtgcctcagcctcctgagtagctgggattacaggcacatgccaccatgcccagctaatttttttgattgtttgtttttatttttttttttgggatagagtctcgctctgtcgcccagggtggagtgcagtggcacgatctctgctcactgcaacctccccctcctggattcaagcgattcttctgcctcagcctcccgagtagctgggactacaggcgtgcgccaccatgcctgactaattttttgtatttttagtagagacagggtttcaccatattggccaggctgatctcgaactccagacgtcatgatctgcccacctcggcttcccgaactgctaggattacaagcgtgagccactgtgcctggccatttttttgtatttttagtagagatggggtttttccatgttggccaggctggtctcgaactcctgacctcaggtgatccaccccgcccccccccccccccgccccccccccccgccggcctcctgaagtgttgggattacaggcgtgagtctactgtgcccagccgctacatatatatgtgtgtgtgtgtgtgtgtgtgtgtgtgtgtgtgtgtgtgtgtgtaatttttgtttgtttgtttgtttgtttgttttttaggcagagtctcactctgttgcccaggctggagcgcaatggtgtgatctcggctcactgcaacctccacctcccaggttcaagcaattctcctgcctcagcctgccaagcagctgggattacaggggcccaccaccacgcccagctaatttttgtatttttagtagagatagggtttcaccatgttggccaggctggtcttgaactcctgacctcgtgatccacccaccttggcctcccaaagtgctgggactacaggcatgagccaccatgcctggtctacaaattttttttttttttttttttttttgagacagagtcttgctctgttgcccaggccggagtgcagtggtgcgatctcggctcactgcaagctccgcctcccgggttcacgccattctcctgcctcagcctcctgagtagctgggactacaggcacccgccaccatgcccggctaattttttgtatttttagtagagacggggtttcaccgtgttagccaggatggtctggatctcctgacctcgtgatccacccaccctggcctcccaaagtgctgggattacaggcgtgagccactgcgcccggccctacaaaatttttaaaaaattagctgagtgtggtggcatgcgcctgtggtcccagctattcattcaaaataaaagctacataagctgggtgtagtggtgtgtgcctgtagtcccagctacccaggaggctgagataggaggatcacctgagcttaggaggttgaggctgcagagagccatgatcacacaactgcactccagcctgggtgacagtgagaccctgactcaaataataataacagtaataataattatgccgatgctcgcctgacagagtaggcacttaataaatttttgttgaataagcagatgctacttggcatacctatggtgtcaagttttatttttttttgaaatggagttttgctctttgttgcccaggctggagtgcagtggggcaatctcagctcactgcaacctccgcctcccgggttcaagtgattctcctgtcttagcttcccaagtagctgggattacaagtgtccgccaccacacctggctaatttttgtatttttagtagagacggggtttcaccatgctggctaggctggtcttgatctcctgacctcaggtgatctgcctggcttggcctcccaaagtgctgggattacaggcatgagccaccatgcctggccgccttcttttttttttaattttatttttagagctggggtctcactgtgtcacccaagctacatggtgggacattttctaacttggttacattgagattacttgaagagataaaggacactgtcactttgggggttcttgttccaacccctctactgcaatactgatatcccttttttttttttttttttttttttttttgagatggagtctcgctttgttgcccaggctggagtgcaatgacgtgatctcagctcactgcaagctctgcctcctgggttcacaccattctcccgcctcagcctcccgagtagctgggactacaggtgcccgccactacacccggctaatttttttgtatttttagtagagacggggtttcactgtgttagccaggatggtctcgatctcctgaccttgtgatccgcccacctcagcctcccaaagtgctgggattacaagtgtgagctaccgtgtccggccccctactcctttttttttttttgaagacagggtctcactctgttacccaagctgaagtgcagtgacgtggtcatggatcactctagctttgacctcctggcttcaagtgatcctccctcctctgcctctggagtagctgggatcacaggtgtgtgccaccatgcccagctaatttatttatttattttgagacagagtcttgctctgttgcccaggctggagtgcagtggtgtgatctcagctcactgcaacctctctgcctcctgggcccaaccagttctcccacagcctcctgtgtagctgggattacaagcatatgccaccacatctgcctactttttgtatttttagtagagacggggtttcgtcatgttggccaggctggtctcaaactcctgacctcaagtaatctgcccatcttggcctcccaaagtgctgggattacaggcgtgagccaccactcctggccacagcgaattgatttttaattttttgtagagacagggtctccctgtgttgcccatgctggtctcaaattcctgggctcaagggatccttcctcctaccttggcctcccaaagtactgggattacaggccacctgtaagccacctgtgagccaccacgcccagccaatattcactgtttaaatcaaccaacagttttgctatgaaagggacactaggaagtaacttctcggatttaaagctctgcgaattactcttttttcctcgtcatctcgtagatccttccacttctctctgtccctgtggctacttgtttaatgcgactgctgtgggttccttctgagtcctctctgtacttccaccctggcccctctagtctgttcatctaccagttgtagtgctctttttttttttttctctctctctctctttccaggagtgctcttttaaaacccttgctggattgggttactcccctgcttcaaaccatttgatggcttcccactgcctaacttccatgctcctcaccctgttttataaagctcagaaagatatgttttcttcttaccactaacccaccgcattcaattctcctgcttgcctgctaaactttagtcacagtttctctttcagttctttgactaagccaagctgttatcagcttcagggccttagctgttccatctgaaggcctctgtccagaaaactgtaccatcttttcctctcgtgaagtttctagtctcagcctcagtgcctcagagaagcctctctaaccaccctactgcagatagcccctgcactcatttgattcacttccttcttaacacttaccattagatggaattcattgtttctttacttgttcattgtttgtctcccatacttgattttaaattccatgaggtcaaggaccatgtatcttttccttattttttctttgtttttaatttaatttaatttattttattttttcttttcttttttttttttttgagacagagtcttgctctattgcccaggctggaatgcagtggcacgatatcagctcactgccatccctacctcctgggttcacgcagttctcctgcctcagcttcgtgagtagctgggattacaggtgcatgccaccatgtctggctaattttttttttttttttttttttgagacagagtctcgctgccccctaggctggagtgcagtggcgcgatctcggctcactgcaacctctggttcactacaacctccacctcccgggttcaagcgattctccagcctcagcctcccaaatagctgggactacaggcgcgtggcaccacacccaactaatcttttgtatttttagtagagacagggtgggaagacttttttgttgcatattggtctattcagctattatgagccctcaataagaatgtaaaggactggctgggcatcgtggctcacacctgtaatcctagcactttgggagggtgaggcaggtagattgcctgagctcagaggttcaagaccagcctgggcaacatgatgaaaccctgtctctactaataatacaaaatattagctgggcgtggtggtgcatgcctgtagtcccagctacttggaaggctgaggtgggagaatcgcttgaacctgggaggcaaaggctgcagtgagccaagatcataccactgcactcttgtctaggcgacagaccaagatttcatctccaaaaacaaacaaaaagaatataaaggactgagctaaaaagtaatcttgctgtgagttttcccagtaacttcctatacaatcctcaagttgtgggaagtgcatcttgtatctttcacactgttaagagagtctttgctgtctccatactattgtgggttttcttttcttttttttgtattgagacagagtcttgcactgtcgcccgggctggagtgcagtggtgtgatctcggctcactgcaacctccacctcctaggttcaagcgattctccttgcctcagactcccaagtagctgggattacaggcgcctgccaccatgcccagctaatttttttgtatttttagtagagacggggtttcatcatgttggccaggctggtcttgaactcctgacctcgtgatctgcccaccttggcctcccaaagtgctgggattacagtcgtgagccactgcgtccagcgggtttttcttttttctttttttttttttgagaaggagttttgctcttgttgcccaggctagagtgcagtggtgcaatctcggctcactgcaacctctgccttctggtttcaagcaattcttctgcctcagcctcccaagtagctgggattacaggcgcctgccaccacgcccagctactttttttgtatttttagtggagacagggtttcaccatgttggtcagactggtctcgaactgctgacctcgtgatccacctgcctcggcctcccaaagtgctgggattacaggcgtgaaccaccgcgcccgactgggtttttctttttaaggcagtgtcttgctctatttcccaggctggagtgaagtggttcactgcactctcaaccacccagactcaaaacaattctgcctcagcctcttgagtagctgagactataggcatgtgccaccacacctggctgagtttttggattttttgtacagacggggtttcaccacattgcccagactggtctcgaattcctgggctcaaacgatcagccctcgtcggcttcccaaagtgctaggactacagttgtgagccagtgtccctggctcatactttttttttttttttgagacgcagtctccctctgttgctcaggccagagtgcagtggcacgatcttggcccactgcaaccttcacctgccaggttgaagtgattctcctgcctcagcctcccgagtagctagactacaggtgcacgcccccatgcctggctaattttttgtatttttagtagagacgtggtttcaccatgctggccaggatggtgttgaactcctgaccttgtgatccgcccacctcggccttccaaaatgctgggattacaggcatgagccactgtgcctggccatactattgttaatatggtatttaatgtagtagaagagggattgtacttatcagatgcagttgtttgttgatgaaggagagctgtttgttaggttttctttttttttttttttgagatggagtcttgctctgtcactcagtctggatggagtgcagtggcacaatctcggcccactgcaagttccgcctcccgggttcacgccattctcccacctcagcctccggagtacctgggactacaggcgctcgccaccacgcctggctaattttttgtatttttagtagagacagggtttcactgtgttagccaggttggtcttgatctcctgacctcgtgatccacccacctcagcctcccaaagtgctgggattacaggcgtgagccactgcgcccggcctaggttttcagtatgtagagcggaacctccttaacaggaaggcagtactaatgtcttaacacttcagttacagtaacttttaacagatgtctactatggtttgattgatagcaaatccaaatttctcttataacgaattggtattaaaacaggcatactaggctgggcatggtggctcacacctgtaatcccagcactttgggaggccaaggcggcggctcacctgagatcaggagttcaagaccagcctggctaatgtggtgaaaccctacttctactaaaaatacaaaaaattagccaggtgttgtggtgcacacctgtaatcccagctacttgggaggctgaggcaggagaattgcttgaaccaggaggccgaggttgtagtgagccgggatcgcaccattgcactccagcttgggcaacaagagtgaaactccgtctcacaaaaaaaagaaaaacaaacaggcatactgaggtcggctgcggtggctcacacctgtaatcccaacactttgggaggctgaggtgggcagatcatcaggagttcgagaccatcctggccaacatggtgaaaacctgtctctactaaaaatacaaaactattagctgggtgtggtggcgtgcacctatagtcccagctacttgggaggctgaggcaggagaatcacttgaaccagggaggcggaggttgctgtgagccgagatcactccactatactccagcctgggagacatagtgagagtccatctcaaaaaaaataaataaataaaaatataaaactggcataataatgcatttgtgaaactgaaggggtcagagaagagattacttaccagaagtcttttttgcctttttgagacagagtctcactctgttgcccaggctggagtgcactggcatgatctttgctcaccgcaacccccacctcccagactcaagtgattctcccacctcagcctcctgagcagctaggactacaggcgtgcgccaccatgcccagctgatttttgtatttttagcaaagatcaggtttcaccatgttggccaggcacacctcaagtgatatacctgcctcagcctcccaaagtagtggtattacaaacgtgagccactgcacccagcccagaagtctttaaagcttataaatttacattaaagtaatatgggaaaaaaggtaatggtaaagaccataaacgtattactatataacccagcaatcccagtcctaggtatttactcaaagtgaagtaaaaactaatgtttacatagaagactatacatgaacatacaattacccccaaatggtaacaactcagatgttttattgttgttgtttgctaccacactttttttttttttttttttttgatggagttttgctctttttgcccaggctggagtgcaatggtgctatttcagttcactgcaacctctgcctcccaggttcaagcaattcttctgcctcagcctcccgagtagctaggattacaggcatgcaccaccacgcacagctaattttttatttttagtagagatgcggtttctccatgttggtcaggctggtctcgaactcccaacctcaggtgatccgccaccttggcctccccaaagtgctggaattacaggcgtgagccaccacgcctggccttttttttttttttttttaagtaaagatgaggtcatgctatgttgccaagctggtctcaaacttttgggctcaagcggtcctcccaccttggcttcccaaagtgctgggattataggcgtgaaccactgcacctagcacaaatgtttttcagctggtaaatggttcaacaaactgatacattcatacagtggaatactacttagcaaaaatagagacaaactatagtaatgatacatgctgtaatgtgaatgaatctcaaatgcactgtgctgaatgaaagaagccaaactcaaaaggctaagatactatatgattccatctatatgatgttctatagggacagaaaacaggtctctggttgccagggaatgggagaagggatgtataaagatgagagaattgagggatgatggaactgtagagtgtagatgatgggatatggagtggaacctccttagcaggaaggcagtactaatgtctttttttttttttttctttttgagatggagtcttgcactgtcacccgggctggagtgcagtgatgcgatctctgctcactgcaacctctgcctgccaggttgaagcagttctcctgcctcagcctcccgagtagctgggattacaggcgcacatcaccatgcccggctaattttttgtatttttagtagagacggagtttcactatgttggccaggatggtctcgaactcctgacctcgtgatctgcccgccttggcctcccaaagttctgggattacaggcgtgagccaccgcgcctggccagcagtactaatgtcttactttagttacagtaactcttttttttttttttttgagatggagtctcgctctgtcgcccatgctggagtgcagtggcgtgatctcagctcactgcaacctctgcctcctgggttcaagcgattctcctgcctgtagcctcctgcctacagtaacttttagcagatgtctgctgtgttttgattaatagcaaatccaaatctttgttataatcaattggtatcaaaacaggagtactagtgtatttgtgaacctgaaggagtcagagatgagattagatcttctctgtatcagagaagataaagatcttgactgtggtcgtggtttaaagtatttgtcaaactcatagaactatatgtgttagtatattagaaaagtatattagaaaggataaaatatatataaattatacctcaagtttgggttttttgttttgtttttttttttatagagactgggtctctacaagcaagcctcctaccttggcctcccaaagtgttgggattacaggtgtagaccaccgtgcccagtttacctcaggttttaaaacgactgtaaacacacaagtgttgatataatttgcatttggtccatagagttaacattttggtatgaaaaagcagagtatgatttcagtctttcaggaagttggtatgttaactctgtctagtgaaatgacaagagttaacattttatgagtgtttatcaacaagagagtcagttgtttaatctgagaaggtcatttctcattttagccaaggagggaggatatactcctaaaatagagactggaagaataaaacagatactttgtagcagtctattattttacagtctgtcttggcacttgatccataattgtatagcaccatcatcgttaaggaatattactactagtgtttattagctgtatcttctctcttttggcagaagggaaaaatgtttcagactagtaagccatgactcagttaggagccaggattctgtctgccgaggtttgaatcctggctctatcatgtaccagctgtgttactaggtaagttacacagcttgggtaagttacttaaactccttagtttcttggcctggtgtggtggttcacacctgtaatcccagcactttgggaggccaaggcgagtgaatcacctgaggtcagtagttcaagaccagcctgggcagcatgacaaaaccccatttctactaaaagtacaaaaattagccaggcatggctgggtgcagtggctcacgcctgtaatcctagcactctgggaggccaaagcaggcggatcacgaggtcaggagattgagaccatcctggctaacacagtgaaatcccgtctctactaaaaaaaaaaaaaaaaaaaaaaattagctgggcttggctggcaccggtagtcccagctactcaggaggctgaggcaggagaatggtgtgaacccgggaggccgatcttgcagtgagccaagattgtgccactgcactctagcctgggtgacagagcgagactccgtctcaaaaaaaaaaaaaaaaaaattgccaggcgtggtggtgggtgcctgtagtcccagccacttgggaggttgaggcagtagaatggtatgaacccgggaggcggagcttgcagtaagccgagatcacaccactgcactccagcctgggcgacagagcaagactctgtctcaaaaaaaaaaaaaaaaaaaaattagccaggcatggtggcattctcctgtagtcccatctacttgggaggctgaggcacggccattgcttgaatctgggaggtggaggttgcagtcagccgagatcgtgccactgcactctagactgggcaacagagtgagtctctgtctcaaaaacaataagagaccaggcatggtggctcacgcctgtaatcccagcactttgggaggtcgagttgggcggattacaaggtcaggagatcgagaccatcctggccaacttggtgaaaccccgtctctactaaaatacaaaaaattacccaggtgtggtggcacacccctgtagtcccagctactcgggaggttgactcaggagaatcgcttgaacccgggaggcggaggttgcagtaagccgagatctcgccactgcactccagcctgggcgacagagcaagactccatcttgaaacaaacaaacaataaaaaccaagaacaacaaaaaaatctcttttctttcattatctttaaatggtaatgatatcagttgttgtgaagattaaatatcagatgtttagaaaagtaccttgcattgggccgggtgtgggggctcacatctgtaatcccagcactttgggatgccaaggcgggcggatcacgaggtcaggagatcgagagcatcctggctaatgtggtcaaaccccctctctactaaaaatacaaaaaaaaaaaattagccgggcgtggtggtgggcgcctgacagctactcgggaggctgaggcaggagaatggtgtgaacccgggaggcagagcttgtagtaagccgaggtcgcaccactgtactccagcctgggtgacacagcgagactctgtctcaaaaaaaaagaaaaaagaaaagtatctggcatctagtgagtacagtataattgtggactggtattggtattagcagaaagcagagcaagtaaccttttgttgcgtttttgagtgactggactgagttgaggagacttcaagtgagaagggaaccatgtgacagagcaaatcttggttgtagtcatggcttacttactggtacttccttcttactgtcatttcgcttaaatgaccaggacaaggcagaggtggtgaattgggagaatagggcttgtgaaattaggattctggtgtagtggccagcacacttactgcttgttgtcacagactggattaaacactggacactttttttctggtttaagtattcaaaatataaaatgacctcagaaattacagtttgtaagcttattcaaaactgccccacaaatgccaattttaccattaaaatactaaaccggataaaacagtgactaggttacctttgtaaacatgtttcttaccagtcccagagaatcagtgcttctgttgtttagggtagaatcaggaacagtttggggatagcctccagtttggttccatttcctgtccaacttcagacatatattatccattgaaaaggtggggcagattttctaaacatttcttcagcatcttggaatcctagcagtcagtctgttcatgctgatagaagtccctgtgacaatgtcctttagttgaaaacacaaaaatataaaaaagatctagagagggtgggcattttattattcttggatattctttctctgttgaacaaaactgatgtgcctatttttgtcccattaggagctcttgtccctggcaaagcgaaagcgcagtgactctgaggagaaggagccgcctgtgagtcagcctgcagcctcgtcagactcggagacgtctgacagtgacgatgaggtgggtgtggagggcctcggcttctgggaccattagatagttgaggctcctcgctttggtggctcctgttggcctcatttccttaaatggagacttacagcctaagatctacaagaatttattggggaaagaaaatggtgtaaggaaggccgggcgctgtggctctctcctgtaatcccagcactttgggaggctgaggtgggtggatcacctgaggtcaggagttcgagaccagcctggccaacatggtgaaaccctgtctctactaaaaatacaaaaattagccaggcgtggtggtgcacgcctgtaatcccagctactaaggaggctgaggcaggagaattgcttgaactcaggaggcagaggttgcagtgagccgggatcgccccactgcactgcagcctgggtgacaaagcaagactctgtctcaaaaaaaaaaagaaaatggtgtaatgaaagctattgaatgtcatgttcattgtactgctagttacctagtgggtccctctgcaggacatgcgtagtcattctgtagctttttttttttttttcagccttattgcagaagtggtacagtcagtaatcctattttttcttttattttctttttttttttttcaagacagagtctcactctgtcaccaggctggagtgcagtggtgtgatcttggctcactgcaacttccgccttccaggttcacgccattctcctgcctcagcctactgactagctgggactacaggcacccgccaccaggcctggctaatttttttttttatttttagtagagacggggtttcactgtgttagccagggtggtctcaatctcctgacctcgtgatccacccaccttggcctcccaaagtgctgggattacaggtgtgagccactgcgcccggactctcttttttctttttgagtcatctttttaatctcactttcaagttagaaaataaattctatcaaggatgctgtagtttaatgggaaatactttagtgagaaaagaaactttgggaagattgattcaacatccctccgagtgatggtgttaacttcaaaggaggaaaatccaactgttcattgtctagaccaaggtcactttcccaaattacctaccaacaatggcaggccctaaaagatccaaaaccttaatggaagacagggatgaggggaaagatatttgaaacacttctacatgtttctcatttgatttatttattttattttatttttttgagatggagtctcactcttatcgcccaggccagagtgcaacggcacgatctcggctcactgcaacctctgcctctcgggttcaagcgattctcctgcctcagcctcccaagtagctggaactacaagcacgcaccacagtgcccggctgatttttgtatttttagtggagacagggttttgccacgttcgccaggctggtctcaaacttccgacctcagatgatccacctgccttggcctcccaaactgctgagattacaggcatgagccattgcacccagcctttcatttgatttaaagtattttcttccccttagtaattacttgcagagaagccggatatcacctttcagtgtaatttcttaccctacagcctaggaaaatatttgttaacagtaaagtaaaaaatgtttatttaatataatgaaatttaattagcagctgaatagtatttaccggtgccctgcatgtgcatattggagtgattgccttctgatcaactgtagtgataatttctttctttttttttttttttttcttgagactgcgtctcactctgtcacccaggctacagtgcagcggcgcaatctcggctcactgcaacctctgccttccgggtttaagagattctcctgcctcagcctcctgagtagctgggactacaggtgcgtgccaccacacctggctaattttttatttttagtagagatggggtttcaccatgttggccaggctggtctcaaactcctaacctcaggtgacccgcccccttggcctcccaaagtgctgggattataggcgtgagccaccgcgcctggcctcttttttttttttttttttgagacagagtctcgctctgttgccaggctggagtgcagtggtgcgatctcagctcactgcaacctctgcctcctgggttcaagcaattttcctgtctcaacctcccaagtagctgggactgcaggcgcatgtcaccacacccagctaattttttgtatttttggtagagtcggggtttcaccacgttagccaagatggtctcattctcctgacctcgtgatctgcccgcctcggcttcccaaagtgctgggattagaggcgtgagccctgtgcctggccaaaagtttattcttttgtttatttttaatggataaactataatttctctcaaattaacaaaaaatcagtggggggtctatgaaataatttgctttttcattttgttttctgttttctttctttaaatgcctagacaatacagaaaaaccttgaaataattttctctcccactagtcccctctttttttttttttttttttttgagacggagtctcactctgtcacccaggctggagtgcagtggcgtgatctcggcttactgcaagctccgcctcctgggctcactccattcttctgcctcaacctcccaaatagctgggactacaggcgcctgccaccactcctggctaattttttgtatttttagtagagacggggtttcaccatgttagccaggatggtctctatctcctgaccttgtgatccgcccgcctcggcctcccaaagtgctgggattacaggcgtgagccaccatgtctggcctctctcccactattcttatagctacttttatttttcatgtttcagaagtcagctgctgtggtccacccttgccactcagtattgtattaagtttgaatatgtgttatgcctggaataccctgtaatgtgtttgtggtctctggtattccttaagatacaagcagtaagtctgcttggaacacattcattctccatatgtctgttgttaaaagttaggtcagagtcctaacttttgcagttagtactgagattcccttcctccttttttagccaaagcattagaggagcccacaacttgtgttagaggagatccacatccataaaattcttcatggtttagggttccctttgttacttgcagctgcttaatgaagtaaaaaactgctcatcttagaacactacccaatgatttgtgcacgtattggagaaaaagctgacagcaagctccaccctgcccagcaagaaatgagcgtttgagtgacttttcccctacaggattcttagctcctgctgctgccttcagattctagtactccaggccctcaggcttattgtaactctactccagtccctctctcacgagagcagcagcgtctgtatcatggtcattctgaaagatgcctgtttttctgtttccatcatgtctctttggcccaagatactagcttagcacgagcacctctgagttagagcaaatagttcattattttggacagttcagaaaataactattaaaatctttattaaaaaattcttccagccactgtgtaactcaatgttattactgtgagctcaaacttattgctgctgtggacattttagattgggtaggggacttctgagagattcttaggttataaagtttgagacagtggctctttttttcccctttcataatgatttttttttttttttgagatggagtctctctctgttgcccaggctggagtgcagtggcgtgatcttggctcgctgtaagctctgcctcccgggttcacgccattcttctgcctcagcctcccgagcagctgggactacaggcgctcaccaccacgcctggctaattttttgtatttttaatagagacggggttttacagtgctagccaggatgatcttgatatcctgacctcatgatccgccggcctcatcctcccaaagtgctgggatcacaggtgtgagccaccatcataatgattattaatacgtctttcgtgggtgaaaaaacacatactgaagtagtttgctatgtcttctcgtttcttcaacttttgtgtctttaacgcctgcagattaaccttttagaaatttggttgttaaagtggcaattctcgggccaggcatggtggctcacacctgtaatcccagcactttgggaggccaaggcaggtagatcacttgaggtcaggagttcgagaccagactggccaaaatggcgaaaccctgtctctactaaaaatgcaaaaattagccaggcgtagtagtgggcacctgtagtcctagctactcgggaggctaaggtatgaaaatcgcttgagcccagaaggcagaggttgcagtgggccgagaacgctccactatattccaggctgggccccagagtgagactgcatctcaataaaaataaataaattaaataaagtggcaattttccatcagaggaagccctccttgtaccagaagctgccctgcagttttttcaaacttatatatgtctctcataccgtttcttttcattagtgagccattaatataggtagaaagaaatacgtttgtcccctcagatttgctaggacagaaaattggtcaagaacaactgagctaaaaagttaatcggtaatttgtttataaaatcagagacatgcactgattttagagcaaaaagatatttagctaattgatgagggagagggaaatggagagaagctctgaaagttttctatcctgaaaaaaatgggtacactggacattcagtataatgtcatattagtgaggaaataagtagatgtttcacatataatgtagcttggtggggggaaacaccaacatttaatgacagagtatatacttgtcctattatttttagtgattgaattattctcgatatctggaggcacatgtaaaactaagaagcaaggctgtttgtaagatttacattggccaaggtcaaggtcagaatgctgtggtgtggcactttgatgctgtcacttcctctccttgaaagcatttgatcagagaagcatcatcaaaggttcaaacaagagtgattggaagggaagataacaaggtgaaaaggaggggagctagcagccattcaatcatgagttggggttaaaaaaaaaaacggccagcagggtgtggtggctcacacctatagtccagcaatttgggaggccaaggtgggaggattgcttaagctgggaagttcgggaccagcctgggcaatatggcaaaaccccatctctactaaaaatacaaaaattattgtagctagaggtgcaataatagaaaaattgggccgggtgcagtggctcacgcctgtaatctcagcactttgggaggccgagacaggcagattacaaggtctggagctcgagaccatcctggctaacatggtgaaaccctgtctctactaaaaatacaaaaaaattagccgggcgtggtggcgggcgcctgtagtcccagctactctggaggctgaggcaggagaatggcgtgaacccggggggcagagcttgcagtgagccgagattgcaccactgcactccagcctgggcgacagagcgagactccatctcaaaaaaaaacaaagaaaaagaaaaattaaaaaaaaattttttttaatacaaaaattagtcaggtgtggtggtgtgcatctgttaccccagctactcaggaggctgaggtgggaggatcacctaacctcaggaggtcaagggtgcagtgagctgtaatcatgccactgcactccaacctgggcaacagattgagactctgtctcaaaggaaaaaagaaaaatacttgctagatttttttttttttgagccagagtcttgctctgtcatccaggctggagtgcagtggtgcaatctcagctcactgcaacctccgcctcctgggctcaagagattctcctgcctcagcctctcgagtagctgggattacaggcgcctgccaccacgcccggctaactttttgtacttttaatagagatggggtttcaccgtgttacccaggctggtgttgaactcctgagctcaggtgatccgcctgcctcgggctcccaaagtgctaggattacaggcgtgaccatcgcggccggcccgttagatattatatgtagtagtttttctgttgatttaaagccatgattacgaataacagttcttgtactgtgaaaaaatgtcttccaaaatatccagctgtgtggtactgctttatacagcttcctttttcctctgttatattggtaagaagtgaccattgtgctcttttcttggtaatgtcttctataacacttccaacttactgcatattttctgtcgtggggtcaggaagccagggaatgccatagagtttaggctggaatactgcgctttagtacttgaacttagtgacagctgtttagattgctcatgagctttatttttattttattttatttatttatttatttttttgagacggagtctcggtctgtcgcccaggctggagtgcagtggcacgatcttggctcactccaagctccacctcccggattcacgccgttctcctgcctcagcctccctagtagctgggactacaggcgcccaccaccaatgcccagctaatttttttttgtatttttagtagagacggggtttctctgtgttagccaggatggtcttgatctcctgacctcgtgatccacccgcctcagcctcccaaagtgctgggattacaggcgtgagccactgcgcccggcctcatgagctttatgttttacatattggctcttaactgtgtagacaaatagacagtaacaccttatctttctagacaccattaagatctcgttgcaagaattaggaataaggtgattttcatggactagttaattgctcaaatgtattttcaagaaattccgacactcccaacctaacagtgtaatgtagtattaattatattgttcattttttggtatcacttctgttttgtttgtgcttttgtcttcataactagactgcaagtttttgtgattgagtgcaaggattctctatgctttccagttaaatgtatgtgattgcttgatgatgaaatacaatagtgtcttttgtactttatctgattacacagtagaaaggaaaagaaagctaagaaagctaagctattcttcatgtcttcaggctgacattaaattgcatttactgcctcctgtcagttgggattaaaaaaaattgcatttactcttcaactcctgaccccattttttttttttttttttggaaacagagtcttgctctatcaagagggctggagtgtggtggctcaatctctgctcactgtaacctctgcctcctgggttcaggcaattcttgtacttcagtcttccaagtagctgggattacaggcgcatgctaccacgcccagctaatttttttgtatttttagtagagacggggtttcactatgttggccaggctggtctcgaactcctggcctcaagtgatctgtctgcctcggcctcccagagtgctgatcccagcacaggtgtgagccaccacacccagcttcctctgactctttttttattttcagaaaaaaacacctaaatcaggaaccgtgccctctcaaacacatcttttttgtggccattgtcagtatctagaataatgactatagaacttttcttatgattagtttgactcagaataacattcagttcatatggaaacctacaatgttacagggtcttagagatcatctgaactttttttcccccacagatgagagaacagactcacagaaattctcatttttggccaggtgcggtgtcttaggcctgtaatcccaacactttgggaggttgaggcgggcggatcacgaggtcaggagatcgagaccatcctaacccagtgaaaccccttttctactaaaaatacaaaaaattagccaggcgtggtggcgcacgcctgtagtcccagctactcaggaggctgaggcaggagaatcgcttgaacccaggaggtggaggttgcagtgagccgagattgtgccactgcctgggcaacagagcaagactccgtctcaaaaaaaaaaaattattttcataaaatagtacctcacatgtatgtagaacttcctggtttctagtgtgcgctaaaacttgtcttattctctctccttttagtctcacactaccctggtaggtggtcaaggcagtgttattattcctactttacagataaggagatactctctggttagaggcttgggctctatcccatttctttagaccctaatcccagtgtagtttgtcactagcccagctgttatttttttttttttttttgagacggagtctccctctgtcacccaggctggggtgcaatggcacgatcttggcttactgcaacctccacctcccaggttcaagcaattctcctcccttggcctcctgagtaactgggattataggcgcccaccaccaggcctggctaatttttgtatttttagtagagtcagggtttcaccatgttggccaggctggtcttgaactcctgacctcaagtgatccacctgcctcagtctcacagaatgttgggattacaggcatgagccaccacgcccagccccagctgttattcttgaaccttacttactgaaaggtattttatttcacttgtaaattcagttcagagtcactgggttggaatggtttctatgctgggtcctgagacctaggaatatgggtattccttgctcattagagataatttgctctctgaaatcttgaagtttctttactttcctgccttcatcatgctcaaaatactcagcatctcaatgccaccctattccagagcaaccagtccccgccttgtgtttcttcccatctttcagttgcgtgcccagaaggatagctgcttcacagaatggggacctgcttataacattctatacacactcagcgtgacatgggggaatatagtactcaccttccttgtttcactaggtaattgttgcccattaaaatacctgttacatcagtgagagtcaaactgctgatctctgttattaggaagaaaacatattccatccagtctctttttaagttttcttcattgcatatttacaaaatacttttctggtgttctgtggggttgcatacatgtacacctaggaaagcaggatgtcagtgtgtacaagagtcctgacaatggatcctttcctttacccagatggtttttgagcagtggtcattgggagatcctctggcctctgtacttggttcagatgcacaccggtgggtgctcattttctcattcttggcttatgtttggtgcatttgagggcagtttgaaggttataacagagcttacctttcagtagaaccatacttctcaaaacagattaagaagtgcaaggtcattttctctacttccttctggatggggaaagtataagagcatccctttaattctttcctttattctttagatcccatttactactacatcctggtgaaatcattcattttccctctgtctcagaatcaggtgaataagatttttgcagggatgggtgagccatctctggactaatagctggattaagatatttccatatcaattctgcttagactctgttcttgggagaagaggtacagagcaaatattttaagtgtgtgcttagacaaaaaagcattcaggaatctctcgtttatgggagtaaatgatctattcttgagaaaaaaaatctttgggagattattgggacctatttgtgtctctttccctgaattaaataagaataatactgagactggcttccagattttttaagtgatcatttatcattgagtggtggctatacaggtgattaaaaaaataaaatttaaaaaaatgggaaatgttggccgggaacggtgattaacgcctgtaatctcagcattttgggaggccgaggcaggcagaccccctgaggtcaggagtttgagaccagcctgaacaatatggtgagagaacagactcacagcaattctcattttcgcccgggtatagtggctctactaaccctgtctctactaaaaatacaaaaattagctgggtgtgggggcaggtgactacgttcccagctactcgggaggctgaggcaggagaatcccttgaacccaggaggcggaggttgcagtgagcctagatcacgccactgcactccagcttgggtgacagagcgagactccatcttgaaaaacaaaacaaaacaaaacaaaaaatagggaatatttcacgaatttgcatgtcatctttgcacaggggccatgctaatcttttctgtattctaattttagatatgtgctgctgaagcgagcagagattatttttttaaaattaatttttatattaaattaaattaattaatttatttatttgagatcagctctcactctgtcacccaggctggagttcagtgtcgtgatcttggctcactgcaccctggacctcgtgggctcaagccattctcctaccttagcctcctgaatagctgggactataagcgttcgccatcacgcccagctaatttttgtattttttgtaaagactaggtttcaccatgttgcccaggctagtcttgaaccctgagctcaagcaatcagcctgcctcggcctcccaaagtgctaggatttcaggcgtgagccactgcgcccagcctattttattttattttttttgtccctgttgtggaggcaggtgaatttttttttttttttttttttgagacagagtctcgctctgttgcccaggctggagtgcagtggtacgaactcggctcactgcaagctccgcctcccgggttcacaccactgtcctgcctcagcctcccaagtagctgggactacaggcgcccgccaccatgcccggctaatttttttgcatttttagtagagacggggtttcaccgtgttagccaggatggtgtcgatctcctgacctcgtgatctgcccagccggcagcaggtgattttttaaattaaaaaatatatttccttaaatagaggtggggtcttgctatgtttcacagggtggtctccaactcctgtgttcaagtgatcctcccactatggcctcccaaagtgctgggattataggtgtgagccaccacacttggcctggtgatttttttttttccccaactttacaaatacttttctggttgtgcactgtggtgtgtttctctagtaatagctactcaggaggttgaggcgggaatatcacttgagcccaggagtttgagtacagcctgggcaacatagtgagacctcatcataaaaacgaaaagaaaacaaaaagcaaacaacttttctatatttttaaggcctaatataatgaacatttattattattaaaattatattttaaagttttattaaaaataaaatacaggctgggcgcagtggttcatgcttgtaatcccagaatttgggagactgaggcaggagaattgcttgaacttaggagtttgagactagccttggtaacatagtgagacctcctctctacaaaaagttaacaaattagccaggtatagtggcatgcacctgtaatctcagctgctcaggaggctgagatgagagaatctcttgagcccagtaattcaaggctgcagtgagctatgatcatgccactgcattccagcctggtcaacagagcaagacccagtctcaaaaataaaaaataaaatgaaataaaacacaaagtaaatatacaagtagcggcactccaacttctcagtactgtaagatataagaagttttaggccaggtgcggtggctcatgcctgtaatcccagcactttgggaggccagggcaggcagatcgggagtccaaggtccagcctgaggttgggagttcgagaccagcctgaccaacatggagaaaccccgtctctgctaaaaatacaaaattagccgggcgtggtggcatatgcctgtaatcccagctactcgggaggctgaggcaggacaatggcgtgaaccggggaggcggagcttgcagtgagccaagattgcaccactgcactccagcctggacgacagagtgagactccgtctcaaaaaaaaaaaaaaaaattatcttccttgaaatgattaaaatgtgaaatggttgaaaactcagacttaaaagggaagcattagggctgtgcaaggtggcttgtgcctgtaatcccagcactttgggaggccaaggctggaggattgtatgagtctaggagtctgagaccagccttagtgacatagcaagaccctgtctctacaaaaaaatttaaaaattagctgggcatgatggtgcacacctgtagtcccagctactcaggaggctgaggtaggaggatcacttgaacctgggaggtcaaggctgcagtgagctatcatcctgctgccctgcactccagcctgggtgacaaacgagaccctggctcaaaaacaaaaaaaaagattaaaaatagcacccttttacaatgttttgtgaaggtaaactagctgactgttgttcttaagaatagctcatatggaaaatttctaagttggaaacatcttcagaactacacctctacccaaccccaccccctcaaaaaaagatcaaaagaatttacttcttctattacctattgtgaaataggaggttaatttctcatcctattatagaaggaacaaagactttgtgcctttgttggatattagatgtagaaatattacgttaataccagacttaatattcagtctgtgataatcaaaagatgattattctttatggtaattagaataaagtttctgagtaaagtatttttcacctaaaatcattttaagttggcaagttaaaatatcgaaggagatatggtttaatgtaactaaatagtctgcaaatttgtaaagtggttgtatggcctttcaacttataattaaagtgcttgatgaagatggttttttggccttggggtagttaactgtattgcctgcctgtttgacagtgcaaattacaggttccttatgtcttgatttctgggatttcctgtttctgatccagtttaagtgtcatgttattgtgtaatatatgccaatgttttaaaaagtatatgcacatatatttaatgatgtactttactttctgcctctttggagttagtgccagtgctgccattcatgccaaagaatggccttcatcctttctcactgtgctttctgcagttttctcctgggcacaagctacattcactgccttcctgagacccaccccagaactaaaccattctctgtactgaaacccagacatatcagccattaacaattactgccatctctgccacataaaacatcagaagtgttttttgacttgccataaagttgatatcttttctgttttctattggcaataaaacatacatgagctgggtgctgtgttgcgcacctgtagttccagctacttaggaggctcaggtgagaggatcacttgagcccaggagttcaaggccagcctaggcaacatagcaagaacctgtctgaaaaaaaaaagaaaaaataataattaaattatatgtttattatgcaacttttctcttgtttctaagagattccagaccagaagttctaaagttttaagcaagttttcaaaaatctaggctggggccaggcacagtggctcacacctgtaatcccagcattttgggacgccaaggcaggcaaattgcttgagctcaggagtttaagaccagcctgggaaacgtggtgaaaccctgtctctacaaaaaatacacagcttagccgggtgtggtggtacacgcctatggtcccaactacttgggaggctgaggcaggaggataagttgatcctgggaggtcaaggctgctaagagcccgagatcgcaccactgcactctagcctgggtgacagagcgagaccttgtctcaaaaacaaaaatctatgccaggtgcagtggctcatgtctgtaatcccagcactttgggaggccgatacaggaggattgtctgagctcaggagttcaagaccagcctgggcaacatagtgaaaccccgtctctacaaaaaatacaaaaattagctgggcgtggtggggcacacctgtagtcccaactactccagaggctaaagtgggaggatggcttgagcctgggaatcagaggttgcagtgaaccaagactgtgccactgcactccagcctggacaatagaatgagaccctgtttcaaaaaaaaaattttttttttcaaaaatctgtattttttttcatatgaagtgtatttgttttggattcaaagatgaatgccagagactcttaactcttgagtcttccagcttttcccaataaagtccctattcctatttcagtcttcctttttcttttctccttatagtggacatttgggagcaataaaaataagaagaaaggaaaagccagaaaaatagagaagaaaggaaccatgaagaaacaggccaacaaaactgcctcctcaggcagttcagacaaagacagttcagctgagagctcagcccctgaggaaggtgagctgagcagcctagacctggaaggtcaactcccactcttgtcagcttgaaggtgcaaaggcagaagtggggaggaaggggggtacttgcattcagcatgacctcttctttagagcagtggttcttaactttttccatggtcatggatgctttgagaatctgaatgaagcaagaaaaatgcatgcaattccaaaggttggtgagacccctgaaacctatccctggaacccacgaggattcctgcattagtcttgaataccctgagtgcctttccctcccctttttttcttgcttatgcatagtctgactgaggagggaatctcagtagaaaatgttccttttctggaagccaattccagaatttttcaacactagtttgaaaagtgaacttgggccaggtgcaatggctcatatttgtaatctcaacactttgggaggccaaggtgggaggatcgcttgagcccaggagttcaggactagcctgggtaacatagtgagatcccatctctacaaaaaaatttaaaaattagctgggtgttatggtatgcacctgaggtcccaactacttaggaggctgaggcgagaggcttgcttgagcccaggacttcgaggttactgtgagctatgatcacaccactgcactccagtgacagagcaagaccctttctcaacaacaacaaaaaaaagtaggaaaaaaaaaaaagaaaaatgcagggacactggaagagaaaatagaagtgaacttgttccaggactagaatgataacctgtaaattataaaaattttaaaaacatttttaaaaataatgtttacataaaagctgactttataaaattggcctaacccggttttgagcacatgcctatgaatgttagctcaaattgagtcaagggcagttcctgttaaattgctgacttagttcaatactcattgtactcacatactttttccatgccaacatttgtcctgttaagatctactattatgataaattcactaatcaatttttaattgttcattaaaatgtgtttttttattttttatttttttaatttattatcgagacagagtttcgctcttgttgcccaggctggagtgcaatggcgcgttcttggctcactgcaacctctgtgtcccggggttcaagagattattctgcctcaagcagctgggattacagatgctcaccagcacacttagctaattttttatatttttagtagagatggggtttcaccatgttggccaggctggtcttgaactcctgacctcaggtgatccacctgccttgtcctcccagagtgctgggattacaggtgtgagccgccacacccggccataaaaaaattttttttttaatgccagctaataaataaaaaagaaattatagggttagaagaatcaccacttttcaatcatagtgataaagttgatttactcaagaatcctcaatgattgttaaaaccactgggtgagagtttgttggaaaacaaaattatatagtcttaaaccttctgcctatacatactattacacaaagaggaaaaggtgcctttacaaagggaaaatctgggagacaccacctttaccaagtaatccaaattaaaataatgggacaaacagatgttagggcttcctgatgtgatacattgaaaaggacacaatcacttatggagtattcttgccaaaaattcataacctgaattgtttcttaacaaatcaaccaaaccaaatgaagtggacatttgataactgttgctatttcaacttaaattaactaaaaagtcatgtttaaaatttagtttttcagttgcactagccacatttgagtttgtgaatacccatatgtggtggctgctgttcagatagacaaaattttcatcaccacctcacagaattctactagacaattttttggggcttatactcttcaaaaattcagtgcaccaacaagtggataaagaaaatgtgtatgtatgccagccgggcatggtggctcacacctgtaatcccagcactttgggaggccaaggcaggcggatcacaaggtcaggagtttgagaccatcctggccaacatggtgaaaccccgtctctactaaaaatacaaaaattagctcagcatggtggtgcctacctgtaatccctaatactctggaggctgaggcaggagaatcgcttgaaccagggagttggaggttgcagtgagccgagatcaccccactgtactccagcctggtgacagagtgagactctgtctccaaaaaaaaaaaaaagaaaatgtgtatgtatgccatgggatattagccacaaaacggaatgaaataatggcctttgcagcaacttcagtggagctggaggccatttttctaagtgaagtaactaaggaacggaaaaccaaatatagtatgttctcatgtataagtggtgtttaagccatcaggatgcaaaggcatagaatgatataatggggccaggtgtagtggctcacgcctgtagtcccagcactgtgggaggccaaggcaggtggatcacttgaggtcaggagtttgagaccagcctggccaacacagtgagaccctgtctctgctaaaaatacaaaaattagccaagcatggtggtgcgctcctgtggtcccagctactcaggaggctgagccccaagaatcgcttaaagaggaggttgcagtgagccgagatcaggcaatagagtgagactctgtctccaaaaaaaaaaaaaagaatgatataatggacattggggacttggggagggagtgagggttaaaagagtacatattgggtacagtgtacactgcttgggtgatagatacaccaaaatctcagaaatcaccactaaagaacttatccatgtaatcaggccaggtgcggcggctcacacctgtaatcccagcactttgggaggccaagacggggatcacctgaggtcaggagttcgagaccagctggaccaacatattttcatctttactaaaaatagaaaaattagccgggcgtggtggcatgtgcctgtagtccctgttacttgggaggctgaggcaggagaattgcttgaacccgagaggtagaggttgcagtaactgagatcagcctaggcaacaaaagtgaaactccatctcaaaaaaaaaaaaaaggctgggcgcagtggctcatgccagtaatcccagcactttgggaggctgaggtcggcggatcatgaggtcaggagattgagaccatcctggctaacatggtgaaaccccatctctattaaaaaaatacaaaaaaattagccaggcgtggtggtgggcatctataatcccagctactcaggaggctgaggcaggagaatggcatgaacccgagaggcggagcttgcgctgagtcgagatcgtgccactgcactccagcctgggcgacagagagagactctgtctcaaaaaaaaaaaaaaagaactgctgggggccaggcgcagtggctcacgcctgtaattccagcactttgggaggccaaggcgagcggatcacttgaggtcaggagttcaagaccaacctggccaacatggtgaaaccccatctctgctgaaaatataaaaattagctgagtgtagtggtgagcgcctgagctactcgggagtctgaggcaggagaactgtttgaaccggggaggtggagatggcagtgagccgagatcgcgctgctgcactccagcctgggtgacaagcaaaaactccatctcaaacaaaataaataggccgagcatggtggctcacacctgtaatcccagcactttgagaggccaaggtgggcggatcacgaggttgagagatcgagaccatcctggccaacacggtgaaaccccatctctactaaaaatacaaaaatcagctggacgtggtggcgtgcacctgtagtcccagctacgcaggaggctgaggcaggagaatcgcttgtgaaccagggaggtggaagttgcaatgagctgagatcacaccactgcactccagcctggggcagagtgagactccgtctcaataataataataataaataagatggggccaggtgtggtggcttacacaggcgtaagcctgtaatcccagcactttgggaggccaagtcaggaggattgcttgagcccaagagttcgagaccagccttggcaacaaagcgagaccccaattctatttaaaaagtaaaaataaataggcgcagtggctcacgcctgtaatcccagcactgggaggccgaggtgggcagatcacctgaggtcaggagttcgagaccagcctgaacaatatggtgaaaccccgtctccaataaaaatacaaaattagctgggtgtggtggcacacatctgtaatccctgctacttgggaggctgaggcaggagaatcgcttgaacccgggaggtggaggagctgagattgtgccactgcactccagcctaggcaataagagcaaaactccatctcaaaaaaaaagtaaaaacaaataagtaaaataacaaactggtttcttactgtagctgaaagaagggtgatgttgtcaacattgtggagccgcttgtggcctgtcttctgtagcatagtgtaatcttgtgtttgggcctttgttgcaggtgaagtgtcagactctgacagcaacagctcctcttccagttcagattcagactcttcctcagaagatgaagagttccatgatggctatggagaagacctcatgggagatgaggaagacagggcccgtctggaacagatgacagagaaagagagagagcaagaactgttcaatcgcatagagaagagggaggtgttgaaaagaaggtaaggttgtcctcgtcgttgtcccccccccgcccccaccttttctgttcatctcttttctcatacttccctgtccttcacacctgacctacacatggagactggcatttggaattgactgttaacatgatgagacgcaagtgatgtattaaatttcaatcacattcattatttactcagtgccactggctttgtttactaatgtacgttattcagaaggttttattcataagacattatttatgtgcactatttaatcttcacaactgctctgtgaagttggttataccatattacagaggtagacgcttaggcttagagacattaggtaactaaagagtaagctgcatgaagggagagactttgtccttttcgccactctattcttagtgcctagaacagtacctggcacagagatatgcactaaatactagttgagtgaatgaatgaagaaacttgcccaaggtgatttagctggtaagtggtagaactggatttcaaacctgggaccatctgacaccataaaacacgctgtggccatatcctctcctgcgtcacatttcctgtcattttacctattctgtaacaccgcactacaggcagcattctaaagggaattacatactttgggaggccgaggtggacggatcaccagagatcaggagttctagaccagcctggccaacatggtgaaaacccatctctactaaaaatacaaaaaaattagcctggtgtggtgttgtgcacccgtagtcccagctactcaggaggccgaggcaggagaattgcttcaacccaggagatggaggttgcagtgagctgagatggcgccactgcactctagccttggtgagagcgagactctgtctcaataaaaaataaaaataaaaataaataaataaaaggaattacaggccaagtgtggtggctcacactggtaatccctgcactttgggaggccaaggcgggcggatcacttgaggtcaggagttcgagacctgcctggccaacatggtgaaacccatctctactaaaaatacaaaaaattagccaagcatggtcgtacgcatctgtaatcccagctattcgggatcctgaggcaggagaatggctggaacccaggaggcggaggttgcagtgagccaagattatgccactggactccagcctgggcgacagagggagattccgtctcaaaaaataaaaaataaagggaattacaggcctggcgcggcggctcacacctgtaatcccagcactttgggaggctgaggtgggtggatcagttgattccaggaattcaagaccagtcatggcaacatggcaaaacgctctctcctacaaaaaatagtcaggcatggtggcccatgcctgtagtcccaggtacttgggaggctgagtcagcaggagtatcatttgagcccggaatgtagagtttgcaatgagctgagattgcaccactgcactccagcctgggtgacagagtgagaccctgtgtcaaaaaaaagggaggggaattatagagattgtttttgtcttgataaagatcagtacgtgatttgatttctactgagcaaaaagtattgaagtaatcataagattgcgttggttttagaacatgaatacagtaatgattgagagtaatatgggaacacatcaaatgatatgtaaaaattaaatgaacaaatggtgttttaaagctttatattttacaaattggcttcaaattgttcacgctcctaggttgaaataattttccaaaattcatatttggagccctgtcttcacaggattcaagacttggaatttctcctcattatgtacaagttaggtatctgactatcctctagcatggtttttgtatttttttaaaaagtcaagtgttaaattactttttgatatttagaagctgcttcaatgttttgaacttttgccatattttaaatggaaaagttttaaatatggcagtagttcttccttatctcctaacagaatttcaaggtaaaaataaacttggcttttgtcttggaaataaaatagccctcagaacaaggatcctacctatttaatcttatgaaaggagaatagaagcattttctttggcagcacttagttccttttcatctgggagttttgtttgtcccttctggagaccatattaagtatgctgagttatcctagagaagaatgtttggctttcagtcagcagcaagcaatagacatttgatttttgtttttgtttttgttttttttttttttttttgagacagactttcattcttgttgcccaggctggagtgcaatggcacgatctcggctcactgcaacctccacttcctgggttcaagtgattctcctgcctcagcctcccaagcagctgggattacagacgcccgccacaacgcccggctaatttttgtatttttagtagagacagggtttcaccatgttggccaggctggtctcaaactcctgacctcaagtgatccacctgcctcagcctcccaaagtgctggaattacaggtgtgagccaccgcgctcggcttcaacatttgttttgagtgtgaatccttccaagtttacctatattggaacaaataggacttaataaactgtgctggagttaccagatggtttaaaatttgtatatctgaactgtggaaagcatagtaagatgttgtcgtgtaaggccaataagtcctatgacaaaatcacaaagtagctcaagggtaataggtggcttgtctcaaacttagtttttatgtttttcaccttacgtgaatgagacagttgactgattcagtgacttcttaaaaaaaaattttttttttttttagacagagtctggctttgttgtccaggcaggagtgcagtggtgtgaactcggctcactacaattgccacctcctggattcaagccagcctcccacctcagcctcccaagtagctgggactacaggctgtaggctaccatgcctggctaatattttttcttttttttctttttttttttttttgagatggagtctcactctgttgcccagggtggaatgcagtgacacgatcttggctcactgcaacctccgcctaccaggttcagtgattctcctgcctcagcctcctgtgtagctgggattacaggcatgcgccactatgtcaagctaatttttttttttttttttgagatggagttttgctcttgttgcccaggctggagtgcaatggcacaatctcggctcactgcaacctctgcctcccgggttcaagcaattctcctgcctcagcctcccctgtagctgggattacaggcgcccaccaccacgcccagctaatttttgtatttttagcagggacggggtttcaccatgttggccaggctggtctccatccacctcctgacctgagatgatccacccgcctctgcctcccaaagtgctgggattacaggcgtaagccactgtgcctggccaatttttgtattttaagtagagacagggtttcactatgttggccaggctggtttccaagtcctgaccttaaatgatcctcctgccttggcctcccaaagtgctgggatcacaggcgtgagccaccacaccggcctggctaatttttctttctttttttttttttgagactgagtctcgctctgtcccccaggctggagtgcagtggcgcaacctcggctgactgcaagctccgcttcccgggttcatgctattctgcctcagcctcccaagtagctgggtttacaggcgcccgccaccacacccagccaattttttgtatttttagtagagatggggtttcaccgtgttagccaggacggtcttgatctcttgacctcgtgttctgcctgccttggcctcccaaagtgctgggattacaggtgtgagccaccgtgcccgccggcctggctaatttttcatattggccaggctggtctggagttcctgacctcaggtgatccacccacctcggctttccaaagtgctgggattacaggcgtgagccacctctcctggccctgtaatttttttttcttttttttttttttttagagagggggggtttgccatgttgcccaggctggtcttgaactcctggcctcaagcaattcgtccacctcggcttcccaaaatgctggggttacaggtgtgaaccaccacccccagcttcagtgactttttttagtgactataagaatggtttagtgtgctgattattaagacagaggttcagagccatcatagaaaattgatattttagtagttcgtttgtttagcttcagggcagtgcaatatggaaactctggaatttcctgaatcttttttactttaaaagctctttatatggattgcatttaatctttgtagtcttttttatgtaagcaccattagcatcctgttctctagccagcagcaccagtagtgagatgtcattttcagttgttagattattcatgggggcaggaagcataaaaggtagcctggttgtagaaagggcactgacattgcagttagaaggtctaggggtcaagtcagactcgctggaggggtgatcggagttaaatcactttctcttcctgcctcagcttcctcctgggggttgttgtaaacctcaagagagattatatacataagaacattatgtaaatgtaaactatcactaactctaaaaaataactttgtttaaaataacccacttaaagtgtataattcattggtttttatatgtccacagagttgtgcaatcatcaccacaattaattctagagcattttgtcactcctgtatttccccataagcctcccagccctaggcaaccactaatctcctttctgtctctctagatttgcctattctggatatgtttattattattgttgttgttatcaagacagggtctcgttctgtcacccaggctggagtgctgtggcatgattatagctcattgaagcctcgacctcctgtgttcaagcaatcctcccacctcagcctcccaagtagctgggactataggcgtgtgccaccacctggccaattttttaaacttttattaaagaagaggtctcgctatgttgtccaggctattcttgaactcctagcctcaagcagtcctcctgccttggcctcccaaagtgtttagattacaggcattagccaccatggccgacctggatattttatataaatgaaatcataatatgtagtcttttgtgactgacttctttcacttagtatgtttttgaggtttatccatttagcatgtattagtacttcactcctttttatgtctgagtaatattccattttatgtatataccacattttgtttatctgtccatctgttgatttatatttgtggtgtttcctcctttttgctattgtgactggtgctgctgtgaacgtttatatacaacaatttgagtacctattttcagttcttttgagtgtatactggaaagtagaattgctggctggtacggtaactctttctaactttttgagaaactgcagctgcatcattttagatttcccatcggcaataagtgtactagtttctccacctcttcactaacactttaacacttgtcttttcctttttttgttgttgttgagacagggtctcactctgtcgcccaggctagctagagttcagtggtatgatcatggctggctgcagcctcaatctcctgggctcaagcagttctcccacctcagcctgccaagtagctgggactacaagcatgtaccaccatgtccagccaatttttaaaatttttgtagagacagggtctcaccatgttgtccaggctagtctccaactcctggactcaagtgatcctcctgccttggcctcccaaagtactggaattacaggtgtgagccaccgtgcctggcctccctttttgtgataatagctatcctggtgggtgtgaaatggtctttcattgtgtgttttttgttgttgtttgtttgttgtttgttttcaagacggagtctcactctgtcgccaggctggagtgcagtggcgtgatcttggctcactgcaacctccgactcctgggttcaagcaattcttctgcctcagcctcccgagtagctgggattacaggcacatgccaccatgcccagctaatttttgtatttttagtggagatggggtttcaccattttggccaggatggtctcaatctcctgacctcgtgatccgtccaccttggtttcccaaagtgctgggattacaggtgtgagccactgcaccgggcctgtttgtttgtttgtttattttttgagatggaatctcactctgtcgcccaggctagagtggcgcagatgagtacagcaataccctatatatgttctctttctctctctttttttttttttgaaacggattcttgctctgtcgctaggctggagtgcagtggcgcgatcttggctcattgcaacctccctcccggattaaagcgattctcctgcctcagcctcccaagtagctgggactacaagtgtgcgccaccatgcccagctaatttttgtatttttagtagagacggggtttcaccatgttggccaggatggtctcgatctcttgatccccccgcctcggcctcccaaaatgctgggattacaggtgtgagcccctgtgcctggcccgtagtctctcattttaaacatattccaacttaatgctatcaaatattttatattttgttgtaattaacatattaaatatttttaatgtacttaaaaggtacaccagagtttcttgcaggaaagccaaaatatctattagctcctttcccttagttcctttctcctatctaatagaaatcagtttttatatacatttcattgctacttaaaaaccaaatatcttttaaccagatttgaaatcaagaaaaaactaaaaacagccaaaaagaaagaaaagaaagaaaagaagaaaaagcaagaagaggagcaagaaaagaaaaaactgacacagattcaagaatctcaggtaggagattcagtgttcctcattgtccaaagaataaacctgttttgagtgtgtgtgtgtgtgtgtgtgtgtgtgtgtgtgtaaaaggtggatttatattaatcagcctaagtttataagacttgtgacatggtttcattaatctctggacatatcaccattagctgtgctgttaaatccttagcactttttcctttgctttcctttttccttttcttttttctttcttctttctttttcccttttcttcccctcccttcctccttcccccttcccttcctccttcccttcctcttccctttccctggtctcattatgttgcccgggctagaatacagtggctattcactggcacagtcataacacactgaagcctcaaactcctagtctcaagcagtcctcctgagttgctgagactacaggcatatgctaccgtgcccggctttcactgaagtctgcatttaaaaagcagccctcaactgcagtgactcacatgtgtaatcccagcactttgagaggccgaggcagacagatcactcaaggccaggagtttgagaccagcctggccaacgtggcgaaatcctgtctctactaaaaatacaaaaattagcctggcgtggtggcttatgcctttaatcccagctactcggggggctgaggcacaagaattgcttgaacctcagaagcggaggttgcagtgagctgagatcatgccatggccctccagcctgggcagaagagcgaggctctgttttaaaaaaaaaaagcagcccactagtgagtgaccatcccttaaggaaaagttggtaaacaacctgtcctaggtagccagatgcttatgatgtttacttagatgtatatcatcctttacttggtataaatatagctgggaaaataatctctgtatttatcataaatgagactccatctcagaaaaacaacaaaaaaagataatgtggggctgagtgtagtggcttatgcctgtaatcccaacattagctgtgttgtagtgtgttcttccagaaagagtttattcggataattcttgaacttggaataggcattttagacagggcttactttactgcgctatcctctttgtccacaagaggatgctctctccccttacataaaagctctaagtttttgcagcccatatagattgatgttggaggactaaatgcattaagtaggtttagagaatcttatcagctgttggtaaaaagggccattctatatatccttcccttcctaggtaacatcccacaacaaggaacggcgttccaagcgggatgagaaactagacaagaaatctcaagccatggaggagctaaaagcagagcgagaaaaacgaaagaacagaacaggtaagcgagggaaatataatggctacttgtgtctttatatgatttgacttcctggtgtccattttcattttgccctcttgttatatctttctcatataaaattccagcacatacccagaatagtataaacatccacaaacccatcatccagccacagcagtcagctcttggccagtcttgttaaatctataatcctttcatcagattattttaaagcaaataccagcattattatattttaaccataaatatttcagtatgttcctctaaaagataagtacttttgttttaaacctaactataataccattattacacctagaaataacaatgaactctttgtcaaatatctagtcagtgttcaaatttttctatttgttttgtaatttaaaaaacaagattttaaaaacatttctatttgttttgtaatttaaaaaacaagaccacttgaatcaggatcttaaagtccatacattgtgatctgttaatacgtcccttaaggcatttaatctgtatgttttcttccccatctctttgccctgccttgcagcgttatttgctgaaggaactgggtcatttgtcttctggtttctcacattgctgactacatctcgtttttgttgttgaatgtgtttctggtcccttgggtttcctgtaaatggttagttagagctacagaattggtcagatttgggtttgttctgttgttgtcattgttgcttgttcttggggaaggctgatttttaggtagtggtatgtatttccatcaggagacacatgatatctgactgtctctcagtttgtgatgttaacaatcctgtcagttagctcttaccacaataatgtgaagtaacaaactaacccctgttctgctcatgcatctgaagttcaactgcaattcaccctcctgatggcatgagttcagctggaattatctccaagctataggtggtagccaggtctgttctacctctctcttcctccctgggccagtaaaccccgagcacttttatatggtgatgacagaagtataaaaggggcaagcaaagacacacatgcctcttagggcctagacttggaattggcatagtgtcactatggggccgggaagaatgactaaggcatatagcaaaggacatgggtatagagatgggtgaagaattagaaaggatactgtgggggccggtcgtggtgcctcacaattgtaatcctagcactttgggaggccaaggtgggcggatcacctgaggtcaggagcttgagaccagcctggcaaacatggtgaaaccccatctctacaaaaaatacaaaaattagctggccatggttgtgcatgcctgtaatcccagctcctcaggaggctgaggcaggagaatcccttgaacccgggagacggaggttgcagtgagctgagattccgccactgcgctccagcctggacaacagagtgagactcaatcttaaaaaaaaaacaacaaaagataatgtggggctgagtgtagtggctcacgcttgtaatcccagcacttcgggaggctgaggctggaggattgcttgaggccaggagttcaagaccggcctggccaacatggtgcaagcccatctctactaaaaataataaaattagccaggccaggcacggtggctcacacctgtaatcccagcactttgtgaggtcagagcaggcagatcacgtgaggtctggagttggagaccagcctggccaacagagtgaaatcccgtctctactaaaagtacaaaaattagtcaggcgtggtagcacatgcctgtaatcccagctacttgtggggctgaggcactgaaaatcacttgaacccgggaggtggaggttgcagtgagccaagatcctaccattgcactccagcctgggcaacaagagtgagactctgtctcaaaaaaaaagaaaaagaaataataacgtgttctgtcctagtagccactgatggtcattacctagataatttaattcattaggagttgcaaaatggtgatatttcgaatctgtcattctttcctcattcattatctagcctgcttctataaagagaaaccttttttttttgagacggagtctcgctctgtcgcccaggttggagtgcagtggcgcgatctcggctcactgcaagctccgcctcctgggttcacaccattctcctgcctcagcctcctgagtagctgggactacaggcacctgccaccacgcccagctaattttttgtatttttagtagagaaggggtttcaccatgttagccaggatggtcttgatctcctgaccttgtgatccgcccgcctcggcctcccaaagtgctgggattacaggtgtgagccaccgcacccggcctaaagagaaacttctaatcagctatttagttaccccccaggcacattttgaacaggaaaggcaagataaatgcttgattaattttcctttcgtttaccagtttttgaaagaatgagatagttcctggcaaggtacagtggctcacatgtgtaattcaagaccagcctgggcaacatagtgagaccctgtttctgcaatattttaaagagagagagagagatagtttttagcaacttccaaagatgactgatgggttttatttattttgaatatccttgtgaactcatcatttttaacgtgctttatgtgttttaatccattgcagttatttttccttccttccatccatctttttctctctctcttttttgagacaggatctctctctgttactcagtctggagtgcagtggcgcgatctcggctcattgcaaccttcacctcccgggttcaagcgattctcccacctcagcctcttgagtagctgagactacatgcgtgcaccaccacctaattttgttttgtatttttagtagagatggggtttagccatgttggccagggtggtcttgaactcctgaccttaagtgatccgccttgccttggcctcccaaagtgcatgagccaacactcccagcctaaaatttttttatattattcttttttctttttaaatcgtaagtacacagattaacctgccatcttagattaatggtagcatattatacacagttttctctctcttttttttttagccaccactcctggtttgttttttgtatttttggtagagatgcagattcaccatgttgcccaggctggtcccaaacccctgagctcaagtgatctacccacctcgacctcccaaagtgctgggattacaggcatgagtcaccatgcctggccacgttcctttttttttttttgagatggagtctcgctctgttgcccaggctggagtgcagtggtatacagtcttggctcactgcaacctccgcctcccgggttcaagcgattctcctgcctcagcctcccaagtagctgggataacaggtgccggccacaatgcctggctaatttttgtattttagtagagacagagtttcaccatgttgaccaagctggtctcgaactcctgacctcaagtgatccacctgcctctgcctcccaaagtgctgagattacaggcgtaagccaccgcacccgtccccacgttccttttttatagctgcatagtagttcattggtagatgtaccagtggtgatttagccactctcctattttaaattttcctcagaagcttctgaagtcatcatgagtctttccccctctttcctccccatagtcaagtgtcttgagtgccataaaagagaactgtcagtagtgttggtgaccctttctgcccacctagtatcaatcttccagcccttttttcatctgctggggcctgacatttggcacctgaataattttaactctgtgttttaactcatttctgtatataccccaagttagcacaatccagtctagagaggacggagctgtgtatttgagtcctcttccatttccagttctttttcaaggatgaattcattttcttgttgagaaaacctaggtaaacatctcttctttctttctagctgagctccttgccaaaaaacagccattaaaaaccagtgaggtctactctgatgatgaagaggaggaagaggatgacaaatccagtgaaaagtcagaccgctcatcacgaacatcatcgtctgatgaagaagaggagtaagctcttgtacattttggtctagtaggcaggataggtgggtttttgaggaagagcttggtatcgtttccaaaatctccctggttgggccactaactctgacatggttacctttggtttgctgaactgagttccccagcacgtcagcccattcatttggctgctagcctgtacgcttagacatttcacctgggcctggaaggtaggaactgacttcgtgtcattctcagattggcctggagctttcattcattttcttttttttttttttttttttttttttgagacggagtctcgctctgtcgcccaggctggagtgcagtggcaggatctcggctcactgcaagctccgcctcccgggttcacgccattctcttgcctcagcctcccaagtagctgggactataggcgcccgccactacgcccggctaattttttgtatttttaatagagacagggtttcactgttttagccgggatggtctcgatctcctgacctcgtgatccgcccgcctcggcctcccaaagtgctgggattacaggctcattcattttcttactctgatgggttatctaagatggcagcctcatttgaaacagctcatactactggtcaggaacaggatcctattacaagtctttgctggtgcttcatttacttctcctcctaggccagtcacatgtactttggttaagttttgaggagttgatattatttttctgtcttgttctgtttttatgatgaacattttttccagtgcccctttgttcctcttaggaaagaagagatccctcccaaatcccaaccagtttccttacctgaagaattgaatcgggttcgattatcacggcataagctagaacgctggtgtcacatgcccttctttgctaaaactgtcacaggatgttttgtgcggattggcatcggaaaccacaacagcaaaccagtttaccgggttggtatttcttcccttggacaattgtccatgctttcagtataattagtctcaactgagggcaggagctactgaaaaaatcgatcactcttctctcagcatttgatggaaagtagactccaagtgggatccccatagagcagtgaggtgcccaggaatccttcatgacttgttgccaagaggaggacttggagcccaagggcctggaagatttggatgtagaataattttctctattctcccttcagtataaaagggagaagggaggcatctatgaagtgttcattgggagttacataatctaaaagatttgttcatttgaaaaaccaatgaatgaaaagtttcatgttgcataccaagtgacttctacaccagggaattgtattgaggttaaaaaaaaccctccagactaatacaggttattatgtaggttccagcactgcttctgtggtctaggtggactgggcacagtggcttactcctgtaatcccaacactttgggatttatttatttatttatttatattttattttaccattattattatttttttatttttattttttgagacggagtctcattctgtcacccaggctggagtgcaatggcgtggtcttggctcactgcaacctccgcctcccgggttcaagtgattctcccgcctcagcctcccaagtagctgggactacaggcgcatgccaccacacctggctaatttttgtatttttagtagagacggggtttcaccatgttggcgaggctggtcttgaactcttgaccttgtgatccacctgcctcagcctcccaaagtgctggcgtgagccaccgcacctggcctatttttatttttatttatttgttgtttttttttttcagacagagtttcgcttttgtcgcccaggctggagtgcaatggcacgatcttggctcactgcaacctccgcctcctgggttcaagtaattcccctgcctcagcctcccgagtagctagtgttacaggcacccgccaccgtgcctggctactgtttgtatttttagtagagatggggtttcaccatgttggccaggctggtcttgaactcctgacctcaggtgatccacctgtctcggcctcccaaagtgctgggattattgacatgagccactgagcccggccttatttttaattttttgttttttatttttggagacagagtcttaccccgttgcccaggctggagtgcagtggcacgctcttggctcactgcagcctctgcctcctgggttcaagcgattctcatgcctcagcctccaagtagctgggactacaggcatgcgccaccacgcctggctgatttttttttagactgagtctctttttttttttttttagacggagtctcgctatgtggcccaggctggagttcagtggcacgatctcggctcactgcaaactctggctcccaggttcacgccattctcctgtctcagcctccccagtagctgggactacaggcgcccgcaaccacgcctggttaattttttgtatttttagtggagatggggtttcaccgtgttagccaggatggtcttgatctcctaacctcgtgatccgcccgcctcggcctcccaaagtgctgggattacaggcgtgagccaccgcacccggcctcactttgggatttaaaaaaaaatttttgtagcaacagcctctctctgtttcttatgctggtctcaaactccgggcctcaagtgatgttctggcctcagcctcctaaagtgcttggtgttggttttttgttttgttttgttttgtttttttgagacggagtctcgccctgtcatccaggctggagtgcagtggcgcgatcttggcttactgcaagctcccactcctgggttcacgccattctcctgcctcagcctcccgagtagctgggactacaggcgcccaccaccatgccagctaattttttgtatttttagtagagacggggtttcaccttgttagccaggatggtctcgatctcctgacttcgtgatctgccttccttggcctcccaaaatgctgggattacaggtgtgagccaccacgcccggcccaggtgttgggttttttttttttttttgagacagtgtcttaaccatgttgcccaggctaatccggaactcctggactcaagccatcttcctgcctcggttttcgaaagtgctaggtttgcaggtatgagacactgtgcccagcctgtttgagataggatctcgccctgttgcccaggctagcatgcagcggtgtgatcagagctcattgcaaccttgaactcctggactcaaacgatcctcctacaacagcctcttgagtagctaggactgtaggtgcacaccactatgcccaactaattttttttttcttttttgtagagactgggtctcggctgggcgcagtggctcacgcctgtaatcccagtactttgggaggcaggtggatcacgaggtcaggagatcgagaccatcctggctaacatggtgaaacccctctctactaaaaatacaaaaaattagcttggcgtggtggcatgtgcctgtagtcccggctacttgggcggctgaggcaggagaatcacttgaaccagggaggcagaggttgcagtgagccaaaatcatgccattgcactccagcctgggcgacagagcaagactttgtctcaaaaacaaaaaacaaaaaaaaagagagactgggtctctctgtgttgctgaggttggtctcaaattcctggcttcaagtaatcctcctacctcagcctcccaaagtgctggaattacaggcctgaacctcggcgcccagcctggattgtttttgttttgttttattcttgtctggtttttatgtgtgttatccccttgtatgaggacctgcagccatgccatatcctgaaatgcttggcaacagaaactgacctacatggtcttcacatttggttgataaaaatcaactggtgaaatcccaaatacatcccttgtaagttagaattagttggaggaaaagcttccagtgggccccatcgggctcctcttctgctggcactttctcctcctgggcacaaggctccctgtgcttggccatctggattctaaacctgagaaacctttctcagaacccctggcagctgtggactctactcagcactctatcagttgtctgcgttcaggtagagagacgcaaaggaagagtgttgtggaaagctccggaagagtctggttttgactggcgtctctgtcctctcacttaggtcgctgagattacgggtgttgtggaaactgccaaagtttaccaactaggtggcaccagaacaaacaaagggctgcaactacggtaggaggcacttctggggtagcttctgcttccacttcaaacaggcactggctttgggggctgctgttctctctgtgtgatgttccttgttaccatgaacgctatgtatgcaatccccacaaggtacacttggagggagacttgtattccatctttgtctatagggaaggtaggatattctctcctctagagggaaccaaatatatgaaggggtaggacacagagaaaggaaatgtgtggttatgagagaccctcccagagcctcgctggcatttccttggcaagcatgtccaagaggcttgcttctggttctggctctatgtcataacctcatctgtgacaagaaagatcatttttatggacttcatttcctcttcagtaaaatgaaagtgtcattcactcagcaaatatttaccgaatgtacagtgtgccaggcactgctctaggtgccatcatagtgcactgcagcttggaactcctgggctcaggtgatcctcccacctcagtctcctgaggagctgtgaccacaggcatgtaaccctgtcccaggctctgttgcatattgttgatgttgactgtaatggattttattgtaaattgacttttgaagcactgaccaagcccatttggtttccagtgctagctttgggatctcaatcttggcagctcattaaaacagcctgggatgattttatagggtagctaggattgagaaccactgcaataggtatatataggtggtacatagtctggtaaggttgctttgcttgtactacagtcaacatgcacatttcttggagatgctgtctctcttttatgtaggcatggcaatgaccaacgcgtgttccgtttagagtttgtctcaaaccaagaattcaccgaaagtgagtttatgaagtggaaagaagcggtacgtggctagagattacctagcagttgttcgtgcacgttgagaaaatatctttccaaaatcccttactaataatctcgtatcgtgtttttgatccagatgttctctgctggcatgcagttgcccactctagatgaaatcaataaaaaggaattatctattaaagaagctcttaattataaattcaatgatcaggacattgaagaggtaagaaaactggtgccccagaacccggaggttcatcaagaaccagtgttgagagaacatgattctcttttatttccctatatcttgacatttttagctatgcatgaaaatgagggaatactaatattactacctgattatttatagttcatcaagcttttttctatacattctcatgtccggatgaggctaacatagactgaagtgtattcagagttcagatgagacaacaaatgaggctacatacactaaagtgtatttagggttcaggggtctgtattctgctaggcttgatccttcaagagttttccttttctaaaacatcttggtaaaattatttgatctctgttctcttggacagtggctagccttacactaccaggcccttgggctgctgtttcttggtgcatgttccttcagcctgtcccagaagaatctccgtgacccaggaagcagcatagtatcccttggaatgaacccgctctctctctctctggggcatgacactgctgtaggaagagcagcccctttgtaactagctgtttgcatccaaaatgggctcacttagcctgtctacaaaaatagcttaggaatacctcactgctggtatctcctctctggtacagattgtaaaagagaaagaaaggttcagaaaagctccacccaactacgctatgaagaagactcagctactgaaggaaaaggtaaggagttgtactcgagcctctttcctcatcctgtaaggagatgtggaaatcaaacttgttcatcctctgccaagttagtggtggtaggattgggagaaaattctgggctcgattataagcaacacagtgtgttcttggcacctgggcaacgttccttggccattttccattccctaaattcaaactcatcttctgcgtgtgtgccagtcttcttactttctagtcacttcagtttcctttgtaataaaatagaccctggggtggtatttaacactgagtctgaacagacagatgacactgtcaaggccacctgtggctggtgattttccattcttcacactgggttggggtgggccttgttatggtggtttagccaccctgtgaggcctggggttctactgccaccagggacccacagccaggtagctgtatgggaaggtgttccccactgtactgtgcactactataatataaattatatcttgtatttgtaaagtacttctacagtattcttccacatctcctgtcctttgctcaccacatgagatatctttgcctgtgctggaagtaaggggatacttgatatggagtcagttgtatgtagccaagaacgaactcacacatctctctatgtgtaggccatggctgaggacctgggggatcaggacaaggccaaacaaatccaagatcaactgaatgagctggaggaacgggcagaggccctggaccgccagcggaccaagaacatatccgctatcaggtgtgttatggagcctatttttggcccgcagaccttggccaaaattatcaggcaagcctgtggcctgtacactctgtgctgcactgaccccatagatatctgagttcagggctcagtggttccctccctcccttgtttcacagccactgactcatccctcttaccccacagttacatcaaccagcggaaccgggagtggaacattgtagagtctgagaaggcccttgtggtaagaaaactttatctgaatcactaaaacaaagttaattaataaaccatgacatcttttctacatcttgcctaagtttattttttaattattgaaataacgtaggcacttaacgtatacacactctctctgtatgtccacgtacatcgatataatttattcataatgaaaagcagcagtcttctgccctgtcctacctcttcccacccttagattctactccacaggtatttgttttttctcaatttctgtttcttggttgtttcccccatatctactctggtattcttgaagggaaaaggataatatgccgggcgcggtgtctcacgcctgtaatcccagcactttgggaggccgaggcgggtggatcacctggggtcaggagtttgaaaccagcctggccagcatgacaaaaccctgtctctcctaaaaatacaaaaatgagccggacatggtggtgcacgcctgtaatcccagctacttgggaggctgaggcacgagaatcacttgaacctgggatgtggagattgcagtgagctgtcgtgccactgcactttagcctgggcaagagagcgagaatccatttaaaaaataaaaaaaattagccgggcatggtggctcacgcctgtaatcccagcactttgggaggctgaggtgggtggatcacctgaggtcaggagtttgagagcagcctggccaacatggcgaaaccctgtctctactaaaaatacaaaaattagctgggtttggtggcttgcacctatagtcccagctgctggagaggctgaggcaggagaatcacttgaacctgagaggcagcagatgcaatgagctgagattgcgtcactgcacttcagcctaggcgacagggcgagactccatctcaaaaaaaattaaaaaaaaaaaaaaaggaaaaggataatagcttttttttttttcagtcccgtgcaaagacttatttgcctgtgagcttatggtgaatgagaggaggggctggaggtgcagttctgtggtgcatgctttctgtttcaggctgaaagtcacaacatgaaaaaccaacagatggatccctttactcggcggcagtgcaagcctaccatcgtttctaatgtgagtgctgaaagaggacattttagtcaggacctagattctaggacacaaaatgaattccattaggaaattaataatgaagttaaaaataatgttttcttagctgggatttgcttgtctgaagctcttgggtctggatacttccttttttatcttgctataggacatatcggtagtgaaaacgtggcatggatttataaaaacctagtgactgatcctcctgtatcagggtgggtttacagtgcagcagacattagtaatgtgtcccttagctagggcctggctgggctgggcttggctttcaagcttgtaattgccttttttttttttttttttgctgctttgaggaaaaccccactagctgctgatgggtcggctgtggtgcttgtgatgttagtttggtaggtgggaaagaatctggcagtaggactctgtgagtgtcaagcaatctctaaaacaacttattttctctctcagtccagagacccagctgttcaagctgccatcttggcccagctgaatgcaaaatacggttctggagtgttaccagatgctccaaaggaaatgagcaaggcaagtgtggtaccaccctgttgcctgctgagtgaggctgctggctgagataccgaacaagtaccttgtctagtttgggcttgatttttccaccttgaggaacagggagtccctcttggagtcccttctccatcccagttatttacagatataatcaacagacaaccttaattccaaacctgacaccactacttgcctagggccttgactatgtccttcagcagctggcttccagccctcagcatccccttttctgctgtgtaaaatgagggtactactgtataccctgccagcttcacaggaggagagataacatacaaagatcagacattgtaaaagtgaaagcttgttgaaaatggcacatttaaaagcagttttcttgctgggcgcagtggctcatgcctgtaatcccagcactttgggaggcggaggtgggcggatcacctgaggtcaggagttcgagaccagcctggccaacatggtagaaccccgtctctactaaaaatagaaaaaaaatagctgggcatggtggcgggttccgataactccagctactgaggaggctgaggcaggaaaatcgcgtgaacctgggagggggaggttgcagtgagccaagattgcaccgttgtactccagcctaggtgacaagagtgagactcccacctcaaaaaaaaaaaaaaaaagcagttttctgtccaagttaagtcttttcctgttgtagtctaactggtctcaggatttctgaaatcttaggtcaggaagtgacccgttgcttaagcccaccctttctacactcataccacagacacaagcctgccctcttctctgtgcttgtagccttcaggagagaaagctctttgtctgtggcctccctctgagagaaggaatcagaaaggggccttagtaggaaaatctaatgaactcaaataagagcttcgtaccgttagtggctgctgctgcttgaaatccacttgcatttatgctcttaccattagctttcctcttcacattccagggtcaaggcaaagataaagatttgaattctaagtcagccagtgacctctcagaagatctgttcaaagtacacgattttgatgtgaagattgacttacaagttcccagctcaggtatgtgagggtggggcgggtggtgagggctgagaaccagatggatccatggttttctggggcaacaaggaagcccacttttagggaagaaaggggaatgctggctcatcagcatccacaggccaggccaagacaggctgtgggtatggtgagagggaacagggccacagtcaggaggctgcctgcaggagtgtagcacaggactaagaggactttgtgggacctcagctgccaacttgctcttctttcccacagagtcaaaggctttagccatcacctccaaggctccgccagccaaggatggggctccaaggagatctctgaacttggaagactacaaaaaacgacgagggcttatttgagcacacccagcctgctgcttctgaccctgcatgccccatcgcagcgtcccacctttcctcctttcctttgatttagcctctttgggctggagcagctgttgaactgggaagagactctaaactgccagtcatctgtaatataaaccatttgctgtatagacctcctttgtctgcacaccatctcccaccagcctcccctcccccagggccccacccagtgtgggcctgggctctcttgggctttatccatgtctttagatttgtgtttgccttttgtttttttaaccgcgcagttcattggccactctgcacgcattcagtattaccatggagctgggaatcttgctggagcccctggggcaatagcagcagcaccaggcggtctcctctacagactgccttggcccacccattgaacattcggcacgtgaccttgtggggggagcggggattgggcacctgcgatcctctttcctctcttcatctttctcttctgcccttctttttggaagaaggggtttcaaaaccagtttagtttccaaaaagtgtacatttgtggggggggggggtctaatttgagagcgagagtgtgtatgtgtgtgtgtgtaagtgtgtggatttttttatcatttttttaaaatgcagtactctttgtatcagtctgtcatgggtctatagctgtttcagatttttttcagctgtacttgagcatctgaaactgcaagaaagaaactcattaaatgtgattcttcttactaaacaggcctgactgctgtagctgtgtaacttccccattcccacctactcttcccatcctttcccaactttggagaaaactccccagtttagccccctgacctgcaggctgtgtcctggcaggtgtgggagggaagcccatggccaggtaccagggagggcagtgaatgtcttgctcttcccatgggtacagcccacagcttcttggctgaacgtagaacttctttttctcacccagtataccagcctcttcctggtgattctgttttgctgctttggcaagaactacattttgtttttaagagaaatttctgaatatgaatgtggagagcaaacacaaaaagatttaggttacgccgggtgcagtagctcacgcctgtaatcccagcactttgggaggcctaggcgggtggatcacctgaggtcaggagttcaagaccaatctgactaacacggtgaaaccccatctctactaaaactacaaaacttagccgggcatggtggtgcgtgcctgtaatcccagctactcggggggctgagacaggagaatcccttgaacctgggaggcggaggttgtggtgagccaagatcgtgccactgcactccagtctgggtgacagagtgagactccgcctcaaaaagatttaggttgcaaatgtttcaagcatgtgcagttttgtgtgtgtgtatacatatatatggtcagcatatatattgtgcagctagggcgaagccagcagaggtgtgtgtatgtctttatgaaatgtttgaaaagagataaactgactgcttgataatcactctcaggtgtaaagctccaagtgtaaataaaagtggcatttaacaaatctttcagaacaaagtacagctgactatatataccaagagctaagctaaaggaacagctgagagctccgatctccacgagagactaatctaaaagctctgctttgtacttcctcaccctgctttcgtacaaggaagggggacgatgggaaatcatggacttgtaagttgtatttaaacataaaaatgaacttggtaacttctgggtttagtagagcctcagtgtcgctttaacttagtttactttttttttatttttaaagcagcaatggatggttttaaaggagtattatgattgtaaaattgctaaatatgactgtaacacagctttgtggtagctgtgacacagttcacttgggcaaaggagtggtgatggactcgttaaaatcatatatacttgaatagtccattgaccgaaactctttatagactattgtgtaaatgtggaatcacagactgttaacattgcctggacttcagcagagtcctggagctgctgggacctctcctatcatgatgaacttggacttttttttttgatttctggttttaaaaaacataaaattatagaatccagataattcgctggagtcattctgatccaccatgtagatctgtatttagtatcatttggatttggagaagtgttgattacattatggctgtgtaataaaatttttattaaaactgc

SEQ ID NO: 37677 - DNA, 58394 bp, Homo sapiens
ggaggaggaagcaagcgagggggctggttcctgagcttcgcaattcctgtgtcgccttctgggctcccagcctgccgggtcgcatgatccctccggccggagctggtttttttgccagccaccgcgaggccggctgagttaccggcatccccgcagccacctcctctcccgacctgtgatacaaaagatcttccgggggctgcacctgcctgcctttgcctaaggcggatttgaatgtaggtggtgcgggggagcgggagtggggcgggggggactgcccagggagtgactttccgaggaaggcatttcggagaagacgggggtagaaaaggctggtgggagattcagagtccactggtgctttcgatttgacttaagtgaagtatcttggaacctagacccagaccttcgtaagacccacaaagaaaccagttctggtacctggagggggaatggaatttttagggtaaatggcatgcatattaattatttttttttcctgaagctctttctctcccttcagaatcttatcttggctttggatcttagaagagaatcactaaccagagacgagactcagtgagtgagcaggtgttttggacaatggactggttgagcccatccctattataaaaatgtctcagagcaaccgggagctggtggttgactttctctcctacaagctttcccagaaaggatacagctggagtcagtttagtgatgtggaagagaacaggactgaggccccagaagggactgaatcggagatggagacccccagtgccatcaatggcaacccatcctggcacctggcagacagccccgcggtgaatggagccactggccacagcagcagtttggatgcccgggaggtgatccccatggcagcagtaaagcaagcgctgagggaggcaggcgacgagtttgaactgcggtaccggcgggcattcagtgacctgacatcccagctccacatcaccccagggacagcatatcagagctttgaacaggtagtgaatgaactcttccgggatggggtaaactggggtcgcattgtggcctttttctccttcggcggggcactgtgcgtggaaagcgtagacaaggagatgcaggtattggtgagtcggatcgcagcttggatggccacttacctgaatgaccacctagagccttggatccaggagaacggcggctgggtaagaaccaagccccttgtgtgtcccttttctttggcctctggtcagagatccccaacagcccttcttctgtatctctttctgttgtgttgggtgattgttggagacgttgatagttgaggaaacctgactggcctcatttcaccacaagaggttaactccttggaaatacaaatgaccctgtgcttcagagatcaggcatctttcaccctggtcacccccatgactccactattccatacttgtgttccagtttctcagcaaagaaaactgtagcctatgtgttcattaagtcccaaacctgtgagggtaggaagttagttcggtgtttcccttaccttatacaatggttcacacacaaaggggtgatgagtataatgcctggagaagatgatgagcatcaatgacccacagacctctccatctgttccccccaaggggtctcagtcctatcctgggcttctctcccccaaatcaagttccctttatttcaaagtttgcgtgtatggcactctcctctcagactagggcatggccataggcaggagttcccactgggttgaatggctgagaattgtcagattttggggcagtgtaggctgtgcagattgtgtttgcactgcgccccctaagttcatttcccccaaagtgtgcgactttctgcatggttgccttgtttgtggagcacttgctgtgtcacacattaagccaggggactttgcacctcattgcctggggtcggttggggagctccagctgctctgcctgttactttccggccagagcccaggggcctcttcaagcactgtttgctggcaaagcaagaacctagtctttggggctctgtgggacattgagatttagtaacagacttcacatgcaggtataagttccagttctgtcatgtaactagctgtgtgaccttggacaggctgggttactttcttgaggcttagtttctttcactaaaaaatgtggcaagctctccttgccttacagtgtattgtaaatcttggcgataatgtgagcacagtgactgacaccagcaaattccctttccagggagggagagttctcctgcccatcactgagccaggatgagatggtggtgaaagcttctttaccagtggtcactgtaggcaagttttgctcttcagtgaattcagtcctgttttcttgcttatctccctacctagcggaggtgcaggttttatgagagatgttctatcccctcagagtatgcagaaaagcatcaagctgtggaaaataagtcatccattgaaggagctgaggtggaaggggacatgcaccatggactcaggaatgtcaagaatgcaactgtctataggctgggcctagggtgtggcaggcacttcactttaccactgagcaagagacctcctgagtttgccctggaaccccaccccctctctcattttgcatttctttgcaatttcaactcgtctgtgccagctcttgtaaaaggcaagggggtcaagtcaatagaggtcagataactggggtggggtcaggggaggtaaaggtggtgggttctcttgagctagctgactagacttgaaagccattctgtaaatgaactctctagggggataaatgattaaatagttcctgttggtttgtgcagtgacctctcctgttccctcctgctttgattctcttttggggcaaatatttgttcagctgattacaggagggacaggattccagtactgcagacacaccctctgaggcatctccaagtagggattgaggctgcttgcccactttgcctgactattgtctttggccagtggtcctaataccaggtgggttgttgccagctataaacaaaaggcagtctgggagaggtgcctggtctgctagccagcctctgcagaaggctacccctaccagagaattgccagctgcccagtggtgcatatgaaagaggtcttagacacagcaactctgggtaagtttattagatctccatggggttgaaattccatcttccatctctttgcttaagaatcatcagagcctgttggacaacataccacatgtcacttcctcttggtgaacagaggggatgtgtgtggaagagccagttatatcagaaccatttctgagcacacattctctccctaaggccagggagtaaagaacatttgactcaggatcctttgagcctgggtagaaggtacccgcccccttcctctcaggtattatcctgttccaagctgcaccgactggctactgtggtggcatcgggtaattatcctggagactgcggctgggagatccttaagggtaggagttatgggctattctactcagggctatgttctaaatttagcatccctacaggaaaggggaaggaaattagtctttattgagtacctgttaagtactaggcactgtgttaggtcctctacttatgcaaccagtgtttcttgagcatctactgtgaagctagcagtgtactaggtgctggccataagccacgcatggtaccttccttcatggaaacggcatgctgtttcatatattctacagtaaccttccaaggaaggtgagtttattcccagtttacacatgaaggtctttgtgcctaagtgactgaccccaggtgtccctcagccagttaagtgtctgaatgagaatttacaccaaggttggcataattctaaagccaacacttttcatcctatcaagttgtccagggagtaataaagtgacctagacatgctggcccagaaagccagagatgctgttgggccaagcaaaccatgcctgtgaaggtgctcactctggactgataactggctttgttcaggtagctatgggaaggatagttggcagtagcaggttcccagaggcgtgttggtagcctcagattctggcactggtaaaactcagacatggcaggtttcaagtgggcatcagggttttgcccagagtgagctgcttattaattttttctttttttttttttttttgagacggagtctcgctcttgttgcctaggctggagtgcagtggcgcgatctcagctcactgcagcctctgcctcccgggttcaagtgattctcctgcctcagcctcccaagtagctgggattacaggcatgcgccaccacacctggctaattttgtatttttagtagagatggggtttctccatgttggtcaagctggtttcaaactcccaacctcaggtgatccgcctgcctcagcctcccaaaatgctgggattacaggcatgaaccaccgtgcctggccccggccaattttttcattgttaaaaccctctcaggccctgccaatagatgacagtggtgtgcgtgtggggagaaggtggcctgccccaggtatctctacttagtggtggagtgatgcttcaaggactgaaagtgtagacccttagccagattactgcctgcctggagtcacctgatgaaatgctgaacctgttcggctgtcttgtccatctgtctctcccgcctgtaaaatggaataatgatagccagctgccatagcttgactcgagtaaaggatctagcacaaaagcccttctcctgccataattgtagggtggaaaccctttaatgaatgggcagcttccctcagagaactgactcttccccctagagtttctccttgagaaacaaagtccctgtgatactttcctggaatgttgtatacatgaccttccccgaagggacacaagtgtttctggtgctttccaatgggaatgtgggaagggacccaggtgggccttgccactttgggattgctgtccctgaagaaatcccttagcctgatagaaacgtaattgttgggagcaatgaactgtgttgggggagaaaacataacttggcctttcttaagctgtatggctcagtggtctgagtttctgtagatctcttattgcctaatgtggcttcttcagatggatgtatgcttagttgaagcacctcagctccctttgcagatagtggcagttctgtggttttcttagggaaaccccattagaaaccccaaatgtggaaatttttagtaatctcattcgggtcccaaaattaagtagaagtgtctcaggggctcccccttgaaacacctacttcttctgagtgtacatttgaggttgctcttaaaattctgttaccatcacagggttttccagacttcctaggaataatttccccagtagccccacagagccctttagcttctgtcgaaaattacccgggtattttttcagggggctccaatggaacctggagggttttcttgacttttgtatgggtgtccccagatttgtttgggctgcatgaaacagcagttgttatctctgtcccttcccccagcagatatctgtcctgaggccagtgggcttgagcgtcctcctctgtgtccagtctccctggttttgccagtgccctcagccttccatcatggggctttcttgaagcaactgtggttttgcctgagtttaatgtggatagacataggggtaattcccagtgtactgcttttctacggaagtataatctcctactgccttaattaagcagaggccctgtccccacccaacctccaacctaattccacagagtcctccctaaggactccctcttttttctttgaaggagtcactctactcctggatcctcttctcttctgcccctctatccgacagtctgtcttccttgttcccagttggcagacctgagtcaggcaatcccactgggtctttttgtttagcctggggaagagaagacccaggagaatatcaccagcttcagatatctgaaggaagagggactgagtctttttttattggtgtggtacctggcaaaacttggataaatgaaaagaagttaacagttggtagagcttaaattatgtgcagagaagacatttctaacagatttactctgtcctagatttaggagctcctcagggtggaggccacatcttgtccatgcttgtttcctcagcactgagcagaggccttgggcatagcagatacctaattgaagagaaacccactaaatttctgaagaaacagacccttgtcaagccagaataacaataatgggagtggctatttacctaataattcattcgttgagtcaaacaatgtttattgagctcctactgtgtaccatactgggagtatggcagtaaacaaaagtaagcaaaactaagtttctgtcctcatggagctcacattccaatgaggagtgacaggcaataaatatataattacatgtttatatcagatgattgtacatgctatgaagaaaataaagcaggttggggcatagggcatgtctagcaagggagggtggggctgcagttttaaaagagtgatcaaagaaggtgtaagggagaaaaaaatggctttcctctacccttctaggtcctttggctgggctgagaattaaattgacatagacagattaactggaggaaaaataattaattacatagttgtacacaggaatcctacaaaatatgaggctcaaagaagggtcagataattgaagcttatatagcatcctgagctacagaaaagaatatggggcttgggacttctgttaggggcttgagtggcagcaacccaagttatggcagggtgagggaaagaattggtggtggcgtgtgtctgtggtcccagatactgttgagggggtgtactgaggtgggaggatcacttgagcctgggaggtggaggttgcagtgagccgagatcaagccactgcgctccaacctgggtgacagagcaagaccctgtctcaaaaaataaaaataaaaagtctctctggtaataaaatttgtctggagcagccctcttcctaatacagatacctttactagtgtagatttcctttttagatgtgaatttcttttacaaaaggacagcttttcagagctactcttatgtctgcagtttctcagaataaccagttcaaaatatgccaaagaagtatatttttggggtggcatattgttttcctacagtcatattttgggatggtatgtcctgagtcccaacaaaagtattacctaaatttatttgagccaagcgctaaatgaggtaaggaggtggatgatgtaggtaccctacagcaaagggtgtttaaagcagagggaatggactcaggagggagcatgcttgacattttcaaggatgagcaagaaggtcaatgtggctggagaagaaacagcaaaggggaaaagggtagaaggtggggagggaatggttgaggaggaggatggagaagtaggtgggggccagatcgcatacagcattacagaccatgatgaggatttggctttggtggaatggtctgtattccttttttttttttttttgagacagagtctttctctgtctcccagactggagtgcagtggcacgatctctgctcactgcaagctgcacctcctgggttcacgccattctcctgcctcagcctcccaagtagctgggactgcaggtgcccgccaccacacccggctaatttttggtatttttagtagacggggtttcaccatgttagtcaggatggtctcgatctcctgacctcgtgatccgcccgcctcagcctcctaaagtgctggaattacaggcgtgagccaccgtgccaggcctggtctgtattcttaagggtggcaacagggagcccagtgaagaggctggtgcaattgccaggtgaaaaagaatagtggcttggacctagaggtggaggtgtagtgagacggggactggagaataagaccaggcttgcacatggtatattgatgggtccagccatcctggaaaccatatttttcaactacttggaggtcctagaatcaaagttaagtaagatagatgttctttgggaatagttctctccaaatgtgatattctgatgaatggtcctcttccactccaacagtatttctgtctgagtaaatgaaatttgtctgagttcagttcccaactcatccgtgtctacctatgcaagctccttttacctctctgaatcttgggacaaataataatacctgcctcacagggggcgatggtaaagacacagtgaggtatacctgagatgcataaagactggagccatgttggtatcattattcttattatctttccacagaacgcatgtcagagacccattcacggaatcttgagcatccactctcctttttctaaataccatagtgacccatcagcacatctcagagcaggcccttgcagcatttctgttgtagtaggagctccacagtgtttgtgtgcaatggtggtgtaagcactggtcttggagttggaatcccagttctactctcagtctcaccttggccaagtcacttcacccccagtccccagtttccctttatgcaagatggagggtttgaagtaggcaataaaggaatgctggttctctctatccttaggccttgtggcggattccaccattacagcatatttcacattagttatattttaaaatggctctctcctgttgacagatatgtcagcaccttaactaaacccagtgtcaaggcaggctagtttatcactgagcccacaatagtgctaccctatatttatgtaacaccttacagcttccaaagcactttcagatccaccttgcctttttgatccttataaccacccagagaggtgagcaggaaggatgacatctccgtttcaaaggagagaaatcaggtgagaaagatgaattgacttgcccaaggttacatcaggaggaagaggcagtttttggactttcaaattggaacttgactactagcttgctgtgtgaccttgggcaagtcttttaacttgtaaatggctatagtaatgccacctttttctgaagattgggtgaattaattcattcttttaaggctttcatatcatcctagggctcttcactcacatcatctggcttctctttttttacatattgatttttgaaattgtggttttgtataaagaaactgcctttgggaccgtctgctatttggtttcatccctgatgagactctcgggccaagcttgagccttacagtgaactctgagccacacagctttttgggcagcctccagtgctcccctcggaactggaggtttttctccagctcttcaggaaatgccattgcgatgacttccatggactgcttcctgtcccagccctgccggcaagagtgtggaaactggaaagcaatgtccctagaggtccgccccccaaaaactactttttttggacgtgtccctgcctttcctcttgtccattactttctttgctccctaccctttcctccttcacctggcttctgcctccagctgtgatcatcccttcaagatttagaaaatgcctttctacttggttctgccaggccattaccccctaccctaggctaggctgtgagggaggtcagttagaattcctgggttctctccttggctccatcacgcattagcagtttcagtcctggacttcccctggagatgcattaaacctgttgcttgcggtgccctgtgtcatccattaaccctgagttcccctaggagattccaccccacccctgcataggatgggattcttaagagataacttgaggtttggcacatataaatcctgcctcttggaaattgatgataaagggtggagtgaaacagagcctgccttcccctcccccagtcacctttgaggaggaagctagaaggttgaaaaccttgttggacaatcatctgaggaatgggagctggcctgggaggggattggaacgcactcaactatgcctcagatcctttgttcctctcttgaaagggaaacattcccctccctcctccctggccacacacacatacacacgtgcctttgttcccccgagtcaggcagggataggaacatagtgtcccttccaaggagcctgactcgcttccctagagactggcctcctggtcagtgggactgggatatttgctcaggagcccccagcctcgtgtcctttccatagagtcttcgaggctaaaaacttgcctacaaacagctgctgagacttctctgtaattatttcatgggacacccatgtcccaggataaacagtccctccctcttactccagttggtgattaatattattgttaacattactattaatagtatctaacacttattgagtgcttactctatgccagccattgttcaaagtgctttacatgtattaatagatttcattctcacagcagcactctgaagtaggttcttttatccctgtttcacacatgaggaaactgaggtacagagaggttaagcaatttatgcaaagtagcacagttagtaagaggcaaagcctgggagggtagcttccaacctcccccttttaaacgctccactgtgttccctcgtccagtgcgctattgtctaggtgactgctggcattaatccagtgctcactatgtgacagcctttagtgacgctgtttttgttactatcccaacaaccttatcgttataggcactgagatttgggagggcttatagttagccagaggcagagtcagcatttgaaaccaggtctctcttactctgaagcctgtcctttttatctccagtccttaaaaatcttgcaaagtaggtgttgttaccttcattttatggttgagaaaattgaggctcagagaaaagtgatatacccagagcttcacaggctagtaccaagaagagctgggattcacactctactgtcttagtagtctgtattgtcatgattattctttttatgtgcatgataatactttcaatttaccaaactccttttataagttatttcccagtgaagtaggagaggtgggtatgttcagccctgtttccagaggggaaactaagataaggggtcttgtcccacagtaaatggcagcatcagacttagaattcatgttctggcttttaacacagtattatcaatactgtctgcctctcctaaagctggatgtgtggcttggagctgtccttggagtttcatttcttttgttaaatcagcaaatattgacaaatgctttgtaatgtgctaaatgctagtgatactgtggatattgtggtaactgagactgagtcccatccctcaatggtctgtttccatactccacaccttgggtcttgctggtgtccctctgccatctgaatcagtctacatgtgccatccatccttctcctcagctgccagacacaccaggcaagattcattatagttgatatgtattaatcaccttcaacacatacacagacaaaactctggcctcacatttgagacagcttgactccttgctggtggcataacacaaagcaaatcagcttcaaattctcatccataagcctgagagaataatgccaagccaccagagtaagtgaggcatgaatgagaaagtgaaatgtaagtgtgttttttggtaataataacagatactatgggttgagtagttacttgctctgtgccaggtgctgtgtttatcccctcaatataatcatcttacttggttctcacaaatgctctcctgtgaagatggagaatctagggttcagagaggctccctaatgtgtccacagtaacagatcttctaagaggcagagctgggtcttatactcagatgtgtctgatgcaaaagcctataagcgtcattgcttcttacaagcccagactggcttattttaccctgactacctggctcagggcccgcggttgggtgaggactcagccagggcctgctcaatgaacatgaagggttattattagatacaggttaggctacaaaaaaagtttctgcccctaaggaagcaaactcatttgaagcagtaggaatagacctcaaacacttggtgaatggcttgaggcaaactgtgccaaacctgtagagtaaacaccaaaagtggaagaagttgagcccacctgactgcattgctgggccctgggcctctgccaaatgggccagcttccaccatcagctacccagttgattactgggcccagaggcctccaccctcagcctgtatcatcaacctgcaccctttccctagccaactgcattgccaatccagactgtcttctgcatcaacagtggaaagggttaggaaggagagaggtcactgacagcttaaataatcatagctttctcagcaccgtagctttgtacaatttccactgaggcctcagtttcccggtctgtaaatggagataatactaatctcttaatgaagatgatagtaatctcttccttataggcttgctgtttttcctctgcctgtatcactcatcctatggatctgatcagggctctctctcttcttatcattcaggtatcaactcagatatcacctccctagaggtcgccatgtttacatgtttaccatctgtctcctgtagtaaaacataagctctcggagtacacgggctttatcctgtctttcatccccagcatctagcagagtgcttggtacataggaggcacttagcaaatatttgttgaataagtgactgtgtagaccacctcacacggtgtctgatatactcagtcaatgttaggcattgttatgtcttaggaagatgtggaccatgatgggtttaaataggtgaaaagaatgtaacaagagcaggctgtggctgggcgtggtggctcacacctgtaacctcagcactttgggagactgaggcaggtggatcacttgagatcaggagttcgaggctggcctggccaatatgacaaaaccttgtctcttcttttttttttttttttttttttttttgagatggagtcttgctcttgctcagttgcccaggctggagtgcagtggcacgatctcggctcactgcaagctccgcctcccaggttgacgccattctcctgcctcagcctcccgggtagctgggactacaggtgcccgccaccaggcccggctaattttttttgtatttttagtagagacggggtttcaccgtgttagccaggatggtctcgatctcctgacctcgtgatccacccgcctcagcctcccaaagcactgggattacaggcatgagccaccgcacccggctcgtctcttctaaaaatacaaaaattagcagggtgtggtggcgggcgcctgtaatcccagctacttgggaggctgagtcaggagaatcacttgaggccgggaaatggaggttgcagtgagctgaaatcatgccattgcactccagcttgggcgacagagggagactctgccacacacacacacaccaaaaagatcaggctagttacacacgcgtgcacgcgcgcacacacacacacgagcaggccagacgggtaagaaccacccagacagaactggagggtggagtatgtatgaagcatttgagagatcatgaggaggcagactggctagagccaaagatggtctgtgtcagcaataaagttggtcagggaagaaaccaggtggctgatgacagaggcctctggacagagggatggttgatggtagaggtgggcctaatggggagaggcccagagcacctgtgggatgcagttaggtctcagtaacccctaagaaaaagaatctcttgccagccagggctcagcaggcagagctgcagggagagaaaagccagaggcacctgcaacctgcagatcaggtaagctgccctggttgttattttgggactcagggccaggtgcagattcaaaggattgattgaagccttttggcaactctggcctcagcagggtaaacatcacctgtctcctgccacctgcagtgacaatgccaggaagggtaccctaggtaggcccaaaggggcctaactttcttgctgccctggtggagcaagaaatatcttctaggagaggccaatccttccctgccccacagctccttctctgcaaagctcaggtggcaatcaggtacctcctgcccaagaggcccccatggttctggcctaaggaaggcagggcggggcattgggagccgttgacagctgggctcagctggggggaggggtcagtttgggagcaggtgcagatttcagggagggtggggcctaaagggaagtagggatcttggtaggctgcaaaattttcctccccatcccccagccacagctggcttctccaggaacctgatgacctagttacaatgcttagaaattgtcagcttagcttgcagttcagggctttgccagtctctcctctctgaggcttcttgggtccaaaaggtaccttggcatttccccaagggggttccatgtgaatgacatacactgtatcacatgtacaggcttcttgcccaggggaggaaagagccagtaaggctgctgcttcttcccttgtgtgtgccccccaaccccagggagaaaatactcccatgcccttgcccccttctgtttctctctagagggttggtgagtgacaaatgggaagtcacaaacttcttcccttgagggtcaacaaagagggccagacccttgttgccctaaggatagattgagcacacctaaccattctttccttacctccccatctcagtgtgatgttaaaacctgatggaaagaggttaggaagactcttctgggggctctggaggccccccactctctcaggcagcagctgctcctggtattcctggtgtctgccttgcctccttgggagaaattccatcgttgttaagagtcaggtacgaaatttgacaaaccgttgttgagttggtgagtctcacttgcttaatagttatccttggcaaatacttaatctttcccagccttagtttcctcatgtatggaaaagaggtaacaatatacagtgcttttcttttttccttttttttttttttttttgagacagagtttcgctcttgttgcccaggctggagtgcaatggtgccacctcggctcaccacaaccttcgcctcccaggttcaagtgattctcctgcctcagcctcccgagtagctgggattacaggcatgcgccaccacgcccagctaattttgtttttttagtagagacggggtttctccatgttgatcaggctggtctcgaactcctgacctcaggtgatctgtccgcctcagcctcccaaactgctaggattacaggtgtgagccaccatgcccggcctacagcgcttttcttgaaacactcttgagagcatgaaaatagttgaaaagatacatggagcacttaccaaggagcccagcatatagtaattacttagtataacaagctactattattactgttattgtcacattgcaatcactggtaaacaaattgttgtcattgctattggatctactctccaggagtgaactttcaggctgacagaatatgtggatatctttggaccaagagtttagagattttaaggtacctgaagcttggggccttggctcacaaccttgtcccctacctcctctacaaggcccaagtcataccttgtacacagtagaggtttggccagtgttgttgactaggcgtttggcaatggggcatattttgttttatcttcccagggtcctccttgtttgttgactgagtggaagacttaatgagttaagtatttaaagtgggtaggagcatgcctggcacacagtaggtgcttgacatgggtttgaatgattaaacatggcattgtgggaactctggagtttttccaggatggccccactcactccttgtttgctctgtggcctcaagcctcttgcccaagctctgcctgttgcctcatatgttgaagaaagataacacccgccttgcctccctcatgggctagcagggaggcccaaagagatgatagatgaaaaagcactttgagaactataaatatttggtcttgttgctactccttgactaaagtcacagccatagctgtgtcattcattcattcattcagtcaacaagcattttttgagtagaagcaatatcttatcacttaactggcttcatgaatttggacaagttacttccctctgtaaacctgaagatctataaagtggaagtaatactcatttcagagggttgttgggagaaagactaaacgaggtgctctgagcttactgaggataaaaactatgtcttattcactcttaacagctactgctgggcctagtacttggtggctgagtgtttagtgactggattaacaaacattcctaataattaatggtacatgtaaagtgcacttacacattgcctagtgcagagtaaaagctcagcaaatgctgagtctttcccttttctctatgaggcttgaggtgccttgatttagccatgggttgccttctgcagtcaaagtaccaggcaaggccagactctgaatatgactcagatgggaagtagaagtgagtattaatgcctggctccaggttgtccttacctgcctacgctggacttcagtgcgggagttctgaactatcgaggatcagtgctgcttaaacataaaatccagtgtactatggttctcaccccatgcttatctctgatccagaacaactgcctcttgttctacccactctccatctgctactcagaagaatttccccttgctcacagcacccatgttcagttggagccctaggggttaccatgtcagggaagtcccagggagtcactcagaaatagcctttggggcaaggtccagagaaggagcccaattctaaggctcagtgtctcctgggactgggtcaagcagcaggtgcatacatgagacccagggctggtggctgagtgatgaaactgagagatgtgtagggccagacaagaagtcaacctagaggaaactgcctgcttgttcatgcaggtgtttggacacctgggggaactttctgggtctgatttagtggtgctagtgtaggttccatattagtatcccaagccccagtgagggaaacctttgggactcccaagcaaagcctgtagttggcacccagcacctttaaacccttctcagatccctttagggtgaaagagaggccccctcctctgggttctacagcatctacagctggaaactccagggacaatgacataataaccatagctccctttataaagtctctgctgtgtgttaggcactgtgctggggctctttatgaaaaggggatcattttgttaattggaagtatgggctctggaatcagacagagttgagtttgaatctggtctctattacatatcagctgttagattttgggtgcattcctttccatttctgagcctcagtccccctatctgaaaaatggggataataataatacttcatagggtttttgtaaggatttaagagccttttgtaagaatgtatgtaagatcatatggtgcaggtattaaggtaattttagtaatatttaacaatgagcacttgcacttaagtgttttatatgagatagttcattgaattctcaaaatagtaccactcaggtaggttctcttattattcctatagagaagttaagaaagttgttcaaagatgcacagcgagtaagtggtaaaaccatgatttgaacccaggtagtctggctccaaagccaacttgtcctacctggataaggaaggccctagtaaatgttgctgttataactattgtatccagcattgtagttgtctgtagtttttggtctatccactgaattctgagctcagtgaagactagaaacccatttaatcaccttgcacccccagagaccaacataatactcataaaactcattaatatttgcttaatggctgagaatattctctttctttagtaatcaatcagtaactctttatcgaccagttcctgtaggctagctttgaactaaatcctaggaggaatgcaaagtacagctatgcctgtgtaaacggaagattgggtgtgtgcgttgggggggtgcattccagagagcactgtgtcattggcagaaacttccacacaggaggcagaaacaatacaggtggtttgaggatgttttccaagatgggattcccacccctccctgagggagtcacttcctccatctcctgcagaacaaggtgacacagattccctactccggccaagggcaaggaaccactctaagctcttcagtcactctaatccagaaactgtgtctttatggctcaggcaaccagttcatggcagcctagaatgacagggaaaaagctgggaagggaccttagaaaatcactcttgcccaatactccagccaaagtggtcttttaaaaaccaagttcaggctgggcgcggtggctcatgcctgtaatctcagcactttgggaggccgaggtgggtggatcatcaggtcgggagttcaagaccagcctggctaaggtggtggaaaccccgtctctgctaaaaatacaaaaattagccgggtgtggtgcacgcctgtaatcccagctactcaggaggctgaggcagaagaatcgcttgaacctgggaggcataggttgcagtgagctgagatcgcgccactgcactccagcctaggtgacagggagagactccgtctcaaaaaaaaaaaaaaaaaggtttagggccgggtgcagtggctcatgcctgtaatcccagcactttgggaggccaagccgagtggatcaactaaggtcaggagttcgataccagcctgaccaatatggcgaaaccccgtctctactaaaattacaaaaattagccaggtgtggtggcgtgggcctatagtcccggctacttgggaggctgaggcaggagaatcgcttgaacctgggaggcagaggttgcaatgagccaagatcgcaccactgcactccagcctgggtgacagagcaatactcgtctcaaaaaaaaaaaaaaaacaagttcagggctgggctcagtggctcatgcctataatcccagcactttgggaggccaagacaggcgaatcacctgagatcaggagttccagaccagcctggccaacacagtgaaaccccatctctactgaaaataaaaaaattagccgggtgtggtggtgcatgactgtattctcagctactcgggaggctgaggcaggagaatcacttgaacccaggaggcggaggttgcagtgagccgagattgcaccactgcacgccagcctgggcaacagagtgagactcttgtctcaaaaaaaaaaaaaaacaaccaccaagtttaggccaggcatggtggctcacacctgtaatcccagcattttgggaggccaaagcaggtggatcacctgaggtcaggagttcgagaccagcctggccaacatgatgcaaccccgtctctactaaaaatacaaaaaattagccaggagcagtggctcacatctgtaatcccagcacattgggacaccaaggcgggtgatcacctgaggtaatgagttcgagaccagcctgaccaacgtggtaaaaccccatctctactaaaaatacaaaattagccgggcatggtggctcatgcctgtgatgccagctacctgggaggctgaggcaggagaatcacttgaacccaggaggtggaggttgcagtgagccaagattgcaccattgcactccagcctgggcaacaagagcaaaactctgtctcaaaaaatttaataaaataaaaaccaagttcagatcttattgcatttttgtttacaaccctccaagtggtcttccactgtagttagaataaaacccagacttttttttttttttttgagatggagtcttgccctgtcgcccaggctggagtgcagtaagtgtcatttcggctcactgcaacctccgcctcccgggttcaagcggttctcctgcctcaaactcctgagtagctgggattaaaggtgcccactggccgggcacgatggctcacccctgtaatcccagcactttgggaggctgaggcgggtggatcacctgaggttgggggttcgagaccagcctgaccaacatggagaaacccgtctctactaaaaatacaaaattagccaggcttggtggcacatgcctgtaatctcagctactcaggaggctgaggcaggagaatcacttgaacctgggaggcggaggttgtgttgagccaagatcgcaccattgcactccaccctgggcaacaagagcaaaactccatctcaaaaaataaaaataaaaaaataaaggcacctgccatcacgcccagctaatttttgtatttttagtagagatggggtttcaccatgatgtccaggctggtctcgaactcctgacctcgtgatctgcccacctcagcctcccaaagtgctgggattacaggtgtgatccactgcacccagcaaaacccagacttcttaccaacctctgaggcctgtgtgatctggtcctggctgcccctccatcattctgtctctcccttactccactcaagccgcatgggttccttgctgcttctggatcctggcataacttcttcctgcccaagggcctttgtagttgctcttttctctgcctgaaatgttctgcccctagtatttcctttctgaggcctacatttggttcagcttgctggtcacctcctctgagagactttccttgaccttcagtttaaagtagccatgctatttctaaatccctctccagtcttcttgtagttttgtcatagcaacagcctctacctggaattttctttttgtttgtgtacttgtttttgtctgtctcttctattagaatataagccccatgattatagggcgtttggtttgttcatcattgtatctccagtgtctgcagctgttctttgcaggtagtaaacattcagtgaatactttttgaataaattattaaacaaatgaacaaaacctaagacatgaaaaaactgaggcccagagaagagaagctaatgagaattaatagtgttctttcatcctacttttgaatgctcattaagtgccaagcactgtattcagtgatttacatgcattatttttgccacttattcttaattgttataatgagttgtttggaacatcattttttatatataccactgtaccacttaaaagaaaactggaccaatcttattttttattggaaccttgctctgttttacaaagagttggaagcaacttaggaaaattcatacaaccaaaaggataatgtagctaagggagtcgggtgaaaggaaaatatgggtaagaagacgagccaaaagtaaaattagttcacacaaatgtatgttacaaaagtcctttgaactgagcagtttttatgccattctttataactaaatattgcccagattcatttaaaatgatggttttttaaaaatctaactacaggccgggcgtggtggctcacgcctgtaatcccagcactttgggagggcaaggtgggcagatcatgaggtcaggagatcaagaccgtcttggccaacatggtgaaaccctgtctctgctaaaatacaaaaaattagccaggtgtggtggcgcgtgcctgtaatcccagctactcaggaggctgaggcaggagaatcgcttgaacccaggaggcggaggttgcagtgagctgagatcacaccactgcactccggcctggcgacagagcaagactccgtctccaaaaaaaaaaaatctaattacatagatgaccttgggattgtcccagactgcacctaatagtctaggatttgctggctcccttcctgcctcatcagctgggctcctggattgaggcaacacgatctcctctttttgccaaaggggctggtccagcagggaggagcctagacccctctccagtcctctctggacctagctaactttgtttcaaggagtcttttctgtagaaggtttattaattgagatattgccattggaaacccagttctgctctcaagatacttccagttgaattagagagaaaagacataatatacatgaaaggagatcttgtaaaagccaacaataaatgctaaatgccaaatgagggaaggacttcacagaagaggtgaggtttacaccgagccttaccacaaagcggagaaaagaggggctgtagctcccagtaggagagtcaatgtgggttaagatttgcaggctgagaccaactctcaagaagagacccgtgggcagtggcagtcaaattttaggcatatgtggaggggtctctttcattaggtaataaagccaaaaaggtcagctagaaccaggtttgtaggatcttcaagtgccagggggaggattccaaggccctccttggcagccctggtatcccaatagataggtcgtgcccagggactaatgcccatgctggccactggttgggctgctgattcccaggtggcaatggcagcttctgaaatgggagccagagccttcaactaatagtgaggggaggagttaagtgtggggccattgtcagtttagcttttggccatcccaggtgctattcatttggcgattcggcaaatgtttattgagcaccaactatgtgccaggccctgtgctacatgctgaagatgctaagataaacaagataaggtcaaggacattgctcttgtagaactcttactttaatgggagagacagctagcccgagaaacaaacaagattatttcagggattgggttaaatgctgtacagaaaatgaaactgagtaatggaatatctaggaagcaactatatgcatgggccaactcagttactcagctttgacactgttgggtctagttggtacctttgtttccttttgtgttatagatggaggtgatctttcaaatctcctctgcagagatccaatgggataatggttgactaccatttattgagcacctagcccatgtcaggtactctacatgcattttctcatttaattccctcacctagactgtgtgctaaatggtccattagccctactttcttttccagtaaagaaactaaggtttggataagtgaagttgcatgccagggtcctgcagctttacgtggtgaatcctggatttggacctagattgggctggctctaaagccaggcttctttcccctgctccactcttggaataaatgaaggattgttggttcaggatatgcagaaagctgcttagcaaaaggagagttggagaagcatcttggtttgagggtcttgaaggacacctactgtactcccagctgagaggactctttctcctcatcttcaggaggatgcctccagagcctggggttactgtaggcctttgccagaggcatgttcggacttagccagctgagtatcccctgtttcctgcttttaccatctcagctgctggtcaggaggtttgggaaggtgacatcatctagctgaatcagctgctgcttctagatacattactggaactgaaagtcattaccccttccttcctgctctgcaagtctcttcagaatgaggctggagtatgggtgttccacctgtctgcagggtcatgactggaatggtacttgctgcttttaaagagctaaaaggtttttaaaagcttgttcatggaaaaagctttcctcaaggcttctcaagctaagggaacagagcgtccttgagaggcaggaggattcacaggaaggccctccccgactccctcttgtccacctacatttagccatatgacccttctgatctcctttgcctaagtccgaggcttaggcctagcactgtaggatgggtaaacaaaacgttatttgtggactttttgaccttaagacttttagagtctggtcaaggggacaaaaaaaaactgcttacatttcagagcagaccagccaccacactattggagatatattggagatctccccttgactcactaattgaaaagcaaaaaagggcaggtgtggtggctcatgcctgtaatctgagcactttaggaggctgaggcaggcagattgcttgagcttaggagtttgagaccagcctgggcaacatggcgaaactctgtctctacaaaaaaatacaaaaattagccgggtgtggtgtttcgcacctgtattcccagctactcgggaggctgagatgggagaaacacttgagtccaggaggtcaaggttgcagtgagccatgttcacaccactataccccagcctaggtgacaaagcgagaccgtctccaaaaaaaaaaagaaggaaaatcgactgggtccagtagctcatgcctgtaatcccaaaactttgggagtctgaggtgggaggatcacttgagcccaggaattcaacatcagcctgagcagtacagtgagacctccatctctacaaaaaatttgtcaggcatggtggcacatgccaataatcttggctactcaggaggctaaggtgggaggatcacttgagcctgggagttcatggctgcagtgagctatgaacacatctcacagaactccaacctgggcgacagagcaaaatcctgtctcagaaaaaagagtcattggagggttttgaaccaagaaatgacagtccgacatacatttttaaaggatcaccaggctgggcacgatggttcacgcctgtcatcccagcactttgggaggccgaggcaggcagatcacttgaggtcagaagtttaagactagcctggccaacatggtgaaaccccatctctactaaaaatacaaaaattagccaggcatgatggcgtgtgcctatcatcccagttactcaggaggctgaggcaggaaaactgcttgagcccgggaggtggagattgcagtgagctgagattgtgccactgcactccagcctgggcaacaaagcgagactccgtctcaaaaaaaaaaaaacagcaacagcacatgctgaggattctgttcagtggtttccacttatcagtatagcacctcattaatcctcccaacagttttatgaggtatgctctagtggtatccacattctacagagaagaaaactgagactttgagaggtaaagtcacctgttaggccgggcacagtggctcacgcctgtaatcccagcactttgggaggatgaggtgggcagatcatgaggtcaggagtttgagaccatcctggctaacacggtgaaaccccgtctctactaaaaatacaaaaaattagccgggcgtggtggcgggcacctgcagtcccagctacttgggaggctaaggcaggagaatggcatgaacccgggaggtggaggttgcagtgagtcaagatcgtgccactgcactccagcctgggtgacagagcgagactccgtctaaaaaaaaaaaaaagaaagtcacctgttaaagattacacagcaaactgccagcatccaaagcctgtcctcttccctcttccatttgaataggctccttccagccaacattcatgtatattctatccaggctccaaagtccagtaccaagccagtcttttccaggaagccttccccaagcttatctaatggcctgtccctctattgagagctgatctacagagctaccatccattgagcactccatgggtgctaagtatactgctgaatgatttaaatatgttatctcatgtaatattccaaggagccatatgccctgtgacatccattttacatgtgaaaatagtgaagctaaaatataggcacatgccatcatgcctagctaattttttttttttttttttttttgagatagagtcttgctctgttgcccaggctggagtggcttgatctcggctcactgcagcctccgcctcctggattcaagtgattctcctgcctcagcctcccgagtagctgggattacagtcacccaccaccatgcccagctaatttttgtatttttggtagagacagagtttgaccacgttggccaggctcgtctcgaactcctgacctcagatgatccacccgcctcggcttcccaaagtgctaggattacaggtgtgagccaccacacccggccgactagcttatttttaaatttttagtagagacaaggtctcactgtgttgtccagactggtctctaactcctgggctcaagcagtcctcccaccttgacgtcccaaagtgctgcgattacaggcgttagccagcagtgtctggcctctaatgacactttattcatgagaataaatgccaaaatgtatacagtgcatgggcatatgactgggagaccttggtacgccagcagtggcaaggacagtcacctagaagtaagtgccctagagtacaccgaacctgggtttcaactgcccaggcttactccttctcaaaaccagcccttttccagctttgtgtccctgtgtgtttgcatgggtgcaggcacaagtagatgacacagtggtgatgctatgcacccaggacatttcataatagggaaggacgttgaccgctgccatggggtaccaaaggtcatcagggctgtgaaagccaaggacactcaggcagccttactcccctttgagtctgagtcatttcctgagggatattggtcattcattcatttgttcattaacaagtatttattgcattcctgtcatatatcagggactgagctaaaggttggacatacagtctgaacgaaccaaagtccctattctcacccagtggacattccaaggtgggtgacagattttaagtaaattaacatgtcagggctaggcatggtggctctcgcctttaattctagcactttgggaagctgaagtgggagtattgcttgagcccaggagttcgagaccaacctgggcaacatagtgacaacccacctctaaaaaataaataacatgtgaggtagtatttagtgatatagggaaaaataaagcagagaaaagggattagggatgggaaaaggaagggtagggtagttaggaaggcctctctgataaagtgacattggatctgaatgcagtgagggcatgagctgtgcggatatatgggggaatagtgttgtaggcatagagaacagcaagccgtaaaacaaaaaaaagccagatgcagtggctcacgcctataatcccaacactttgggaggccaaggcaggaggatcacttgatgctgagagtttgagatcagccagagcgacaaagccagagtttagttgggcatagtggtgcatgtctgtagtcctagctagctactcgggacactgaggcaggaagatggcttaaatccaggagtttgaggctgcagtgagctatgatcctgtccctccactctagtctggctgacagagcaagaccttgtttcaaaaaaattaaaaaataaagcaagtacaaaaaaagactctccaacatatttaaagtacagcaagttggccagtatggccagagtagagtaagccagtggtaggaatcaggtctgagacgtcaccaggggccaggtcttgtagggccacatgggaccttgctttaagggcagtggaaaggcatggaggatttttaagcaaagaagtgacaggttttagaaggatctctctgatgtggagaacaaactctatgggtaagagcgggagcaggagaccagtgagaagccaggtgggtgataacagcagtttataccagggtggatgggtggtggaagtggcgagcagtggtcagagcttcaatacaatttgaaggttggaccaactggatttgctgatgtttgctggataagaggtgagagagaaaggagtccaggtttttggcttaagaaactggaaagtccttactgccatttaataaggggaagatgccttggctgatagtgatttcctgctagggctgtggagttgaactgcctgcattcaagtcctagtttgcttactgttttgtttttgttgttgttttgagatgaggtctcactatgttgcctgtgcttgtctcgaactcctgggctcaagtgatcctcccgcctctatcttcctgggattataggtacgccaccaggccctgcttactgtttgactttgagcaagtgtttgactttgccaagccttagtttccttcaatgtaagcctactgtctagatgataggcagttgggtgctgtgaaaactaaatgagggtaatttgtatgaagggcttaggacaatgcctggcatatggtaaaccttcagtaagagttagctctaatccttattactattgttggaagacaagaagtcccagggcctcaaggtcctctggaaagcaggcagcaggtcacactccacctccaccaccccctcaaggagcccgccctccaagaggcagctcagacaccatctgtccagcagagaaaagccacagggagacagctttcggggagcattagatagatgagcccttcccaagaaacctaatctcattctcagcaggtgctaatcccaccaccctcccttggtatctgagcccagcccacccacttccttccccacccccatcctgtgtcctagaccctcttccccttctcaccagctccaagctgccaccagcaaacttccttaccagatggaggggctctgacagaagcccaccacccatctgactgggcccagcctctcacatgtatcaggtcaccaagggctacaggtgccacctgtccagaagccccccctacaggtgccagttcctgggcgtggtgcttgatccaggctggagccagctggagccaggaactcccactgtgccccagctgctgcctgccctcccacccacaggcagagaaacaggcttaacccttcggacactgcatatgttgagttagttgttacagttctggctcagagtattgcactgtttcagtacactttttttttttaaagaaatttatcataaatacaacagagaatatctaatgcatatgtacaattttaaaaataggaaaatcatcacttgtaaactcatcacccagattaattaataatcaaacatatgtttgccttgcatgatggcttatgcctgtaatcccagcacttgggaggctgaggtaggaggaatgcttgaggccagaagtttgagactagcctgggcaacatagtgagaccaccatctctacaaaaactaaaattaaaaaatagctgggcgtggtggtgcacgcctataactccagctactcagaaggttgagtcggggatcacctgagcccaggagtttaaggctgcagtaagctatgatcgcgccactgttctccagtgtgggcaacagagggagaccttgtctctaaaaacaaacaaaaataaacgtgagtaccttagagccccctgtgtaccccctccccaatcacagctaccccaccatccatactcctgagttctgtgttttcttttgtgatatcttaccatgtcaaccaggctagagtgcagtggcatgatcatacctcacttcagcctcaaacctctgggctcaagtgatcctcctgcctcagcctgccaagtagctaattttttaattattattattattttttttagagatgggatctcactatgttgcctgggctggtctagaactcctggcttcaagcgatcctcctacctcagcttctcaaagcactgggattacaggtgtgagccaccacacctggctacctttttttttttttttttttaagttttactatatatatataggtatatattcctaaacaatataggatattcttctacatgcttttttttgtttttgtttttgttttttttttttgagacggtcccactttctcgcccaggctggagtgctatggtgcgacctcagctcactgcaacctccgcctcctgggttcaagcggttcttctgcctcagtctcccgagtagctggactacaggcgcacgccaccacacctgactaattttttttttttaagaccgagtctcactctgtcgcccaggctgtagtgcagtgtggtgcgatcttggcttactgcaacctctgccacccgggttaaagtgattctcttgcctcagactccctagtagatgggattacaggcacctgccactgcgcctggctaatttttgtagttttagtagagatggggtttcaccatcttggccaggctggtcttgaactcctgacctcgtgatccaccagcctcggcctcccaaagtgctgagattacagctgtgagccacggcgcccagccctaagttttgtattattagtagagatggggtttcaccacattggccaggctggtctcaaactcctgacctcgtgatctgcctgcctcagcctcccaaagtgctgggattacaggcgtgagccactgcgcccagcctgtgcattcttttaaacttcatttaggtattatgctgtgtttatcatctgcagtttccttttttcattcaaggttgagatccatccatgttacttgcatagcataatttgttcattttcgtatccatttatatgatcatgtctcaagctgtgtatccattctgctgtcagtggttatttgggttgtccccttgtttttgctgtttcagacaatgctgttatgaaaactgtttgtgtctcctgcacatgcacatgttcaagagtttctcccaggcagtggttcccaaactttagctgcccatcagaatcacctggaaggtttgttaaacctcagattgctgggctccacccccaaagtgtttgattgtgtatgtcagggttggggccctcagaatttgcacttctaacaacttctcagctgatgctgccactcttggtcctgggacctcactgagaatcattgttgtagggtttacacagaagtggaattgcttgatcagaaggtaatggcagattgttttcctgtgtttgtgtgaatttacacagccaccaacagcatatgggttttccattactttacctctttgttaatacttgatatggtcagacttaaatttttatggagctggtgggtgtgagatggtatcttgcggttttaatttgcatttctcagattacaagtggggctgtgaatcttttcttacatctgttggccattcatgtttcctctttgtaaaatgttcaagtccttgctccatttccttttgatttgactttttcttatgggtttgtaggcttttaaaatgtattttgaatactaatactttgtctatgcatgttacaaatatagtctttcagttcttctgcctcagcctcttgagtagctgggattaatttgttcgccgggcgccaccacacccagcctgtttattttattttattttattttattttattttattttattttattttttattttgagatagagtctcgctctgtcgcccaggctggagtacagtggcacggtcttggctcattgcaacctccgcctcccaggttcaaatgattctcctgcctcagcctttcaagaagctggaattacaggcatgcactaccacacccagctaatttttgtatttttagtagagacggagtttcaacatgttggccaggctggtctccaactcctgacctcaagtgagcctccatgcctggcctccatagggtgttaaaggctgtaaatttgaattatttatgacttaagttatacctagagcttattgtatatactgtattaatatttcttttttttttttttttttttttttttttttttttttgagacagagtctcgccctgttgcccaggctggagtgcaatggcatgatctcggctcactgcaacctctgcctcccgggttcaagcgattctcctgcctcagcctcccaagttagctgggattacaggcatatgtcaccatgcctggctaattttttttatatttttagtagagacggggtttcaccatgttggccaggctggtctcaaatgcctgacctcaggtgagccacccacctcggcctcccaaagtgctgggattacaggcctgagccaccgtgcctggcctactgtattaatatctcataatgaacaaaggtaccctctttgggaaaaagttggggctttttttccttttttcttttttaacttttcaattgattctcaaagccagcatgtgggagagagtttatcaaaacagccaggcatcatggcgcacgcctgtaatcccagctccttgggaagctgagacatgagaattgcttgaacccaggagacggaggttgcagtgagctgagatcatgccattgcattccagcctgggcaacagagtgagactctgtctgcaaaaaaaaaaaaaatacatactgacctgtgtgtgggatttgcttcaaaatactactggagtgagagatagtggttggggaacagatgaaatcagattggcaccaagttggtacttgttgaagttgaatgatgggttcgttttattctgtctacttttgtacatgattaaatattatcataagaataagtttaaaattggccaggtgcagtgactcacacctgtaatcccagcagtttgggaggctgaggtggaaggatggcttgagcccaggagttggagaccagcctggacaacatagtgagaccctgtgtctctcaaaaaaaaaaaattagtcatttgcagtggtacacacctgtagtcctagcttcctagctacttgggaagctaaaataggagaatctcttcagtccgggaggttgaagctgcactgagtcatgattatgccactgcactccagcctggatgagagtgagaccctgtcacagggggaaaaaaaaagttaaaaatatccaaggactatttccagggctacttgtgaggtagcacatcttttctttttttcttttttgagacagagtttcgctcttgttgcccaggctggagtgcaatagcgcgatctccagctcaccgcaacctccgcctcctgggttcaagcaattctcctgcctcagcctcccgagcagctgggattacaggcatgtgccaccacacccagctaattttttgtatttttagcagagacaggatttctccatgttggtcagggtggtcttgaactcccaacctcaagtgatccgcccgcctcagcctcccaaagtgctgggattacaggcgtgcgccaccgcgcctggcagaacatcttttcttaacgttttgttagccatttgtattcttcagagccaatttagtctccatctactttcaggagttcctgataaagtggtcttagcaggcatggaagagactgattttaaagaaaacaggagagggagtggtaaggaaagactggggaggggattttcaggcggttgccagcccttctcctagagcctgactactactgcctctaggattaagtttcctaccttcccttgtttcttccaggaccaccatgggataatttttattttctttctttctttttttttttcttttttttgtagagacgggatctcactatgtctcccaggctggtttcgaactcctggtctcaagcaatccacccgcctcagcctcctgaagtgttagtaggattacaggcataagccactgcacccagctgtctttcttccttccctcccctcccctgccctccccctccccttccctccctttcccttcccctttcttcctttccttttcttctttaattatagagacagggtcttgccacgttgcccaggctagtcctgaactcctggcctcaagcagtcctcctgcctcggcttcccaaagtgctgagattacaggcatgagccactgtgtccagccaatttttattttaatggtattcttctttccctattattttacctggacagacttaacccagaggatagaggaacctcatcatggatcctggtccgcttttagcttaacagcatccaaagacaaagggtcagagatggtagcaaccctagtgtggttgattacacagtagtggtgttattttgttgtcataggatgcaaatatcaaagttgtatctcttaagatctttctgtgtcagtacataaaagctttctcagtctttttaatgctgcatagtattctacacagggcactattctatactttaaccagttcccattggtagacacatttttttccagtcttttgcagttataatagtgacactcaatgaatagccctgtatatttgtcatttggcccatatatgaatacagtatatctgggggggatgaatccctaaaagtggaattactggggccaagggtatgtgtacttgggattttaatagggttagttagcctgggcccacagcagtgggtaccagtttacaggagaatcttttttcttaacacccttccacccaagtggagagtttggttcagcacatttctttttctttttctttcttttcttttcttttctttttcttttctttcttttttttttttttttggagacagagtcttgctctgtcacccaggctggaatgcagtggcacgatcttggctcactgcaacctccacctcctgggtttaagcagttcttctgcctcagcctcccaagtagctgggactacaggtgcccaccaccttgctgggctaatttttgtatttttagtagagacagggttttgctatgttcgccaggctggtctcaaactccagacttcaggtgatccacccacctcagcctatcaaattgctgggatttacaggtgtgagccaccgcgccggccatcagcacatttcttgagtgccttcctgtacctggccctggatataagataaacactttcatgtatcaagtgaaattgttactatttgccaggcaccagcacattatctgataatcctcataactactcaaagaggaaggcttttagatgagataagtgaagctcagaagggttaaatagggtgccatggtcatggtccagctattaagtggcagagctaggattaagcccaggtttcaatcctctgatgcctgtgctcttacagtacacctttacctgcctctcaggaggaagaacatatggtcttattgtctaatacagataaggaatcaggctcagagagggtaactggccacaaaacagccagcctggaagctatgaggaacccacatatgtctgatcagaggtctctggtctacactgagctgcctgcctccctcccggggaaagagtttgagaattttcttttttttttttttttttttgagacagagtctctttctgtcgccaagctggaggagtggagtggcaatcttggctcactgcaacctccgactcccgggttcaagcgattctcctgcctcagcctcctgagtagctgggattacaggcgcgtgccaccacacccggctatttttttttgtatttttagtagagaaggggtttcaccgtgtttgccagaatggtctcgatctcctgacctcgttatcctcctgcgttatcctccttcctttgggaggccgacgcctcccaaagtgctgggattacaggcgtgagccaccgcgcccgaccgagaattttctccgttcagagcttcacttgctatagagagcctcaagtcactggttctcagtgtgcatctattggccatcagagggtcctttagggatgacccatctgtgcttaatttactaatgacagtatagttgctgctatttattgagtgcctgccatgtgcaagatgctgtaaggtacagtgtagtttgttttgttttgttttgtttttgtagagatggaggtcttgttgtcttgaccaggttggtctcaaactcctgacttcatatgatcctccctcctggacctcccaaagttctgggattacaggtgtgagccaccagactcggccagtgtagtatttttaatcttcacaataatccttcttgggaaacatgttattgtcctcattgtccagattagaaaactgagtgtaaagtaagttaaattatagtcctaaggttgaatgctaataaagacagaatacaagtccaatatattggactcaaaagccctcacttaactatggtctccatgggcttcccttggctctctctgcctttttttattttttcttattgcttgaggccctttctggaaggtaagtctggattatctacttcacactgttttagagaagacttgtggtttccatttaccccttactccctccgctccatggcctttcagggagaacactgtgggtatcatgctgggtggcctggagggtccaagtaacaggaatctagaaggatggaccagatgtgaacaaaagaaagcctgagtaggacacaaaacagagaagtggggctgtaacatctctaagatattacagcttgctacttccactctctttgcaaatgtggtgaaacccaggctggagtcataaaataatagcataggatcattaactaaagtttgtctagtgcttccttgtgttcacacattatctcattgaacctctgacgatgctaggaggaggtaaatagggttttcctcttaccttgggtgaactgaggtcttctgactaagtctcaggtcctttctaccatttgtgctgcatccacatctctactgggaagaacacaggctctgcagtcagacacacctgggtttgaaccacctccattttgtgtgtgttggatcttgagcaagtgaattcacctttgtgaccatccatgtcttcataaaataagaattttaaacacacatgagggcctggcatatacaaaacattgaataaatagcagtgatctttttattgacatcagaagggggttggggacccagaggctatttgggctcctatggcatagctcttggaacgtgttaattttcaaggacaggggtttgcaagtcagagcaatgtcaagtaaagaacaggttctttgggaggccaggatatgctaatgggtgaacaatgtaagggaggcataataataatgccaaaggcctcctagagtacctgttcactgcacttttgggtctttggtttatatatgaagaaaatgaggtgcccccagaggggaagtgggttgccattgttacacagtaagttaataaatggcattgctgagattagaactcagtcttttgtctgccaagaaagcttacttttcccttacactccactgctcccttgaggggaaaaaaaaagggcccggagataggatcttagtgctttggaactggagagaaagccttagagatcatctgatccatcctccacacttttcagatgagaaaagtgaggcccgtggtgcttaattgacaggaccatagccaaatagagccaccacaaagcaggagtaagctcacgtttcttgaacctgaccatgtggaactttcaaattgccttttttctgtgcggaactagagcctcactgaaaataccagtggtttacaataagaacagctgtttagtttggggaacatttttccaaatagaatcttctttttctctctttctcaattctttttttttttttgagatggagtcttgctctgtcactcaggctggagtgcagtggcacgatctcagctcactgcaagctccgcctcctgggttcacgccattctcctgcctaagcctcccgagtaggtgggactacagacacccgccaccacgcctggctaattttttgtatttttagtagacggggtttcaccgtgttagccaggatggtcttgatctcctgacttcgtgatccacccacctcggcttcccaaagtgctgggattacaggcgtgagccaccacgcctggctgtctttctcaattcttaataaaaatatactagaagaagaaaaagctttaatggaggaccttggtagaaagcaggtaaaaattatatagagtctctaaaatctagggaggtccccagagccagtaaatttagaggccagccttctcgcctatcccagcaagcttatcacttgtcttgccctattcacaacaggccttcagaaggcccagccttcccttggcagctgcatgtggtgaacaccaacggaaatccctggtatttttctttgtatgcaaccaaccgtggagatgtaggtcaggcattgctggcttggcagttacaacatctctagcttcacccctgcacctgtagccgtgttcactaagcccctcaaagatgggaaatggatggtcccttcttaatagggtttggatccccgagggctcatatgggtggagtgggtttgggaggagacagaccatccggaatgtggagatgagaagggtagatctggctcttccctccttaatgtctgatgtctggtgttactatagctggattggtggtgcttctgctcagctcaccttagagtaatcatcactgacggaggagactggggaggtcccatccttcccctgggctcagctgggtccccagacctacacctgaaccccacgcctgtctggtgtttacggattgaagctgccaccctttgggacctatcctgttttcatttctgctctcagctctctggtctctgtggacctcacttacaggtttgtacgtgcctgtcacccacggtgcagccccatgaggctctcccagcctggcacactcatgcctctttggcctttgttctcttcaggaaaactgctagctctatgccttgctagggagggcttttctggcccctcagataggttcttttggtccaacctagctatacctttcctgagattcagtctctttgtccacaccctgggggacagggctgtggttccaaggcatgttggggggtacctgtgggccattctggactggcttccggtcagctggctgactctgccctgggtctcaaatatctcctctgtaaaggtgttagaccaggatcttcaaggtaacttagaggtgatatgcagatggacattttctgttttaatagtcagtgtattttatgttgatttccatctggggcaaatgatactctttataggaagaataataagttgccttttcattgcatttatttatttagcaaatatttgctaagtgtctactatctgtcaaccactattctagctactggggatacctgccttcatgaagttcacattcttttttttttttttttttttttttttttttttttttttgagatggagtttcactcttgttgcccaggctggagtgcagtggcgcagcctcggctcactgcaacctctgactcccgggttcaagcgattcttttgcctcagcctcttgagtagctgggattacaggtgcccgccaccacacccagctaatttttgtatttttagtagagacggggtttcactgtgttggccaggctggtcttgaactcctgatctcaggtgatccacctgcctcgttctcccagagtgctgggattacaggcgtgagccactgcgccgggccatcatgaagtttacattctaagaggacagagagtgattaggtggccggtggtaggcagcttttggtatgtgtttgcctttttaataaaggataattaaggaaggcctctgaggagcaggcatatgagcagagatctgcatgatctgtctgagggaggaaaccatgtaacagtctatggaaaaaacattccagacataaggaacaagtgcagaggccaaagggtgggaatggtgtgcctggcatgtttgaggaagagcacgggagatcagtgtggctagaacagagtaagcagaggagaagtgattggaaaggaaagtttgtgtgagcagtggtgagacattttggttcttcctctgggtgagatgggaaggcagtggagggttttgagcagacaggaaactgactttgctgacccctctggctgccatgtggtgaaggaaccatggagtcgataagaagctgggagaccagtaaggaggctgttaggacaatacaggcaagaaatgatactggcttggaccaaataatagcagtggaggtggtgggaaatggtgggactctagataaatttggaatacagattcatcaggatatattgacagatgagtgttagaggggatttaaggatgagaaagatgcagaaagaacaggtttagggaataaattgagaattttcagtacatgtatttaaatttataaaaagtaagtaaattgatagaataatgttaagtaggccaggcacagtggctcacagctataatcccagcactttggggggccaaggcgagagaatagcttgagctcagtagttcaggaccagactgggcaacatagtgagaccttatctctacaaaaaaagaaaaagaaaaaaaaattagccaggcatggtgatgcacacctgtagtcccacctagtcgggaggctgaggcaggaggattgcttgagcctgggaggttgaggcctcagtgagccttgatcacacgattgcactctagcctgggcaacagagtgagaccctgtcttgaaaagaaaaatgttaagtaaataataacagaatcacatataaggtcaaagcagtgatggctgaaattgtggatagagtggaccaaatgtgtctgtgctgccttccagctctaaaatcctgcttcagtgattcagaccacatagtctcccattcacagagaacaagaacttgaagctcagcctagaataagcagataaagtgacaggagagcaatcctttggaccaggcctacctcctgttaatttggaaggacttgggaagttcttgcacatatactggccttctggcattaccttatttatttattcattcattcactcagtcagtcagtcagtcactgagcaccttctgcctagtaggccctggacaacggcagctctgatgcttcttctctcctaatataaagcaagctaccctgacccccgctcccactggagcctgtctactctgtggcctggcatatgcctggcggtaatgtgtgtgctgaaagtggaatagccacagcctaggcagagccctgccctccctttgctgcactgtctctgtccatctctgccttcctcatcttattgccatccacactttgaggcctggtgagcaaatgattttgcttccatgagagcagcagaaatagttgctttatctctttcttcatataggtcctcatagttatcaaactggaaagaaatccccaagggcctcttctctcgccttttatagatgggaaacagagggccaagagggcaggcaactcccacagtccacatctaattcatcagcaaatcctttcagctctacttttattgattgattgattgattaagaacagtatcttgctgtgtcttccaggctgaagtgcagtggcgcagtcatggctcactgcagcctcagcctcctgggctccagcagtcctcccacctcagcctccggaatagctggaacatgccatcacgcctggctactttgtgtcatttttttgtaaaaataggattttcccatgttgcccagactggtctgaaacttttggactcaagcagtcctctcacctcggcctcccaagtgctgggattgtagacatgagccgctacacctggcccagccttactttaaaaaataaattctgaaactgactgcttctcaccaacttccctggcaccattgtggctaagccactgtcatattttcctgattatctcaccagacccctggagatctccacccagcagccagacggacgctatttaacaccaaggtcaggtcatgtccttcccctgctcaaaaccctacagtgctttcccaggacaagcccaagtctttaaatggcctaccaggccccacacaatcgggcccttggctacctccagatctcatcaccaccagtctcctcacattcactggacttcagccacactggcatttttcctgttcctggagcacctcaagcgtgttcctgcctctgggcctttgcacttgttcccacagccttttctcagatctttgcagtgcctgtttcctcatttcattcaggtctctgatcaaattcacctccttaagaagttgtccctgaccatggattctaatcttaccttcttccatgtttctctgtaccccctttctcacatttattctttcttaatgcatcaccgtctgacatgtttattgcctgtctcttcccatttgattataaactcatacaggtacgaattttcattctatttagtcactgctttatccccagcgcttagtacagtgcctgactcttagtgggcacttaatgaagatttgttgaatgactgagtgtccaaagctagggaaggcagcctgtctgggccttcctacaactccataggtcagcctggcttacaaataggtcatgtcccatcttagaaaactcatctaatagcttcaccaaagctacgtggcatcacttttgtttccaagataaagatcagacagagggaggaactctctctgcaagtactgtccttgcagatctggcttaggggaaagtgggttcatcactgagtagcctcagcacactcttccctttctcacccctcaaggcacccagggaaccaggggggaatgctacttccatgtacttaaagtcatctctgacttcgaaggcctaagaatagcagattctcagtaaatattgggtaggtgaaagggtgaaggaaagaaggtcttagtaaaatctcttcatgtatcctgttgcactggtaaatttaacatgctgtgaagttgaatgccctcactagtaaccaggggcctcaggcaaagtctcatcacttcgctgaattttagtttcctcattggtaaaatgggaacagcacctacttgcaagattttgagaattcaaacagtaaatattagttcagcaaatactagctgttactttttgtttgtttatagctacaaataagagagacactatgagaagcacaaatggagccactgattttttagctataaaaaaacaggctgggtgcagtggctcatgcctataatcccagcactttgggaggctgaggcaggcagatcacttgaggccaggagtacgagaccagcctggccaacatagcgaaaccccatttccactaaaaatacaaaaattagcctgcaaaaatacaaaaattagtgtggtggcacatgcctataatcccagctactcaggaggctgaggcacaagaatcgcttgaacccaggaggcagaggttgcagtgagcagagatcacaccactgcactccagcctgggcgacagagacagagtgagacttcgtctcaattaataacgataataataacaacagcagcagcagcagctaacatttacagaacgcttaccatggaccattgaactctgctgctaggcctgtgaagtaagtacagctgttttcattttgcagccggaacaccaggcttggagggggaaagtgtcttgctccaggtcctgcaaccaggtagtcacagaactagggttggaagccacactgtctcactccagggtagggaggcctgagaccaggctgtgctctgtccctgtatgaagccttggaggtatcccttcacttcctctgggcctcagtttcttacctgctcaggatcgaaccacacatctctgtgacgctctgaaatttctggtggtccacaggccacatcaagtgggacagtgagttgcttccaggcctcctggtggtggtgctctgggtattgactgtgaacagcacacctctgggtgccccctccctcgacatcaggcaaagtaccctagccctcttctcaccatctcaggcatcttactgttctgcaccttaaaggggtaatggactggggcagaaatgaatagggtagaaaacaagaaggaacccactcccttgtctggtgcagatcaatgttggatgctgcagagaagagtatgaggctgacagtcagtggatgtgggttttgtttcccagttccatcacatcacagaatagaaggaaatgcaacaccgtgggtgccttcagccctgagtttttggttacatggggtgtgagcattcatctgtacagtggggagagaagggtgttgcagggatttgctcccttccccaaatcctccagagctgttgccttctgctgtggaattccaaacatttctgatcagataaaggtggctgaaaatacttgggacttgtctggactagttggaggcggtgctggggtgaagaggtcgaggccacaggagctagagcgtggaaagatctagccttgcccaggagtctgcctggtcatagatgtgcctattgctctcttcccctggaatcctgcaggttcagagcaatgcccagcgggctttgaggtggagaaggatcagactcctttgtggcaacaagttctcctacttcagaatgttgcttctcaatttacacactaattactggatcttttggatacccctgagagagagaaccctggtagtcactcatctgtctgcatgagttactttcattctccttatgctgtagccctagacggagccctttgagatgattcccacttcatttgacagttggggaaaggcccatactttcccagagtctcaggcaggggaaaggactcacctgcaaatcagcgatggaactgggaaacaaaatccacatccactgactgtcagcccagtactctcttccccacagcatccagcactgatctgcatcagacaagggagtcgccatagctttgggtggagaggaggaaggagaagctgctttggactatggagcacttggggtcaaagacctcagaaagaagtcctagtttttggagattgctaccccattcctgcctgttgcctcagcacagtgcaaaagatgccttttctagaactttcccataagcttcctgtcccctttccttatcctgagagaaagtgtctggagaatactggacaccttgcataatcacctgctatattggggcctctttctagttttgccaggcagtgaggaaagggatgaagagagtgggaactggcctttcttctcttccctcctctctgtccaacactcagccagactcttcagcaccttctctggacccagcactgggcaaggcctaggggacagagcccatggtcagatgggggaagaagtgagcagctaggctccttgagaaagtgacctgtggattaagacctcagagataagtgggacagagcttggtagaagcaccagtgtgggcaaaggtcctgagtctgaacagaacatggcatgtgaggaatgaagcagcctggccctaggtgaagctgagaaaaccctgcaggcccttgtaagccatagagaaggctccgagacacaagctgagccatggtctactagtaagaacaataaaccagacatttactcaaagttaactatgtgccatgcacaattctaagacctttacatgtattaatttgaatcctcatggtattcttttgaaataaggacattttgggccagatgcagtggctgacgcctgtaatctcagcactttggggggccgaggtgggtggatcatttgaggtcaggagtttgagaccagcctgaccaacatggtgaaatccagtctctactaaaaatacaaaaaaattagccaggcatggtggtgcatgcctgtagtcccaattacttgggaggctgaggcagaagaatcacttgaacgtgggaggcagaggttgcagtgagccaagattgtgccactgcactccagcctgggcgacagagtgagactctgtctcaaaaaaaaaaaaaaaaattaaataaggatttttttaatccgcattttacagatgaggtcaaaagcaaaatatcttaatctagtttgcaagacttattggttctctgcctgctctgtgctctggcagcccagcttggtagagaagtagaaattaattgcctttatccagatagcacttccatttcacaaatgagacaactgatacttggaggagagcaggagagcagcagcggagagagagcagaactaagaccagccagtcaagggagacagagggagacgagcatcagctccctgacagggaagagttttccaacggggctgtccgaagatgaaatgtcccacccaggaaggagggagctctccataagtgcataaggagagaatgccctcgagatgactaccaactcccatgggtgtggaccatcagaatgaaacagacccactgtgggacttcagcactccacccttctgaaccctgtctgtgaaatgggggtgttcgtggtgagcttgagtattacatggaaggttggatgggcatgctgtaaggtccctggagtctccgactctgttccaagggtgagtattggtttttctcaccctggacactgggagaagaatggagggctgtggccatctacttacgaaagaatagggagtcaccagggttgaaatgagagagttgagatgacgggaggcatcggaatcccaggggatgagcctatatgagcacatagcagccacccaggaacagttaaatgtttggactctggagacagactgcctgtattcaaatcccaactctaccacttgtggcctctgtgaccttgggagggtgatttatcctctctgcctctgtttcctcatctgtaagctggagagtaataacagcatgtactcggtgggattattgtgaggattaagcaaattctttacacacgaagcacttagcaccatgcctggtacttagtaaacatcagctgttttatctccatcggttccagggaaggaggttatgagcccccaaatgagcatctctgcccccagtaaatgcttttctgaattctctctctttgcccccaagcccatcaccctggttctgagccagagagatggagagcccacactcgcactgctaggcctgatagctttctcgattccccagcggaggtgttatctcctcccggcacaaccgcttccttttctgagaaatgcaagtgcatctgtcaggcacagcttcttagaactaatggtgggggaggaggtggaggaggagaggctggcagctgaattgaacaggtcagagttggaggaagataaacatgaagtttgttgtgaggataccaccaaatattccctatagcccagatggcttgagccctctatgacaccccctgatctcaccactactgctagggaggtcaaggcaggagaaactgaggctcagaagccaaaaggcttgctgtggcacccacccatacctgggccggctggactgaggtgttgaccccaacacagtcttgccacccctctctttgccctgcctccactgagctgcttctccaagttgcccacctccaggcctatgtttccgtgggggagaggagaaaggccatgttcttctcacatctcgggagccaacagctcccctgggaaaaccagaggaagtggattccaaccacaaacctcacttcttccgagtctccgcctgcaactccctgccaaaagagtgataaggcctctccgtttgccctacccccttcctaccatctcccagcgatcttctagcaaggccatgtttgtctattcagcacacatttatcagcctctccctcagggaaactgaggccaggagcataaggtgactctgcaggtgactcacagcctgccaatgcagggatgtgagaaggacagaacaaggtacagttctggtgtccctggcacttttcctggctgctagtagcctcttcctcttctccacctacctctttcctgaaataaccaagcaggaaggaagcaatgggcctgggccctccagagtcacccaagaggaaggaagggttcgtctggcacaggcatgcttgttcctcactgaagccaggacggaagggtttcactttccctcctggtcttcgtcacatccttttcctgtggcaccagttcccctcagctggcaggagccagtgcttattcattcagctgatggcctcaggctactttaccctccttgacagacccagggccatggccctggctcagaatatggggtttgctgccaaacatactggggcttaaaaatggcttccctttttttttttttttttttgagacggggtctcattctgtcgccctggctggagtgcagtggtgctgtcacagctcactgcagtttcaacctcccagcctcaagcaattctcccacttcagtctcctgagtagctgggactataggtgcatgccaacacactcagctaaatttctaagatttttcttatagagatgggggtcccaccatattgccctggctggtctcgaactcctgagctcaaacagtctgcccaccttgaactctcaaagatgctgggattacaggtgtgagccatcacagctagctgccacttatccactttagctaggtctcagtatctctgagcctcaggttacctggacttagaatgaaggccttcctcagccacagaagtacatggacctggcccatgattgtcctttagaaactgagcagagtactgcatcaacgttaggagtaaaggcactgaaccagattgctggtgtaggcatcccagttaggtcaccagctcactacatggccttgagcaattcacagatcatctgtgggccacatatccatcagctatatgggttaatggtagtacccactgacagagtgtagagacaactaatgaactaatctacaaaaaaaccaagaagagtaccttacagagtatgtgctcaggaagtgtgcgctgctgctgaagtcactaaggaagtcaggttttctgtgggtagagatagcagggtctaagatggcaagattggacatcagaatgagtgtgaatgaagtactatcttggatagattaaaagaaaaagaatggtgtgaggccagaactcagacagatcctactcttgccacttcctagatagggatcttgggtaaattctggagcctccattttcacatatgtaaaatggggctattgataaatgttatgaggatcaaatgaaagcattcatttgttcttctaaaatagatttatttagaatggcatctgctgtgttccaagtatagcacaccaggttctagagatacaggtgacagagccacacacagtcaagtgggggagacaggacaaaaaataatctctcaagtgaatatgatgattgtacatgtaattgggaaatatggcctagtgtgcatagactgctttatagctcagtgcccagcacaggtgaaacactgaaatgtttggtaatggtcagctgtcataataatagttttttgtttctttgcttttatcttttgtttttttgagacagggtctcactctgttgcccaggctggagtacagtggccccaaacatgattcaatgcagccctgacctcccaggctcaaagatcctcctcagcatcctgagttgctgagaccatagatgcataccaccacacccagctaattttttttttttttttaatttttttgtagagacagggtcctcctgtgttgcccaggctggtctcagactcctgggctcaagcaatcctcctgcctcagctcctaaagtattttattactgttaacaagtaagggctgggtgcggtggctcatgtctttaatcctagcactttgggaggccaaggaaggtggatcacctgaggtcaggagttccagaccagcctggccaacatagtggaaccccacctctactaaaattacaaaaaattagccaggtgtggtggcgggtgcctgtaatcccaggcaacttgggagactaaggcagaagaattgcttgaacctgggaggctgaggttgcagtgagccaagatcatgccactgcactccagcctgggcaacagagtgagaggctatctcaaaaaaaaaaaaaaaaaaaaagcaaggacaccatggaccagagaggtgaagtaacctgctcaaagtcacactacttggaagaagtgggaagggtgggcacagttgctcatgcctataatcccagtactttggaagaccaaggtaggaggatgaggccaggagtttgaaaccaccctgggcaatgtagtgagactccatctctccaaaaatttacaagaaaaaaaaaaagaaggaaatgtgggcagtgaagccaggatgggaactaaaagatcagattcaagtagggactatacttcagcctctggctggtcctctggcacttgggcccctttcctcagggcatcatgccaaccttttcacctgacttctacagggtcacaggcacctacaaggtgacctgcatcgttcagttggctgcctctgggcagagatctagctgaagtcagtctgtgcctgtctgagtaggtcctgggccagacttggtccctgcctgcactgagcccccagactgttgggggaaaccaggcacacagaggccatcaacccaggaacacccctcctctccctcccacctcagggcctttgcacttattacctctgctaaaacaggcttttttttttttttgagacagggttttgctcttgttgcccagactggagtacaataatgtgatcttggctcactgcaacctccatctcctgggttcaagcagtcctcctgcctcagcctcccaggtagctgggattacagatgcctgccaccacacccagctaattttgtatttttggtagagacagggtttcaccatgttggtcaggctggtcttgaactcctgacctcaggtgatctgcctgcctcggcctcccaaagtgctgggattacaggtatgagtcattgtgcccggctcccccagatattctctgtcacctccccaggacttaaaaccctatcatctctaaaattatcttttttttttcttgttatcctctctgcttcccagtaagacagggtttctcaaccttttttttttatcatccacccctgcaaggagtctttttcagatttttttgtcctaattgccctcccatgaaatttgaatacctcagctatactatactatatatagtatatatagatatagatatgtataatatataatatatagtatatgtaaagtatatatatagtatatacagtactatatatactacatattgtgtgtatatatatggtatatatagtatagtatagctgaggtattcaaatttcatgggagggcaatacctatatactatatatactatatactctatatctccttatgtgctgtggccctgtggagagccacaaatcactgtaatgtctaagaatgcttcacttcacgccattggaggtgatcttaccaccattgagaatggactagaacataagctccatggaagccttgctcacggctgagtctccaatgccagcctcagtgcatacccctggtataaacagaagtccaaggagtctgggaacagaaaggagacattcatcccagaggttggggagggatgagcagggaagaggggactccaaaatggagtcctataggcttagtaggggttggttaactgaggaagatatggagtgaccagttaaaggacagtgttggcaaaggcaccagggcctgaagcactcaggagtatgtagtgtggggccattccaagtgggtggccaggactgttgaagcctcttgaagtattggaagaaggaccttgaaagtgatactagcctgggcatctcctaggggccaagtcaggagacccagttttctagtgtaggctctactacaaaccagcagtggaaacgtagaatgggcaggtgggttggccttgctgacttcatgggcctacctggctaggaatccatgactctcctgtggaggtcattagccattgcctgtcgccagtggccctacaaacccccacatggaagtcagctaccccactttcctcttaactcaagcagaggatgcagacaggcccttgggcctgggtctcctagaaacctttgtgacatcagagacctccctacaacccactcttaaacctcatcccctgcctaccatgccagcctggttaaaaccagtgggagccacccaaggtgcagtaggggcttatctctgcttttccagaccagggctgctctgcaatcctgtttatttatccagagcagccgcctgctgagaaaatggctctgtttatttccaagtgtgtcgtgtgaaccatgggctaaatatacccacgccaccgcctctccagcacccgccctggaacagcacgccccattttgctcatgctgtctccgcaaaagcaatccttagaatccacaccccttggaaatactactccccttccccaggaaaagaagctgaaatggaaatgaaggttgtcatgaccaggaacacatgagtggaagctggggcaggtgaaatgagaatgtttctatggcactgaaatgagaatgttccctccacccaggaatgactgtttctggacagtgaatgctttgtgcccttgtggggacagcgcctgtttactccaacccagccccagagctgaaaatttcctgtggctgccagccgtctacttcaggaaagttcccatcaagggagccaggcctctcccattttggctgcaaccccagtgtccctggtttcttgagagacatttggcctcttgggataaccagggccttctcctatgctcttcatagtgtggaactctcccccatcacagataagcctattttgtgactccacctgggtgtacttgggagcaacaaaatcaaacctcctgtaagaatatttttgtctgccaagacccgcagaggctagctaggatggagagggagacagggaagcatagccacggccctagtgccctcctttccccagatcctccacctcaaccctgctcccacattccttctcctggaaatccatcctttcagcactactgacaggacaggtccctccagcctccaacttcagggaagtgtcctgacatagcagccctccctttgaagctaggcagtcttgcagtttgatcccgactctgctatctgtttgctgagtgttccctgctttaaatatcaggcatcttatttgtgaaatgtggctcaaatctacatctcaggattctgatgaagatgaaatgggataccaatgcctgacatgtagtagacatgcaatacatttgttaactcatgtattctcatgtatttacagagcaagacactgttctgagcactgggtgtataggaacgagacaggacctctgccctcatcaagacacatctagtataggccgagggcagtggctcacgcctataatcccagcactttggggctgaagagggcagatcacttgaggtcaggagtttgagaccagcctggttaacatggtgaaaccccatctctactaaaaatacaaaaattagctaggcgtggtggcaggcgctactcggggggctgaggcaggagaatggcttgaacccgggaggcggaggttgcagtgagccaagattgcaccactgcactccagcctaggtgacagagcaagtcttcgtctaaaaaaaaaaaaagacacatctagtatggaagacacatcacaacaaaaacaaagtacagaatctagttatgagaagtacagcttaatgggggaaaaatgtggtgaggtggtgaggccgggcatggtggctcacgcctgtaatctcagcacttgggaggctgaggcagaaggatcccttgagcccaggagtttgagaccagcctaggcaacaaagtgagaccctgtctctacaaaaaatttagaaatattagccaggcatggtggtgtgtgcctgtagtgtggcagctactcaggaggctggggcaggaggatcatctgagcccaggaggtcaaggctgcagtgagccatgattgcgccactacagtctaacctgagtaacagagtgagacactgtcacaaaaatttaaaaattaaaaaataaagcactgagaagaaaagctggcatggtggtcattctgtgtagtgtagttcctgtaatcaggaggctgaggcaggaagattgcttgagtccaggagttcaaagtcagtctgggcacatcttttaaaaacaagaaaaaaaaaatggtggctgggcatggtggctcatgcctgtaatcccagcactttgggaggccgaggtgagcagatcacctgaggtcaggagtttgaaaccagcctgacccaacgtggagaaaccccgtctctactaaaaatacaaaattagccaggtgtggtggcacgcgcctgtaatcccagctacttgggaggctgaggcaggagaatcgcttgaacctgggaggcggaggttgcagtgagctgagatcgcgccattgtactccagcctgggcaacaagggtaaaactctgtctccaaaaaaaaaaaaaaaaaggccagatatggtggctcgtgcctgtaatcccagcactttgggaggccgtgggcggatcacttgaggtcaggagtttgagaccagcctggccaatatggcaaaaccttatctctactaaaaatataaaaattagctgggcatggtggcacatgtctgtaatcccagctactcaggagaatcgcttgtacccaggaagcaaaggttgctgtgagcccagtttgtgccactgcactccagcctgggggacagaataaaactgtgtctcaaaaaaaaaaaaaactgagaagaaaaatcaaggaaggtaaggggacaggcagagagagacgggggtggtgtactgttttagacaaggcagtcagggaaggcctcccctaggaggtgacatttgaggggagtcatggttgtgaaatgagggagtgaggcaggcgacgacctggggtcaggtgctccaggcaagcaggaacagcagactcctgcggcaggagacgttggaggaacagcaaggaggccagtgggactggagtgaagttcaggggacaggggtggggaggaggccagaaagtgttggagccagatcccactagaccttgctggccagagtaaggagtggggactttatttcaggtgtgatggaagccctgggaaggttgagaacttggagtgactgaatggagtgtgcttctgcaagggctgagattcatgggtcactgctctctactgccttaatgttgaggattccttcagtcaaattagcagctcagtgcacatggcattttgctaggtaccagggatacaaaaataaatgatgctgcccttctaagtgcaggagaatgctgctggagggcttccagtgttcttagaaagctctgtgtggagcatggactgagggggttgtcaagactggaagtgggccacggcaggggtcacaagtgagcaaattgataggtgagacctgaggccaactggagatggcatgcctgtcttgagggagcagccactcggccatttgggactggttggaaatgtaggcccagtgtggcagaggtcttggtagagaggcaagaaccagccagtaactcattcattttacacacacacacacacacacacacacacacggtactatggtacttccttttttttttttgaacggagtctctgtcacccagactggagtgctgtggtgcgatttctgctcactgcaacctccgtctcccgggttcaaacaattctcgtgcctcagcctcctgagtaactgggattacaggtgcgtgccaccacacccggctaatttttgtatttttagtagagacagggtttcaccatgttggccaggctggtctcgaactcctgacctcaggcaatccacccacctcagcctcccaaagtgctgggattataggcatgagccaccgcacccagcctggaacttacttctttcttacatatttctaggtgccagatgccagttttagattctggctccaccactgacacagctgggtgaccttgatccagtccctggaccctcagaggcacagcttcttggcctgtaaatggggagagacagcctgcattgcagaattgttgggaggattaaaggacaaattgggtactacgcttactcataaaagttatgttctaagcgtccttctccctgccccacaggctgctgcaccctgggctgggtaatttagcccacagctcctccttccccctgtcatgtgcttcccttctgacttagattcagggcagagggctgttgatcacaacctcctgggcccagagtcacaccccctgcagtggaggatgtccgggacaaggcctcacagaccccgtgatggaggcctgtcagtcctgcatcattgttaccctctctcctctgccctgctcttcttgtcaccaacctgcccaccagaggctccctccagagggaggagcctctggctgaagtcccaggacccattctacccctgaattggcctcaaatgaccctggggatttagccctgggcttccttatccctccctctggtgcagcagtagaaaatctgaggcctagtggctccacactccacactaccctcagactcaactctaggctccttgcggcttccaggccacgtatggtctggctcttgctcacccctgcaccatcatctcccccatgccctcctctcctgcactctgctccagccacctggcttccatcagttccctgaccctgcccatctcgttcccaccttggattctggagtaagtgctacttcttgacttacctcagacagggcactttcctcctctctacctgtttctcagcagtaacatggtttgattatcaccaatggagggtcaagaaagaggaccacccttagccctttacctggcccagagtgggcacagatggctacagtttttcacatcaccaaggccatagcatgcagatggcccctttccccacccacctacatcactctctgaggactaaaactgcaccttccttctctctccctgcaggatacttttgtggaactctatgggaacaatgcagcagccgagagccgaaagggccaggaacgcttcaaccgctggttcctgacgggcatgactgtggccggcgtggttctgctgggctcactcttcagtcggaaatgaccagacactgaccatccactctaccctcccacccccttctctgctccaccacatcctccgtccagccgccattgccaccaggagaaccactacatgcagcccatgcccacctgcccatcacagggttgggcccagatctggtcccttgcagctagttttctagaatttatcacacttctgtgagacccccacacctcagttcccttggcctcagaattcacaaaatttccacaaaatctgtccaaaggaggctggcaggtatggaagggtttgtggctgggggcaggagggccctacctgattggtgcaacccttaccccttagcctccctgaaaatgtttttctgccagggagcttgaaagttttcagaacctcttccccagaaaggagactagattgcctttgttttgatgtttgtggcctcagaattgatcattttccccccactctccccacactaacctgggttccctttccttccatccctaccccctaagagccatttaggggccacttttgactagggattcaggctgcttgggataaagatgcaaggaccaggactccctcctcacctctggactggctagagtcctcactcccagtccaaatgtcctccagaagcctctggctagaggccagccccacccaggagggagggggctatagctacaggaagcaccccatgccaaagctagggtggcccttgcagttcagcaccaccctagtcccttcccctccctggctcccatgaccatactgagggaccaactgggcccaagacagatgccccagagctgtttatggcctcagctgcctcacttcctacaagagcagcctgtggcatctttgccttgggctgctcctcatggtgggttcaggggactcagccctgaggtgaaagggagctatcaggaacagctatgggagccccagggtcttccctacctcaggcaggaagggcaggaaggagagcctgctgcatggggtggggtagggctgactagaagggccagtcctgcctggccaggcagatctgtgccccatgcctgtccagcctgggcagccaggctgccaaggccagagtggcctggccaggagctcttcaggcctccctctctcttctgctccacccttggcctgtctcatccccaggggtcccagccaccccgggctctctgctgtacatatttgagactagtttttattccttgtgaagatgatatactatttttgttaagcgtgtctgtatttatgtgtgaggagctgctggcttgcagtgcgcgtgcacgtggagagctggtgcccggagattggacggcctgatgctccctcccctgccctggtccagggaagctggccgagggtcctggctcctgaggggcatctgcccctcccccaacccccaccccacacttgttccagctctttgaaatagtctgtgtgaaggtgaaagtgcagttcagtaataaactgtgtttactcagtg

SEQ ID NO: 37678 - DNA, 115395 bp, Homo sapiens
cgcggggctcgggtggccgcggcagcagcagcagcaacccccgccgctcgcggtcggcccccgggccgcagccatggtcccgagtggcggcgtcccccagggcctcggcggccgctctgcctgcgcgctgctcctgctctgctacctggtgagcgccggaccctgcccgggtcttcccctccgcgcggggccccggggacgcgggtgggggcggccggggacacccgccacgcggggcggggacgccgctgctagttttctctcttcctcgtcgctgcgccccgggcgttcccggcacctgggataggtaccccgggcgtggagaggggcgcttggaccggacttgccaagctgctctctcgctcgtgctcattcctttccctcctggactctctctagacccgggtcgggttaccctcgagaccccttcttgtcctcgactccacccgggagcctcgccgcccggagttcgctccccgccccgccgcgcgcagtctccagcaccccccaaccccccacccctcctgggcttccctctcaatcttctcgcagctcctttccttcccgtgcccaacttcgcctcttactctcggcgcccgccacccgcgtcgaccctccttttagtttccaccgggtcctcccggcccggacagttttctgccaacgcacctcgcatctccagcgctcttcaactcctccttggtcactccagccaagttgcggatgccggaaagaaatctagttctctgtaacacgcttaccgccagagtggtgactttagctgcgtcttgaacattgtcatttcagagaatatgtttggctcatgcatgtcagtttgcaatttgcacacttcttggcttctgttttagtcatcaactaaagggcagtaacctatttttcaaaacccatttattttaaataccagagtagctgagacccctcagaacaaagtggggagaaattttctcagttcctttgagggcttgcttgcttctgttttgagttctcctaaacaatagtaaatttacagaaggcgacacccttcctgcccagagtaacttatgttccacaatcctgcagaaaccttgggttatctcgccatatattactgtaaataaatgaaatggaaaatgctgaatcatgaaactgatgtaataggaaattcacagaatgccaaaaaaaaaaaaaaaaagagcagtgtcattgtccagaattcatttcacttatgtggcattgtcattatttggagtctttctttttggaagctaaaaactgcttaggagatactggcagaaattagaatttgattctgaagaaatttgccactcagcccgtttcttttaacgttttttacttcttgaatgtttcatttcttgaagcaagaaggtgtaaaaatgcaaattataattctgcctgtgcatctacctgttgagcaatccgtgcttttactcatatttcagaattagccaatatcaaattgtgtggttgggcttacttcatattttcataagaagttgtcagttaacatgaatgatatttttttgcccaagagatattattatttaatatttatgccacaaggttacaacacacaggctcataaataaaactgccataacaaatgacaagatttcagtttaaacagatgatccctgtacacagggccctgctggctacccacagaagcagaagtgatgtagtagagtgttgcgtgaaacattcatatacaaatgggccgggccgaaaagttccacgtggacatctcaagacctggcaaggagggggactacttctggacagttcaggaagtcagagtcaggagagcaaagcctaagggcctaagtggactctggaaacagagacagataatgatggagcaagtattcctgtgaaagttctgtgtacaccaagggggattaagagaacagagggaaaaatgatgccatggatagactcaagtgagatagtgaaggagtgaggaagggctccggaaagagtaattttagaaaatactgtgatgtggaaaataactagagcatggatgaatgtcttggcagatggggaaggaatggatttggggacctcatggtggggggaaatgtcagtgcttcctgcctttgtatgcttccttcagatggacttctgatacgcttactgtacaagacagactttgataaacaagagagccattttgcaaaggacacaaaaggccgacttaaaaggtagtctccacattttgttctgaagatctagccgtttactagggatgttgctcttgggtctacactacccaagatactactgaaggcaaggcttcttgatcttggagaagcttggtgtgagaattggggaaaatgtaaatatccatatgaaacacttgaaaaacataaaacaatagagagaaaacgcaaatgtataattgtgtgcattttgctcaatcaaggaatgctacctggaggaagtggttggtcagggggatggggctgggcaggtgcagggtagagatggagcagaatagctgggcaggatcccaggaatatgtagactctagaggaggaaaggtctttcataatttgaaagcctacatggtaataacgatagcttacattgtgctatacattgtgctaaatcgtttataggcattatccagtatttatcttagcaacagccctctgaggtaggagctactataatctccatttagatgagataacagagactcagagaggttaagttagttgccccaggccatacagtctgagattgaaacccaaatctgtctccctccagagccccagctctaaaccacactagcttattgtcttctggattttgctgcttgtaactcattcttcatcgatgtacgggccattagcagagctctagcaattagcagctactgtgcaattggccaggatgtgaggtcatgtctaaagtaatctaaaatatacaaagcaggaagcgcaggccacagaatagaagcaggatgttaaagtggggaagaaaggtaaagccagaaaatatttgccatcgttaatgaagagataaaggtttggggtttttatgtagtccagaggcagctggtagagtttagcatttgagtttggatgaatgtgcatacaagtgtacagcaaatgtgccttggaatgcattccaaagccaaattgcctatgatttggggaccagttcctgttttgtgttatcttcacctatttgcctgttcacaagggctggaggttgagagcagcttctgaatagatgcctttaagcacctgccctcacagggagcatgcttcctggagtcagggtcctgaggagtgggtgccttccgtctccataggctgggacggagtaaccttcagtatcagctcaaaaagagtactgtgtctgtagctaggatactgccaaagcatgaataattgtgatgagggctgaaagataagtcacggaacgatgccaaacagatttctgaaaagatgatccctggttccagtggctgccagaaaattctgaggtcaccaaaggccaagatgcagagagcctcctcagagagggagagggcctcgaaagcaaaagataatgaaattgcttccactgaggtcgcgggtgctgagtactgtgccccacgcagaactttccctgcccaacgggccttcttgctattttcttacaccattaactcttaccttcttccaacttggctagaaccagcctgaggctgccccagctctctatctgtgataatggcacttccagaaaacaattttgttcgttctaagctctggtctccaaagtataatattttcttatatgaaaagataaatctcaggatggccagtattgatgtcagctgtcagttgaaatgttcggagtggatagctgcacttgttagacaatcagactgaggacaaagaagtaagaggacattaacagcacagaggctgggcgcggtgtcttacgcctgtaatcacagcactttgggaggccgaagcaggcggatcacgaggtcaggagatcgagaccatcctggccaacatggtgaaaccccatctctactaataatacaaaaattagctgggtgtggtggcgtgcacctataatcccagctacttgggaggctgagacaggagaattgcttgaacccaggagggagaggttacagtgagctgagatcgcgccgctgcactccagcctggcgacagagtgagactctgtctcaaaacaaacaaacaaacaaacaaacaaaaaaatcaaaaaaaacaaaaacaaaacaacaacaacaaaaaaacagaacagatacatgtgggacagttagcagacagcggctgtgacagagccttgtacaggattccctgtaagtggccacacaccctcggtcatccatctaagagtattcattaacccctcactatgtgtgcaatgcagagcatgagaagatcaaaacgaggtaaagagatctgcagttatctagcttgagggagaggtattatgaatatttgaaaatagagatcatccccaaacctcacatcaaccaatagcttccatattcatcctgactggagctcctaaaatttcccaagccatggtgttggcctcttgccttctatttcttctggctgcctgttggcaaaagcgtcagagctagaggacaggtaggagagaataacccaggcaattcgctggaaacatggatagactggagtagaccgtaaatagcctaaagtgaattcagttaccctgtttaatggctcatgccattcccctgagaaaggagccgaggggcaggaggcgtgttcggcccatgaggaatggctgatgggattctgccttggcaggccttgtttccagtctctacctggagaagggcttagttatactggggagctggctgagtctggtgtttgtgtgtttgtggttaaggcaatatctgtctcctccaaactcaaggcatgccggcataatggcattttagccccaaccctttcaagatgggaataaggaaagtcatgagattccccaaccctgtagccagaaagcggtgacaggtgtataaaggcaaggacgtgagttgagggcatcatctttgggtgttgttagaagacaagaggcacaccttccctggctttggagtcagccaatgtggatttgaattttggttctgctttttggtagctggttgaccttgggcaagttacttaccctctctgaaggcattccattgcctcagctgtaacagtgggatgctgtctccctctgtgggttgttgtgaggattgggttagaagtgagaagttctatgaggtcccatgtgagaggtggaggttagaagtcagagagagaaaaaggtttaacacacccatcccagtgctcagtacacagtaggtactcaatgaaataagagcaaaccaagcttaggtagctttgtgtgatgtaagttgggaagaaacagcatattaaatagtatgggggagaatcttacacaaccaggaatattgatcatgactgtgatggtgtggctctggccagctctcaggtttaggagggaataatactcaactgggaagttcttccctaagcacatgctgattttgaagtctgtattgacatcatcatccattttgcttaattgcatgctttgttgacctaaacagaatttttgcttatatctagtagacagaaattacaaaaataggccctttaaggcaagacacttacctttttgatctagggaaaatgtgatccagccagtttgaagagaaagccctcatgagccacagttttcttagaagaatggggcagaaaggtcaggaatgagaaaaacagttattgttttcttgtcatacccacccacagacatgtgtacatgccaatgaacttcccgtagcaagatgtggatgatttaaagtttcccaatctctctgttccttccttaaataccaagtggagaccagatagagaacaaagccaagttttctcagctctttgagcaagggagggttatttgaatagcatctcttcttattgattttcttaaaggaatcaaatgcagttatcctaaaagaagtttaggtcatattgatagttttatttttccatccagaatatacataaattcatctgtttcttgattcccaggctgagttcaatgcatttagatctcctatttggggtcttctatcatgaacacacattaactggcccatttctttgttttttttttttttttttttaattacaatacatgcacatttacacaaaagcaagagaatctgtgttttgtgactgtgcatgacgttgtcaaatttgactttgatgagggctcacatctggtataaacatatttgagggctcaagcatttttcagggcccagctctgttgcgtgcaaaatggatcagtatgttgctttcaaggtggaacatctattgtagctgcctaaaccacataatttgaggggcacagatgcccctcttcaccccaaatatcttgcttagagttgcggtgcatttagactgtgcttttaaggcattatctccacaaagctggtgtagaaatacagatacgtgaccttacctcagtattttttcattatcacagtaacatggatgaacttgccagatgaacaggaattcagcagagggtcgagggatgagaaatcttaaaaatttaatttgtatttttggtgtggagaaatggaaacggtctagaatgtagggcagttgtctgaaaaggtctagagggaccaaatagctgggagaagtttgccccaaatggttaaggtgggtgccaaggtgccaccttctctgacctcacagttccccagctcagctctgatccccagggaccaatgaggtgccaaagggtaagggctctttggaaggaattaacgaggctgggagaaaaatagagaaatgatgggggccccttacaagagaacttacgagtataagaagaaggcagtggggactcaaaactgatcaagtcatttggtttatatgcaagtgccctcagggccactgaggcacctggcagaaatgcccatgcccagtgctttttttttttcctgagacggaatctcgctctgttgtccaggctggagtgcagtggcacaatctcggctcactgcaacctccacctcccagtttcaagtgattctcctgctttagcctcccaggtagctgggattaccggtgcccgccaccacacctggctaactttttttttgtatttttagcagagacaaggtttcaccttgttgaccaggctggtctcaaactcctgacctcaggtgatccacccgcctcggcctcccaaagtgctgggattacaggcatgagccaccgtgcccagccccagtgctttatttcagcaagaaacacttactaaattcttactgtgtgtcagactctatcttagaagctggaaacataacaatgacatggactctgaactcataatttctaaacaaaggaacatgcagataaatttttagcttgtgttaatgcaacctggcatgtgaaaatacctatgaaggctggacacgtgtcatgcctgtagctggaactcttcaagttaattgccttattttcctggcaggaaacagcttataaccacacacatgacttgagccaggaagtcagcttcagcttaatcaatatttagagtgtgatgtgttgctaatcagtgttggttttgtgcataggaaaggtagccacgactcgtggtgaatcagctgcccacaggtctgctacaagccaccggatgccagcttccttcattgcatgggtgcctcaaagcaccttcttgaagggtttagaccatgttctgcacaggccatgcagggtgattttgaggccctctttggggccaacacaccctcattaacttaaggaaacattgccccaccccgaagtttctcttctcttgtactccagctgtcattcaagcttctcctacttgtcaaacaatccatctcagtccttaaaatttgatctctttgcctagcttaacttcatgttatcctctgacttagatcttttctgaaagaaacaatagcaaaatgtcaacactctccaccagggaaccttttagaaaaatacagaatcaagccccatcaactacacacatatgaaatgatgcccagttgagctattcaccccgtttctcctatatgagaactcctaacaaagcatatcttctgtcaccttttgttcttcaaaactctatctgggataatagcttgataattggccaggcgctgtaggctcatgctgtaatcccagcactttggaaggccgaggtgggtggatcacctgaggtcagaagttcgagagcagcctggccaacatggtgaaactcggtctctactaaaaatataaaaattacccgggtgtggtggcacgtgcctgtagtcccaggtactcaggaggctgaggcacgagaatcacttgaacctgggaggcagaggttgcagtgagctgagattgtgccactgcacttgagcctgggcgatagagggagactcagtctcaaaaaaaaagcttgataatttagaaaagcagttcgcaaactataggcctgtgggcctgtccagtcagctgcctgtttttgtaaccaaagttgtatgggaccacggccacacccattcagttatgtgttgtccctatggctgtttcaaagtgtccctgcaaaacctaaaatatttaccatctggctatttttcttttcccaagaaagtcagctgacctcaaatttagaatagcactatccagttgaaatacaatgtgaaccacaaatttcaagccacatatatcattttaaattctctagtagctatgttaaaaaagtaaagagaggccgggggcagtggctcacacctgtaatcctagcactttgggaggccgaggcaggtggatcacctgaggtcaggagttcgagaccagcctggccaacatggcaaaaccctgtctctactgaaaatacaaaaattagctgggcatgttggcacatgcctgtgatctcagctgctcaggaggctgaggcaggagaatcgctagaacccgggaggcggaggttgcaatgagccgagattgccctattgcactccagcctgggcgacagagcgagactccatctcaaaaaaaaaaaaaaaaaaaaaaaaaggtaagaagagcaggcataatgaatattaatgtattttatttaactcagtgtatccaaatattgtcatgtcaacatacaattaatataaaatttattaatgagatattttgcagcccttttttttatacaaagggtttgaaattcaatgaatattttacacttacaggacatctcaaatcagaccagccacattacaagtgcttaatatgacttgtgactaccatgttggataacatatgtctaacacctatataccttggggtaacttttactgcacctgagactttgaaacaggtgaaaatgaaataatcttcatataagtatatggagagtttttttgaaacagaatttgaagggacggctctgtggagagtacacggtgaaatgtgtatatgccttcttatttttatttttattttggaggggacagggccttactctattgctcagtctggagtgcattggcactatcatagctcactgtaaccttgaattttgaggctcaagtgatcctcctgccttggcctcccaaagcactgggattaccagcatgagccacaacacctggcgtgtatgtatgtccattatccacaatgttataagcatggaccatcaaacaaaactgaaaccacactcagggtgctgcattaattaatgaagaaaagtggactgttgcatttttagcagtaagatgtaaaataatgaacacggttattatgaactgcacttttctagtaaaatcaaatggtcattaccctggcattctgtttaaaagaggttttcactggagatcctagcatcagcactaaaaatctgacaccccttatccctactcaaaaaattatcaaagtgggagagctgagcctgggtgagtttttaaggtatacatgaaaggaatgaggaagaggttttaagttgttctttgggaaagaacaaagtgtgatatttaatacacctctgcatgtcctgggtgctgggctgccctttgtctcacaaaataagcaaatgtcttatttgacatttgacttatttgtgggattagtgagggaaacattcggggcattgctttggaataaggcgtgttggccacccattggctggttcggcttccgccagcaccagcgatccctggccttgggtgaaactctgttgtggacttaacactgtgatttgcatcttgagaatgggggcgacatcttggcatatctggctgaattaataaaccagcacttatggacaaatgctgggtatatccctattcatgtggaagcagaatttagtctagagtttccaggaggccatggaatggtgaccattagtcaccattgatatcatttgctatggcgtggggaaggtgggagtgggtgggtggctagaaaaggagccaggtttctgggcttgcctttgctcacccaccagctgggtggtgttggagaatgtcacctcttgattgtcatttcctcgtctgcagaataagagagtagactggcttgtcaccagactcatccactgtaacattctctgcttctaattatgagatgatttttatatgtgtttcctccctgtaatctggcagcataaacgagaacataaaacaattaaacctctcctggggggggtggcatggacagtttgcattgtacccccttctttatatatctcttcccacaggttgcccatgactggtcaaaaggaatcaccagctcttctcctattccctctgccatttgcagaagacatagtttccactgtgaccttttttttttttttttttttgagacagagtctcactctgtcgccaggctggaatgcagtggcacgatatcggctcactgcaacctctgcctcccgggttcaagcaattctcctgcctcagtctccccagtagctgggactacagacatgtgccaccacgcccggttaatatttgtatttttagaagagacggggtttcaccatgctggccaggatggtctcgatctcttgacttcgtgaaccgcccacctcagcctcccaaagtgctgggattacaggcgtgatccaccatgcccggcccactttgaccttttaggacagttgctttctcctcacctacttaaaaaaaaattgtgtagtacacaattcaaaagttagggaaggatatacagtgcatctttctctcttattctgtctcctggtcacctcattcttatccgtgtaagcaaccagtgatatgtgtattcaagtgactatacacatgtacatatatatgtgtgtgtgtggtgtgagtgtgtatttaatccaaatggtatttctgagtctgttttttaaaagcaagcaaaaaaatgggaagtgactgccagtgggtactgggtttcattttggggcaatgaaatgtttgaaaattgattgttgtaatgattgattgttgactaactctgtaaatctactagaaaacgttgcaatttacactttcagtgtgtgaattgtgtggtgtgaattatattccaacaaacctgaaatttcaaaacctgggctgggcacagtggctcacgcctgtaatcccagcactttgggaggctgaagtgggtggattacttgaggtcaggagttcgagaccagcctggccaacatcgtgaaaccccatctctactaaaaatacaaaaatcagccgggtgtggtggcaggtgcctgtaatcccagctactcgggaggctgaggcaggagaatcacttgaacctgggcggcagaggttgcagtgagccgagattgcgtcactgcactccagcctggatgacagagtgagactccaactcaaaaaaaaaaacaaacaaacaaaaaaaagaaaaccctgaaaattcaaaaacaaacaaaaaaaccagacagaaaaccctttgcgatcattccattttctgtacgtgaagagcttcctccttttaatagctgtatggtactccatgagtggatgtactatttttatttaaccagctccctcttgatgagtttaggcttccctatctcctgcaattgcaaactgtactggtgtgaaaatctacacaaacatcattttgcacaactttcagtgtattagtaggttaaactcctagtagtgaaattattggtccagagggtgagtgcatttataattttagtagatattacttgattggcctcataaagattagagattactgccaccaacaatacataagagggcatgcttcctacactctggtcagtacgatgtgttatctgactttttgatctttgcaaatctagtagggaaaaaatggtatctcagtgcagtttcagtttgcatttatcttactatgaatgagcatttacttgttgattagctatgtcatttgctcatttttgtatgaattgttagccttgtttctaattgacattgactatcagttgctttaaaagggagacaccacccccttgtacagaaacctttgttgattctttgctgtcggtagaataaaagttcacattcgttgggctgggactcaatgttctccagggccaaactctacttttctttttaacctcatacctgcgtgtccacatagctgcttgctattccccaagtacacctgcattcccctgcctcttgcccggcttatgctgttcacaccccttgcagtgcctttcccttgtgtctctacgtgaagaacttcttttcgtccctcaaagcccaactgagataccgtttcttccataaagcctatcccagaccttccagttagaattattctctctcagtgctatgcacccttgggcttgtttacagtttgatgggaacactgaccacgtttcgcctgtattgccattatttatagacacgattccttgataccaaatttcatgtcttgtccatctttgcctctcccgcagctctaagtcagaattgaaaaaaggagtccttatttttttcctcagaggagaccaaagtgacttttttcttttaaattgtggtaaaaatatgcaagcattaaaatgtacctttttaatcatttctaagtgtacagttcagtggtgttaaggacattcccactgttttgcaaccagcaccactttctgtctcactatttcatcgtcccaaactgaaactctggacccattaaatcctaactcctcaatcccctcttcccttaggccctggtaacctcttttctcccttctgtctctgtgagtttgactactctaggtgcttcatgtaggcggatgatataatgtctgttctcttgtgtctagcttgttttccttagcctcatctcctcaaagttcatccattttacagcatacatcagaatttcattcccttttatgggctgaataatattccatcccatgtatataccacattttttctacccattcatccatggatggacccttggggttgcttttggctagcgtgagtaatgctgttatgaacacgggtgtacaaacatctcttcaagtccttgctttaaatttttggggtgtatatccagaagtggaattgctgggtctgatcataccataattcttttttgagatggagtctcactctgttgcccagggtggagtgcagtggtgtgatcttggctcactgcaacctccacctcccgggttcaagtgattctcctgcctcagcctcccaaggagctggaattacaggtgtgcaccaccttgcccaactgatttttgtattattagtaaagacagggtttcaccatgttgaccaggctggtcttgaactcctgacctcaagtgatccacccacctgggcctcccaaagttatgggattgaaggcatgagccaccacgcccagtctgatcatatgataattctgtgtctaatttatttgaggaactgctatactattttccatagtagccacaccattttacattctcattaagagtgcataagggttccagtttctccacatcttcaccaacacttgttattttctctctgtgtgtatgcgttgtgtgtgtttaataatagccaccctaatggatatgcagtggtccaaagtgacctttttctattgtgttttggatacttgaatcacaaagtcatatttaggagagctcttagcactcacatatcagcacctcatgctcaaaaccttgcattgatttcatgaccagataaataaacattcagctaaaatccttcttggtgcatgtagcattgtctgtggtgaaagaatcagacaacacagcccatcgtctgagcttacttgtgtgtgaccaggagcaatagaagcctcttgcctgtccatatatcatgcaggcttgccctggcttcaaacttatgggagaaaaaggggccaggttggcatccctgttatgttccctcgagggtgcacttttcacttttctgccaccctttgatttggtagtgtctgacccaccatttaaagtcaggacaatggtttgaaaatgtctgaagctgcattgtctctgttttattctaaggcaggttcccttgctactggatttgttgtgaaccaacttctgcctttgaaaaccaactctggaattattgccatgtagatgtgacagtcacattctgatcagcagatgttactgtgtctggggagagagtttaatgtggcctcatcttcctttgtatttgtgtgttggtttttccccaattcttcagtagtggttttgacatcttttatctcccgcattcattcattgctttatgtagattgatatttttttatcccaggaaaataatgattcaagtatctgttatgatgaggatttttaaactttctgtatttcttactttctttttctttttttcagaatgttgtaccatctttgggtaggcagacttccctgacgacatcagtgatacccaaagctgagcagagcgtggcttacaaagactttatttattttactgtctttgaaggaaacgttcgcaacgtttctgaagtctcggttgagtatttatgctctcagccttgtgttgtcaatttggaagcagttgtttcatctgagttcagaagtagcattcccgtgtacaaaaaaaggtggaagaatgagaaacatcttcacaccagcaggacacaaatagtacatgtgaaatttccaagcattatggtttacagagatgattatttcatcagacattccatctctgtatctgcagtgatagtacgcgcctggattactcacaaatacagtggcagagactggaatgttaaatgggaggaaaacttgctccatgctgtagcaaagaattataccctcctgcagaccatcccgccttttgaacgccctttcaaagatcatcaagtgtgccttgagtggaacatgggttatatttggaaccttcgggcaaacaggattccacagtgtcctctggaaaatggtaggtcatctatcttgctaggaacctaattctcattttttcagatagcctgtatcatgatcgaatggcaagagaaaattcttctattagcgaagggggatacagggaagatggagggacacaatgagtctgtaactttggagtttgaagacaaaaggagaaaaattaaaaggggaagagaggagaaagattaggagagagcaggaccaaagatgaaagaacagaacagaggagctgaggaaggtggactttgagagggttagatctgctttaagctggaaaggagtattcatgccaccgaaacaaggattgggaaaatcttcccactcaccttccaacaagcctgctaaagtttcctcttttttttttttttttttttttgagatggagtcttgttctgttgcccaggctggagtgcagtggcgagatctcactcggctcactgcaacctccgcctcccaggttcaagcaattctcctgcctcagcctcccgagtagctgggattacaggcacccaccaccatgccaggctaatttttgtatttttagtagagatggggtttcaccatgttggccaggctggtctcaaactcctgacctcaggcgatctgcctgccttagcctcccaaaatgctgggattacaggtgtgagccaccatgccggggcctctattatttttaagcagagtgttttatcctggaggagatgagaacctaaaggaacccttccaacagaaagggaggttgtaccacagaatggtaacctctggctgggcctgattcctgtcctgccactttctatctctgtaaccttggaagtctctgagcctcagttttcctatctgtaaaatggggataacaagcagttccttcagagcagtgctgtgaggactaaatgagatgtgattgctcagcacatcatcagcactcagtgagaagctgtgatgatgatagagtccacactctgcattttatcctaaatgccacatggtcacagcctcagcaggaccaatcccggaggctccaaggcccttctgcagcctcccttaagccgtggggctggagatctcaggcatgtgctgagaggcggcactctgaagttctctccattggtgcaaggagcgccttgctctgtggatgccgagtgcctgccagctcttcttctgccccctcagtggggagccctccccacacatgcgcccagttgtttcctcaactgtggccctaggaccacctgtgacagaatcacaaatgcttgttgcaaatgcaaattcctaggcccagtccttcatctacttagtcaggatctgcgggggtgggggaaggcttggaatcggcattttaaacaccttcctcacgactctaatgcaccctaaaacttgagaacctgtgggccagggacagagctggttggacttaggattgctatggttcccgtgtcccgacccccagccaggcttggcaggcagaggacatccatggatttgtggcaacagacccttccacaggaagtgcctgacatttcatcaacaggatgggtttgggacaaggtgacttaaggacatgcactctaagtttttcctttagtgatcaatttcttgtcatctctgggatgtgatttctgttgggctatctttgggggaaataatgactgtggcgatttcttggtactgtcccaaaacagctctgcatataatgaaaactgaaaggacctgtgtcaccatacatgatagttggtcagaagccacttaccctagaactggcacatttgatatttttcaaaactttttcttgttttgagacagggtttcactctgttacccaagctggagtgcagtggcacgatcataactcactatagcctcaacatcctgggctcaaacaatcctcccacctcagcctcctgagtagcggggaccatgggcatgtaccaccacacccagtttatttttttatttttttgtagagatggggtcttcctatgttgcccaggctggtcttgaactcctaggctcaagcagtcctcccaccttggccttccaaagtgctgaattaaaactattttgaaataagtatagattcacagaaagttgcaaagggtacagggtccctgtgtatcctcacccccgcttcctcattttccataactacagtgcaaaatcaaaattggggaagtaatgctgatctaatactgttaactggactccagaccttactcagattttaccactttttacagggggtcctgtgtttgtgtagatctatacaattttaacctacattttaataaccctgtctgtctggtttattctgcatttgtgcagtgctttaaatgaaaagatgtctagaagatgaaagtaaattccctttctgtgtgtgtgcacatagtggggagggtgggatgggtagttaaatgtctgaaagcagtcaagtcaatcattttgatgatcagtgtgcctccctcttccaggcagagccccatgcaggcatctgtctggaataccttccacagggccacctaatttgttaaggggaagatagcgtggggcacacacagccacaatttgctgtacctccgactttgtcagggattaatgattccatttcatatttgacaaatcatgtatttctgattgaagaatgactgaattgcaagctggaagtttccaaatgaaatcatttaacgaactggctcagttcttagggcacctgaatatgcccttaaaatgtgaaacgtcttttccttcttttgttgtttcttctcatattcacaaggcttaggaacagcacagtgggatttttctcctcacctgcttcagagcattaccttaggagtgagaattaaaccataacgcagagaaaaccctttcccaagagttaaagtcactgaaaatggtggggagctccatgcaccctcaaaataagctctgattacaaggctgtgatttgtttaccgaaaaaggggcacacattcttccttctccaaaagacagatcacaagagggtctgcagcagtcccatggaaaacatccatgacctttgttctggatctgggctgtggggatagaagggggccaagcctctggtttgttcttagcaggggcttcttgatgaacaagaatcaagtcagaacaagatggcattagtgaggctccgagctgagccacagggggcctgtcatgtatggtccctgtctcagccagcactgatgtggggtttcagggaaggttttctgtgtcaagtgcctggtgtcctacgatggccctgcctctgaactgaagtactccctgacttgctttcattttccttttcatgtataaaaagagtcaaagtccctgtgcccgggcgttctggaagtgtgcttggagggcctccatcgctggctttgccaaggctcccgaggcgagggccacgtgtgtccagacacggctctcagcagcttatctcctttgccaggccagacccggccaggccatgaggctgatttttggtggagacgcagcagacgtttacccagccctgcagggaaaacctaacccagatgagaagtcggtagccattgggaacacgtgtgtgccacgactcggccacatgcccccggtgcacgtgttactgctgcattctgggtgtggggggcatatgtagccataggcagactgtggatctacctaatgtggcttatttccttgagggaggggactgggcgtttctgttgtccctcccaaatcacatgtgtgcctgactcacgctggagtcacagaaagaaaggaatcagccatgcaggccagtgacttgggccccagacctggggacccacctggacttctcttcctgtcatactctattttgagagtcacctagtgctggctgtatgtgtcacatattcagtcccttcttgcatttctcaccacgtggagtgccgtcatcctggtctaagccgtcatcctcctgtctggactcctggcactgcctgcaagtggccacccagttttgcccgtcgtaccctcctcaccccccaccagcagccagtgcaaggtgattgcatcactgcctgattaagccccccagttcctcccataatccactgatcccagttaagatcaacccatgccccttactctgtgggaatctgtccctgtccccttgcagccttgtgtcccaccacgcacacccttccccactgcttccagccacaggggcccgcttgcttctcctggagcataccaagttcattctcactttgggacatctgtgtgactgctccctccacctaagatgctcttctcccagatcaccacatggccacttccttacctcacctacccctctgctccaatgccatctccttatctaagacagcaggcccacccccaccgccctgcctgtcattgtccaccttcattttccttcctggcctgatcaccactggacagtttcagtaaatatctttagttgcctatgtgcctatttcctggcccacactggagcacaagctccatgaggccaggggacttgtttgctttgttctgatgctgatcataggcccctgcactcatgactacttgttgattgaatgaatgctcttaaccaagagggaaggacagtttgtgaacatcacacactgatacccttgcagggctgtgttgccacatgagggagggtgtgggggtggaggtggcagtgctccttccctagggccactgcacacactccacagcttcccagacaaacccaccagggctgcgctagttaaggctgcaggctcctcctgttcagggattctcctttgcagccacaggtaagctcagcttcccctttgtggtttaagtctttgattccccacccctatgtctttgctaaagcagtttcttttccttagaatagctcctgttccgccccgactccccctgcccacgaagcaacaccgccccccactgccactttccatgtctgcttggcaaaatcatgcccctatttcaacagcctgctcaaatttctaacacttttctagcccccaccctgaagttttgttgagtttttttttttttaatttccacaaccagaaattaacttcataaatgctggccatcagaatgctgtgttggtactgctcctatgacacgtatcatgattcattcaattaaacaaagattgactgagcacctactatgtatcaatttctttactgagtgtggaggcttaaagatgaggacaaagccaccctctttaacatggctaccaatagttacagtcacttactgctactgaacatttgctatgtgccaggcactgtcaaagtgctttatgtggtttacgtggttatctaatttttttgagacagggtcttgctctgtcacccaggctggagtgcagtggcgcgatctcagctcactgcaccctccgcctcccaggttcatgcgattctcctgcctcagcctcccgagtagctggtgttacagacacgtgccaccacacccagctaatttttgtattttcagtagagatggtgtttcgctatgttggccaggctggtctcaaactcctgtcctcaagtgatctgcctgcatcggcccccaaagtgcagggattacaaagtgctgggtgaactacagcgcctggcccgctgttatttaatttaatatgcccaatattccaccaaggagaaaacagaaaactgactcagagagatagagtagtttgtctaagtttgcacagctattaatgaagatgctggagtttgaacctggatagtttggttcccaaaccccacacttattcattaggctaaactaccaggtgatgtcatgaagctatttatttattttaagtcattcattcactgaaaaaaagttcctgagcaatctgtgtgtgttaagcactttgtgtggcttcttcagaggaggtgacattttgacagagacttgaaggatgtgtagagttttcatggatcaaaaaggaggggctgggtgcagtggctcacgcctgtgatcccagcactttgggaggctgaggcaggcagatcacttgaggccaggagttagagaccagcctagccaacatggtgaaagcccatctctactaaaaatacagaaaattagccaggcatggtggcatgcatctgtggtcccagctacttggggggctgaggtgggagaattgcttgaattcaggagatggaggctgcagtgagccaaaatggtgccactgcactccagcctgggtgacagagcaagactctgtctcaaaaaaagagaagaagaaggaaaaaaaaaaaaggaatgaaagaaggacattgagctttcaggcagaggggaaggcataagctgtggcacacaaaggagaaaattccggattgggaaatggtgataagcctttgttccttgacgggaaagatggcaacaagggcttcatctcacaggctagcttgtgttgcttgggggtggctgcctagagcatggtgttgagtaggattctgaggatgagtctgcacttactgagaaagagtgccatgtccatcagttactgtctgccatggagtggaaatgtggactagcagcacacttgctgtggtttattttccaaggtataatctcaggtgtgacatgggcaattcaagaagtaagactggataagcagtttaggaacactcttggaaggttcttaaatgccctaatgtttagctttatgaacacttctctgatcttccctcttaaataagaaactctggggcaacatggcagttttcttcttctccactcttttcgtttcaaaaatgcattctcatcttcagatccaatggactggaagtatgattttttataacaaaatttcattacaacaaaatgattgaaagttaagtcaagtgttggaaccagccttgacttgtctttgtgaaaaaaaatggtttatgcagcaggactattcaagtcaatgtcatgatagtacttttagtagttataaactatatatttggcattaaaaaaaacagacctagttcctttttttccagttaatcatggtagtctgaatttttcagtaataacactaattaatgcctagcatctacattcccctttatgatttttcgaaacacttttttcacacacattgtctcatttaatcctcataatagtaccatgggaaagacagtattattctcaacctttctttaacaaagaggaaaaccgaggctcagggagtttgtttaactggagtccagacttcctgattcttttgactttgctatgccgcctctctgaaatatgctaatacagtcctaacccaggttctaaattagaaagaatactttttttaaagttgaatttttatcgatgtgaatcatcctgttttcttcacccactggactttgtgtctttgaagcggattgggcagacttggaggccgagggtggggaggccttgggatgtagctggctccttctatatgcctgcccggaagtgctcagagcttttgttcttttctttcgtagacgaaaaagtaatacgtgtacacggtaacaataaaaaaatttaaatagcgtgaaaaggtttaggggaacgagtaagtttccacacccctccccctcgaatcttctggtccttttcccagaagtaaattcattagcaacagtttcttgtgtttccttctagaaatgttctctgcacatacaagcgttaagttgtgtcccgttttcttcctgcacaaatgagaggattctagaaacagacctgcgctcattaacaatacagtagatttttctgtaccaggacatgctgccgacctcattcttttcaacagctccttagcgttgcatcgcctgacagaccgtaatttatttaacctatcttttgctgatgatcatgctgttgcttttaaccacaaggcttcactgaacatccctgtacatgtatctctgtgcacactcataagcatgtttggaggataaattactaggagtagaactggttttattcttaagattcctgccatcgaatgttccacagacttccttaggaacctgcttcactgcctagtatcctttctggaggaagttctgacctaaatcatatctgctagaaaatcgagtttttattctcagactttggctttaaagaaaattaaacaccttattggccactggcttttgaatgtcctgtgtttggaaagcattattgagctgcctgtgctctggctttatttctccaggttgagaaatcttcgcttctttccccgcagattttgcttacagacttgtagtcattgtgattccttgcattgagaccatcttcagcttctctgaaggtgggctgatgatctcagtggcttcattgctgtgtgttcgaagcacatctggagtggggttttgttacacagaagtgttacctttgttacgtggaagtgttaccttttcccaagcaagggatctgtgtcagggttctgatcactcagctgaaccagagaatgggctacataatcgtcccttaaccccacctgacccagggatgagatttaacatatttaacaaccagtgaggggtgggggcctcggtgaactccagtgggtgctagccttagtgctgaagccggctccagaggccgctgttgggccaggctctaacttgaaggaggggccagggtgggtggcggggccttggaggttcaaggtgacatcaattatcaaaccaaaatagaaatatttcagtgttttagcaaccagtatatccgcacaggtcatgcccactgaatatcagccgaggttctctctgggaggacttgtgagaagaaaagcccattggtttgcagtggggaggccaggtttgagtcatattagagcttcttctagctatgaaatcttcaataagacactcacacttttcttgtctccaaatggaggggtttgcaccatataatatctgttgcctcttcttgctctaaaatttgaggaaataatacaagcaaaacagcaaagggttcctaacatcaactgttttcctggcattctatgtttatgtcttaatggtgtctttgtttgtttgtttgtttaacctaagctcttcatgcaaaataagctaaagaaatgaatgtggggaaaggatttgaaagaagaaaggtcattctttggcttacgcagtgtggtgcacattacagaattgtggacagtactaggaggaagggagacaggttcaaatcctgacttggccacacctatattcattcattcatcaaatatttatggggtctttatcaagtactgcacactgttctagattctggggatggaatagtgaataagtaaggcccctgctttaatgagtacatcctagaggcaaagcagtaaacttctttggacctaagttttcctacctgtaaattatttagtggtggatggcactggtattgttgctacccattccactgcccatgacaagacatcactagtcaattatagcattgcactcagccataaccagttattagacaatagatctatatgttatcctgataaataacatataggataaataacatatcctatatgttattcagatgaattttaaagtcttctcctgctccaaaattaattcttgttcattacctctaattgtaatcaaaagacagtatcatactgagggcaaactgcactaggaatccaaattatacacatcgcaaagctacagatttgaaagaaaactaccattactttggttttgttgggtacaaacggtatgtgttcttgtaaaattattttagatctttggggctgagctttttccttcataatctattgcggcaagttctcccgtttgacctgctttattttggtctttggacagggaagagctcattgtcattcacgtttaactctttccactttagaaacctcctttatgaagcttttttttttaattggagtcaggttgggcagaattgaatcccatttgttttgacaaatgtttccactgcacactagatcactcaacagccatcaccagcagaaggcttcctaggggtctaacgtggccatctggtctcttctgctccactcaacatagtggaagccaaaccaaagttgagctgatgtcaacttccttggtgaatttttccttcagattccaaagaaaacctttgcagtacttccatttctcacccctctcaccacccccgtcatagaccagcaagtccagtgggcccaaattgagctcaaattgaaaaaacaaagggtttcaagtgcttctgttgaaattgataactccactcttttggatttccaaatgcatctctacttgtaacaaaccatgaagatttgtggctactggggagaaattggcttatttaatcttattaaaatacacaagggcctgtgattctaaaaactgctcttacgatttccaaattgtagtaaaccagaggtacctctctatataataaaactttttatttcctttgggaaatgagagctgggatgtccagcatcctaagctgaagcccccataatttgtgccgatattggtgtttgatggattgcacataaatcaactcttctctctccaagaggcccaggaaaatagactgttcccaccatttaatcatgaatgtctaaactaaggagtattttaagcagaagaaaagtatcccttttttttgagatggagtcttgctctgtcgcccagtttggagtgcagtggtgccatctcagctcacagcaacctccgcctcccagcttcaagcaattctctcgcctcagcctccctagtagctgggtttacaggcacgcactaccatgcccggctaattttttttttgtatttttagtagagatggggtttcaccatgttggccaggctggtctcgatctcctgacctcaagtgatctgcccactttggcctcccaaagtgctagaattacaggtgtgagccaccacgcccagccaagaaaagtattcttattcctaggttgagttaagtggattctcttttctttagttggggagaatagggaaaaccaaaaattcatacttaggcttgttgaaagtgttaggtattaagtatagatgaaataactcagttctccctttaagatttgttgtgaacatccctatgctttttagagctatagagaagaattctttcgtgtttgtgaaataaaatggaagactttccaatgttaaggtatatggttagtaatttttatgtagggtagtatgttgaatttactgtggaaagtttgcacagaagaaaaaaaactgcaattttaagagtatggattctgaaaccaaagagcctgagtttgaatcccagctccatctcttatttaaccctctctgatgctcagttttcgatctgttaaatgaggataataaaagaacctatttcatagtttgttgtgaaatgaagtgagattatccctgaattgggcttagcatattgccggtgtacactaaatattacttactattttggcaaccgtgcctctgttttctcatctgtagactggggataataatgaaaatgaaatgaacaaatttatgtagcacatttacagaaatgtcaggaccatagtgagaactacagaagtgttaacttactgttgtaacacaaattcagatacttttcttagcattcagagggcaagatgtgaaatgattatgaacacagaagcctgagttcagaacctgaattgtggttctatcacttattaactttgtgaacttagcctcgggcttttcatctgtagaatggaactaataatagaatctacttcacagagttgttatgaaaagtaattgacatggtctctgtaaagtgcttagcatggtgcttggcatttattcaacagatgtttgctaatatttttagggtatctcacttaaatgtttgattggagctcagcagaggctttcaggatgaatgtggtttgggaaggaatgtttttctggatataattgaaagggagccattttgctgtttgcagatgtggttgccctgcttggctttccttatgcctccagtggagaaaacacaggcattgtcaagaagttcccgaggtttcggaaccgagagctggaggccactcgacgccagaggatggattacccagtgtaaggatgggtagcagaagggagctgatcgggcggtgcttgttttatttgaggaccagagcaggctagtggaagaattccttaggaagacacaccttcttggtaaggtgttttgcaaaaatgttgagatttccatggcttagacagaattggtggacctgaaaacctcaaatgagtcttgaattattcttggcatttaacaatcctcaatttgccttagcctccttacatgacaacgagtagacagcaaggtgttgaagcctgaggccctgcaaggtctcaggtgcagccagccaaagccagcacacattgcagccttggctttgcctttctgtcgtggaagattggacgagctgtttgaaatctcacaacttctgatctcctccattgatttcagcaagacccagatatatgtattttttttccttctgctgaattgaagatgctgaaaatggttcctggttcacctcataccagatggatttagcagagtgatttaattcttcccatgctgctggctgtagaaagatcttgagtcactttaccgagcgtatgttcttgctaagcttccttgtaataacttatcttcatgagcttgctcagctgggtgggtcaggagggagctgtgtggcaccatctgtttgcatatcataccactgattttgaggccagattataaagaccagaaaggacttgtgtgtatctgcaaagaacctggggccactgtcactttaacccaaactgtaaattggttactggggtaaatgaagagaaatcaatgcattcattttgaccttgatccatgtttcacatacaaaatgtaatcattcccacttcctcatctttgaactactggtcagtagcattgtgtgcggtatcaaggggtgttcagtaagtcttttctgaatgattgatggatcacatatcttggctaaatgtgtcctggttaagttggctactggtattttatcctcactctacaagtcacagatgtacaatatttttttcgactaaaatagccccagtccaggaatgggataattagattaattgttccgtattggtcagccaggaccgtgatactgaataacctaatctgagcatgaaaatagcatatatgtgtccctattatcacatagtgatgccatttgtagatgattacatttttctaccttatggcttttatctgtgaaaggaacaaaattgctcaaaaggctctaattatgttttttcttttaacatagaaattaaaatagcttcttatcatatcacctcttattaaaatccagatttttttaatctatgtctgactttgtaagccttaatcaagaattcaaatagcaggcatgtgagattctcaaagaggcagagaaacagagtttttggtgcaaggtagaaagtctgctagttttgtacaatgaagcttaactcctgtcttttgcagttactttaactacctcctttgtttcaaaaatcaagctttgcaagctgatctcccatgatgaacgcgaaggcaaattcatccattcattggaaagaaagcaatttacttggtcattgttaaccataattacctgttcttggatgatatcaatctgcagaatttttttccccctcactcttataggtttactgtttcattgtggctttatttactccattattgcaaggccaacctctgtgggattctgtactttgttgactctaatgagatgtacggcacaccttctgtatttcttacggaagagggtgagtataaaacagaacctttaaaatgatattgtaattttgtaatgctctgcctagtgacagatatgtctgtctagaataaggaagatcctgtcaacatggcagcccagcaagagcaatgacttccaaatgtgggcttcaaatttaacttctttcccagaagcttaaacccaatgtcttatttacaaagaaatgcatttataaatgcgtgtttgggttttgctttgttttcgtggagtattgtagcttcttaggacaattgttgaaaaggcctagctacttcattcactcgtagatattttttgctcattttcatgtgctcgaattttccttttaggctatttgcatattcagatgcatcttgtcaaaggggaagaccttgctgtaaaaactaaattcatcatacctttgaaggagtggtttcgactggatatctcttttaacggaggccaggtatctgtatgcacgcttcatcacacgacatacgagcattttcgcttaaagttaagcattgctataaagccggggagcaacaaaatctgcaaaagcaaatttgtggtaaatgatagactcgttacaactacacgcttgctaaatcaaactttcatagatggaagtttaaatcataagaatcccatcccatttaattaacttttaaagtgctgcttttgactgtagggtgaatgaataaagcatacaggcagctctacagccatactgatctgagcaagtcagtccttttctcctggggagataggctttgtggagataaatgttaaaacaatattggccatgtttatatagtgtaatcagatgtacaactttttttttaaggaaatggattggttagttcagccaagaaatgatttgactgcttttggcaagtgaagcaattgcttatgtttggcattaaacagaccataataaccaacacacataagtgataattcaggtgggatggagggtctttatctactttgtagtataaaacattgtacataactgcttcaaactctcataacatgaattttatggattatggcaaatctgttgttctaattgaagacagttctatttctcaatatacacagtgtgggtttgccacctttttctggttgctttgttttctcatcagcttttcttattgatctgtgatttttcctgtaacaaaactggaagaggcattttgtttgtcttgtggatgagatgatgcacagtcttcccttggtgtttaggttgatcacatttcctttttctgtaagagaaaagaaatcaggtcagtccttgctgctttcctgagaagagtctgtaaaatgttagctgggattcttagtatgtgtgtttgtttacttaaaaatgttcagtgacatagcggtggtccacattttagcttcctatgtatgtgagaattatgatggccataatagcttggttgatgctttctcttacggagaaggtcagctcagtgctgttgtccctgagacaacaaatcatcagtgcagattcacagatcttattttgcacctactgtatgcaaggcactatgctcgagttgcttgtagactatttgtggaagtaacattaagcaggtaaaggactgtcacaaagcgagcttagttgccagatgatagctgggtgcggtggctcatgcctgtaatcccagcactttgggaggctgaggagggtgggtcacctgaggtcaggagaccagcctggccaacatggtgaaaccccgtctctggtaaaaatacaaaaattaactgggcgtggtgtacgtgcctataatcccagctacttgggaggctgaggcaggagactcgcttgaatccgggaggcggaggttgcagtgagctaagatggcgcccctgcactccagcctgggcaacagagtgagactctgtctcaataataataataataataataataataataattattattattattattatttaaaaataattaattgccagatgatttgtattgattcctagaagggagatagcattttatgctggaatgcttaggggaggtatcatgagaagatttctctggttggacaggatttagatggagaacggagaagagggtatttcagcatgttattgggggttagcagacaaactagtttgactggagtaaaaatttatggactatagaaagctaatagaagggaaaatacgtatttaggagtagaatgcagagaatcttggatatcagggagtttagacatcaacttgcaaagcaccatagaagatttttgagcagaagattaaaagtagtcctttaatgaaggagataaacttagtggtggagtacatagttgagtaaagcaggagagaattagaaagaccagataagtgggggcaaaaaattttttttggtgtgtgtagactttagcccatttgtccttcttctttctattctatctggtctaatatatacaggtcccaaacaacacataatgcttcccacccaaaatccacctctgtgatgggactagcatagtctgccttgactgaatgtataagtgacttaaatggttggtttaggcaaacaactggcgtgagacattttcttttctgaaccaacatgttgtatggctgaattgggttggtttctggtgggttagtttgtctttcatagaccaagtgtcgtagccacgtctttgagacacgccctaacacttactctgtggtggcactagcagaatgtaagtggccccttgagtcgagaggcttattatgttggagtccaagacatgagaagagcccatatgagacagctaacagcattcatgacaaaaaatagtgtccctgttaaaatgagaatgatgattcccagtgcttagggaaagggaggtgggaacagcagtgtgtgaagaacatacaacaccaatcttgttttccccctaaggctctgatggaatcagagcaagattttaaacactccttgtagtgtcatacatatttccttgtctttctacacaacaagcgtttaaggacaaatacatcaaatgagcctttggcttggagtttggaagtatctgaaacttggtggaaactgcattgtagatatttttaatcacatcaagtcacatttggggaagttaaatgtatgaaatcttaaaatatgcacagggctagtaaactgttaattttatttttgcagaaactgatcaggtaaaagactctccaacacatatcatgagtaatttacacaaaggactgcataggtaatgtagggtgatgaggcataactgattcttgtgtatccctcccatcatagatagtagtaaccactagcattggacaggatttgaaaagctaccacaatcagaccattaggtaagtgcgatttttctttttattcaaaatttgcctgcatgcgagttaaggaatcttcatactttagccctcagccctaatgttattccacatctcttcattcagcttttccaagcatggattattctctgccctgtagctagtctttgtactttttttttcctaccatgcacaaactctttctgcttcccccacaacctttttttctgagcaagaaaaactagtcctctctccagatctcattgtaaattcttcctttcatggcactttatagttcattttctttgaaaattatcttctatgaaggattctgaaaaataaatcaaagtattagtgttgcttattgagaatggttggtaactttggcctcatataagacataaaagcagacagtcttcatatttatgtttataatctggatttgaaatgtatgcaactattgatattggtgtcacttttcatctttatataaccattctctacaagagttacagaaactaagaactgagtttcctgcctgtgtttcataattttttaatttacttctacatccacgtataatcgtgggttttatagtgtcagaaccatggggcaaccttcattaggaattcaggataccttgccatagctagataatatatgtatataggtggtctctgacccaatgatgatttgatttgcaattttttgactttacagtgggtttattggggtaataaatgcattttgtactaatgataccttcaacttacaatgagtttattaggatgtaatcccattgtatgtcaaagaacatctgaaattgaaggcttaagaacaagtgtaggccaggggtgttggctcacgcctgtaatcccagcgctttgggaggccaaggcaggtggattacttgaggctatgagtttgagaccagcctgggcaacatggcaaaactctgtctctactaaaaatacaaaaataagcctagcgtggtggcgcatgcctgtaaccccagttactcaggtggctgaggcacgagaatggcttgaacccaggaggcagaggttgcagtgagctgagatggcgccactgcactccagcctggtgacagaacaaggctctgtcttaaaataaaaaaataagtgtaaagatcagaaataaaaattaaccaatttcgcatgtataattttaaaaaatgcatcagaacttttaggcactttgtctgggatgaggagtgttttattcttcgagtctgttatttcactgcagcaggcagaatgctgcctctccaaacaggctggggatacgcagagtcccgcacaacccaaattctcttgtatgctgattattaacgaaagggaagcaaagaggggcagacacagaaatagagggccatatatgctacttaaaaaaaataaataaactcttggcccggcattttacaggtggttcacacctgtaatcccagcacttcaggagccaaggtgggtgaatcacatgaggcaaggagttcaagaccagcctggtcaacatagtgaaacccccatctctactaaaaataaaaaaattagctggtcatggtggtgcgcacctgtaatcccagctacttaaggctgaggcacgagaattgcttgaacctgagagttggaggttgcagtaagccaagatcccaccacagcactccagcctaggtgacagtgatactctatcttaacaaaaaaaaaaaaacgaaaagataagaaaagaaatgcagaatcttgggctttgctccagagcttctaaatcagaatctgcattaaaaaactaaaaaaaattaaaaaaaaattcctgttttcacttgagtccatctgatttcttttaggctctgggcatatagaacaattcttattttcatggctggattaaaggattagagttttatagaaaggctaaagaagtgttattagcctgcaaagagagggtgcgggtggcttaatagctgcattgaaacatagcggctgaggcctagggagagagcacatgtcttcaagagcaccgaggtagattcagatcagccagaaggcgttcaacacataggagtgttgttatataacaggtggctaggagatcttctctgaaaagttcaaggacagtgaagcctgggagctgtctttggagaaacagatgatctgagtcagctttggagatcagatctccatgttctgtgaaatgggctctggccagaaattaaaggtttttgtttcaggacatgaagtttaaaataagagcttcctctctctcccctgaaacccacgtccagctccaggacattttcgaccactggttgaatttcataggctccttttcattttctttgtaagagtttcctttcctcttcaatcccagagatctagaggctgatatgagtgaatgggagaaagagtggccacagaatgatccagggctggggccggggtgaggcaagtgagcctaaaacttaagggggtgccagaaagctcagggattgcattagtttgttggggcctgccagaaccaagtgccaaaatgaagtggcttaaacacaaaaatgtattatctcagttttagagggcagaggtccaagatcacagggctggcagggccgtgctcccatgaaggtacaagggacagatttgctcccggtctctcctggcttctggtagctccttggctcgtggcagcataacttcagtcttcacatggcatcctccccatgggtgtgtctgtgtccaaatttcacttttttataaagatgtcagtcatattgggttaggggctcaccctactccagtatcacctcaatttaattacttatgtctgcgatcaccctatttccaaataaggtcacaatctgaggggctggagatttggactttgacatatgaatttggtgggaggaggggtacacaatttaactcaacagtaatcatgataagtaacatattaatatgatgtttttaaaaatcaaaatgaatgcagagaatctatgatgaacaaaatattaaaattttaagtaaagacataatcagtgtaaacatagaaggatcaagggatcaagactgatttgggggcacacaccaactctacatcccaattgaagcattgaaacaatttcttagtaaaagtggcagtactctggcctggcacagtggctcacgcctgtaatcccagcactttgggaggctgaggcaggcagatcacttaagtccaggagtttgagaccaggctgggcaacatggtgaaaccccaactctactaaaaatacaaaaattagccgggcatggtggtgggcacctgtaatcccagctactcgggaggctgaggtgaaggttgcagagagccaagattgtgccactgtactccagccggggcgacagagcgagaccctgccacaaaacaaacaaacaacaaaacaaaacaaaaaacaaaacaaaccaaaaaagctagccgtactcagacgcaggagtgcccctccccaccaccccagctgccctgcctgtactcctgagacctccccatcagagaaataagcagaggtaaagctagtcccagagggagctgtccagagtcccccgggggttcctgtagtcaggtatttggaatctcatccctgccaggaaccccacttttagagtgggccaagtcagtgaactaaacatcagatatttccagtttactggttataggtgttcccaggcaaggctcttacccctcctttttatttgttcctgtaacgtaaacataatgactgttgtcctacaaggatagtgtgagaagatcaggaattaagtgctcgggattgcagtgcaacgcataaatgaaaggctgtcaataatatcccatgacaggtgacagcttcaggcctctatagcgttaaattcattcatttattcaacacctgtttactgagcacctgtcacatgccagacacagcactcaactctggaaataaaatgatgaacacaaagaatacagactctgccttcatggagctaaaatattgagatggggagacaaacagaaaacaaattcacaaataaatttaaaattacaaatcgtggtgagtgctaggaaagaaatggataaggtagcttgaggagaacaagggggtcagaatttagaccaggccggccgggcgtggtggcttatgcctgtaatcccagcactttgggaggccgaagcaggcggatcatgaggtcaagagatggagaccatctggccaacatggtgaaaccccatctctactaaaaatacaaaaattagctgggcgtggtggcgcatgcctgtattcccagctactcgggaggctgaggcaggagaatcgcttgaacccaggaggcagaggttgcagtgagctgagattgcgccactgcactccagcctggcaacagagcaagactctgtctccaaaaaaaaaaaaaaaaaaaaaaaaaatagaatttagaccaggccctgaagaagtgacttgtaagatgatggttactctgtgggacatgggggcagccaatttgaagctctaagttctcataccacagaaacttcaagctggagctatttcttaattctgagagaggcctgtttcacaacgtcggtgattctttcaggcttctggtgctctgcggtaataaaccagggcactctcctatgtccagataagagtaaagatagtttgccagcatgtctcgggttttcaaaaggggctggcttgggctttggaagagtctagctcagcttttatgtcagtgaaattgatgaccatcaaacagtgcacagtacaaggaatctcttgcaatctttgtgcagacactgagaattttgcgggagaaaaatatgaagacatcaatgtacatggagaccaagctggacatatatcctattgcttgataataatgacaatttaaaaattacgattcagtgccctagggaccaagtaatttgttttttgttgaaaaactcagttaatgcaaggatccactaaaacagataactcccttaaacattttatttcaattaaaacatatatatgtatatattcatttgccaatctttctagagagggccttcttttgagtacaaatctgcagattagcgtttgctgtgggcttttttcacacttgtaaacaacacccaatttctgtttcttccaaatgaaagcaaagatacttgtgaaaataatcagagcccaaaagccatctagatttttctcaattttttcccatgacattttacaattttttagtaagctctattgcgtctacccaaaataatcaacttagtttttatagaaagaagagctctttcttccccactcatgttttattgaattacatatgtaagtaaatggtatgattacaataaatatactactgatattaactgtttgggctcaagtgatccccccacctcggccttccaaagtgctgagattataggcatgagccactgcaccaggccaacattaactggcttgagagtatgcacatcttattcttgctaagcatgaaactcaagatgtgggagccaaagtccaacagagggctaggttaaggatgataatcactgttgctgatggttatggtgtctgctctgtgcctgacactgtttgaaatgctttgtttacatattagtttatttcatcttcataacaaccatacaggcaggtactattactatttccgttttttaaatggggagactaaggctctagacagtaagctctaggcagtgaggcggtgagcatcccggatgctgtaagcatcagtcagtcggttttgcatgaggacagtcaggtaagctggggagttggttcagctgcagctccgttaagagggcttcctactgcagaagtgttgctttgtatccatctagtgccccgtgctgtctcatgagggttgttggaatgttcatgtcttttcaaggtcttggaaaacagactcagttcgcaactctcagagataataactttatggcctctccttaaataggcaggagagaccatcatcttcacagtcctacaagactgagattctgaaaagaaaaatatcaggagctgaagcacttcttttccattttggttgtgtttagacgagactaatctctagacgttcgatgttgctgctgtcagctgttgctgccaggctgtgtgctttgcttcattgtctcatgcctcctccctggccaggtgcacctgctagggcttgggttgtttgctaacagacagtccatccctcgttctgaaataaccctgggttgcctggtttccctgatccaactgtgggtagcttgccctgtccccatccatcgtcactccggccctttgctccttcggctccctgggctcctggcagcctgcctgacactttgttttctttccctctgcttccatctgccccttgtggttcctggctccatcttattgcctgacctctcacttgatacctgtcttagccctcactcccctcactgttcacatatgctctgatcacacatatgctgtgatctattctttaaaataagaatcctcccattcttattttaaattcttgttatttttattttatttatttatttttgttattattattttgacatggagtctcgctcttgtcacccaggttggagtgcagtggcgcaatctcagctcactgcaacctctgcctcccaggtttgagcaattctcctgtattagccccctgagtagctggattacaggcacgcaccaccacacctggctaatttttatatttttagtagagatgggcttcaccatgttggccaggctggtcttgaactcctgacctcaggtgatctgcccaccttggcctcccaaagtgctgggattacaggcgtgagccaccatgcccagcattattttaaattcttaataggtaatagatgcacatggttttaaaaaatcaaaactttgtaaaaatacagttaaatatcttgctcccaagcctaccctcatgcacttcatcccaaccccccaccaccccatggggagataattctattggtttcttgtatacactttggcccagagtttctttatgcaaatatgaaaaaaatctgttagcctctttcttagataaaaggtatgctctgtgtcctgtacttttattttttttacttaacactatattttggagatccctccaggttcctttgtcccttttttagttgcatagtgaaaaagctcaaggtacactaaattgatgggccagtccccgctgacagacaccggggttctcccatctttggcgaatataaacaatgttgcaaggaacaccttcatgcattctataaatgccaacccactttgtcctccctttccttcctgatgtttcaagcccttcaggacagtgtggtcctccaactcatcacctgtgctcacctctcatctccggccaaaccctctgacctggctgtggcctcctcctcctcctaactgaattttgcctcagtccttatctaatagtctacgcttttggctttcccccacagccaccttctattcattcaacaaggtttgttattttcttttaaagcaaaatatttccaatgaaaaccaacaattccagacaattccattgattctgaacaataccaccactatcaataccacatattgactatttactgtgggccaagcactctgctagatgcttgacatctttacacttcacgtaatcctcttaaccatccagtaagtggagaactatcatttgacacaggagaagacagcactggagaggaggttaagtgactgggctgaggtctcatagctggtaaacagcagaattgggatcctagccgaagtccacctgaccctacgctggtctcatctgctaaaactcagagtgaagggcttggggcaatttgggttaagtcaaggagggtctaggaaagagactgtttttaaatcatctagttccggcatggagctctcttaatccttcattctcttctctagcttccgggaggatttccattataatgacacagctgggtacttcattattggagggagcaggtatgtggctggcattgaagggttttttggacccctgaagtactatcgccttcgcagtctgcaccccgcccaggtgagtccaggggatcaggaagattgcggtactcctgggtgatgggtgtgggcctcaggggtgtgccacccagtgtaaataaaagtttacccaagccagaccatgcatcgcctctgtcatcagacatcattaatattgaggcttttcccccagcaaatgcaataaaaatttctgttaacatttggttcatttagtactcataaaatggaaaccattgacttcctctgttttaataactactagtttaattatagagtagattttcatcaggctgttgcctatccagcgattaagctaatgaaaggagagaatcttagttatttggtaaaccttcttttatataatattatttaaagtatcagaagagatactgtagcaaattaaaatcttggttccattggctgctctcttcagaaacacaggccttcagctcacgctggggtcggttggcagcagttgtatggatcgaaaagggcattgtgttcagggctgaatcctctgcacagtgccttccacatccataacccgcccccgaatggaactgtccaacgcttccagccaacacagctggactggtcgggggagagggctatttccctatgagggagccttcagggcacttgttttctgggctgctttaaggagatcaagaaccccacctgatacctgaaagagaaacattctgtcattcccttcaccctgtggggtttattctgagaaaaacaggggtcactaggcaaagtcataatcaggaaaaatggggagtcctgctgcccatgggtgatatcttacagcctctgtgagacacttttgtgaaaagggaaaaaaatgaaatagtcatttgtgcaacaaatgcttattgagaacctactgtatgccaggctttgaactaggtgttgagacaagcaagatggataggtttaaaattgttttgaaggttgtccacaataagaaatctgcttaatatcagccaagcgtggtggctcacacctgtaatcccagcgctttgggaggccgaggcaggcggatcacttgaagtcaggagtttgagaccagccaacaaggtgaaaccccgtgtctactaaaaatacaaaaattagctggacgtgctcacttgaacccaggaggcagaggttgcagtgagccaagattgtgcgactgcactgcagcctgggtgacaagagcaggactgtctcaaataaaaaaaattaaaaaaagaaagaaagaaatgtgtttaatatcatgaacagtacatatacatatgcatacatatattcacacataaaatggaaacaaaattattctaagaatacatacccttgctatattcagtgcacgctgatattttgtgttctactttatagaaacaaaaaacaccaccaaaactctggaggttcccacccactgaaataactgtgtgaccctctaatgggtcccagcctctattttgaagcacactgagctaagtcccttgttcctgaggcgctccctttcgggatcttaaacagggaattcatgaaagaatacagtacatgctttaattcagatgtgtttgggagtgctgaggcaggaacggatacatcggcccgtaagtgagatggggtgagccactaggggggcctgtcctgaagccatggccttgcagccagctcttggaggttgcagaagaggggaggagggctctctttgatgcagcaggcacgtcgtgggtacccttgcatcttttcgtgggaattgaagggggaggtgagtgtgattttctagggacagagtgcagccagagaaaagaagagggaagagtcccagtctctgggaaattctgacatttaagaagctggacacaaagagaagctgaagggaagccatcagagctggcatgtccttgaattagtaccaatgaccttgctttgcaaatccagagtggatgatatgtgtacaaacgagccacctggagatgtcaatgggagaacaaagtcaacccaaacacatcctcctagaggtggatggatatttgatgacaattgttgttcatttgactttcttgccttcttgtagatttttaatcccctccttgagaagcaacttgctgaacaaatcaagttatattatgaaaggtgtgctgaggttcaagaaatagtatctgtgtatgcatctgcagcaaagcacgggggcgagagacaagaagcatgtaagtgttgagcttcaggggagctgttttaagctctgtgcatttacataaacacatgtttggcttctccataacaggattaaaattaaacatatatgacttggctcagataccagatgggacaagtgtgaccttgagccctccactggtggatacaggtgaaattgtacattccacctggattctaccaagaccaatgacagccaagaagaaccaaaacatcttatagctccaaccataaaaatctagtttacaagtacaaatgaaagcgagtgttttgtgccttcgcatggcgttattcccaaccataaggccagcctaagaaaataaaaatgaactggaaaataaattaatcattagaaatgtttccccatcagtgcacttttgttttgggccattgatatctgaatattagctttcagaaatgttgaatggtgactttgttgtttggagcttggttttattttttaaatccttgaaattgactcattctcgaagacatcggtaatttttaacagaaggaatgaatttcaaatagactgctttcatgcatgctcatatttgcacagacatccttttactcacacagggtgtttatcagttacaaaacttggtcctgtctggttcgccagtgttccagcttggatctagcacttacacatttctctgtgctgtggatcttgctgtttgatatggtggcactagagttactcacatatgttccttctggaagagaaattcctgtgggacctttgccatcagcaaaagcgaattgagtatttcagtcctgcccatatgtctctatctccagagcggaacttctcattccaggtcgtggagggagggatgcatctcaaacatgccccagtccaatagggttcacatgaaatggtcccaggtagtgattacagatggtgacaggtgagtgtggaaagatagtgcttctgcaattcaatttaagaataggctatactggtccccagctgctgctctcactgctgaatcatccggaaaatatgatgctgtcaacaggagggggaagatatataggaatagtaataacccaaagaggaaagaaactgactttggtaacttatgtactctcaggagacataccctgagatagaaggccaggcatgcacacccatctgtttggtggcattaggaagattttcctatcatcttgaactgctttgcctccctgagggtctttgtgctttgctcctcaactcacatgccaaaaaatggcctagatattggcctcctggggaccggtcagaggccagctgctcattctgtagaattattcaacagccatcagcaactttggcacatttctcatggacttggctctgaatttgtgacctggaggcaaaagcatcatagccaatttcaaatcccaaaaggaccaaaaccaacatccagtaatggcaagtctttctagttcctgttaggaagaagggctttagggaggtgagtcttatcttctgctaaagggtgtgatatcttctgctccctcttctgtgtaggccacctccacaactcctacctggacctccagcgcaggtatgggagaccctcgatgtgcagagccttcccctgggagaaggagctgaaagacaaacaccccagcttgttccaggcattgctggagatggatctgctgaccggtaattgagtctttgcctcggctttaggcgctggttagaaaggctccttgtttttctctgtttcactcaccctctttggtgatttatgccttaaagttatttttaaccctagtgttttagtttaatttcagatttaaattctgcctttgtatgtccacaactctcgatatatctgtgcacacttccaacactaaatgcaaaaacttaaatttaggaatcgctcaagcaattctttattgaaagccaaggcggcaaatggataggccgcagccagagccagccccagatgcagttgatttggaaaataccttgttgtatatgttttaaaaaaaatcagttatctaaaaagcttgtatgaaaatgcaaatttctagctttttaaaaaaaaagaagaaaaaaacaaagatctggcaagactgggcctttctcctatgtggcagcaattgtggaggtgaggctgagaccaggcatactttgtccacccacagcccctcctgtctgtttcatcatctcctgcttacttcattcatggatctgacccgtctgagcccacagacacttgaacgtgggacctccgatttgaagtacactttaagcatcatctcaggaatctgcataaacttcccagatgccaccagcttctctgtaggcccagtgcaatttgggtttgcttagtaattcagtgcatattctagggacgtgagggatcttaaaactatgcctgttaggaagaggaaaggcagctggagatgttcggtctggtgaagaggatcctagcagggagttgccaactgtcttagtggtgggaggcaactccacgtagtcctgggcatagaaccagatcctgagttgaggcgatgcagaaactgacttctgcctcatgtaagattggtgtcttacattgtacccaccgcctaagaatggcagtgtctaacagcatagatttcctttgcaaatagtgaccatcctgcaaagaattcaagtcatataggatattttatcattcattcttctgatgcttactcagtgactactcagttgcttggctagacttcagagatatgtgaagtaacacaatgcttctgtccttgaggaatggacttgaaagcaaagaaaaatagtaatggattttattaaagatatagaagctaatggtggagacacaaagaagggagtggtcagttctacctggagggctgaggtgttctgggaaggcttcctggaagaggagacactgggactgattcttgaaaggccaacaggtgtttgccagataagagagttggaggtgggaattgcaggcagagcagaccctgagaggtggtaacagcacagcatgtcgcatgatggtgctgtgacaatggggaggcaggagaagccctgcaaagtgattgttccaacgagagctcagacaccatcctgaagtttgggctttacctttcaggtgacagggacctgctgaagggtttcaagcaagaagaagagacatagtgagatctgggattttgaggtcactctggtggcagtgaatggcagggaggtgaattagaagcgggtggagctggaagaagggaatatattgccatggtcccttgaggagtggatgcaggcctgagtgggacatggtgacaggaacagagctgaaggatgtagagatgggctctgagggactccatggctgcttggatgtgggcacaaaggacaagtaggcaggaggctgcgtcatgttgtgtaatgagtggcgtagcctctggagccagctggcctgggtccaattttaacactcactagctgtgtgatttgggcaagttacttaatttctctgagccttagtttcctcatctgcaaaatggggatgataatagtatctgtcttctagtattgggttcaataaattgatctatatatgtatatgtatatataggtatatatgtgtatgtatatgtgtgtgcatatgtgtgtatgtatatataatatacatatataatatatgtatattatattatgtaatatatcatataatatataatatataaatatataatatataagtatataatatagattattatataagtatttcatatatatacaatatacttagaacagtatcagcacatggtaagccctacataagcagggtttctcaatctcacaatattgacattttggactgtagaatttttttttgttgggggctgtcctgtgtgttacgggatgtttagctgcatttctggactccacaactagataccaaaagcaccccccccaatatccctcctctccaaaaatatttcctggtattgccaaatgctcccaagtccccagggaggccaaatcacccccagctgagaaccactgctatgtcaatgttattgctcttattactgggcagagataattccaggtttccgttggatggttgtctggaggtgacgaagccccatgccccaagacccgcaaacaggagagggagacgcatgttggacagtttaggctaaatggactaagaccacatccacaccaaaattgtctttacaagagttctgatcctacttaaaaatagttgtgctgattgggaacaggagtgcatcctttccacaaaacattcttttttaagtaaatactgtctatgagaatgttttcatgttattgttgcagctcaaaattctgtttataagaatttagaatgatttgttttccatggaggcctggcaatgaaatctaattaaaaaccccaatcataagtccccttaccttaagactccctgggtatgggcgctgcagaaccgctagattcccgcacagtgagcctgttctgctgacctccgttagacttctggggcccccatcagtggggagagagggggacccaaagctggatttgccactttaggacccaccgttcatgactaacctgccattggggtcttctggtgccaaattagaacagcaccaaggagcttcccccgagggaccatacctgccagcctccccggccaccacagcctctgcttccagaggcacatggccagctgccttcctcttctccctgcctttccctggcctaggagatggcagggagggagaaccgaagtttaggtgaatttctagaaccaagccctgggccccatttgccttcagcacctctttctctaggtcacattggaaggactggggagccttctgcagaggtggggcatacactccttaaggtcatctctctacctggcacagtgcccttgcttggggctatcataacatcttccagcaaccctgggagaaagactggtgtcttatgttgcacccagcttcctaacaaggctgagaaaaaaaaaaaccttgattttgtaaattgagggtaaaaaaaaatgagtttatatttccaacacgtctttactctgatctcctataaaaagaaccgtagtaagacgagtgtgacgctatcgccgttcccagttcctcaaatacccttcgttccaagttcttcctgcccacagcgtctggccctagctggctccggcgggcttcagatgactctagttaacaggaactgtgtttgcattctattttctgctgctgccctgacctgtcctgtcctgttgattaatagactttattagaacatcctcattgtattacatttttcatatctgagataagctataagaatggattcaagcatgagatgtttgatgcttggaattcttattgtaggcactgaataggcgtggtaacaaagataaggaatttaactgagtgggtgtgttctgaagtcactcacaacctttcattcattcatttactgaacaagcattgactgagtgccccctacgagccaggatagaatcaaaatggggctgtgttttgaatgagagtcatttaggctaatgtaaaagaaaacatcagcttccatagtttccccaaagggcattaatttgtggattttttttttctggaatttttaacaaataagatgacaccatggtgcaagagaaaatgggctgtaatttctggttctgtctgagagtcatcttcttccctgccagcagcttttcttcatagacacagccagcactccacttccaggccgctacatatgcacgtttcagacctgaaagcgtttctttcccccacactgtgtgattttaggtggatcatctgctcactatctcagccaacaacacacttcaaagcagagatgagaacattgcagggggtagagagtgaggaggctttggcttcattaacagccagtgggaagtggaaaagagtgtcctccacattcccgtccagtgaggtcagcacctttgagttgttcccagaataaccgtattattctattacaaaagagacttgccaaatatttacacttttcctctttaagggctgtgatttatctttttaaaattcttattcttgctaatatacacataacaaaatttgccatctgaaccagttttaggtgtacacagttcagcagtgctaaggatattcacattgtgccacagagctccacgacttttttcttgcaaaactgaaaatccatactcagtaaacgtctccccattgcccccatcccaaaccctgggagccgtcatcctgctttttatttcgatgagtttgactgctttagatacctcatatctaataccacttggtattttacacagtatttgtcttttggtgactggcttatttcacttagcataatgtcctcaaggttcacctctgttgcagtgtgtgttagaatttcctttcattttaaggctgaatggtatttcatgacatgtttataccacactttatttatccattcatccatcgatggacacttgagttgcttccaccccttgactattgtgaataactttgcttagaatataggcctaaaaatatctctttagaaccatgctttcattttttgttagatatatacagtatccagaagcagaatttctgggtcatatagtaattctacatttaattttttgagaaacctccatgctgtcttccacagcagctggaccctttatattccctccaacggtgcacaagggttccaatttctccacatcctcagaaacacttgttatttcctgttttgtttgtttgtatgtttttttgagacagaatctggctctgtcgcccaggctggagtgcagtggcagatctcggctcactacaatttctgcctcctgggttcaagcgattctcctgcctcagcctcctgagtagctgggattacaggcgcacgccaccacacccagctaatttttgtatttttagtagagatggggttttgccatgttggccaggctggtcttgaactcctgaccttaagtgatccacctgcctcagcctcccaaagtgctgggattataggcatgagccactgcacctacccttttttttttttttttctgagacagagtttcactcttgttgcccaagctagagtgcagtggcatgatcttggcttactgcaacctctgcctcccgggttcaagctattctcttgcctcagcctcctgagtaactaggattacagatgcctgcagccacacctggctaatttttagtagagacagggtttcgccatgttggccaggctggtctcaaactcctgacctcagttgatctccctgcctcagcctcccaaagtgctaggatttcaggtgtgagcccctgtgcccaaccctgtctttgaggacatccaagctctactgtgaaatcaggaaagtcgacagtcattatgcaggatggtagttctggtaaaggggatgcctacactgtggcaaggggggcatcagagaagagccatctgcctggggagacaggagagatgacgtgaggagaggtatctgagtgggaacataacagctgtttgccaggcaggcaaactgaggagtgtgggtggatgaggtatgttctttggtgagtatggggcacaaacacgccatgtgtggtcatatagaagaaggatcacttcactaacatatggcataggcagctaacatatgcctagcactgttgcaggcactgtctagaattcaaagtataagttggatccttccacttcttacaccagccttaacaagcttgccacggagtgagcgacggagacacatgtaggatcgaatggtgtaactcaaggcagagtaagatgagctctattcaggcgaacctatcctccgggtccatatgttatctttctattcactaagttctgtcgtagacattatgtcactttataaaagcattgcattttaaattccggttaaaccagactttctccaatatataaattactgcacaaaaataaattatacctcacagccatgaggatggctactaacaacaacaacaacaaaaaaaaaaaaaaaaaacaggaaaagaaaactcctcaaagataggaacagtatctagggttttgctttttttgttgttttttgtttgtttgttttttaagactcttgcctcaataaatatttgtttagcaactgaatggcggcagcccaaatgaataagtgatctcactgttagtactcaaaacatctttgttgggtaaatgaatcactgaaggaatgaggaatttgacttccaggagacccaagttcaaggtttgcgctagccaagctgcagctccaatccagactgctaagagttctatggacttactctgcttccttccacatttccctcatttctcccactctccctcagcctgtttcctctgaggagcggctgctctttctcggtagacacttctgtaaaacatcgttctgtttctcaggtctaccaggacgctgtttgccagctttccgctgtcaacagcagtagaccagaatcctgctcaggtctgtgcacactcatttacaaaagaatcccagaaatgtagccgtcatagttcttgctttcatatgatctgtaatctagttgctgagatatacaggttccaagacgtaaagcagccacgaggtacctgtaaacccaattcaggacccatgtactgggtgcatcccacatggtgccaggccctggggcgaccacagtgagaattgtggaccagcccacacacaactctgtgccaagtgccagggtgtacagaggagggaggctcattgagagttgacagctgatgcgctaacctggtataagacacagctgttcccactggtgttttcttctctgatgtataacaggacccgttcctcgcctcccagagcgggcacgcctttgaattaaacatggcggggctactcggggtgcccaactgcagcgcatatagatgtggccgagtccccttgctgcctcgggcattccagggcctctgctctgcatcctgattttcttgcttggcacagggattctcttgtgctgctgtggcccgtagttcaccaccgtctagactctggggtggcatccaacatgagaccccacgttcaggactccggaagaggggactctgattggtcaaattctatgttgtttcctggggaacctccaattctctaggaaaatggctcctgccagagcgtagaaattgccctattagcatttgggctttttctaatgctagtacggtggtgttttagtatgcatgttttttcattatttaagagttgtgctggccatttccttcttttactttcttgtcacaccttacctgtcaaaactgagccgtttgaattcaaaaaccctttgaatggggctctggcatccagagaagagatgcgatgaggactgggctggtgagaggctgcagggatggcagtggcagtccgggctcttggttgtggcagggagcaatgaggaaggacacaaaggcactgaacaggtgacatgaaggcagagaggggaggggggagctgggcagcatggccccagggacatctgccctaaggccaggcctatttattcctttcctgcctttcatctgcactgggcacctctgaccaagggagttggtgcctgtggctaaaggaagtccaaagtctgccaacaaatggttctctgggatggggccaggtccaaggttgggctcggctccctgggctgacaccatctgcgcccctttcaggaccactgcctgcctcttgcccccaggctccggagtgctgagtgtgggggcagaggtgtccccacacaatacgccaaggagtgactggctgcactagcgaagctctaccttgcttttgactttatttttgccaacaattgcgatgtttatttggagaccttaaaacgcagagagtggagatgttagaaatacaactatgttacataataacatcgggatactgtttccttttaagagctgtgttccctgtttgttgaagaaccatcatctttattaccttttttaaaaaagcatacatatagtttttttaaaaaaatacacagagacaccaagaaaacaaacaatgggctatgcttttcttgctcagagaataacagctccgaaaggagagagagagagatggaggaaggagggaaggaaaagaagaaggcagggagaaaaatgacgtgtaaaatcagaaagtttatacggggtcaggagcggaggctcatacctgtaattccagccttttgggaggccaatgcgggaggatcacttgaggccaggagttcaagaccagcctaagtaacatagcgaagccctgtctctatttaaaaaataaaataaaataggctgggcgccgtggctcaagcctgtaatcccagcactttggtaggcagaggtgggtggattgcttgaggccaggagttcgagaccagactggcaaacatggcaaaatcctgtctctaccaaaaaaaaaaaaaaaattagccaagcacggtgtgcatccctgtaatcccagctactcgggaactgaggcaggagaattgcttgaacctgggaggtggaggttgcaatgagccaagatcatgccactgcactgcagtctgggcgacagagcaagattctgtctcaataaaataaaataaaataaaaaagaagaaagaaaagaaaatttacccagtacatagaaagatacaaataggcttttttttttttttttgagacagagtctcactctgtcgcccaggctggagtgcagtggcgcgatctcggctcactgcaagctctgcctcccgggttcacgccattctcctgcctcaccctcccaagtagatgggactacaggcactcgccaccacaccctgctaatttttttttgtatttttagtagagataggggtttcaccgtgttagccagggtgttctcgatttcctgacctcgtgatctgcccgcctcggcctcccaaagtgctgggattacaggcgtgcgccactgcacatggcccaaataggctttttttgaaaaagaaaaagaaagcaggctgtgagcccaatgaggatctccaggtcagagtgcaaatgaggaatgccctgtgtttttacaaaccagtcaacttggtgtagatcattccttttaatagttaagtgacattttctcctttcctttttttcccctttcaaacttctaccttggatgcattacacctttcagaagcttgaaactaaaaacgactttcctattgatgtctacattcctgtcacagggaatgaggtgcctttctgctcctgaattctcgaacagacgctggtcccagctccggggcctttagcaagtggttaccttctcacattctgctttttgcctcttctaaagatgagcacacaaacggtgaccttatgatattactgtgaaaaaggggaaaaaagcaaaataaatgattctgggctacatggaaaatagtaaggggtaattagtggtggtggtggcttttgttccttagctttgggcgctgaaagaaagaaaatgggaaaatggctgcttcttctattttgtttgtttgtttcttcattaaaccattaatctccataaacaaggcatgtttttagttacagattgactagaaaaaaatgcatatgctaagccagatgggtgaaattaacagtttcattaaactgactttaaaatcaccagtgtcacaatatcacccaagacattatgcctttgcttttgagcaacagttggaattcaaagtttaccaaatgtgcaaaatgagcagttttaccttaggattattatttttatttatatttactactgcagaaaattatttgattctttttcagagaaaatactgtttggttatattttggggggagttttgaatttcacatacgaaagaaataacacagccctttcaaactgcctgtgtttcaacctgcaaagttttttttgtgctaaagatttgagctttgtgaaggattccctttttgttccttcttctccagcaatctcagctacctgggcgctcctgctaatgatttctggggttccgtgccaggggtcggcaggacaagtgtttcatttgaagcttcatttggtttggagtctcttcctcctctgagcctacaaagctcgggtccacgggtactctggcaaaattcatcatcttagttaggcatttggcagaataggtgaggcagggatgaatctttaacaaatgttaatgttgctttgctgggaatgtgcagaggggcatccaagatgagcacacatttaaaagtaaacacatgaataagtggcagtagaatttattttgcaactctgagtgctacagtgtctactgaattcagtgtattccacgttcttattacaactaaagactgggtagaacggacttctcttaactatgcaaagggaaaatccaagacaagattccgcaggctgctggtgaaaaggggtgttatcatgcagatgtcatcctaacagattagcagagggaagtggaaatgttcgaggatgttcaatgccacgttgttggttatagcaaaaccactggaaacaacacaggagtctaaaaatagaggcctggtagggaaaatggtacagctacggaatgcaatactattgaagcattagaaagaatgagcttctgacagccccagagagttattcataatgtgtagttaatttaaaaaagaaagtcgagagtcagactctacaatggcataatacgccattttggtaaagaaaatgtgtatgtagatatgtaaatagatttggatacgaattattgtatatacgaaggaagagtgccaaagcctacataccacgcttttaatagtttttaatcttcgttattaaagaaagattgagggagatgggatttctgtttttattttatacaaatctgcattgtttgaattttttttttttttacgacaagctgttatttctctggggagtttaaaaaaaatacagaaaaaggaacaaactccattcgttcagtaaagtgaatgttttcagcacctcctgtgccaggtacttgggatcaaaaaagcaaaagcagaaccaggaggtaggcagggaagagttccagaagctagtaactggaggatgccttagagctggtggaggtggtggctgcatccttccccacagctcagggtctgccagcacaggcacagtgtccccatctcagggacacccaacccacccatgtacccccaggcaccagttcccgctcattgacaacgtgtcagcattcacaatttcatctgtgggtccttctgatctcaacttccatttttagcatggacctctgcaaggaaattgcccttaaataaacccatccccagccttcccacattggatactcttctgtgttcaatcctgatgaagggctgataagagtgagtctctctcgttgcctcctgagctttaaaaaaaaaaacattttgccgggcgcggtggctcaagcctgtaatcccagcactttgggaggcctaggcgggcggatcacgacgtcaggaaatccagaccatcctggctaacacggtgaaaccctctctctactaaaatacaaaaaattagccgggcgtgctggcgggcgcctgtagtcccagctactcgggaggctgaggaaggggaatggcgtgaacccaggaggcggagcttgcagtgaaccgagatcgcgccactgcactccagcctgggcgacagagcaagactccatctcaaaaaaaaaaaaaaacaaacaaaacaaaacaaaaaaaacccacaacattttaatttttcacggaatgaagaaaaaaagaaacatcatgttggacatagtttttaggcaggtgaaattttagtcaagttgacatttaacttaacatttacatcaacgttatttacatgtacatttacatttaactcacatcctaagttaaatgtaagtcttaagttaaaagttaagtcttaagttaaatgtaaatagtatctttgcaatcctatatggccttttgtaacacagcatctagcatagtgccttgcacataatggaaagtaaacattcgttggctgaattaacaagagatatgaataacaaagatagactttagaagactctaacagtacatctagggccataaaacttgcttgtttgggcttaaatgatgatcagcttatagattcatgggagaattatgtaaaaggaagcatcatatagcttaaagcagttgtgtaaacaagtctctatccgcgtggtaaagtacttattaaggcaactgattgacttttcattgagggtacgtgcatcagggtgactgtgaactctggctttagtgacctttgaagcagggctcactgcttggctctgcctcttgccagcctttgtaactttagacaagttattcttctccaggcctcagtctcttcgtgtaaaaaatggggatgctgaaaatagtaccgaccttataaaagtgtaccaattaaatgacataatttacataagacacttaacccagtacttggcatgttgtaagctctcaataaaagttgactcattctttttatttggagacccatgagaaaaactggggacaaaagatgtctagaaagcatctaaaactaaggttcttttgctcaactttttagagcagtacctaagaactgtttgtgagataaaacacattcttctttagggagtcttagagggggaaaaggtccctctggaagtttcagtggtcctgatttggtgatgagttacactgagtaaattactctcttgaggcgatttctaagctacatacagcacatcatttccccaggatactaggctgtcatatagtgccaaagaaaaagctatttacagaatgacaccatggcatccccaaagggtttcatttacctccctggaaggtggtatattttgaggcactgcaggaccgaccatatcaataactcaggtgatttaattggcttttcctctttttctaaagccacatcgatcccatggtaattaattgtgtgtgctctgaattgtgttatttacagtgccaaggaaccaaaatgaatctgtatcagaaatcggtgggaagatatttgagaaggctgtaaagagactctctagcattgatggtcttcaccaaattagctctatcgtcccctttctgacggattccagctgctgtggataccataaagcatcctactaccttgcagtcttttatgagactggattaaatgttcctcgggatcagctgcaggtagagtatttcattgctccattaacatcagtcacttgcattatatttgcaaagcaatgctctcgtgcccctggtagaactggacatgttgcagctccttggagacctttaaaaatctttacactcaagataaatgtcctggggctgtgttaaatacaggatcctttgctttcagtgagtgaaaaagggcacttcatccatttctagacaggccttggggggatgattggtgtaccagctaaggaacagtgtcagtgcttgccagaacaccagttcttcaagaacaggtgctccttaccaaattcttgtaattactctgcctgtgagaccattatcccacatcactttttagctaagtgaagtcacttggaccttgaagcaaagtattgctgcatccagcagtctgtcatcaaaataaacgccataccagacggcttcatttctggttttgaatccaaatttattatgcaactagtctaacatttagaattacattttcatagtgcattagtcagggttctccagtgaaacagaaccaatgggattagatatatataggaagaggtttcttacaaagaattggctcatgcaattatggaggctgagaggtcccacagtctgccgtctgcaagctgagggccaggaaagccaatagtgtaattccagtctaagcctgaaggcctgagaatcaggagagatgaggccataaattccagtccaagggcaggaaaaaaaccaaaacaacaacaaaaaaaaaaacatataaaaaaccctgatgtcttcctgcctcaagcaggcaggcaggcagaaagcaaaaagggaccaatttctctttcctctgcctttttgtcctattgaggccctcaagagattggatgatgcccattcacagtggagaaggccgtctgtgtagcttacctcaccagttcaaatattcatctcatctggaaacactctcacagacacatccagaaatgatgtttcatctgggtacccgatggcacagtagagttgacacaccaaatgaaccatcgcaataagcactgctaaatgttccctgattgcttttcgttttcaaatttgcataggtgattgtgtatgcgtggtttggggaggctcagactgttgagatgtgcccaaatggttccatgttcccttccagttatttgcttatgatgcctctggcttacagatgctcctgaatgacagcatgttttcctgagtcccggaagcagtccccacaagggtggaataatgaaaacagcctagtcccatctctgccacgaagtggctggttgaccatggacaatcgacttcccctttctgggcctctcttttcccaactgtgagatgaggtggtcagaccagtcaatctccaaagacccttccagcacaaacattctgagagtgtgaggatgggacatgggcccgccatccagaccccgtgtccatcgatgatgtcactgaaacagaacaggggacttaggatggttggctggtgcccaaaaaggtgctgcaatagaagtcatgaaagatccccgtttgtaccaggaagaggcaaaagtcagggcattttaagctatttgacattaggaagggcagctagctggaaatttgtaaaccaatagaaagctagattggcttttttcccatttcattttattatttttttaaaaaggcaagttaaatcccagcactttgagaaaccgaggcgggtagatcatgaggtcaggagatcgagaccatcctggctaacacggtgaaatcccatctctactaaaaacataaaaaattagctgggcattgtggtgcacgcctgtagtcccagctactccggaggctgaggcaggagaatcacttgaacctgggaggcggagcttgcagtgagccaagagtgtgccactgcactccagcctgggcgacaggccaaggctccgtctcaaaaaaaaaggcaagttaacatatttctggaatggctaggattgtatataggaattgggcctgacaacctttcagtgttaggattttatgaccctatctacaatctcatgaacgctttgtcaatttcttcctaacagggcatgttgtatagtttggttggaggccaggggagtgagaggctgtcttcaatgaatcttgggtataaacactaccagggtattgacaactaccccctggactgggaactgtcgtatgcctactacagcaacattgccaccaagacaccccttgaccagcacacactgcaaggagatcaggtatgagagagaaaaaaggttgggaatggttatggccctgtttacctgctttcatgaagtgtctgcccctgtggttgcttttgtagttggccttcagaggttgaacataatcaaatggagagaggagctgtcttgcgctctccatttcctattacctggctgtgttctcaggctgaatgcaggggcagccctacatttatgcatgaaaagcttttcatttgtgagaggactggtatgtgaagagtcaacttggccttgggcagattttgattttgcaaaaaagtgtgtacctaccagaaacataggcatcttgtctttgtgccaataccctatgagatggtgaggtctggagatgttaggtgggactgggtcaaattcagtggaggcaggaagctgtaagggctcctttcaatgtgtgatgagcaagcaatgtctacaatggacacaggcaagcttcctacccagctatgttccccctgctgggtgcttgagaaatgtctgtccccatgccatgagccttgctacaccagtgctcccaggtgactgacaacagggtgtgatgattgaagactccaccctatcccagatgaaggactagatgagggacactaactccagcccccaattttgcaggctcccagatattattgattcattggacaaaaaaatcagtgactcacatctcccaaaagaccataatgtattacattacaccaactgatggtttgcttccagacttctttcagaggacagggagtaatagggtccaactaaaaggtgatagtgtaagaataaaagaaagctgcctcttgatacagatctgcatcgaatggtggtagacaataaagtggttgcttcttataagttgttggttttttttgagacagagtctcactctgtccaccaggctggaaggcagtggcgcaatcttggctcactgcaacctccatctcctgggttcaagcgattctcatgcctcagcctcctgagttgctgggattacaggcgtgtgccaccatgcccagctaatttttttattttcagtagagacagggtttcgccatgttggccaggctggtcttgaactcctgacctcaggtgatctgcatgcctcaccctcccaaagtgctgggattataggcgtgagccactgtgcctggcaagtgccataaacttgatttgcccctgcttagtgagcagctctgagagacaggcctagccaggttaggattgttgaattttaggctgcgtggctgactgggaaccagacccctggttcccagctctgcccctggattgggctcagaaatcctcaatgcagaaaattcaagctttgatgtttgggaatggttggtttctggaaaagaaatctagagtggctactgggtggctatgaagtaaatgacttgaagatatgctgtcagtaaatgttgaacatgagtcaagctataaaacaccaaaaggctgtctatgtaggcattctaattccttttgaaaataatgattccttctgaacaaacttacacacccttataatttatacatgtattttctgtctgtataatttaacctcaatttacaggaatagatttattaattggtaaagttttttttaaaaaaagaattgttctaaaaaaatttgcacaaagccaagccaaaaaaaactattttttttaactaagcctggatgtgttaataatgttctacatgtatatgttatacttttaagaattcaaattcagcataaattagcaacaggaaatgatatgttgctaacaagctccttttcttttgaagatttggcatatgaaatgttatgattgcgaaagaaaacatttaattggtcagaaccagaggagatgaatagaaaagatccgtcttgcagctgaaaagtcacctgattaagaatcacagataggaattatacagttagaagagttgtgtcatagctcattttcttaagaatgggtaattaatggcttcttaagaatttaaacaggtgtcatatgttgatttaaatgtccttttgttgagaaatctattaattcaccagcgtaatgtagtaaatgagaagacagagaaagccagacctctaattaacaaaccaaggacccatcaataactgctttcttgattcttgtttcattctctcttttgcgtaactcgtggttcacatcatttcatctttattagtgctctcccttcacatcgctttctttatgctttagtaggactctgcttcaggatagacagaaagaagatggctagtacttctgtttgtttctgcagcttaattacaaatgattagtcctcgcattctgcccactcctcaaaagctgctcttcctccaggtttggttgccaatattctgttctctctctacattttctggacagagatctcatctacacctctggtttcagctgcactccgcatatgataatactcagaccttaatctctgactgttttcttacaaatccccatctgccgtcattgtcacatactgcaaaagaaacacatccctcctcatctccattccctgcaaacacctcagcagatggcacgattgttcatgctagaacctggggagtcatcttggatcctccatcatcccaccagtcaacaacccccaacagctttccataccactttttctctcctccccacgtgcacccctgctgctgcctgaatttgttgctcatcgtctcccctctgagctcctacaacagctgatgggctgaattgtgtcttgccaaaatccgtatgttgaggttccaattcccagtacctcagaatggaactatactcggaaatcagatctctgaagagttgattaagttgaaatgaggctgttaaggtagacctctaatccagtaggactggtgtccctataaaaagagattagaggccaggtatggtaggtcaccccggtaataccagcactttgggaggaggaggcaggcagatcacttgaggtcaggagtttaagaccagtctgggcaacatagtgagaccccatctctactaaaaatgcaaaaactagccaggcatggtggtgcgcatctgtcatcccagctacttgggaggctgaggcacgagagtcacttgaacctaggaggcggaggctgtagtgagctgagatcatgccactgcactccagcctgggctacagagcaagactctgtctcaaacaacaacaacaaacagagtaggacacaggcaacacagacggatgaccacatgaggatgcagaaagatgacagccatctgcaagccaaggaggggggtctcagaagacatcaagccttccaacaccttcattaggaacttccggcctctaggactatcagaaaatttctgagtcacctaggctgtggatctttgttatggcagccctagcagatggagaccccctcctccccggtctttctttctttcttttttctttttttgaaacagagtctcactcttatcacccaggctggagtgcagtggcacgatctcagctcactgcaacctccacctcctgggttcaagtgatcctcctgcctcagcctcccgagtagctgggactacaggcatgtgccaccacgcccggctaatttttgtatttttagggaagacgggatttcaccatgttggccaggctggtcttgaattcctgacttcaggtgatccgcctaccttggcctcccaaagtgctgggattacaggtgtgagccacctcgcccagccgtcctggtctttctgtcaccagtcttgtgccttcccatcctctccctcaggccaagttcaccactgcacactggaatcacctgggggcttacagaacatctctgcacggaatccaccatggagggtctcatgaaagtgatgtggggtgtggcctaggcacatacatgtgatatgcagatacatgtgtacgtgtatgtgtatattttaaaataagcctgctgttcagcaggctttaactctgcagtatcagagatgaacttctgagctgcccattctagagatgttgattctataaaatggcagcaacaacaacaacaacaaaatacagtcctcaggggattgtaccctgcagccagggttgagcagtactcacccagaagaataagtctagctcatcggatgccgtatgagacgttcttcgatctggttccttgctacctccccaaccaaactcgcaacaccaaacttttggccaggcctggctgttcccacctcctgaccttgcctgtctgcttactggtttgctttctccatgcccctcccacttcccctctgacttcccactttgattctttcttgctcagatgtcaccccctctggaagccttcctgggtctctccttgctgtgccaccgtcacatctaggcacatctctcccattgctcctgcactgggtgttgtgtgcagggtgacagagctggctccccagtagactatgagctgcctgaggcaaggacgtcatctgttcacctctgtgtcccggggcccagcactctgcctgacacatagttggcgctcagtgtttactgatggaaagatggctagaagtgggtgcagaggttacccagtgatgaacagaaagtcaactgcagtgtcttgatgctggtgcttttcgaggggacccgtgtttcgttcttgatggcaggtacccagagcccttgccatgagcccctgcctctcttgcatgcagcaccaccatcgtatgtgacacccatatttggggaatcttggcagtttgcttccctgtctctccacccttacagctgatgtttccccttccgacttacaagtccctaaagtgttaaatttctacaaagaaaacacacgcactcctactgggagcctaacattatagctgattttaaacacgctaagaggcaagttcctcgtggcggttctgccaggccctgaggtgagcggttgaagtgcaggctccacaactgcctgttcctccagctgagcctgctcctgagttcccaggggtgctggcagaaggcagaggctcctggaaaatgtggggctgccgagaggcttcgctcctcagctgcaacaactagagggttttttttttttggtcttcctttcttccttcctttctctctctccctctctcaccctcacctgctccccttcctctctccctccttctctttctctcttttccacttcctttctttcttctcttcctttctctttctcctccctctcctctttctctctccactacctgtctattccccctgtcttttcctctctccttttcctctcttcctctctctttcctcttcctaccccttcttctctctccctctttcttctttctttcattacctctcttccattccctgtccttcccgcgtcactgtcccagatcttacctttcttcttttttttttttctgtctttatgctctgttggacttagaaaggaaatattttccaacaaacacaaaaccttactgtgttttgtttttgtttttttgttttgttttgtttttttcgagatagagtccctctggagtgcagtggtgtgatctcggctcactgcaacctccacctcccgggctcatacctcagccttccaagtagctgggactacaagtgagccaccatgcctggctaattttgggcatttttagtagagatggggtttcaccatgttggccaggctagcctcgaactcctgacctcaagcgatctgcccaccttggcctcccaaagtgctgggattataggcatgagcacctggccacacttactgtattgattaaggttttctttattttattttttaaaattttacacacacacacacacatattttttttttctttaatttgagacagggttttgctatgttgcccaggctggtgtcaaacttctcggctcaagtgatatgcctgcctcagcctcccaaactgctaggattacaggcgtgagccactgcgccccagccttcagctttcctgaagttgatgacacacagacaggacatgttgtgagcaccgccctctgtggcctgcaggctgactggaatgaaaggcatgtcagcatccccgggacagtgtggagccttctctggggcttggtcctgggtggtctgaggattgctttgtctccagacactgggcctcctgtgacttgctcagcagtattaagatacaaacttctgagctgctcattctagagatgtggattttataaaacggcaacaataacaacaatgaaaacccagatgccatggaggatcccagaactggtcaggctgggacgcttggttcctgccagtgtccaccagctctgcccctaccccacacacccgcccagtgatttttttttttttctcccagtccacagcttcttcccggcttttcctgcccacaaaactgtttgaatgaatggacaactgaacactttccttttaaaggtcattcctgcctccgaagtctttgtgttaataggtggtctgctttcacagaaggcctcaggaatgtgaccatgatgtgatgctggttgctattgtagtgaccccagaactatggagaaggcaacccccacctgggtgtggcaggcagcgtgtggtggctccagggccagatttgcctgggtccaggtcctgggtctgctactcactggctgtggactctaggatcattctgcttacctctgtgtgtttctcacccgtaacatgggagccatgatggtctgcacctgtcatgttgttacagcacagataagtcaatccagtacagccaagcacacaggatgagctccctaaattgtttctggccccaacacaccctcccccagttctagtccttctgttttctaaagcataaaattctcttagatcttcatccccacaacctaaggctttgagttgtactaaactgcaaataccaatagggttaacgttctaaacagcaattagccatttacactttagtatgagttaaggccctaaaaaatgatgagttgtcatttactgagagtgtgccatgacccaggcactttgctaagctctttcacaaacaatcttcttttaaaagaaatattatattttatgttccggggtacaggtgcaggacgtgaaggttgttacataggtaaacgtgtgccatggtggtttgctgcacctatcaactcatcatctaagtattaagccagcatacattcactatttttcctgatcttctccctcccccccaccccccaagaggccccagtgtgtgtttttcccctccctgtgtccatgtattctcattgttcatctcccacttacaagtgagaagatgcagtgtttggttttctgttcctgtgttagtttactgaggattatggcttccaactccatccatgtcccttcagaggacatgatctcattcctttttgtggctgcatagtatttcatggtgtatatgtaccacattttctttatccagtctatcactgatgggcatttgggttgattccatgtctttgctattgctacagtgaacatatgcacacatgtatctttgtaatagaatgatttatattcctttggatatatacccggtaatgggattgctgggtcaaatgttatttctggttctaggtctttggggaatcgtcacactgtcttccacaatggttgaactaatttaccttcccaccaacagtgtaaaagtattcctatctctccacagcctcaccagcatctgttgcttcttgacttgttaataatcgccattctgactggcatgatctgaattctaactcaccactatctacctggcatgagatggtatctcattgtggttttgatttgcatttctctaatgatcagggatgttgagctttttttcccctacatttgttgcctgcataaatgtcttcttttgagaagtgtctgttcatgtcctttgcccacttttaaatgaagttgtttggttttttttcttgtaaatttgtttaagttccttatagactctggatattagacttttgtcagatgggtaagttgcaaaaatgttttcccattctgtaggtttgttgtttgctctgatgatagtttcttttgcagtgcagaagctgtttagtttaattcatcccatttgttaatgtttgcttttgttgcaattgcttttgacattttcacatgaaatctttgtctatgcctatgtcctgaatggtattgcctagattttcttctagagtttttgtagttttgggttttacatttaagtatttagtccatcttgagttaatttttgtataacatataaggaaggggtccaatttcaattttctgcatatggctagccatttctcctagcaccatttattaaatagggaatcctttctccattgcttgtttttgtcagacaaacaatctcatttaatcctcatgcaaccttatgaggtcagaaattgcccaaagtcacacagcaaatgagtagtggagcctagatttgaacctaggtcattctagctctttgcacagtgaaaaagaatggctcataggttggtgcctttgatgtagcagatgccatactaaactccattttatggatgcagaaactgagtctcagataaagtaacgagcccaaggcctaaggtaagtagtggtgaattaaaattcagatcccctccatctgatatgaaaaattgtgctcttaatggtcccaccctgctgcaaagctcagtgattccagcagggcagtggggcaggccaggttaggacacagaaacaaaaggcaaacgtttgagcccaggagttcaagaccagcctgggcaacatggagaaaccctgtctctacaaaaaatacaaaaaaaatagctgggcttggtggtgcatgcctgtggtctcagctactcgggaggctgaagtgggaggatcacttgagctcagggaggtcaagcctgcagtgagccatgatcgtgccactgcaatccagtctgggtgacagagtgagaccctgtctcagaaaaaaggacaaacatgtttcctcttcacagtcaccatttacgtcaccacccagatacatgagtacttctcacgatggtaaggctgggcaaaggatgtgggccccacaaccagccggcttggatttgactcctcaatttgaagaactatctgatgttgggcttgttacttaacctctctgggcctccgtttccacatatgtgaaatgaggatattcatggtgactgtcttatcaggttgcaaagatttgatgagtcaatctgggcaaaacaattaggacagtgcctggcacatcatccatgatggttcttatgaaatatcactgacagaaagacctaagaatatcaatcactgcagggtaggaactgtgtcttcatgagttatgtctttattcaaggaggaaacaaaacaaggagaaaaagaaaaacaaccaaaaataaaaaacaaaacaaaacattaagagcaccttccatatcagactgaggggatctgaattctaactgatcactaaccacctgtgggccttgggccagctactttatctgagactcaatttctgcatccataagtggagtttagcatggcatctgctacatcaaaggcacccaaccttttagccattcttttttacagtgcaataagctagaaagacctaggttcaaaactaggctccaccactcatttgccaaacagatgaacagaaaaccttcagctgagaactccttctcagggcagctcaggcttcagcacaattccaggctccccacccaggacagtgtcctctggagtttaagctgaagcacccgctcatgggttgccctccatacacactggccataagcttggccaagcgtggaccagatagagtggtctgtgcccagattggatttcagcaccttctcactagagggcgacatcccatgggagcgccagagagctgtgtctttggagtcaagccaacctggcaaggccagttctatagtttcacctggagttcatggtttcaccctctgagcctgtttcttggcctgtaaactggggacagtgatacctggatcgaagctttgttatgaggattaagtggaaaaaaagaaaaaaaggaaaaaaataccacgtatctcaaacactgagcatatagttggtttcaataaaagtcgttattctaagtgttactgttaacttggtggcctcctcaggttagctgtccagcaggaatggctgctggctgggttttgagcctagcacaatcaccaaatctcagcccccgagtccccctggaaaggacccctggcttcacgaggccagtagaagaggcagctgagagacattctgaggaacggggctgcagactcaagtttgtgactctcagtacttttttttttttttttagactgagtctcgctctgtccgccaggctggagtgcagtggtgtgatcttggctcactgcaaactctgcctcccaggttcaagcgattctcgtgcctcagcctcccaagtagctgggattagcggtgtgtaccaccacacccattaaattatgtatttttagtacagatggggtttcaccacattggccaggctggtcttgaacacctgacctcaagtgatcctcctgccttggcctcccaaagtgctcaatactcttcttaattaactaacaaagaaaatcaggcctggctccttcttctctggggcttcttttccaaactagtgcagacccaattttttcaccatctgcctgtggcatggctttgggcatggggagccctctctagtatcccccttatggcactattagagcgacttcattatgtataaagagagaccgtggaacaacaggactggatttttaataaacagtgaaagtttatacatcaaaatgaattttatcttcttcaaaggagtcagatacctgggaggctgtgtgcaaattctaaacattttgtgaactttccctttgggttcttctttaaagcctctagcatattctttcttgcatcctcagagttaacatgccctcttcttttcagggtagatttaatttttggaaatagccaaaagatatttgaagcagaacctgcgaaataaaagaggttagtcatgcaggatagtaatacgttagaatcaaaaataaggttatacttagaaaatattgatttgcctttttgattttgcatgtgtataatctggctctgaaatcagttgcacgaagtggacttcgaaacaagcctgagcaatagaagtagatgtggaaataacttcggtttctcaaggcaaatactttgataggaacaaacaaccgtttagatatagaagatgtgatacattcctttaaaaagaatttgaccttatgtcattgtaggcacacctcatatttcaattattcatatagtttttcttgagcaattgctggtttaagaataatgtcatgtcttttgcgtgcttatatcatttggatatttccttccttccttccttccctcctttcttccttccttctttccctccctccttccctccttccttcctcccttcctttcttccttccttccttccttccttccttccctccctccctctctccttcttttcttccttccctccctccctccctccctccctccctccctcccttccttccttccttccttccttccttccttccttccttccttccttccttccttctttccctccttccttctttccctccttccttctcaggcatatgttgaaacaattagactaaaagatgatgaaatactcaaggtacaaaccaaagaagatggagatgtctttatgtggttgaagcatgaagctacccgaggcaatgcagcagctcaggtaaaaacgcaggctactgtcttggggattctgtcagccatgatagactgggttataccgtggtaatgaaacatctcaaactgcagtggcttaaaataatgccagtttatttctcactcacactgcatgtccaataggggttgtcaggggcaggccatagttgtcacagtcccttaagagtccaagctgacagaggtttccaaaaccattacagtcgggccatggccatagcgccttaccagctggctaacgcttctgcccacaagtgggatatttcactggccaatgcaaatcacgtggcccctcttgacttcaagttctgccactcacccagaaagagggaaagccacaatatttatgaccagctctaaagagtaccatcaggtgcactgatgcatccatcagatagaaaaacaagatgcaccctggggtgcaggggaaattagacagcgtccagaagaccatgaactcagctaggagagcaatagaaagtcatttatggcttgttggaccaaaaggatcaaccttgtctcttgaacatctcttgtctttggatggacttttaagaggtacgagaaagggcagacggctggggaagcaccctctctgcttccctgctttgatttcactatgaagaggagccctttgtgggagcctgtgaaggctgattgcaccaggaggaagcctccttcccataggaaggatttagttttggcttagtgctccctgtgagtgcagcaacatcgggaagagtctctggggctgctaaggaggctgaagcccagagatgggaaagggaaagaaaaaagaaaggagtcacaggcattgacaaagcagacagtacaggggcttttttttttttttttttttgattcagggtctcactctgttgggcaggctgaagctcagtggcgtgatcatagctcactgcagcctcaaagtcctgggctcaagtgatcctctagcctcaacctcccgagtagctggaactataggcatgtgccaccatgccatgccctgctaatttttaatttttttgtagaaatggggtcttgctatgttgcccagactggttttgaactcctggcctcaagcaattctcctgcttatgcctctcaaagtgcaggaattaaggcccaccacacctggcccaagaggctcttctataacaggtctccctcctctctataggggtcttcctcacatttcaggcgatactttgctggaagttataagtattggggaggaaaagggaagagaacgagatgagaggagaagcagaaagaaggaaggaaaacaaaggacccatgtggaactagaatgttaacacacgttgctctggccacgttcctgggcatatgtccttggtctgcagtctttctagtacaggaaggaattccaatgtatagctctgggaatgactctgccagagccatttcctgggtgtgccagagcttgcattaacttttctaaccataggcacttctttcttcctttgttcactaagaagtctttgttcagcagcttctatgacctgctgagctctgctgggttggggggctaacagacagggacaaagataagtaacatcttgaggttcctccctcccaagagcttccagcctccagtctgatgttggagccagccatgtagacaaatgataagatgagagatcagtgctatagaaggatgccctaatgatacagatgtgcagagacctccatgccaatcgctgggccaaaagaaagggcaatacctcccaaaagagtgccatttgaggagttctgattattgacgaagttccagctagccctggtcctgggtacagtagatacacacacacacacacacacacacacacacacacacacacacacacacacacgaaccatttctggcttgcattaagggcttgtatttacataagtccacattcagggctctggcctccagttggaagataaagtgtatctaatccttggttctcaatctaaaacatcgtaaagtaggtttgctctcccacctttcaaaatcttgtgttaagcattatacaggaaaagtcattgttctaaattgctattatctttaagcaacgattggcccagatgctgttctgggggcagcaaggtgtggccaagaatcccgaagcagcaattgagtggtacgccaagggcgccctggagacggaggatcctgcgttaatctatgactatgccattgtgctattcaaggtaagaatcacttaattcgtgctgaaattgtgcaattcttatcagactcctgagcagtttcctgtgggcgggctggcaaacagggagtcgataactgaagaaatttagtatatgcttctgtcactcttgatggaaaagaatgttggctaaaaaggcagagtcagaagcagttccctgttctcatttttaatcattagtcttatgtttggcacctggattctctgtgctttcgcaagaaccacggcattctggaggagacacccgtattttattgattggcgctcagccgccagcccccacaggcactgcaagtttgccaccaggcagagttctcttttaattacagcttaaacatagtgtgtaattgggctggatcccaacaatcctgctgatgaaaataaagatcttggttttaagccaacaggagaggggtgggaagagcctaggagacaagcgtgaaagtcccacctctgcaaccatcaggtatgtccttggagtcacctcatctcatgggacagtggcaatgaccacaaattgagtgagataataggaccaatgaactttggggaccataaaatgccgtgttctttatacaaaatagtatggcctggcgcggtggctcacacctgtaatcccagcactttgggaggccaaggcaggtggatcacctaaggtcaggagttcaagacaagcctggccaacatggtgaaaccccgtctctactaaaaatacaaaaattagccaggtgtggtggctgtgcctgtaatcccagctacctgggaggctgaggcaggaaaactgcttgaacctgggaggcagaggttgcagtgagccaagatcgtgccactgcactccagcctgagtgagagagccacactccatctcagaaaaaaaaaattagtaatagttcacactgattgagtggttgttacctgctttgcatgtattagtgcattaaatcctcacaaccaacttacgaggttggtaccttggtgtattatgattgctgttcatttacatggagacaaaggcacagagaaaggttttgtaatttgcccaaggtcacccaactggtatgtttctgacctgggactgggatctaggaaatctggcttcacagtctgtgttcatcatccccaaatacagagacatcaattcatcaatcttggaaaagtaaaaagctttggctttggtaaggaaattcgtggacttatgtccatatccaaagaaagcagctgcccccaaaaagcaagcatcttcaaacaaggccaggcccatctccagaacacagctgtggccactcagtaattaaccatgactgtggctacatttctaaccctccctaccctatcaaagcctgaaaacctattggttgttgtggtttccaaattgaggtcccagaccttctctttccagttgtcaaataaacatagaaatattttgaatctgagccatatgtgaatgcattcatgtgtttgttcaataagcatccattccattcagggctgaccaatgccaggctctgggctagatggaggggcatatggatgcatgagtcacgtccatgacctcagggagctcatacacagagaggaaggcagaggacctagatcaataagcacagaggagcagcacctgtccaccagagtggaggccgatcgctgtccaaagataaaggcacaaatcagacattatctctgcctaccaagatctcacaacctacagggagaggcaaatccagaaataaatgactctgggagtgatataatgccttctctgggtttgctttctcacaccgtaagacttttttgcagagaggggggttctgcattctttctaagttttgtctgggtgggaggaaggaagccctttactagcatctcagggaagatttccgcctgtggctagaagatatcctcaagtgtattctgtgtgaaagaaccccacgctgaaaatgggctttccatatgcaaagaacagtacgtgcatttgactgtgtgggggcattgggctttatgcaaagatggtaccaagatggcagctgtggttcattccaggtagttgagtccatcttatcttgcagccacatgaggataaagctttgactttgacagcagcaactgtcctccatccattcactcagtggatagttactgagtacttacgatgtaccaggcttcacatttctctcatttaacaacttttaatactactcagattcgtgtagagtacatcgtctttgtgcaagaaaagtcatcccacttttgactcaatagcgggtatagtgtaaacatccctattctagagtgtgtgggttgtcattgcagctctaactgtgagactttagctaagtcaactgctctgggcccccgttttatttcttcaaaacaaaaaagagttggagaagataaacttattatacttcaaccaggcgctaacgttcagtgattctggtctttctgatgcttttccagaagtccagaaagcttgtctcctcccctctccagttactccaagtgtccttctatgtccttttccctctcctcttcctccctaattaaatgaagcagtggtgccattctgaaaaatattttcatcttccactttgcttcagttcattggttttattaaataagcaagttaaagtcaagtagaaacttggcatatgtaatttaacctttagttggattcagttttatttggggtcctgaaagatacacagtcaagcatatcctgcatggttcctggatcctacaaggaggttatgaactgaaataggcagaagaaaatagagagcggtggttacaagcttggattctggagtccatttgtctggattcaaattctgcccccatttcccattgtgtgactaagggcatatttctcagatgagaataacagcagcacctcaggtagagttgatgaagcacttagacagtgcttggccaacgttaattcacacaggaacggtaactagcgctgtttccatttactatagagctaagcgtttaaatagagtttgtagatgtgtttgttgcaaaaccctctcccatccaaatcacaggcgatcctgtcaactgttgtctgagtccaggaggaccccatgtggcacatggggattgggggtatcagtaattctgagtttggaagcagcagtggtttacagtcacctccacccccttgcctggcatctttgctttcagatctatgtcaagagatactcaaggacctccttccactctacccttgagcacaccatctccccagttgtcctccagacatttcagtgtgttccacagagtttctctcttatgacaagaaccccaaagcccatgtctctctgtagtggacaaaccacctcatctggaaaatcttgattttgctggaagaaccttgttagtttctgttagttacatctgaggcaaccaattctgctgccttctatcttctgtggagccagttcttgagctgattctgaagcaacaatgttccaccctggagatcccagccaaggctgatgaagcctgcaagcgacaacctggtaactcttgactgtccaacacagataaagtgctttttctggctggcaaattaggtaatcccaagaggaaagcatccaggatgaccaaactcatttaacctgattcatatcttcccccagtagtacctgtggattgacagggttgcaactgacacagcgattactgctaagctgcgaagttgaggtttgttgcttctgctccacaaatataagcaaaataataatgatgatgataatgaaatagcactacctatagaaatccctaagcttgggtttaaatgaagaaagttagggttttatttttaagtattttatatccaacactaaagtgtctgtatgtgtgcagtctggttgtattttctttgtaatcatcgctgtttatcaatgtttagggtcaaggagtaaaaaagaacagacggcttgccttagagctgatgaagaaagcagcttccaaggtaacacatgcatattgtcagagggaaacagttccaccacacactcccacacgctctcgcacgtctaaaagaggaaatggccagcctcttcctacaaagccctaaggtggaaacggggtggtgagcagttggtcgccagcacggcacccccactgcagtgattagtcactttttagttacaatacatacagaaacttgccacaatgggggcagcaaaattcaaaagctgaattcaccttccagtcaatagcattcgggttgattttgtttgaaggctaaaattataatcaggagctgccctgataacaagcagcaggacccctggaaattggatgggtattaatgccattgaattcaggaaaccagaagcctaactcctttgaaggttaactctgtggtgcccgtttcccatttgtttcctgtgcattgataacagggctgtttattaagtttattgctaggtttgggaattattttgcttttgtcactacatttaagtggtatcttcaagtcagctagttcctatacagctctacagaatggaggttacaatgttgctttcgaggggcccccacccacacatgcacatacatgcacacatatacatacacacatatgcccaatgcatgcacagccacatgtgcacactcatgtgtgcatgcataccgatgtccaaataaatagatttgcagaaactaccgtaaatctacacctagacaaggcaccttgtagcccttttggcagctggatgtgcctcccaaggctgccaatatttgccttaacgatgaagactcctaaaatgaccatgctgaattttcttcctcattgttgtctcttgaggagttcaaagttgcatacagcaggaagttgtagcatggaatgagagacctaaaagattgttcctccatctgtgtgttgtcaagaggacacatgacccaggaagagggaaccccctgatttgtactccaactcctgaccccaacagaaactctagggcagaagtagaaaagtaacttaatggtagtcatggaaatcattggttccagagcaccctaaaatggggccataagggggcttcttggaagctgtgaaatttgcatctctgtagccatcctagtagtgaattgatgtctaatgtgctttattctgtatcaattttaacagagcttaggtaagtaatgaggaaatacagttttattgatctggaatagtcatggcctgaaaagtgttatatgattctcattcttcgctgccatccccttctgcttctgcttctcccagaccctgaacccactgtcagaaccatgcaaagagagagcacctgtgctgtgcaagtaggatgttgctgctgcttgccatagagtgcgtgttggtgttcagggcagaggaatcaacagatgggcaggcggatcacctagaaaccatcccagtcagggcaggtttcaggcctcagttgagcgttcatgaatttcaagggcactattgatgcggcagggcaatcagaggccttttgtagacaagcgtgttgcgtaagagcccaaaggagcagaacaatgatttgggggataacattgctgcagagatggaaggcagaatcccagcagcagtcgggtgaaacacacctgggaagactctcaggcaggcttgtgttttctagcacttagcttttctttaatgccatctgctccaaaataagagaaagggaaggttttgttcagacttaggcagaatgcttccacaataattgcttccagagctctctagatttcatttttctaaagttaatttctttcttgttccaaaattcagggattgcatcaggcagtcaatggcctgggatggtattaccacaaattcaagaaaaattacgccaaagcagcaaagtactggttaaaagcagaagaaatggggaacccagatgcgtcatacaatcttggagtcctgcatttggatggcatcttccctggagttcctggaaggaatcaagtgagtaggacttgagacccactctgcaactagtcagtcacttgatcatgaagcatttgttgaaggtacactgtgtgcaccagacccaaccccagacacagtccctgtcctcgaggagctcagagggtctcgtaggaaaacaagatagtgaagaggaaagggtggcatctagccaagtgccaagtgtgtggcaaatggcatgacccaaagctctggagctgggaaacagtgaaagccaaagcagccaggaaggcttcttggaggagggaggcttgagctagagggaagagtgggagatgacgcaggacaggaataagcgtgagatggagcagagactgatcttgctagaagcaaagagaactaagtccagataggattgcctggtgtgaaaccagttttaataataatgaaaacacaatggcaatctttagtgttgattaagcatttcctctgtgccaagcaccatgcaaaacaccctaccatgtgccctcttatgtaatcctaattctcctctgaaatagctattaatactctggttatgtccatttttcagacaagtgactgaggttctgcgaagttaagtaacgtagggtcacacacttagtggagtgaggacctggcctagtgcacagtggaagcccactctattaataataatgttgataataaaaatcgttaaaaataaaaacgattctcatgcctcagcctctggagtaactgggattacaggcgtgcaccaccacgcctggttaatttttgtatttttagtagagatgaggttttgccatgttgtccaggctggtcttgaactcctggcctcaagtgatccgcccacctccaccacccaaagttctgggattacaggtgtgagccactgtgcctggtcctgagctccgctacatttaacaaaatgtggtgaatacccacccagtgccaggcacccttctgaacactgaggacatagtagcaggcaaaacagtccctgatcttatgaagctttcattccaccagatggaaaagacaataaacaaataaatatataataggaggggaggtgaagatcagtgctatgcagagaactaaaacaagttcaggagggctgagagtggtggttcacacctgtaatcccatcactttgggaggctgaggcaggcagatcacttgagctcaggagttcaagaccagcctggccaacattttaaaactccgtctctaaaaatacaaaccctcatcactaaaaatacagaaattatccaggtgtggtggtgcatgcttgtaatctcaggcactcgagaggctgaggcaggagaatcactggaaccccggaggcagaggttgtagtgagctaagattgtgccactgtactccagcctgagcgacagagcaagactccatctcaaaaatatatatatatataaaatatatatatattatttatatatattttatttatgtgtattttattttttatttatatatagtttatatataattttttatttatatatattatttatatattttatatatatgtaggatgagggggtggagattgggaaatgctattttataagggaaaccagggaaccaaggaaggcctctctcataaggtgatattgtatagactcctaaaggaatcttacagatatctaggagaacattccagaaggaaggagcaggcagtgcaaaggccctgagaaggaagcaggcttggtgtgctagaggagcagcagggaggccaggggagtggagtggaaagcagaagagatggagagggtgggagataggaccagggaggaagccgaccagtctgagactcagtttctgctctgaatgaaatgggaaaccactgggcaatgttcaatggggcaacgatgggctgtattttaaaaggttcctcctggatcctgcctaccggagacatggacaggagcagggggttcatgcattggatccaagtgagagagggcagtgggcgagaccagggcagtgtcagtggaggggctgaaactgggttctacatgtatttggaaggtcgaggcagcaggatttgctgaggggttgaatgtggggtgtgagaggtggagaagagtcaggggtgactccaaggtgtttggcatttgttgcgttggaagaatggaagtggcatttattgggaggaacaagattgtggcagcagcagatttgggggtaggaggggaagaattggaagattattctttttgaagcactgtgctaaaccttgagaatgtgttatctcatttaatccttacaacaacccttcactctaggtgctatctgaaggcacattttttagtggaaggaaattaggtttggagagattaaccaacatgcccaagtccacacagctagtaaggagcagagttgggatttgaaccaagcctgcctaacttcaacacccatgctttcaaaaaacaatagccaactgcctcagaaaaataagagtaatctgtggaaatatacccatctacatgtttgtcttattttttccctctacctgtctctgatgacataagaggcagtatatttttatgcatagcaaatgtgtgctaaccctcccaagacatctgtgagtgaagatttcttattgtcacattctaattctcaccttcctactggaaatgcagttttcgcacatgagtttgaagaaaggtattaagcagggttaggaaagcaaatgcctggattttcacctggtttgacttctgatatagtcttctatctagccttcagggggttatgtgaggatcaaatgagatggcaatggtattcataattacatgttgtcttatttattgggtaaacttaatcaacagaatagatgaggcaaggtcatacatctcagaggctgacttctgtgattggctgtcttcctggaattgttgcttgccctggttttaaagctatcagaagttataagcctgtaatcatatcaggcttaaagcatctcatcaccttgtctctggcgaaaccagcccagctaggatgactcgatgtttgttcatctcttgttacagactttagctggtgaatatttccataaggctgcgcaaggtggacacatggaagggaccttgtggtgttctctctactatatcacaggcaacctggagacattccctagagatcctgagaaagctgttgtgtaagactctgtcaaacgttgcatttgaagggaaagccatatcctatattctctgtgcctgagcattttttaagttgagttctttatttttaccagttgtacatgcatgtagttttaaaagtcatgtaatttgacaagacaaaattaaaacttttaattaaaaatttaaaaataatttgacaaaggctaaacaagaaatccttgcctacctcacttcatcccacccctagactctattttctgctccctagaatgaatcactttcaatcttttttgaaagatttattttattttatttattttttatttgtctctatttctaaataacatgcttataccactatttcttggtattttcatccgaggcattgtctaatgatgtcccactgcgaaggataaagatgtagttttctttgactctgccacctcccactactcagctcactcatacttcctgccatctttcatcttcccaataagtatatcattttggttacattagtatcagggtttacattattatgaccatgtaaatgctatttctaactgaaccatgtagtatactctgattacttttcctttcttgcacaactttttcttttctatggattgctacttattttttattgtttatttgctaagctttctgtatacttatcattttctatgtatttgatctccaaattctcctccaggtgcctgaatttcctcttggtatgtccagacctatctaaatattatattaatttaaccttcttggtgacatccatcctggagtctttgttcaggacaatgctgtcatgctgagattaactgtcatcattatgggtatttactttccctccatctgtgtcttttttggttctcttctttgtcagacccctttctttctctttcttggtctgcacttaaattttggtggagcacatccaatagtaggttcctgaggtatggtgaatgggaggcacatttttgaggtcttgcagatctgaaaatgttttacaggagttgtcaaaccatgacccatagatgaaatgtagcttggtacctgttttgtatggctccaagagctaagaatgctttttacattcttgaggagttataaaacaaataaagaagaatatgcaacagagactatatgtggcccacaaagcttaagatatttactatcctgctctttacagaaaaagtttgtcgacctctgttttaggccaccctcacactgataccctggctctccaaaagattgttcttcataacacatttgggttcaaattcaacctgacctgaccttggtgataaacttgacttagactgacttgaagttttttatcattgttatttagtatatttgacatgaatattcatgttttgtggattttctgttatcctcttgttaatgatttctagcttaatttcactgtgatcagagaatatattctgaatgattccaatcctttgaaatttgtcaaagtgtgctttatgattggtatatggtcaattttggtatatgttttatggctttttgaaaagagtgcactttctgaacttgctggatcaacatctacatatatatcagttacatcaagtttgttaattacattattcagagcctccccatcctttctgatgtttctttttctgcttgttagttcagttactgaaagaagtatattaaaatctccaactatatttgtggacttacctacctctctttttagttctgtcaattttgcattatatatcttgaatctatgctattagatcacatagatttagaattgttttgtctttgtagttgatccctttatcattttacaatgtcttctttatctctgttgatggttcttgccttaaagtctattttttctgatgatcatatagttatacctgattttaatgttagagtttgtatgatttatctttttccatttttttgctttcaacttttcttcattcttaaatgtcaatgcatggctcttgtaagcagcatgtaattgggtatttgtattttttaatttttaaaattttgtatttttattttttgtatttttaaattttcatctttaattggtgtattttgtccatttacatttaatgtaattatggatatgtttggttttaaatataccattttcctgtttattttctatttgtcacatctgtgggggggtttttgtgcctttttttaatctcttttcttacccttcctttgtattaatcaagtatttaaaaaaattattctacttccccttctgttagctttttagttatgcattcttaaactattattttagtagttataaatctaaagattataacagactagctcattactaataaacccctaataaattagagaacaaagcaaaatagggaaagctaataataagtcagtaaacatgacttaatagagtactagaactcttggtagagattatattttttcatattggtggatatatttcattatgtatcttacatgtctttgtttccataaaagacaactcctaatcattcataagaaagggcactaaatgaaaagctctcagaatgcattttctttaccttaacattcagttctggtttgttgctctataaaaattctaactagcaaaatattccccaagtgggatttattgagagcatatgaagaaaaacattttattaaatttgccatggtttgcgtattttctcttcccttttttttttcagatgggcaaaacatgtagctgagaaaaatggctacttgggccatgtcatccgcaaaggcctcaatgcctacctggaaggttcatggtaagcttgggatccacgttagagcaaacttttttccctgtctgtcagtatagtcttatgaaatggagtcttaaaatgcaactgagaaagcaatttgcagggaaatcacagctcccagtaatgatattcagagtatcatggactgattggctgttgattggaaaacatagcatttccatgtttaattatacacaaaaatttgttctctaggggaattgttcacactcatcaagttgagaaagatatacaaatacattgatttctctttcctttaagcttgcccctcttggttttagagtctggtctggagacagcataggggatcttaggtgagactctctgctttttatttccaggccacagaaagtccagaatttctaccttgttcctagcaagaagagagatcagtgtttaaggttcaggccacctcttccatagatgttttactgcatctgccatgactaggagcctgggattgttggaagtccagtatccaatggcacaaacaaacagatgccctccttcctaaccttctggtggagttagcaaatctcatcttgttctttatgggatgaaacatggtgtatgaggacccacaaatgttccctgtttgctgttactcatagattttacaaataagggacccctctcctaacttgaccagtcttctttcttttatttttttctatcagttctagcattccattgttgttttaacttgggtcacattttcttggctgctttattgcttaaatgatgtggatatttcagtaataactaaaaaaagtcctcagtccactgcctcaaagacattagctgagactcagcattgatcatactctgatttgaaccttaattaaaaattaaagtgtaagttcaaaagaatgacattttcccttttagtccatggctgcacacgcaaccaacagatagcatctcaatgagtaagaatcttaaattagaaagtgtaggagaaatgaggccaatgaagaaagcaccaaatgcaaatttttattatcatcatcctgtgaaagtttattacctgtggcctcactttgcacaatcaaaaagagatttttttcagaaagttactgtttccccatcgtaaatgtaccttacaatttttgtgatgctttatcttgtttctcaagtgaacttcagttcataaaactcccaaatttgactttaactcattctctgcttctcgctttcccaacctcccaccctctgctccctacaaacttcttaggatgaactaaacattcagatatcggagtgtttatttttggggttttcccaaaggaagagcactcctgtaaacactcctccccaacccacccctgcccccatgatgtctgacactgtttttctcatagagtctttgttagttccttagctttcttgcctacttttgttgttttgaagcttttttgagatgaagtctcactctgtcacccaggctagggtgcagtggcacgatcttggctcactgcagcctccgcctgccgggttcaagcaattctcctgagtagctgggattacaggtgcccaccaccacgcccagataatttttgtatttttagtagagagggtttcttcatgttggccaggctggtcttgaactcctgacctcaggtgattcaccaccttggcctcccaaagtgttgggattacaggcatgagccacctcacctgggccctgcttttgaatttaatatcacaaagcactttagcatattgtaaaagctgctgcgaaggcctagatgaattaagatttctgtggcttgttctctttcttaatactcagcctcatcatggttttctgtttgggtggttggttggttgattggttggttggttggttgggggaaggagaaaggagacctgaagtgtgtcctgtaccctttgtgagtttggattcagttccgcagattttactgagtacatttaaatgcaggttgcctggccacaggtttcgagagatgcctcaaatagggcttagggaaatttgctgcctcatctcttctgcaggcaggttctcatgtggcccatattctatctgatctctgagcccttgcgctggctttttcctctgccccggaatcctacctaactccttatttccttttgttcttccatggatcatgattgctttttacatgtcaattgcctgataacttctatcccagttccttacacactggggtgcctggaaagtgtttggaaactactgattgaatgaactaaggtgaatagagggaacaattatagctcaagggccgtgagcagtatgtaaagatcactgggggtacttaggaggaaaagatgcctggtttgggaagcttgggacagccttcatgatagaagtaatggatgaggtggtcttgaaggatgggtggaatttccacttagccaggcagggaacagcatttatggtgtagggaattgcaggaacaaaagcaaagagagtctacaaaatactatgccatgtgggtaaaacttgagagggatatataatgaaaccaaagaggtgctacttcatggaattttgaatggcagattatgcgtttgtgaagcagtggggagccatcaatagttttttatttaatttatgaagcagtggggaggcattgatcattttggagagcgtagttacatgacagagcctgtttcttagatgcttatcaaacagctgtgtatggtgaatagaagggagagcctgaaaggggagttagttcaaaaggagccgagcatttgaacggaagatgtggcatgagtcagtagggtggcttttctcttcttttatcatgtaatcattgatatgtatgaagtatatatgatacatacataacctccaaagagtgacaataaaatgaacagccataaagctatcactctacttaaaaaaataaacatggccagtgctagtgaagcccctgctgtccctcccagattaaatcccatcctacccccagtacccagaagtaaccatcatcctagcttcttgttgatctgccccttgccctctttatatttttgctatatatgaatatattcctaagaaatggatttagtttggcttatttctgacctttatatgattataattactttatataacatataattcttcaactgcttttttttacttaacataatgctcctaagattcacacatcttgctgggcgtggtggtgcacgcctgtaatcccagcactttgggaggccaaggcgggtggatcatttgaggtcaggagtttgagaccagcctgaccaacatggtgaaaccccatctcgactaaaatacaaaaattagccgggtgtgatggtatgcacctgtaatctcagctactcgggaggctgaggcaggagaattgcttgaacccaggaggtggaggttgcagtgagctgagattgagccactgcattccagcctgggcaacagagcaagactccctttcaaaaaaaataaataaataaataaaaataagattcacacattttgatgcatgtacctgtagctcattcatattcactgctgtaacagatcacaatttatttcccagttctcttgttaatgaatatttggattctctttcttttctttttttcttttccttcctctcttttctttcccttctttttttcttttcttttttctttcttttcctttccttttcccttctgccttgccttgccttgccttttctttcctttgttttttaagatcaatgcggccatgagcattttttatgtatctcatagggcaaatagaaagagtcgccctagaatgtaaacttaggagtggggactctaggtcataggagaacatgttcaacttacaagacaatgtcaattgttttcttaagtagtttcaccaatttactctcttgcccaccatatataaatttctatttctccatatctttgctaatcttgatacagaagctaattatttttaaaggtatgtctcagtctggatttgaaacctcttagtatcaacaggaagaaacgttttgtatctattacaatgaggaaatctttttcaaaagatatttgggacaaagtacttccatccattcctgctctccaagctttcaagccctccccaggggttaaataggaaatgtatgtttgctggcctcctcaccgtccaacgtgacatttttttggtaccatctattctgctgtaatagaactaaatcatccatcgatgtcccagtccctccccttttttcatttttgtgtgagtgaatttattctagaagttattttcaaattacatgtgtcagtttgatgagcttgtgcttttctatgttgttccaagatttatatgggatagtttaaaagaggagcatgattaaggaaagggctttttgctatatcagcgtaatacagaagataatgttgtcatgcctgaggctgtcctcggacactcgaagaagttagccaaggaaagaccagctgtcatgtttcatttctctctgccttacccctacatgtgttttatctattttatctgcaagctacatgttttattgtcctttgtcttaagtataccaaaaacacttaacccaggaggttagccagattatagtgggcttgaggcaaggcaagtaagcatacatagctccaggtgaaagaaattcacctttttgcaatagagctggggtcctgaattccactgagaccccaggaatttttttttcatccttatagtctgagctgcttcagccattggcagaaaagagcacgtgcaaaataatataattgtggagaaactgctcaggggtactcaaatttgtaattcacagcaagcagccaaaggattgattattaagatgtatcattataaaagttctagaaatgcatttgctgggtctgaaaggaggatagcaaatgtgtccttaaattctttcttttctctcaatcccttcctctctgcacccattcccctctccctgtcaaaatggctgtctaagggacaattttacttgagtgcattggaaataaagcttgaagctctggttgactttctaaagcttgaggaaattcaaggaaggacaatagttttgcagcttgtctttgggtttcctgcaattaaaaaatgctgagtaaatgtttgttctatgaatgtaagtgtaggaatatctggaattaatactttcagatagcgtctgttgaaacacaagtaggagcaaagtgctagaaggctaaatatggtcagggtttctgcagaggcattgtctcagaagttttaataagctgttgaaacacagttaagcaagagcaaagtgctggaaggctaaatgtggacagggtttctgcagaggcattgtctcagaagttttaataagctaaagaaatctggtcttgagtggctagcccccacctagagctcactgctcagtagatgtgaacatggatggtggtggtacacgcattgggtgattgattgtgcaagatgaaaaatagaggtggatttctttttttcttttttttcttttcttttcttttctttttttttttttttttttgagacagagtctcactctgttgcccaggctggagtacagtggtgcaatctcggctcactgcaacctccgcctcctgggttcaaatgattctcctgcctcagcctcccaagtagctgggattacaggcgcccaccaccaagtccagctaatttttatatttttagcagagacagggtttcacaatgttggccaggctggtcttgaactcctgacctcaagtgatctacctgccttggcctcccaaagtgctaggattacaggcatgagccactgtgctcggcccagaggtagatttctgttcagtgtttctatggatctcacatgcctttttagacatctctttctgatggatttcagtgtttcctcaatggaaatgtttgagaattctgtaacacttcctcctggtttacacaatgattggacgatagaagtctataaaacttgttcctcccttccttccccaccaccagatcactttagacacaagatattatctttataaagcttatcattgtgaatgttcttgcagagagtatcaacctccatctcccccacccattctgacaaccagcctattggtttctgcagttaagaaaaaattctttttttttagagacagaatctggctctatcgcccaggctgcagtgcagttgcacagtctcggctcactgcaacctccacctttcgtgttcgagcgattctcctgcttcagcctcccgagtggctgggattacaggcatgcaccaccatgccgagctaatttttttgtgttttagtagagacagggtttctactgttgcccaggctggtcttgaactccagagctcaagcgatcttcccgcctcaccctcccaaagttctgggattacaggcatgagcaaccacacgcctggccagaaaaaacctcattttgttacattttagtaaacacgagccacatcccagccagttacggttagagggcactggtccaatatttgaccttggtttgcaggtctacactgtctcctttcctcatcaatccctggtggaaactgagacaccagtgcaggccagagtgtctctaaagaaacttgagaattctaagaccttaggaagaggaccttgtgtcagaatgagggggactttctgctgggcctcccttgcatgccctctgtctggggccttgggtctgctctgaggattcttgtagccaaacatagattttgcaggctatgttagctaatccccaagcatcctttgggacgttgttgcagctgcacttggaggcttgttatctggcttgcctctgcaagggatgctgcttagctgactttgtccctctttagcctgagtcatggctaattggtcagctgccttaggtatctcagagcctgcgaattggctccctcagcagccacgtggcctgtgacctgcagcatgtctgactgaaggtctaactatcctaatttgtcccccagcacctctcggtctccaagggattgcctgccagaagctgcttttagcagtttagaaaagataatttcagaatctgcttcccttactccccctcaccgaacctttccccaccgtttcctaaaccagttcctaggtggagctaaaattaaaaaagagttattaatatcaactccttaaaatgaaaaataagatgtaagaaactacttctggataaaatagagttttactcttaagctaggtaacgtataaaaattgaggaaatcagataagtaaaaagaatagaataaaaattacctgcattctcaccacccagaaataagtattgttagcattttagtgataatttttagggttttttttttctctgcttatttgtatctgcatgtatatgtgtgtgcatgtgtgtgttcagttatatttttgttttgcaaaaataagatgcattgttttatactctgctttttttttcactgaatggaaatttttgcataaatattttgctatgtttttgaataccctgccacacatcattttaatggccacatctgaaagtggctgcactatgggttaatttcactagtctctgattttcagacatttgtttccagttttttgttgctattcatatacacagctctaccatgaactccgtggcaacagaatctttgcacatatctctgattgtttctttagaataaacccccacaagggagaactgtagggccacatggtatgtacattcttaagactcctcccgcctgtccttccagaaccgttgaattaattggccctcaagctggcagtagttgtagagtatgtccattcccccaagcttttgccattattccaaatatgaatcttgtaccaatctttcaacagatgaaaagtggtcactcattttgggattatttgattgctagtggtgtcaaacgtttcttttctcatacgtgttttggccattgatgtatcaactcccttgtgaactgcctttcctttgccaaacttctaatgcacaacaaaagctcagctttaattaagcttgttcagaatcttaagccctataaagctttttataaaacagaggactccaaagcacaggggtttttcttaacaccatttatctcctctaagcgaggatgcaagaaggattcaagaactgaaggctagtagacaactccccagccaacatccgacatgcccttcagccagtagaggtagctgttgcatcaactagctccccagccttgtctgtgagttcagcctttaagacagaaaataaatcagtgcatgcagtatttttaacaatatttatttttaaaaaaactcacgattttgtggtttttttaaaaaaactgcttattttgtgccctcttatgtttgaatgtaaagctctctgtgaatattagtaagagccactatatgaaatttattattaatcatctatttttaggcatgaagctttgctgtattatgttttagcagcagaaactggaattgaagtgtcacagacaaatttagcacacatctgtgaggagaggccagtaagtaaatgtattcttctcagagtagaagctctgaggttaaggataatgaattgggttttatggaggcaacgttggtcacttggccgaaatattaatgaattaactttttcttccctttaccccttaggacctggccaggagatacttgggtgttaactgtgtttggagatactataatttctctgtttttcaaatcgatgctccttcctttggtatgtatagaaaaacggtgcaaaattgaagcattaggtgtttttaatctttagtaacagggaacatctgacagctttgtgtgaagtgaggtatttctaaataattagaaaagaaagtgaaaaatctctgctattaagatcgctaaactctgctctcagcctcacacaatgcactactcctcacccattgtcccgtggagtgcttggacccaacatttcttattttttgatttttatttttggagacagtctcactctgttccccgggctggagtgcagtggaatgatctgggctcagtgcaacctccacctcccaggttcaggtgattctcctgcccgagtagctgggatttcaggtgcccacgaccacgcccagctaatttttgtattttttaagtagacatagggtttcaccatgttggccaggctggtctcaaactcctgacctcaggtgatccacctgccttggcctcccaaagtgctggggttacaggcgtgagccactgcacctggcccccaacatttcttctgagtcaatgaaaatgtaaaagagaacgctattatggagcaattctctgggccagtcatttgtgcggattcctctacgctgctctgcatggtgggggactggcctccaggaactacagttcctggactcctctacccaccggcttctgattcctttcaggcaataagaggcactggcagaagattgcaggatgggagaagaagtccaagtacttctacctttgtctctctgctttggactgtgtctctggcagtggctacatttccatggttccagcccctgcctggcagctccaccctctttgatctcagcaccaggctctgggtctctggtaacatcacaggcaccctctggtccccaagtcctggggatgatagtagccttctcactgctgatctctgggctgcctattgttttccatttgccttttcagctctcccaacatcctagtaactacttccccatgatgaaattcctcttttgaaccacttgaaacgggttctgttttccttattggacattgactaatacatacaccctttttttttttttttttgagatggagtcttgctgtgtcgcctaggctggagtgcaatggtgctatctcggctcactgcaacctctgcctcccaggttcaagcgattctcctgcctcagcctcctgagtagatgtgattacaggaacgcaccaccattcctggctaatttctgtattttttagtagaggtgggatttcaccatgttagccaggctggtcttgaactcctgacctgcagtgatctgcacaccttagcctccaaaagtgctggaattacaggtgtgagctacggcactcagccgatacatatactcttaaacacaagtttttcttcagaggaaaaataaaatacatggctaaagcaaagagttaccaaaaacagacatcaaagatgaacagcaaaatttcagatgtgaagtaaaacacccaaaacaaccttggctgatttgggcagcaaggttgtagactgagatttagctattcaggagagctacctggccaaataagaaactgtctagagtccaggcacggtggctcacacctgtaatcccagcaccttgggaggctgaggtgggaggattgcttgagtccaggagttcgagagcagccaggacaacatggtgaaaccccgtctctataaaaaatacaaaaattagccgggcgtggtggcacactcctgtaatcccagctacatgggaggctgaggtggaaggatcacttgagcccaggaagtcaaggctgcagtgagccctgatctcaccgctgtattccagcctaggcagcggagaccctatcgcaaaaaatttagaaaaaaaagaaaaaaaatatgtctagaaatagggatgctctgggcaaaaagcctttttgcttgtttctctcttgacacatcagggaaacataaagatgttctgtattcagatactaataggaaaaacttgcattcatgtgaatgcgccaataatttaaaatgttggtataaaaaaaaccacttgacaaatggatctgtgctttatttcctgcagcatatttgaagatgggagacctttactactatggccaccaaaaccagtcacaagacctggagttgtctgtgcagatgtacgcccaagccgccctggatggagactcccaggtaaacagcaaccgcaacaaaaaccagctcttggccgggcacggtggctcatgcctgtaatcccagccctttgggaggccgacgggggcgggtcacttgaggtcaggaattcgggaccagcctgagcaacatggcgaaaccccatctctacaaaaatacaaaaattagctgggtgtggtggtgctcgcctgtagtcccagctacttgggagactgaagcaggaggattgcttgagtctgtcaagtcaaggctgcagcaagccgtgatcacaccattgcactccagcctgggtgacagagcaagaccctgtctcagaaaaaaactcagctcttggtgacatccatttgtgaatttgcaaaaccagaattcttcctaaccgtcctttcagtgtgtatacactacacagtttacaaagccattgttcatccattttcacatgcccctcaaacaactctatgaggacactaacaataagggtgagcctttattaaacacctactgtgtcccccacgccattctcacataatcctgtgggggtgcggattattataccctatttataatcaaagataatgaactgttcaagaccaaataatcaaatggtaagcaaaatgcccagctcctaaacctggatctttggctccaaacagaagggtgtttctaccaaattacatcaaactcactcaccaggtagaaactcaagaaattagcagtgcatccacagtaggaagtgttttgcttgtactgttgggctttgcttaagcgacagagtttttccctcagtgattttttttggaaacttcttatttgaaaataatgttagatttgtagaaaagttgcaaaaagaggtgagagtttctgtatacccttcattcagcttcccctaatgttcacatctgacataactgcaatgccattgtcaaactaagatattaatgttgggacagtattattaactacacttcagacttcatgtagatttcaccagtttttccactaatatccttcttctgttccaggattcaatccaggatcccacattagattgagttgtatatttctttccaatcttctccaatctatgacagttcctcagtcttttctcatcttcatgactcttgatacttgaagaatgcttgttaggtaccttgtagaatgtctgttgatttgggtctgtcttctgttttctcttgaatagattgaggttatacattttgggcaagaattttgcctattacgattattaccatgctgttctaacgatgattctcaatttcccttattccttctacatttgctacttggaatcctcttttgagaacctcagaatcattttcatgatggaggtttggatagttgttaccctctgctgcaacgtatttctggtgttgtgctttacagtctgaccactgagcaaaaactggaaacttatccctgtatcaatctttggtgggatttttttgttgttgctgttttgtggggttttttgagacagggtttcactctgtaacccaggctgaaatgcagtggcacactcagctcactgcagccttggtcccccaggctcaagcgatcctcctacctcagcctcctaagtagctggaaatacaagtgcatgtccggctaatttttgtagtttttgtagagatggggttttgccatgttgcccaggctgggcttgaattcctgggctcaagtgatctgcccaccttggcctcccaaggtgctgggattacaggcatgagtcactgtgtccagccaatcttttctatttttattttatttttttaatggaggtacaacatcgcagtggtcatgtacctgggttaaaatcccacatctctctcactccatagctctttgttcatggcgagtcactaaatctctgaatctctatttgtgcatgtgtaaatgtaaatgggggtaataagagcatctgcctcatagatcgtgaggattaaatgagatgttcagtgtaaagctctaagcccagtgccaagtacactcagtggacatgatctattctgttatcatttcttctgaaaagaaggagttactgctaaaggcatttgctatagaaataaactcccttaggtcatatttcctgtcacttaaaattgggcctggattttttttttttcaatttttatttttactgtttgggaagccaatgttacaaaaacaataaaggataattttttcaagaaaaataaaccaaagaatgcactgacaattctatggcaggggttttactcctttatgtcttcatgttcccttgcagtccctgcccacaagcagatgtatctgtcatgttatctatagtgtgcctgtcactttttttttttttttttgacacagagtctcactctgtcgccaggctggagtgcagtggcatgatctcggctcactgcaacttccgcctcccaggttcaggtgattctcctgcctcagcctcccgagtagctaggactacaggcgcgccaccacacccagctaatttttgtgtttttagtagaaacggggtttcaccatgttgggcaggatggtcttcatctcttgacctcgtgatccgcccaccttggcctcccaaagtgctgggattagaggggtgagcaccgcacctggccaccggtcacttttaaaatctgtcttatcatttattgtaggattgtgtgcattttattacatagtctctaattattaaccctaatagctgccccatattctgttgagctgatacattataatttcttaagctttaccttattggtggatgcttatccttttgtttactaacttatttattgatttgacacatatttatctatagagtcctaccatgtcttagacagtgattagtggtggggacataagataaaaagatagatcatactgttgcctatatgggatttatagtctaccaaggaagacttggaggtggtttcctcttgtgttggaattacagctagtgctacaatgaatatttttatatttccatattttctcttagtttgaatactttccttataatctgagaaatagtattattgagtcagacagtctaaatggttttatgaggccgggcacagtggctcatgcctgtaatcccagttctttgggaggccaaggcaggcagatcacttgaagtcagcagtttgagaccagcctggccaacatggtgaaaccccatctctgctaaaaatacaaaaattagctgggcgtggtggtgcaaaccagtagtcccagttacttgggaggctgaagcaagagaatctcttgaacctggaaggtggaggttacagtgagctgagatcattgcactccagcctgggcaacagagtgagattccatctcaaaaaatagaagtaaaaattaaaaaaaaataaatggttttatgactacatgatagcatgctgccattttgctttctgaaagggctttccatttaatacctcaccgatcagtgtttaagtagagaaggatgactgaaatctttccagcaagtggatgctttcatgatttaattttgctaattgaataatgatatgttgatactttcttactgtttttaacttgcatttacttaattactagtgatgatggacacttttacatatactagcttgtgataatttactttttacattttcttttttgtaaattctgtattcttattctttgcctatttatctgttggaattttgacacttttgaaaatttaaaccataattagttctttatatatttatctagcagataaggaaccttaagctattacattgcatacgactattcccctactctattttcccacttattttaatcttggtattattccattgattagagactttaaaatttcataaagctggctgggcgcggtggctcaaccctgtagtgccagcactttgggaggccaaggtgggcggattaactgaggtcagaaggtcgagaccagcctggctgacatggagaaacctcgtctctactgaaaatacaaaaattagccatgcgtggctgtgggcacctgtaatcccagctactcaggaggctgaggcaggagaatcacttgaacccaggaggcggacgatgcactgagccgagatcacaccattgcactcaacaaaacaaaacaaaaaatcataaagccatttttttcttttctcttaatatctcaaattttaagagtgccttcctttcaaagagtgcagaaatagtctattttctgctgttgtgtgagtgtgtgtgtgcatcttaaagatacttaacgcttcatctatttagaggttattcttggcaccatggtggagtttaagatttgagactctgcaccctgtcctcttgtgtttgacgctccagctctgccactttccagctgtgtaaccttgggcaagttgtttaaccactctgtgcctcggtttcctcatctataaaacagggaggataagactacctatatcgatttgttgttatgaggattaaatgaataaatataaaaagcagaacaatgcctcgcatatggcaagcactcaaaacgtgagctgctggtatttttatcatgattgcgacatacgatggttgtgaaagtcctggagtatgcaacctggtaaatgatgattttcatttagattgcggtcagaggcaaggtcagagggaagatataagccattagatgtgatcgtgtcataagggaagcacaaatcaaaaccacagtgaggcaccatctcacaccagtcagaatggttattattaaaaagtcaaaaaagaacaggtgccggtgaggttgcaaagagaaataacacttatgcactgttggtgggagtataaattagttcaaccattgtggaaagcagtgtagcaattcctcaagacccagcaatctcattactgggtatatacccaaaggaatataaatcgttctgttatgaagacacatgcacatgtatgttcattgcagcatgattcacaataccaaagacatagaatcaacccaaatgcccatcaatggtagactggttaaagaaaacatggtacatatacaccatggaatactatgcagccataaaaaagaatgacatcatgtcgtttgcaggaacatggatggagctggaagccattatccatagcaaactatgcaggagcagaaaaccaaacaccacatattctcgcttagtgggagctaaatgatgagaacacatgggcacatagaagggaacaacagacactacacctaagggtggaggttggaaggagggagaggatcacgaaaaatagcaaatatgtactaggcttagtacctgggtgacaaaataatatgtacaacaaacccccataacacgtaacaaaataatctgtatgacaaacctgtacatgtacccctaaagttgaaacagaagttaaaaacaaaacacaaaaaacatgatcctgagttctttcaatggcaacaatccagtttaattggtcaagttctaatggtaagtaccacatcgtttattgcttgtttcttaatctggccacctgctcggcttgtgatggagggtgtgcattctccaggcagtgtaatagtacccatcctttatgaagcatgtctttggtcgggccctctaactgtgtttattttattggatccgtacagcccaataagacaggtcttacctctaaggatcaagaacaaggtgtcagaggaagaggtaggaaaatataccatagtgggaatctgtgccaagaggagtcatgagaagaggtttctgcaccagcctaggaaagttgagatgagtgcccttaggtgatcccgtgcaagggaggcaccgccttgggttgtcagtcattggaagccgccctagccacagaaatattttgtcagatttccaacagggctatggcaactgagggcatagtctgtaggcaatggacatggtattcgactcagtattcttgtttcgtttatgatacaagggcacgttttccagtaagttctattctgagagagtgagcgagaaaggacggatctcccggttgactggcttcggagcagatgggacacagcagcttctgaaagcctcctggttctcctgcaaataaatttctcagatgcatatatttagggaaacaattcatcaatgaagatgacaaaaccatctggctctagagacttaaaaaaaattttagaggttgtaaacatttacattctgatgaagagtgtgtgtctaggttttatttcaaggatttgatgagtttggtttgtggcttgtttttagggattttttaacctggccctgctaatcgaggaaggtacgataatcccacaccatatcttggatttcttggaaattgactcaactctccattctaataacatctccattctccaggaactgtacgaaaggtgagctcagagcctctagaactgtggaatctgagggaacccaagtagatgatgttcgcttcttggttaaagttagctttacccttatattgtaatgtaaattgttatttaaaaaacaaaaacaaaaagcagggcaccgtggctcatacttgtaatcccagcactttgggaggctgaggcgggcagatcacttgaggtcaagggttcgagaccagcctggccaacctggcagaaccttatctctactaaaagaaaaaaaaaaaaaagaaagaaaagaaagaaaaagcccaggattttcttctactagaaaacattcagccagacccgagtgtatttctcttttctaatatctgaagtttaagatatagaaggtacttgatcggaagttcaagggctgaccagaaatttccacgagaatggaaagaataacaatccgattagcctatgcttgtctcttgtttgtttattttgagacagggccttgctttgtcacccaggctggagtgcagtggtgcgatctcagctcactgcaacctccacttcttgggttcaagtgattctcatgcctcagcctcctaagtagctgggattacaggtgtgcactgtcacaccaggctaatttttgtgtttttaatagagacagggtttcaccatgatggctaggctggtctcgaactcctggcctcaagtaatccacctgcctcagcctccctaagtgctgggattacgggtgtgagccaccatgccctgcgtaaatagccaatgcttttttgaaagatgaggcattcctacatctgtgctttaaacagaaatactgttctagtgggtcctgttcttcagcgtcttgcttgacttttattttatttatttttaagtttttgctgtcatcacagcagaacagacttgactcttaattaagcacaaaactgacctttttctaaaatttctactgggattctagaatttcagatcaggccaaaccacttatttggccactggctttatttctttgtctctcatctttgtcagttgagtgtgctcatttgtccaaaagcagaagaatgtaggtttgtggatctgaaaatgccagtcctgagtcgtgccaccaaagttggctgacacgtcaagatgccctgggctttgtctgcaggtgctggagccacagtaacgaggagtccttcagcccctgctccttggcctggctttacctgcacttgcggcttctctggggtgctatcctgcactcagccctggtaggtttcatgtcccaccggccccacccttgtggcccctgccctttgtcagtcactaatgcgtgcttctgatgtttgcagatctactttctgggaacctttctgctatccatattgatcgcctggactgtgcagtatttccagtctgtctcaggtaaagatttataaaaagcgaaagcaatatattaaaaaaaaaaaaagcagggatttttttttttttttttttttttggtctactggaaaaattgtgttttccctcctggtgctgttggtcatgctatctcctatccctagggtggtcttcacagggtgggaatccttctagaggtgtatgaaattcctggccggtgggaggccacaaagttactattgtatttttcaaaataaggattttattttttattttattttgttttttttgagatggagtctcgttctgtcgcccaggctggagtgcagtggtgtgatctcagctcactgcaacctctgccttctgggttcaagcaattctcctgtctcaccctcccgagtagctgggactacaggtgtgcgccaccacacccggctaatttttgtatttttagtagagacggggtttcaccatgttggccaggctggtctcgaattcctgacctcaggtgatctggctgcctcatcctcctgaagtgctgggattacaggcgtgggccactgcacccagcctcaaaataaggactttctttaaaaagcctaagaaactgacctaatacaatttcttccattgaaaatttatctgtcagaattctgcctctgtgtgcctgaaaacacagcgccaaagctcctggcagcatgaagtcttccctttcatttcagtcaagcaatcagatgtgtaagaggataaacaaacactcgtaatgaataaaaatcctcggccacacggactcagagggagggactgagcaggaatcgtaaagtgggcatttagctgagcatggtttccactaatcattgttatttttctgagccagtatagaatagttaaggacaagggagccctgcttgcttctgtttgggcttagagtccaggcttggctactcattagctgtatgactcatggcaagttatttaaccttcctgatccccaaatttctcatcaatacaatgaggttatgagagtagctacttcctaggaacataaaatgaaaaaaatattaagtgaaaaaaaatgcacgtaagatacttaccaaaatgacggctgtagttaaacgttagctgttatatttatctggcatataaaaccttctcaataaatgttagctcttacatttactcctctattagaccataagctgagtaagaggaaggccccagtcgtgtcatttgtgataactcatgcatagtaggtactcacacccacagacgactccggtctctcaagagacaagaaaactgattttttaccatctcggacggctacaaaagggtataataactcatgaaggcaaacagagacatttacaaatgggtagattaggactggacatggcattggagcatttgcgtagctgttatttctgtagcagataatggaaagtgaaaggggtgcacgtcagcgtctcttccacggtgagaaggaagtcactgttgcaagaagctaatgcgaaatcatttctctctgatttacctgaggaggttaacaaggacccatcaaaaccttccaggcttgatgccccatagtctgctggttaataaacttcactcatgcaaattctgtcccatccttaaatttgttgccaggtatagtcatttattttgcatcttgtcagtgttttccatttcaaattgtctttgtcatttttactctgtagaaatattgtgatgattattacaaatgcagttccgttagaggagctgaaatttgtctttgtgattttatgccagctggtagccatgaaaattcatgggcgggtggaattgctttgatcagaagtcatctcttttttctgtctccatgccttcattatcagtctctccacattcttgtctccgtgtctctcctgtcctgtgatgttttgctcttcctatatccccatagttctttcatacattttcgtcattttctcaaactttttcaattgctttctccagcacatacctacttcctgcttgaccagcctaaagaaggctatgtctggataggatcaatcataaaaattatttaattctatgccctttactttacagatgaggaaactgaggcagagaggcgaagtagcttgcccaaataaagaaataaagaccaggagaccagacgcagtggcttactgctataattccaacattttgacaggcccaggagggaggatcacttgagctcaggggtttgagaccaacctgggcaacatagcgagaccccatttctaaaataaaataaaataaaataaaataaaataaaaattagccaggtgtcattgcacatgcctgcagtcctggctactagggaggctgaggcaggagaattttttgcacccagaagttcaaggctgcagtgagctatgatcacaccatggcactccagcctgggcaatagaatgagacccagtctctaaaaaagtagaagttaaaaaaaaagattaagaatagatgtagggcagcagaatttcgaacttcttttcagcatcacaatactttaaaacagtgattgtcatctgcctcaaacccattgcctctcacataggaaatattttgaaacatattttttagtaccttgaaatgaaattcatgataattaacccatctacacacatttttaaaaatcaatatagggccctaacagcaatataaaggggaaataaaaagaaactaattgtaataaaataatattgatttcaataagtacattctagcccagtgcttataaattttaatgtgcatatgaatcatccagcattcttattaaatgcagattctagttcagtagattttggttcagtaggtaagccctgagatttggcatttctagcaagctcctagatgatgcccacactgctgtttagtaagagcatactttgagtagtaagggccgaaaagtataaaaaaaaagaaaaagaaaaaaactccacacatttccaaaatgtgccccgacagtggtacctgccagccctgttagaactaatgttaagagttgaaatatgggacgggtatggtggttcactcctgtaatcccagctacttgggaagccaaggcatgagaatcgcttgaaccccggagacggaggttgcagtgagctgaaattgcaccaccacgctccagcctgggcaacagagtgagaccctgtgtcaaaaaaaaaaaaaaagttgtcaataatttttatatttatttatttatttattttatatatttttgagattgactttcgctcttgttgcccaggctggagtgcaatggtgcaatctcagctcgccacaacctccacctcctgggttcaagtgattcttctgcctcagcctcccgagtagctgggaatacaggcatgcgccaccacgcctggctaattttgtgtttttagtagagacagggtttctctgtgttggtcaggctggtctcgaactcctgacctcaggtgatccacccacctcagcctcccaaagtgctgggattacaggtgtgagccactgcaactgaccttatttatttatttatttatttatttatttatttatgttgagacggagtctcactgtcgcccaggctggagtacagtggtacaatctcagctcactgcaacctccatctctcggattcaagtgattctcctgcctcagcctcctgagtagctggaattacaggtgcacgccaccacccccagctgatttttgtacttttagtagagatgggctttcgccatgttggccaggctggtcttgaactcctgacctcaagggatctacctgccttggactcccaaagtgctgggactacaggcataagccactgtgcctggcctatcaataatttttaagtaggaagttactccagcagtacagtgaagctgatgggatgatggggcagggaaatcgaggcatggaggaggtgaggagaagctgctgcaaaggcgatgctgctcagagaccaagtttctaccatttggtgtctccccagtgagctggtgcacaaggtcctgagacctgccccacagctgggggaagacagggatgggtgcatgtagcagccatggcgttgtgaaacaaacttaataatgaactctgggtgctgactgactgtaaaaaagaggaaatgtatttgagagttaggagcctcccgtcagcagctttgggtgaggattgttgctataagttagagagctttgtcattttgtgatttgcattttttccagtcagttgtatttaaaaattaatgatttatagtcaagacttgcagttgagctgtccatccattttgcgttcagctccaactaccttcattttcctcctgagtttatatgctctgtgatatatagttgacacatcatggcatttgccacattaaattgtcctgcattcagaaggctagccgcgcaggacggtggttaacagcatcggtgtgggaggcacactgctaagattctggccctgccagtagctagctatgtgaccttgggcaaaggaaggagcctatctgtgcctcagttccctcttccgtaaatagcagaaatagtagtacatccactgcctgttgtagttgagataaccaaatgaggtaacacaatgtaaagtgtttaaaactccacaaatgggctgggcgcagtggctcacgcctagcactttgggaggccaaggcaggcagatcacctaagatcaggagttttagaccaatctgaccaacatggtgaaaccccatctctactaaaaatacaaaaattagcggggcatggtggtgcatgcctgtaattccagctgcttgggaggctgaggcaggagaatcacctgaagctgggaggcagaggctgcagagagcccagattgctccattgcactcctgcctgggcaacaagagtgaaactctgtctcaaaaacaaaacaaaaccacaaatgttagctggtagttctcaaggagtatgtcctctggggcactggacctgtaattaaagcatgctgacactaggtaatacccacacataaatagcttgatttacctcagaaacagacataatgaccaaagcctagtatgtttttctttgctgttaggactctttctaaaacattcaacttttttttttttttttttttcggagatggagtctcaccctattgcccaggctggagtgcagtggcgctatctcggctcactgcaaccaccgcctccggggttcatgccattctcctgcctcagcctcctgagtagctgggactacaggcacctgccaccacaccaagctaatttttgtatttttagtagagactgggtttcaccatgttggctgtgctggtcttgaactcctgacctcaagtgatccgcccgactcagcctcccaaagtattgggattacaggcgttagccaccgcaccttgcccattcaactattttttttttttttttgagatggagtcttactctgtcgcccaagctggagtgcagtagcatgatctcggctcactgcaacctccgcctcccgggttcaagcgattctcctgcctcagcctcctgagtagctgagattacagatgcacgccaccacacccagctaaattttgtatttttagtagagacagggtttcaccatgttggttaggctggtctccaattcatgtcctcgtgatctgcctgccttggcctcccaaagtgctgggattacaggcgtgagccaccgtgcccagcccattcaactattttttaaagcatttcaacaaaaacattgactgatcaataaaaaataccaagatagctcaattgatactttcaatagattagtcaatgtcttgatcttcatcatatatacttatatatataaagaatatatacttatatataaagaacatatatttatttatatatataaagaatacatataaatatatgtattctttccttcaagggaacttgtgtttgactcctggctcgcattccaccaggcagctcagtctttcttgctgcttatacctcccacggtggtggaaaggtccctgggtctgggtggtcctagggtcactcagatagtcaccagcctgatagcagaacacacatcaccctgggcctacactgttcccctaggtccattggctttgcagcttctgggtcacctgggaactccgtcatctttgccaaagccaagcgtcattagcccttcttctcccaagtcttcatttctgattgctgatggggcacccaagggtactgtgggtacaacccaaggactccaaaaagctcctttcctcacctgttgcatctcaaaagcactctccttgtccactctttgggagggtacaccaagcataattgccttaatggatcaggcttttgaaaaacaaaaaatcccaaagtatatgtctggagccatctccacttctgcctggccacaaacctcccctgagaccaaaaaatcacagagcctgaccgtcagctgcctgaaggaagctaaaggcaagaacagaagtggaaaatagaagtcactatttcaaagaaagagccctgtcttactagtatcatgtcaactttatgtctcaatagaatacaccatatagagcaagatttgcagaactgctagctcctcggtacaactaggtaacgttttaaaccaacgtcagcctattcaatacatttataatttaagacaactcattccttccagctaagtggttagcctaatgttcttttaaaaagagtatggtgatatgtataagattaattaaaccttttcctgctgtttcctgtcatctacatttccagctaatgaggtttctactaaaattatagtaaaatgtcacaaagtagtgcttatgaagaaagcagtagccttatagtcagagagatttcatgaggaggttgtactctgtcctgtctcattagcttgacatcttaccagtatctccactcctgaagagtgtttcagtgacacaaatctggtccctgctagatccagaggcccagatgaagtaggcatgatcttacttatagcatacaatttctagggttttcccctgtatacctcctttgtgcaaacattctctcatttcacatgtgaatccaacatagtcccacgtattctttcttttttgcttccatctggtcagtcggcaagcagatgttcttcctaacagcagagatcagcaaactttttctgtaaaggaccagataataaatattttgggccctcggggctgtcttggtcacaactactccactcagccggtagctgaaaagcagccattgtggctgggtttcttttttctttctttttttttttttttttttttgagatggagtctcgctctgtcgcccaggctggtgtgcagtgacaagatctcagctcaccacaacctccggcctcccaggttcaagcaattctccggctttagccttccgagtagctgggattacaggcacgtgccaccacgcccggctaatttttgtatttttagtagagagagggtttcaccatgttggccagcctggtctcaaactcctgacctcaggttatccggccgtccgggcctcccgaagtgctgggattacaggcgtgagccacggcgcccggcctgtggctgggtttctaataaatctttactatggatgcaaaatttgaatttcatatatttttcacatgtcgcgaaatattactctttttctgttcaactgtgtaaaattgtaaaaactgttttttaaaccacgagccgtacaaaaacaagcaatgactacgtttggcccatgggctgcagtttgggccagttcgtgatatttctcactaatgtacagaaaatggtcccccaggcagcaaataattcacaaatcactcctatttggctctggaatatactctgtaattttttaaacaacatgcttattgtcctggttaccttgattctagtccaataataaaattagcacacattccagatgagcagagacaaagaggccactttaaaattaggccgggctgtggggggcttgtgcagtgattgcaaaccccccagtggaagaaggggagtcctcacacagataatgactaacttcctgtagaaacatcaaacatttttactatgctcttaccaaagatttaaatggtggcaatgctaattatgcattctttctacatttacacattggcactttttttttttaaatcagaaaactcattgctgatttatcttgttaccatggtgatttaaacatttccctgagcttgaaaatacatgccttagtacttcattaacttcctcagagatcatcaggaaggtaaatcttaggatcaaagtgggtttcaagatcatctaatccaagactctcaattcacaagtgatgaaaccgaggcccgggagactcaaacattttacaaccaaaatgtctgccatctgtacctatcccaaggtcccttgttagcagcagataaatgaggcttgtccaacccagttctcctgactgctgcaaaatggtctttgtacctcatcactggggctctaatcactagatcacctgccagagtagtggctttaatgaccttagaaagggtacatcattctacaacatcctgcccctccccatcactctcctattctttcagaagagtgttggaatccacgacctcttctgtaggtactggaaggggcccgaagaattcccgcatatatccagaaaagccagaagtttggggacccattcttaaacttcctagaatgtccccttaggaatgagcatcggcacttggaggtgaaactcttgaagggtttttatttagaaatcagattgtcagcatgtggtggcatcttcttaaacttagataacgggtccagagttgcctggctagttagtgtcaggttcattagactagatgcatctctcctggcttgccagagtctctaggtgtggttgtacattctgaatgcactgttttgagtattcagcacctgttgtgcatgtgtctctgcagcaagcgatccccctccaagaccatcccaggcctccccagacactgccacgtccactgcaagtccagctgtgactccagctgcagatgcctctgaccaagaccagcccacagtaactaataacccggagccacgtgggtgaactgtgcactccagttctctccagatgagagagaatcttttcaacagctggtattgggaagctggggccagggcatgatcctgataaacaccttaaatgtcttgtcaactggatgcaaattttgcaattggtgtcattttttttaaagtcaaattacaaggaagtacccagatcaggcagtggtaataccaaaggtcatcaaacacatacaaggaacatcttgatcatagggcatgtggggaagtttactgggccatcacagacttttgttctagtgattgtatgtattaggagtcatagcatgccctacggcagatctggattcttatacactaagatgtgtcttaagaatcacagtgcgtgcttcatccctttattgaagaacagaaaattatgactactctacaaggtggataatattttggtacctgtgcttgccacagccctgttcctcaaagctgaattgatagatttctctttgacttccaagacctagcagttataaggcaccttgaaataaattgtttgtgcctggaaatgcagggagggcaatagctttgtaaattggtttacatttttctccttgaatttttctagggtcctagtgcttccgaatcatttaatggcattgtcggatatcttttacatttcaattgcaatccatgaaattacatttagaagattcttagtacttaactgtagtcttctccatgaattacacgttagaatagactggcagcaacggaatatgcagcaagtaagcctctagcttatagtttcatccctacccctcatgcctgcgtgagtctgtacagggatatgtgtgtgtgtgtgtgtgtgtgtgtgttagagaggaagaggaagagcagaatgtctgtatactacatgctgctaaggtagtgaataaatcagtaatgcaatattgtgggtccaaactactctttgcactactttatttacagtagtaaataaaattatttttatacaattgactacc

SEQ ID NO: 37679 - DNA, 104073 bp, Homo sapiens
gcgcgcgcgcgggcgggagcggagggcaacggggcggcgcgggcggccgggcgcagggtcgcgggaggtgacgcgcggcgaggatggcggcgcggggccgggggctgctgctgctgacgctgtcggtgctgttggcggcgggcccctccgccgctgcggccaagctcaacatccccaaagtgctgctgcccttcacgcgggccacgcgcgttaacttcacgctggaggcctcggagggctgctaccgctggtgaggcgcgcggccgggccgggcgggcgccgtgggccgggctgggccttcgcgctgagaggctgggcgggcgccgggaggccggcagagccggcaggtgcgcggcgcgctctcgctgggcgctaggctgcagcactcggagcggcgggtgcgcgtgggtcgccaccactgctcatgtcatggcgccgtccgggcctccgcgccgctgaggcgcgagcagagcgggcgcagcctggcggccgtgacccgcgtgttctgggttgtgcgggaggaggggtggcctggggagcggcgtctgggaccgcagggcccaagccggccgggcccgagccggcctgacccgggagggggcgccggggcagctgggccgcacttcccttgagtctgggaccccagctcgggtttgtctgtgaccgccctcgccctggcgtgggaagtgagtctgtgaaacgaagcgcagcgcctagcgtcgcggggaggaacggagaccctggaggaaaggagttttggagggaagcccaggggccgctttacagaggcgaagtgagacgaggcaggccggcgcttcccctcaggctgcctcggcgcgggtcctgatgctcagggcatttccatcaccctccctctcgggttgggagttctccaaggggtcggatgcggagtgtgaccctgtggaaccacagggacccatgaaaccagagaccgacactgacagggcggtgcagtccagcccttccattttgcagaccaggggaaatggagctcctgcccctggcaaggctgcgtgggcacgactgagcgcccttagcttcccagcccagccgtcctaggggtgaaaagatgggcttccgcccttcccacccccaggatgctcagtagttgctccctttatttctgtttcaagactgggtcaaggttgaggcagaacggggtgtgaccacgtgacagccatgtgtgtaagcctggacatgtgtgtgtcaagcctgtttgagtattagtctgtgcgtgtatgtaagtgtgatgcccgaagctcagaccagccagctttctctgttgcttgcactatttgccctatttctttctttctttttttttttttttttttttttttgagacggagttttgctttgtcgtccatgctgacgtgcagtggtgcgatttcggctcactgcaacctccacctcccgggttcaagcgattctcccgcctcgtagctgggattacaggtgcaggccacctggctaattttgtttgtttgtttgtttgtttttagagtgcactccagcccttgttgcccaggctggagtgcaatggcgcgatctctgtccactgcaacttccgcctccccggttcaagcgattctcctgcctcagcctcccgagtagctgggattacaggcgcccgccacaacacccagctagttttttgcattttagtagagacggggtttcactatgttggccaggctggtctcaaactctggattcactgtgttggccaggctggtcttgaactcctcaagaccaaggagaactcctcaagcgatccacctgcctcagcttcccaaaatgctgagattacaggcgtgagccaccatgcctggcttgtctggccaatttttgtatttttagtaaagatggggtttcactatgttggtcaggctggtctcgaactcctgacctcaagtgatcccgccgcctctgcctcccaaagtgctgggattacaggcgtgagccactgcacccggcctgccctatttcttttttgaaggtctccttcctgaaatcaagacgtactaggtcagcccattgcattttggttttagtgctttatgcacctggaggctcctatttctggcctgatgccagaggctgaacttgggcattaggttttctgtatcccagtctaaggcctagtcttgtgtgggaaaatcagctgttagtcaatactgtggcggggatacatgctcattctcttgttgaagctgtctgtcctctcagtatgtgggcaagaaagaggaaactggttattaaaaacagctggcttcaagtgaatccctttggatatatttgtgtgttactttctctgagattctatagctgtacttttttctttttctaaactaacaacacttttttcccccccaacatcattttcttttctgagaggagctgaagggtgttggtggattttaatttacttggtaggaaaaagggaaaaaacattcttaatctctgatgcatcagagaagtgctaagtaccttataacgtgtttggcgttgatctgtagtttgtattgcagatgtgtgactgcagatgtgtgactgctattcaaagtgtcttctcagaggtgtttggaaattgtgattcccccttaacttgacaggaagacattctgtcaatcaagcattgagaatattttctttatttttagtattgctgttcctagtgtagtcgtctattgctgcagttttgaagaatctgctctggagattttaagagctggcctatagacatatatccacagtcctctaaacctgggaggaacattacctcttcatccagaaagttcattgttaagtctctcagacgaaaaagaaaatgagaattctgccagaccctgtgggaacatttgcacatccattgaatttgcagctgagctctaagtttacagaaatcactgtgtgtgcctgagccaacagcttcatgtttacttttcctattttttttattttataacatcaaaattggacagttttcgggccaggggaaccttagaggtcacctagtttaaacagcctgtgtttcatataggaaaacctgagctccagaaggggaagtgatctctgggaagtcttgtagcgatggacactgagttggagcaggagctgctgggacccctccctgtcccacgccattagacctggggactggcagcctctggctaatttgccaggctctaattctctccaactgcacccagccagcactggttttgtgacaagttcctgattccttctagatattttgcattattgaaagtgttccataaagtatattacatttgctccttttaaaggtatatacaaaacgacctcatatcaaaaactgggagaacagacgaaaaagaaatcatgccataatcttccagctgtaatacaatcacaggcagcattttggtttcttttcggtcacttatgtttcctctcctagctcctttcttacattgccttgaacctggttatttgggcacctcgggaacctcctcccctgccaacactggctagcactgaagcccaagcactgctctgttgcttcttcctgagggctccgtgtctgagcacctttctgctgggttgaagttgcctcctcattgattctttccctgtcatggagtcccagggtattctgggtgctccagcaagggggcgctgtcttggagaaagtgagtggctcagattggtttcccaggggtggagcctgaggcaggattctgctgccctagtttacagagaaagtgctctgttgggcagctggatagggaagggaggctgcctgcaggttgtcctgccttcaggcgaagagaccaagctttgagcttttgtacccactgtcaggcagccattggttcccctggggaaggggatgttgtgcgacctcccgggcctctggcggagacactctgttttgaattacgacctgcagctcccctggctgaggtggggaggggatgtggacctgcctggtgaacaacatccagacacagcatgcacagtgactgccataccaagctgttcacagacttctcctttcctgcccctgacagtctctcctgggcaccttggagccatctaacacgtgtgccaggcctggtcctgcaccagggtacaccctctcttatgtggtctggggcacttctcagtcacaggtgtaaggattctcaaacaggtagatgggagtcctttcagggccagggagggcactggtccctatgccgtggagcttggccttggggcatgctgtaccccaggcagttcagatgacccctggggagtccctctttgctgaggggtgactgtgggaggccagaggccagcactacccttgcgtgtggatgtcctgggtccctctccctgccccagcaggggaagctgcagcaaatcccctcacaggccttcgtgggtgaagttgggcactaagggtgagggatgcacgctgagccaagtcagagtgtcatctggcctagctggcttctgctgggctcagggaccctgagcctctgggacgggcacgtcagcaggtcacatgctggaaacttgcacaggtgaggcaacagggcctgtaagaagttgccccatagtcaaaataaaaaattcacaaagtggaaacaacccaaaagagggagttgaattcgacgggaggcccccagtttgctcttctgtacctccttcacttggccttccctgagcccacacctgtacttctgctcttttcgttgagagtgttttcccctgtaccactcaatttgtgtgcatgctgcatccccacacacctaggccaaatctctgtctccttccttatgcctggccttagagtcacaggctttggtcgattgcgttatcatctgggcctatttgatggcatttctggcagttagaaagtggggtggagaaaccagagctcccgcagggcctgggagagggcacacggtgaagacccgtcctgcctgagcaccaggggacaagcactgatggacgacacatatttcaccgaggagggctggagagtcactgaataagaggtgacaaatgtctgtgactctttttattttttgagatggagtctcgctgtgttgccaggctggagtgcagtggcacgatctcggcacactgcaacctccacctcccaggttcaagctattctcctgcctcagcctctcaagtagctgggactacaggcacatacccagctaatttttgtatttttagtagagacagggtttcaccatgttggccaggatggtctagatctcttgaccttgtgatctacccgcctcagcctcccaaagtgctgggattacaggcatgagccaccacacccacctgtctgtgactcttactatgagccaggcactacttgaggtcctgggatgtgacagtgaagcagcaggagatgccctgctctcagggactcacagttgattgccggagttaaacggttaattaagatgagatctgtggatgcatgtgaggcaggagtaagtcctgaaggaaacagaactgcaaggcatggaatgtgttttggggagggcgctcagcataagcctcctgggagtcgaactaggagtggagtggggttgagttggaggggacagcaagtgcaaagggccggaggagagatagagcttgtcagaagtgcgcaaaggcagcacgtttggccagggcagcagggctgggagggagggtggagaggttggcagggcggggccatgtgggaccttgtgggctgtggttaggagacaggaaggagaatgccaggtcagatgtgggcagggttagactgggcctggtttttgggcctcgttctccctggcccctgagggctgtctgtagctgtggcccctgcagggctggaccgggccttgctcaactcccttcaccaggcccgcagcagggaagtgccaggaagtgtctgtggacctgggttgacttgggccttgggtgattttcttcctgcttcctttgtgggtcccccactctgcctgagctctgtcagccccacgaggtggcttccgctctgtagacactgcctttgggcaccgttaggggctggaccccgcgggtggatgggaggtggcgtgtgtcatccaccaccctcacccatccttgttctttgtgcaactctcacttctcttttcttttcactgttgctttctggcctgacccaggtccctgagttcccctatggcctgcctgcctcctgttcctgtgttgtgaagagtggggagcaccccctcaaaagcagtgcctgccagacgccagcacattctgtgtgccagtggggcctcatgcgacagtgggaatgagaaaaattcactctttcaaaactcactgtcagtcctttaattttcctcaaaataaaagttttcttctggtgtctgtatgtggtttacatatttttttattttaaattgtggtaaaatatatataacatataatcgacctccttaaccatttttaggtgtagagttctgtggcatgaagtacgttcacaattgttgtgcagccacctccaccatccaccttcagaactctttcatcttcccaaatggacactctgtacccattaaatagcaactccctattttctcctgctcgggccttggccaacaccatcttttcattgtactctttgatgtttgcctgtctcccaagagaacaggcagacgcctagagtctttgcaggtagcagcttccccccaggacttactgacactgctttgagtcatctggatggatgacaaatgctgtgatattcttatttacactagtgtgtaaggtttccttttttgtttgtttgtttttttttttgagacagagtcttgctctgtcgcccaggctggagtgcagtggtgcgatcttggctcactgcaagctccgcctcccgggttcatgccattctcctgcctcagcctcccatgtacctgggactacaggcgcctgccaccacgcccggctaacttttttttgtatttttagtagagatggggtttcaccatgttagccaggatggtctcgatctcctgacctcgtgatccgcccgtctcggcctcccaaagtgctgggattacaggtgtgagccaccgcgcccggcctcaagcaattcttctgcctcatcctcctgagtagctggggctaccggcatgtgccaacacgcctggctaattttagtatttttagtagagacggggtttcaccatattggccaggctagtctcgaactcctgacctcgtgatctgcctgcctcggcctcccaaagtgctgggattacaggcgtgagctactgtgcctggctttttttctttttttgagacagagtcttgctctgttgatcaggttggagtgcagtggcctgatctcggctcactgcaagctccgcctcctgggttcacgccattctcctgcctcagcctcctaagtagctgggactacaggtgcccgccaccatgcccagctaattttttgtatttttagtagagacggggtttcaccatgttagccaggatggtcttgctctcctgacctcatgatccacctgcctcagcctcccttttttttttttaattgagatggagtcttgctgtattgcctgggctggagtacagtggcaagatcttggctcacagcaacctctgctgcccaggttcaagcgattctcctgcctcagcctcctgagtagctgagattacaggcatccaccaccatgcccggctaatttttgtgtttttagtagaaacgggatttcgccatgttggccaggctggtctcgaactcccgacctcaggtgatcagccctcctctgcctcccaaagtgctgggattacaggtgtgagccaccacacctggccaaggtttccttttaaagtaattttttagtaaagaagaatccatttaatacaataataagaaaagggccgagcatggtggctcatgcctataatcccagcactttgggaggttgaggcaggaggatcgcttaagctcaggagtttaagaccagcctgggcaacatagcgaaaccctgtctctactaaaaaaaaaaaaaaaagaaaaggaaaataaagctgggtgtggcacaggcacctgtggtcccagctactcctgaggctgaggcaggaggattgcttaaacccagaaggtcaaggctgcagtgatccatgattgtaccactctactccagcctgggcaacagagtgagagcctgtctattaaaaaaactaggccgggtgcagtggctggccagatgcagtggctcatgcctgtaatcccagcactttgggaggccgaggagggcggatcacctgaggtcaggagttcgagcccagcctggccaatatggtgaaaccccatctctactaaaaatacaaaaaaaatagctgggcgtggtgctgggcgcttataatgccagctacctgggaggctgaggcaggagaattgcttgaacccgggaggcggaggtggcagtgagctgagattgcatcactgcactccagcctgggtgataagagtgaaactgtctcaaataaataaataagtaaataaacgaatacaagtcatacctgtatgtgactgggctagggcaggtgtccaaccaagaggagcctgatggtggggaggggccgtcggcaggtgcaggtgtctaggcaactgcccttcctggccacagcctgcaggtccagaggcaggggcttccagtgttgcagaggagatgtgggggtggtgacaggggggatggacagagggagccaaaatgaaagaaccaatttttctgttaatccctttgcatactatgcccccacttaatcctaaaaatgaacaataaacaaaactcctttggtaagaatgactgcactgtacaaatgaggagcctgggtccaagagcctcacagctggttagtggcagagctgtgtccaaaaccagcctcagatccagaaccacactcactctcagatgcctggggaaatgcgccacccttctcagatgattgttggtttacccagtttccttcagctggattttaaaacttcagtagtacttttatttttctgagacagattcttgctctatcacccaggctgcagtgcagtggcacaattatagctcactataacctcaaactcctgggctcaagtgatcctccctcctcagcctttagagtagttgggactatagatgtgagccaccacgcccagctaatttttaaaatttttatttattattattattttttagagactcactattgcacaggttagtttcaaactactggcctcaagcaatcctcctaccttggcctcccaaagtgctgggactaaaggtgcatgccaccacacctggctaattttttttttttttttttttgagacagagtcttgctctgtcacccaggctggagtgcagtggtgccatttcagctcactgccagctccgcctcctgggttcacaccattctcctgcctcagcctcccaagtagctgggactacaggcgtctgccaccacgcccggctaattttttgtattttttaatggagacggggtttcaccatgttagccgggatggtctcgatctcctgacctcgtgatccacccgcctcggcctcccaaagtgctgggattacaggtgtgagccaccgtgcccggcctttttgtttttttttttagaaatggggtctcactgttgcttagtctggtctcaaactcctggtctcaagtgatcctcctaccttggcctcccaaagtgttagggttacaggcataagccaccatgcctggcccagtggtgcttttaaaaatcagtattggccaggcacagtggctcacgcctgtaatcccagcactttgggaggccaaggtgggcggatcacctgaggtcaggagtttgagaccagcctgaccaatatggagaaacctcatttctgctaaaaatacaaaattagctgggtatggtgctacatgccttttcctagctcctcgggaggctgaggcaggagaatcacttgaacctgggaggtggaggctgcggtgagccgagattgtctcattgcactccagcctgggcaacaagagtgaaactctgtctcaaaaagaaaaagaaaaaggaaaaaaaaatcagtaatagctgggcacagtggctcacacctgtaatcctagcactttgggaggccaaggcaggcagaatgcctgagctcaggatttagagaccagcctgggcaacacggtgaaaccgtttctactaaaatacaaaaaaaaaaaaaaaaattagctgggtgacgtgctaaaaattacaggtggcgtgcacctgtagtcccagctgctcgggaggctgaggcaggagaattgcttgaatccaagaggcagaggttgcagcgagcctagatcgtaccactgcactccagcctgggtgacagaacgagactccgtctccaaaaaaaaaaaaattagtattcaggatacatttggaggtgggggctgattcaggtggatgttaaagccatccttctgcttggtctggaggcagcaccaggtaaaggtgggaggcctgtggccttgttttgaactccgtgtaccctagcacaagggagcaggagagtgtccagaccaggggttctgagctagactacactaaggcccatgtctagggacgtggcttcatgaaggtcacttaacatccatgcaaaggattcctcatgtatcaaatgggggttttaataggattgtttggaagcaaatgaaatgttcatgatatgtttcactctgtgattgacacataagaaagcatagaataaatgaaagtttcaagatggtaccagcatggtcaggttctggtgaaggctgtcttccaggttttagactgctcactccttgtgacatcctctcatggtgggaagggatgagcagctctgtgggacctcttttataaaggcgcttagtccatccatgagggctcagacatcatgacctaatcacgcaccaaaagccccacctgttaacacatgtcatcacctcagaggtgaggatttcaacatctggatttcaggaggacacagacattcagaccatagcagacaggcacctacagaaaaattgagtgctgttactggaaggtatgtggaggctgggcagcccaaacccagcacatgtcccccacagaaatggcactcacaggtcagctgcttgcctgttgacagctgtttgtgggaagggcaggggaggcctacagaccctggacttacaggggagctggtgtgatgagggaggacattgagcagaacagagtcaggtgcctttgaggaggcagcctggccatgtgacagcaccagagctcagtctcagcagccgtcaggtggtcacatgagacctgctgctgcacggagcttttgggatgccctgaaaacacttgcagagtatgcagccctagatgccttctgttccacttggtacatttgataaaattaagtttgtaattaaaaaccttttttttttttttttttgagacagagtctctccctgtcactcaggctggagtgcagtggtgcgacctcagctcacagcaacctctgcctcctgagttcaagcgattctcctgcctcagcctccttagtagctggaattacaggtgcacgccatgatgcctggctaatttttgtattgttagtagagacagggcttcaccatgttggtcaggctagtcttgaactcctgatctcatgatccacatgccttggcatcccaaagtgctgggattataggcatgagccatggcacctggcctaaaaaccttttcataaagaaaactgtaagcccagatggccttgtctgtaaattctgtgaaagatttaaggaagaaatgatacaggttctttacagactctcaggagagagagaaggagcaattgtttcctaattcacttttatgaggccaacattacacccattgcaaaccagatgaaagcattataagaaaaaaaaaatcccacagaccaaaagcacaattttttaaaatactagctaatcaaatccagaaaaataaacaagactaatatatcatgatctggtagggcatatcccaggaatgcaaggttggttcaatatttttaaaaaatcagtgtaatgaccatattaacagaataaagaagaaaagccatgtatttgtctccatggatgaacattcaccacccacacctgatagagtccatgcctgcctgtccttaaagtctctgcttgcacagtgccccctcagtgatgcctcctctgagtgtccatggaagatggcagccctggccctcccagcattttatctgtccttagccattactaagatcccatcttcattcactcattttgtctgtttttgttctccttccactaaagtgaaagctccgtgaagatagaggttaatgtgtagtctgtacttagttgtgtccttggcacctagaacactaccttaaatatcactaatagcccagtatttatggtttcaataagtggatgaatgccttaaagacctcaaggaggaccagcggtgccatgggagctgataggaggggcatgggtgttgcagatagggacagtccatggaagagttgctgtgtttggtgagctaagaaggttggacagcatacctgtgggtcaagaggtcatgtgaggtggagggaccagcatcagcagaggaatagaggtggagaagctgggagggagggaggagtgggaggcaggggctttggaaaagaggttagatttgatggcaggtggttcaggctctttccagcagtgccaccttgggccaataactctgttttgggcctgaatctttgattcaggctttaaggatgccttggtggtatcattgggaggcctgtgaggagggccctgaccctagggctttagggtcaggcttcagggaagaggaaggacaggttcaagcaggagtaatcacaatgccttgaactcctgggctcaagccatcctcctgcataattggaactataggcacaagccactgcgcccagcttttctcctttctttaaaaagcaaagttcttgtggtcagaatcatcccaaacattgcaggaccacaactccttcatttgggagccccctcctttttcctagatctgagagctgtgagaagagcttgatatatattatcccagcccagtgctttgtataggtgctattttcattcctattgtgcagatgaggatgtggcagcccagggaggttagctcatttggtcaagatcacgcagctggtgagtggcagcacctgtctgtcttacgacctcccattccacagataccaacagatgagagaaccgagtgagccacgtccccatccccgagggctacttgctgcactacatgaggggtccctgggaaagccacacgcaccactcccgactatgaaacctgccatgtgtgccgtgtggggggtggggggggttggggcagaggtgttggtgagtgggagggtagggcagacatgccgcccacctgctgaggtgcagagaagaaggacaggtgtgcaggtaagaggaccaagtgtccttttagaggagtggctattcatttagactggatgggcaggggagggcttttcctcagaaaagtcgccggactctgtttctttggccaaacttgatgtggaatccaagtgaactgggctatgagctggctgacctggcttcggtgggtggcagatgaaagtgttggcatctcagccagtgagccctatgtgcagaccctgccttttctgcttagtgagcccctgtgtgtccttgagtgctgtgtctccagacccggttttgagtatgggctgagtggctacatgggccacctatggcccagagcctgtactggtcagggactgtgttagctgttgtagccacgtgcctcttccagtggttcctctgttcctcacggtgggtcccagccaaccagggagaggcccatctggtgtttagagttcctgatatcagtgtaggacattaccctgcccctgtgctcccagaaattggagaatggcagcttatatcagactctgtaccagagggaaggcatggctggcgttgcagggctcggttcccctcttccctggacccacacttccccgaggtgtgcctcagtagtgggtagtggggactgcagtcacttcactgccaccattaaaatgctgctgcttttatgtactacctatactagaatttactgaacatttccttcaaaatgactcactttttaaaaaacattgacattatctttcgtattaacatttatgagctcatgagtttggtacatttgtttttcctaaaacacttaaatgaatatgtaatagttaaaatgcataatgagtctgttaaaaaatagctcatctgtgcatcatctaaactggtgggtgtgtcatatcctgaggaaaatgctcctggaatgggagaggtatctgatctggagtcacccaggcctagctgcgatagttggccctgctgctgacagctgtgtggctttgggcaaattacttaaccactctgagcctcagtttggttttcccatacagggctggtggaggattcagtgataaatagaagtgtttagctctgggcctgatacatggtgccctttcctttcctcagttgcccttctcatttcttataccctccctgattagtcagggttttctgaagaaacagaaccaataggacatatatgtcatatatatatagctcatatgcatatattcaataggctatatatatagcctatatatatatatcttatacacacaccccctcatatgtatatgagaggtttagtataagggattagcttatatgattatagaggctgacaagtcctaagagctgcattcagctggaatctcaggagagctgatggtttagttttagtctgaaggccagcaggctcaagacccagaagagcctatgtttcagctcgagtctgaaggcagggatgctgacatccccactcaatgactgcgaggcccagagcgggaattctccttgctcaggcttttgttctgttcaggccgttacctgattggatgaggcccacccacattaggtggcatctactttacccaggccacagattcaaatgctaatctcatccaaaaacaccctcagagaaatggccagattagtgtttgaccaaatatctggtcactgtggctcagtcaagttaacatgtaaagttaatcctcacactccaccagcacacttttattttaataaaaaacagtccttggatatctcagtggtctccagaaacgaactgttcctgcctgccctcacctctcttatctcctcctgcactccctgtctctctttgcctgggttggtttgatcaactaccatgtctgtgaagaattacccaccctccctccatgtagatgtaattcttctctccccagatcctggaaacagaaacattcccgacttgcacatgactggccagctctttcattcccagcctgggaaagagccagcctgaatctccagggacacctatagggtttttctaaggcccatcctggaaagctgtgaggggcagagacagcccttcggagggagggcgcttctgcgtggccctgatagcagaaagtatcctgcttttgggcttagaacccctgtgtcctagcctggcctctgtggccttaaaccagtcccgttttcctaagcctcagtttaccgatctgtaagatgaggacatagcagtagttctttaagttacaactaacattagggggaagatattttcatttagaagttagaataacacagaaaagaaataataatgtaatgaatacccatattcctaccatcagaattagccattgtgtaacaacctatattggtttccattctttttttaaagaaataaagccttctgaataaaagtgaattcctccttactacccccaccatttccacttccaccttctctattttgagtttggtgcaaacctttccctctgtaattctctggcagacactttctgttgtgctttttcatccagcattacacacccctgtgaggaaggcagggtgggtggggggcctgccttacagatgaggacggaattggtggctgttgcagttcttttgtgtcccttaaagacatgcccaaagctatgggtgggctcaaaatgcccgggaaggaagtcagataactgaaaggaacactcacactggtcacaggaaaaccagcgtgagctgcctgcagcctccaggaggtgttgggatgggctgcccctgattcccatgcaggtcctgacccagagagagcaggccccaggggagcggggatctgcagaggccagacgtggcccggtctgcttgtgaggaagccctgggtggatggaatcttactcctgttgcacagagctcagccagctgaagaggggatgcagggatcaagccccaggccctggggcctgaagggtgggagccaccttagatggctgaggcaagccttcccaggccaggccaggctgctttctctctcccccaggctctgtcgtcagtgctgagaggagggactttcttaagaaggtcacaagagcatttagcacccgctgcctcccaagtagagcctgggcaggggtcagaggtgtccacagagaccccaggacatgagagccctgcgcctgcacggccctccaccaggaggccaggcctcagagccaggccagcattggaaccactcaccacgtgaacgaatgtctgtgtcccctcagactcatgtgttgacacctcatccccaaggcgatggcatttgaggatccccaaggcgatggcatttgaggtagcacctttgggaggtgatggggtcatgagggtggggccctcatggttgggattagtgcccttatacaaaaggccccagagagctccctcgccccttctgccatgtgacaacagtgggaagacagcaggcatgacccagaaagtgggccctcactagacacctagtatgccagctgatcttggactgccagcctccagaactgtgagcaatacatttctgttgttggaaaaaccctgtttgtgatgttttgtcatggcagccccaaaagactaagacgtgtgactgtgagctctgaaaatgcagccagtactacatgtcagaagcatgatatttaggatatgttggggtaaatcacgtattttcttaaaaatatgactttttaatagggatttaaaaatggaggaataggcagagtgcaggggacttttagggcagtggtgctgttccgaaggatactgccatggcaggtgtgggctgttatccatctgtccaaacttacaggacatgggatgccgactgtgcaccctcatgtcagctgcgagtgttctgagtgattgtgaggtcaccacagcctcctccattgtaaccaattcaccactctggtggggatgttgagggaagtgttgtgtatgcatggggcagggcatgtatgggaaatctatactttctattcagttttgctgtgcacctcaaactgctttaaaaaacaaggtttattaaaaattaatctcacctgttacttttttttttgacggaaaatgaaaacgtggcctgtgttacacgtctgttgtgcagggctatctcaggcttgtatgagtccttaatgtagccctgctacatggacatgaaaggtgtggtcactgcagtcgggttctgcaggctgtccaggcatctcagtgtggcagcccagggaagagcttggggagttttgcaaggagaatttcaggcttcttttacttggataggaagagctctgtttgcatttattgggcctgtgtctgagattaatacactgctgttatgaagcaagaaaagagtggttatctctattttgttgaggagacagaggctaggagagggtgtgggatttacaggccagaccaggaccccagatcccagttcccaggggccatcgaatgatacataccacagtgtttttaaaggcaggagtgggaaatgatgaattctcttttccccccatagactttattttctttattctttatatttattcatttattctacttgtttgtttgcttgagacgggacctcattctctcactcaggcagagtgcattgacacaatcacaactcactgcagccttgaactcctgggctcaagggatcctccctcccacagcctcccatgtagctgggaccacaggtgcacaccaccataactggctaattaaaaaaatttttttttgtagagatggcgtctcactttgttgcccagcctggtcttgaacttttgggctcaaatgatcctcccacctcagcctcccaaagtgttaggattagaggcatgagccactgcacctggcagagtagacttttttttttttaaagcagttttaggtttatggcaaaattcagtagtaagtacaggctcctttttctgcccccagatcgaatctaggacccaggatttgttgagtttccttagcctctactgccctgtgtgaattttctaatttgtccttgtttccacactcttgtgtgtgcttgtgtatgggaagtttaaagcccctcgaaaaacaccgtagggcactagtgctgtcagcatttggatggttggacggagtgtttccagtgggtatgggccgggttcataggcacctgcttcttgtctcctgtgtgggcttgtgcctgctttgctgtgttcctcgactctgtgccatgctattttcctggaagaaatccacaaggggccacagacacacttcctccggggtgtagattgctttccttcactgatggatgcagctcattttccgtgaacttccaaggtccatctggaggcctcctgccgcagcccattgtggccaggtggtgtcggagtggtcggcatgctcaggtgtgttggaaggggccttgtgctggcttggcccagggaagacacttggcatccagccagaaggcgggacatctgcctaggtgtgttccgcaccattgcctttttttttttttttttttttgagccagagtctcactctgttgcccaggctggaatgcaatggcttgatcttggctcactgcaggcctccgcctgccgggttcaagcgattctcctgcctcagcctaccgagtagctgggattacaggtacctgccaccaagcctggttaattttttgtatttttagtagatacagggtttcaccaacttggtcaggctggtctcgaactcctgacctctggtgatctgcccacctcggcctcccaaagttctgggattacaggcatgagccactgcgcctggccacgcaccattgctttttgacaccaggcagtttctgacaagtctccttcagaatactcgtggctgtggatgttccagtgagtttaggcaaagttagggaggatgcagagaccccggagtgtctgctctgtgtcgggtgctgtgccgggtgcggccccgagagacaagcgccaggcacggcttagtggcccctcctggggccttggtcacactataaactctctgagggcagcatggccagccgctttccatggccctgcttcaccccagatcctggtggcattcttttggaggccctgtacactaggcctgagagcctgtctgtagacagcacatgctagctgggcacgctcagtgtggagtctgctgtcctctgcctctcgtcaccttctcacctgggcctggggcagttatcctgggccatggatgagaaactgaggcgctgacagcagatagctttccccacacattcctgttatccttcctcctgttatcctccctggggaaattggctcacagacgtctgggctcatttgtggatgtgtttatctgtctgtctccccactgtggctataatatccgctccgcaggcactgggagctcatggttgtgtttatcattacaggtagtgatccccagggttagtggaacccgttggggttggaagctgatgcctggagcctgctgtgcgccaggcctgggctagaggtcggtcgagatgcctgtgccccctccctgtgcaacgtgtccctcatgggatcccttgagcagctttcctgctggtactgaacgactcccacatctgcaggagtcttggacggtggccatctgttgagccttgaggtcatttccaggtgtgaggtctcctgtttgatttgctccatgggaactgtgtgcacaggcctggagccctcagcttgtggaggtcttaactggagaggccttggcagggccccacgtctcctctgggtttgaagctggtgttaggtggcccacctcacttctgtctttgggtccaggactgcgccctagacgggtgccacagcctggtgtctggaccccactgtgccttgcagtgcagctccagagagtaaatgctgtcttcttccactgcaggttgtccacccggccggaggtggccagcatcgagccgctgggcctggacgagcagcagtgctcccagaaggcagtggtgcaggcccgcctgacccagcctgcccgcctcaccagcatcatcttcgcagaggacatcagtaagggctgagtgctgtgtgtgatccccggtgggagccagagacagggaaacgcccactaagacccagggtcctagaggctacctgagcccatggcagggctttctcttgttgagtggcaggacacccaggcaggagacaggcacccagcaggcaacacccatcccaagccttgtgccagcacttcgtaccgtgttcccttttgtggaggctggcttgctaaatttctaaattattatttgttacctaaataactcttaatgggtagcaactcattactatgacagttgtcctaatctgtgagatcactccttttccttccccatatctaatttattatattagttgtaaaatagtttgacaacaacaatataattttctatcatgcttttccctacttagattataggacatgttccattttaccatacaatgatttttttttttttttttttttttgagacagagtcttgctctgtcgcccaggctggagtgcagtggcgcgatcttggctcactgcaacctccgcctcctgggttcaagtgattctcctgcctcagcctcccgagtagttgagactacaggcatgcgccaccacacccggctaatttttgtattttcaatagagacgggtttcaccaagttggccaggctggtctcgaactcctgacctcatgatccacccacctcagcctcccaaagtgttgggattacaggcgggagctaccgcacctggcccatacagtgatttttaatgctgaataatattctcttttttatgttgctgttttgagacagtgacttactctgtcacccaggctgaaatgcagtgactccaacactgctgactgcagcctcaacctcctggactcaagcaatcctcctgcctcagcctctcaagtatttaatagctgggaccaccacaggtgcatgccaccatgcccagctaatttgtaaaattttttgtggcgagttgggcgtctccctgtgttgtccaggctggtttcaaactcctgggctcaggcaacccttctgccttggcctcccacagtggcggaattacatgtgtgagctaccacacccggcccaaataatattcttaacaggaggttgtcctataagcattcccttgtattgggcatttagagtgttttcagatgtttgtttcagtgttacatataaaaataaatgtttttatatagagaacaaattagaattcttttacattatttcttaagataaattcccagtttttctgggccacagctttgaatatttttatttttattttttgagatggagttacccagctggagtgcagtggtgtgttcttggctcactgcaacctttgcctcccgggtttaagcaattcttctgcctcagcctcccaagtagctgggattgtaggcatgtgccaccatgcctgactaatttttcttgtatttttaataaagatggggtttcatcatgttggccaggctggtcttgaactcctgacctcaagtgatccacctgccttggcttcccaaagtgctgggattacagacgtgagccaccacacctggccaaccttgaatacttttaaggcttttgatacatgggaccgtattgctgtgcaagaaaaccacactaaagtgcacaagcatttttatatggtacctggagaatggtcagaacaattttgtatctcttgctgctatccttacacttgagggttccccaggtaatgccatttacataccttatttatggagcaagtaaaaaaatctctgggtgtgcccaccagccccttctgtactatacttgatagtcttttataaaaacaccagcatatgtgaaaaccaaaaaccaccagcgtaatccctaatctcagtgaagggacagggttctcgtctttgggatgggaactcatcatactataacccttgtcacttcacggaatgcttacaccctgaacgaaactaagttttcctggagttttttttgcccacagctttaaatgctggtgccctgctggaaaagccagaatgggtggtgacaaggcccccacagccctttctttctggtagtccctgttaactgtcagtggggccatgtgtgaggcagctgcttggcttctgagggtgaagctggtggttgccgtggtctttgccagagtgtaagcctgcaaggcttggaagtggagccaggggcggggactgtctttggtgctgaccccttcctggggttcctccagccacaggccaggtcctgcgctgtgatgccattgtggacctcatccatgacatccagatcgtctccaccacccgcgagctctacctggaggactcccccctggagctgaagatccaggccctggactccgaaggtgagaacgtcccctgcctgtttgtcttctgcagcccatgctagatcatccccccaccatgactctggcctctctgcattccccactcctctggcatccaaccctgcaggtccctagagggcagctctggtcaggcaggtgaagttggtgctgggggagatgctgaagaggcagaaaccacctctgaggtgggcctcaagccctcggtggtgtcgaatcatggtcactcctggccctcaggaacccctgcagtggggcctgtgtgctcagagctgtggctctgtgaccctggagccagaccctgcctgcatagtgctggtccttggtgcagcacatcttggggaagctagcattcttggcagcgatgggaggcagggagaggctccctgctctggctcttagggccagtggtggcttcctgttccagacctcagagcatgtttgtgggtcaggtcacatttatgctgccggcccagggcactgccctcacatcttcaccttgccagagtcaaatatgggcttgtttccaggctggaactcttctaggtgatctcttaaaggaagtaagggaaacttttttttttttttttttttttgagacagagtcttgctcttgttgctcaggctggagtgcagtggtgcgatcttggcttactgcaacctctgcctcctgagttcaagcgattctcctacctcagcctcccaagtagctaggattagaggtgcctgccaccaagcccagctaatttttttttttttttttgtatttttagtggaaacgggttttcaccaagttggccaggctggtcttggactcctgacctcagatgatccacccggcttagcctcccaaagtgctgggattacacacatgagccaccgcacctggccagtaagggaaactttgtaggttaaaattcttgtcagagaaaataaaagtcaggcaaaagatgcctttcagatgatctgcccccaaaccaagtccaaaccaaggctcactttgtctttgaaaccttttctgacaactctagctcctgtttttgaaaaaaaatttctggatcaggatttcttagcctagatagtattgattgacatttggggttgagtaattctttgtgatgagggctgtcagtgcattataggatgttcagcagcatcccaggcctctacgtactagatgttagtagtgtctcccaagccatgacaatcaaaaatggcccagacatggccaaatgtccctggggggccaaaccactgtttagagcactagcagaccctttcttccccgcttacccattcatcagatgaggcccttaacctctgacactgccttctgacctgtgagattgagatagtgatgcttgtcctggggaccataaggacttagtgagaaatatgtacagtgttcggtcttgcgtgagtactcagtaagccagggggtgtttctctgagcactttgtacaaactgggcattgtccaggcaccagtgttgctatagggaaagaagtacctggcagctcccaaacagttaaacacagagttatcctgtgccccggcaattccactcctgcccaagagaccagaaaacacatgttcacatgtgaatgctcataacagcattattcataaccgccaagtgtgaagacaacccaagagtccatcaacggatgagtggaaaaacaaaacacggtcgacccctgcaatggaatattatttagccacaaaaagaaggaaatacaggctgggcgcagtggctcatgcctgcaattccagcactttgggaggccgaggcgggcagatcactcgaggtcaggaattcgagaccagcttggccaacatggtgaaaccctgtctctactaaaaatataaaaataagccaggcgtggtggcgcacacctgtagtcccagttactcaggaggctgaggcaagagaatcgcttgagcccaggaggcggaggctgcagtgagccgagatggcaccattgcactccagcctgtttcagattcctgggtgcagtgtgtgaaggtgccatgatctccacgtcctggccagcacttgctattgctcatccttgtggttctagttaaaccccctttaagtcactttttcttgaatgtgtatccattctccccaggtaggtggtggggatgtcgggattggggaggtgcctgcctcagccttcccaggccactgttatgccaggatggtgcccagcagccctggatggtttcctctcacactcccccctctcctggagggttgatggcccctgcagccagttccagagtaggacgtcacctggtctccacagactgggtcattcaccagtagcccatgtcaaggccccacctttgcagcaaggaaatggataacttccctcctcgcccactgtgagggcatcatgctttctacttggtcctcctcgccccgaaatactttgatgagtaccttcatcatttcttttgcctttttttctgagcctgtgacctcttttctgatcagagtctcctctgtgaagatgaacttgatccttagaacctttgagggcagtcccagaaatgatgtgccttatctgtattgatgaatgtcaagaaagagaattgctcaacgaacagtggcaccctggctgcccatggatgccaggcagtaggttgtccccttagtaagtacaatgtcttattgtgcttataaatggtctcatgcccactatatagatgaggaagctgaggctcagagagcttcagtaacttgcccatggtcacacagctcatgggtggctgagcagggcctgggatccaggatgtctgactctgtcgcctgagctgtttcccgctggatgcactgcctgtctcctactgctgcattttcctgggcattgggggccctccccacatggctgggatctgcccttttggccagaagccacctgcagagtgcccgcctccagacagggctctgtctgttgcacatagtaggtactaatagcttctttttgcgtggaaaaagcaaaactttgagcagaggttttcacagctatttcctggcccacccgtgcctcttgcatcagcagaactggactagctcagggtatccaaagatgccccctcctcacctttccttatcccatctcttctgcctggagcaccttcccctcctgaactctgctttcagaagccatgcttcctctggcattgcctctcaggtgtcccctcctccagggagccctccttggctgcccaaggtgggacttgttcttcccttcgatgtccctcagttctgcagtgccccctgccctgggatacaagacattttctactgtggcttgtcaaggtcagcactaggaagacataactgaaatcagttcattcttctggacttttctgtgcctgacactggactttggggccagccggcattgggtaaatgtttgctaggttgaattgcctaacattttccttcagctgtcctgcaggacaggggaggtagatcctctggagactggatccctggctttcctggttaatatctaaacttggctgtgaggcttcaaggtcaagggctccgttgcacatagtaggtactgatagcttcttttagagtggaaaaagcaaaactttgggcacagatttattgagagctttcccttcccccttgccacccttagggatgcccacctgcagcaggccctggaaaggcagacacctgccttgacatccccagggcccacgcagctgggtctggccatgttgccagcagctggcgggagagaaagccagtggccagcagctggcaggcccatgcatgaacgagggtccctgtgttctcatctgcacggagccctgcaaatcctgcactcggtcctgtgtgtgcacctgcccgagcaggtaacttacagaagcctaaggacactttctgcccttgaaattaccacacattcaactcttcttccacatttgaacgtggtggacttccaggagagactgtggggagcaaagatgatgaaaaacagagctccacgtgcagcccctgaagtgtctgcaggcatgattctctcccaccgttttccttgctaagagccccttagcagggcctcccccacctccatccccttgtccataagcggaccgttgtgaacactggacatgtcatgggggtgctttctcaatttgatcttcccaccaaccccatgcgttggtattttcatccccattttacagaagagaaaagccatgcttggagctgagctgggtggaagccccagggtagctattcaggactcttgtggtgttggcatgtatttgtgttaagggagtggcctgcctagtggtctgcagtcttgcgtttctggttactgggtcacactattatagggactccatgctcccctcactgagcacactgtaaagctggcctgctgggctctgactctggaaggcaggaatttgggcccaggctcccctcaccgagcatactgcaaagccggcctgctgggctcttccccgagaaggtggaattggagcccaggctcccctcactgagcacactgctaagccaacctgctggctctgcccccggacagtggaactggggccagcagtactccatatgcaccctgtttcagctcagtgtgcagaagaaggttctcacagtcagagctgttgaacagaggaataggctgtgctgggcgatgagctcctcatccctggggtatgcgggaagggtctcaagcccccatctgatggggacgcagcatccaagggttggactagaggactcctgtcttgcagccgatgtgcttcgctggtgtggattttcatatccaccatcctcacctaatgccctggatgttaggaagacagattaattttcaggaaaccatagagttttcatttgctcaaaatcctgctctggacctctaagaaaaaatcttcccgcatatatgtacatcatagatgggggttgtcttcctctgatcagttgctcacattgacggaaagacacccagggaactgtaagaagatgcctctcttcattaaagatgccctgagaagtaaggcgaaggagcagagttttctggagcttctgctaggcactatttcatgcagtctttgagaccttgcagggccagggatcggggtgaagagaagcaggaccccaggcccgtcagactctaaataccttgccctttgcactgtagaaaacagcttttcttggcccccagatcccttgtactgggagctggtcagaaggggagtgtggatgagggatgtggaacaggcgtggaacatcaggggctggtgaggagtgtggcatggccccttctagagagggcgagcagcttctggctctcagagggaatgaggcccaggtgggtggatcttcatcctttcaagaggaggtgagaactagacttgcatgtggcatctgtttcttgattggaaaggacagatcagaaggctcccaggcagcaagccaggacataagagccaaggctggctgggcctggctctccttgccccctacctaccccacgacctcaggagtctcacagtcaaggtgaagagacaagagtcatgtgacactagacagtttgggtaatgcccctccaccctgggtcccctcccctgcacagggagggagaggagtttactcccaggaagtggtgagcaggaatgaatggcccaggtttccgagcagactcctaaattgtaaaccgctcacagacgtgcggggcagcagtgttatgcactgcactgagctggtcctgcagtcaagggcagggagtcacagcaggaagagcacaagctttcatcggacagccctaggttcaaattctggcctcgccccctggtggtcacatgaccatgagtaagtgtcttcattcctttcagcctcagtttcctctcctgacatacagtttatgacacctgcctggtgggtggtgatgtggagtgtggttcctgcatggggcagaagctcccatcacgcctccctccaccctgggaaattaactccatatctgtctgcctctcccatctgctcttatagggaacaccttcagcactctggctggactggtcttcgagtggacgattgtgaaggactccgaggcggacaggttctcagactcccacaatgcgctgcggtaaggggtgcctctgctaggcctggcccctttgaagggaaggggaaagggggacacctgtgagctcctcaccagcggggggctttcatctgggtcattgaggagtctgggagactcctaggatgcccgtaacattccgagtgtctgattgaggaatgggatccactcacaccattgtgcgggagcctggctgcttctgcagcccccagagagtgtcctgtgagaagctgtcagaggcttgggatgtccagctggagaaatgagacatgcatggctgtctcagggcacagggaaagtgtgggtggccccaggctgcacttctggggggccagttaaagggcagccaggtttcggctggggcacaggccagctgtgccggtgggtctcaggtggaacaggctgagtcgcccatatggcggtatagtaagaccagttgtgaggcggacaccttaagcatcttgacctgtgtcatcctcctggcagccacatgagcttgcgcaccactgtgctctccatcgagtagttgtggaggctgagacttggagaggccgagccgcttgtctgagctccgggaggacagagctggagtctgaactcagatccgtggatctgcactgtctcgtgggagccacgggccccagagctatttacttgtagttagaaaatgagcagttcagttcctaagatgcataagcctcctgtcaatggctcactgcactgccacatgtgggacagggcaggagcagagccacgcgggtcctctgccggtgctggtgcaggtcccaggtctgagcttgtattcccgactgtgccgccttcctcctgatttgccatgtgatttttaaaaagcatggtcccttttttaaagttgtttttgaatcttttgagtctccttttgcagcaattttaggcctgtagaaaatctgccagtttagtccaaaaagtggtctccctcattcacctgagagccggctgccagcctcatgtcccgtcaccctgatgattttcatgtgctttacgaccatcggggcattgtcctgcacggccaccatgcagtcatggcactaggaaacgaacactgttgccggccgtcttcagaccttactcgagtttggtcatttgtcccagctttatccttttcagtaaaaagaaggatcccagccccaagtcacctgccgcatgtgtcctgtttctcttagtctctgtcagcctgggactgtctcccgggctttgactttggacaccacaacgcttgtgaagaggacagtctagttatctgtagagtggcccttgttttgggtttgtctgctgttccctcacggccagggtccgaacgttgtgtctttggcaggaacatcacagaagtgagactccgctcttccacttgcctctgcgctttctcacccctatataattataagtcctttgtcagggagtttactgtctggtctttcattatgccattaaagtcctgctctgggctgtaggggatgttggggatgtggtggttcctctgtcacagccttctccagggctcagcttacagcaactccaggccgacgtcctcatgtcctgacgcctttgtgagccgagttgcccttgtggagacagcctgctggaccagctctgtgggttctggtgttttgtaaaacaatgaccatgggccagagagtcagagacctggattccagtcctggctttgtcgcttcctgcctgtgtccttagccagggaacgttacccacctgagcctcagcctcctgccctgggaaacagagctggagggaatcccgtgcctgcctctgagggccactgtacagctcagtgggttgatccactcagggcccctctctgggcctggcacacgctggatgttgaggggatgctgaatccctgtccccttctgacaataccccattccccaccccttgagcttccaggcagctagctctgcacctgagccaaatgctaacagaaatcccagatgccaaggcgggttggagctggattgtcctggatttgtaatttggcgtgtgacacctagagtaaccaggcgaggaaataaatcacagtgcggcccagcattggcagattgctcttgtgcaggggaacagtgggctcgtttgtaaatgcaggctgaagtgggaggctgcgtgggaaggatccctgaagtccgcctgcccagcagcccacactccaggctacaccacgtccccgacatctccccaagctgggatccagggagagtgagacatggtgccgtctggtgcccagggctaggggaccagtcatggagaatcgttccccagagctgggcgctaggccggggaggttggacaggagcaggcagcctcggggaggtgagggtgctgctggccctgctgtgactgggctgtgctcttgggcctgctgcctcatctcccgggcctcactgttcccatgtggactcagcagctggtctcgcatgttagtatttacgtcacgtgtgcgtgtggataaaatgcagattcccaggcatcttggagacaaagcctgggccaggggccaagtatctgcatttttcacaaggactttggcagttctgatgtaggaagctgcagggccgtgtctctaggcagccccagccctgactagggggacaccccttatttcagcatcagccccagtgggaggtactgatagggaatgctgtggtagattctgacaaatcttgtgttggggtttgatcaacaaactttgacaacgtgctccttttccagaatcctcactttcttggagtctacgtacatccctccttcttacatctcagagatggagaaggctgccaagcaaggggacaccatcctggtgtctgggatgaagaccgggagctccaagctcaaggctcgcatccaggaggctgtctacaaggtgggcctggggcgctggggtgtcagtgggcttcctggggtggaatcaggctgacggtacctgcttataggtaccatcacacctataggcacgttgaatagtggaagtgagatgctgtcccgtgatttcaggatgtgggttcatatttttatgtgtttggtttggtttgtttgagcctcagcttacaaagaaaggtggttgaggccccagaaagcatctctaggggtgcatagcatttgctcattcttagtttctagggaggtccaagagcaggaggtttccagtaactcacctgtttccaactggtgcccccaccgtgctggtatagggacactcccaagcacttggggctttgacaaaacctggggctcctgggtgtcttctatgctgtctctccttgggcccccattggagccctgagactggtggcccagggatcctatgtgtagatcacctcaaccccctgccccagccgatcccatgtcttcctggcctcaccagcatcccattcttagggtagtgggggtatgccagaggaaaggagagtgaggagtgggtctatccaacgtcctggttccttctctgtccctgtggactaatgtccacccaaccagtgcctcgttttgagctgcaaccctgagatatttttgtttgcctagtgtctggagcacaggcaggaacactgtggtacttggcctgccatttaattttgtaaagtggcagacggagaaatcctcttctgattcactctctgtagtgggtttgctgcatctgggagtcctggaaagttatggaaacatggggacatgccctgttataggggctaatcccgtaggactctgcaggtagtacttagagacagtttgctcctgtgtagggcccaggctgggatggggtacagccacactgctaagctggaaaggcagacttgctgtcctgcccatagacattcagtggccctccctgcctgcgtgctggaaagcagccgccacagagccctgcccatggtggtgcccaatacacttgtctgttttggacacactgaagatattaactagttgttaagtgaggaaagctgtcagttgtgacagcaggcttaaaggagaatccaaagagttgccacaggacaccaggcatgctgaactgaactcagaaaaatgtagaatgcccacacccacaggagggcagtcagctgcgccttcacctgaggaaatgtttttgtgtttctgtggacaagaatcatttgctgtgttgtcgcttttctacaatgtacactgccatcaaacaggccaaagacaatgaaaggtgcaggcctctggagaatccagtacctaagggtgcactagacagggcacctagtgatctttctcccattgcgaagttgcccacgggttttcctgaggaggcaggaggtcacaggtcgggggtgaaaggcgggcaggggaaggggtcaaggaatagcagccaaggctcatcacagcatatgcctctcctgctttttatgttggcctggggcttctcaagttccctggaccttgggcttttgtgtggagagaacttgagctcccggtggccatagcatccctagagttcaccctggctctcctcttttactccagtttaatcatggtttcacatagagataaaccatgcacaatgggcagtcagtgtgagggctcagtctgggtaatgccctttttctgggtgcctgctatacttatggagctcccctgggacctctgggttctgaaagtgaggatttgggaatgatatcttgtttctttcctcttaacttccctattcccatgtttaaaacatctctttctcttgctcacaccaccacttccccattccctgtccgcacctcactttgtctgccttttctttatgccaagaatgtacgccctgcagaagtcaggctgctgattttggaaaacatccttctgaacccggcctatgacgtctacctgatggtgggaacctccattcactacaaggtgcagaagatcaggcaagggaaaattacaggtgtgtcattggctctgccatcatgacagatgcttccttcctcctttttttattgtggttacatacatgtaacaaaatttaccatcttaaccatttttaagtgctccatcaggtagcatcaagtacattcacactcttctgcagccatcaccatcatccatccacagaactcgttcatcttcccaaactgaagctctgcattgttaaacactaactccccttcaccctctcccagcccttggcactcatcactctatttcctgtctctgtgaatgtgactactctggttacctcatgtacgtggaatcatatagtatttatttttttgtaactggcttatatcacttttttcctagcctgatgtcttcaagtttcatccatgttgtagcaagggttggaattcccttcccttttaaggctgaatagtgctccattgtgtggatggatagaccacattctgtttacccattcatctacccattcatccatcagcagacacttgggttgcttccactttttggccattgtgagtaatgctgctgtgaacatagtgagcaaatatctgagtccctgctttcaaattctttggggtatatgccctttcagtggcagcaagtccagagctgtgggctttgtgtttagctgggctttgccccggtctgcaactgacaactgaacaaacttggacaagccactgcccttctccagggctgtttctcattggaggctttgaggcctttctgcctgggctgtgaggacaaaatgaatcaataggagtgtagttgtactgtgtacttgtgtttagatagtgacggttctcaatggagcgccagtcctcctaaggatcattatcattttgttcaaagctgtgtatgtttaacatccagagcataggacctgaagggtcatgggcataagagctctcaggtccagtccatccgagggcctcagtcaggtgagtttgccaggttggtaggttggttccacctgtgatacagggtgtcacttaagaggcaggcagatacacacttcagcataagagcaacttgagtggtgtctccagttgatgggaggtgctgcattgtttaaagtcctgctcaactgagagcagtcacctggttggtcattcctgtgtggcagaacgctttctctcaggaggacaaaaaaactgaagacaggcgctcctgcctttgggcccagttctttctggcaagggggtcctagttgaagagaagcaaactcatgtttcttgattctgggcaagcagcatctgcccttcagcaggatgtcaagtcaacaggaggatggcctgcagtaggatttgtaggaagccaagcgtgggtgtcctggtcagagcccgatgtttacctgacttcagggaggcagattctaggacagggacagtccaagatgtggctttctgagactctgaaaggggaggaggctccaagatagagttctgaggacagcagcctaaggaagaatgcaaaggggaagcgtgttgaaaggccagagggcacaaacaggaggtctcagaaatataaaattatccatgaacactgatcaagaaatggcactgcggcctgaaggaagacgcttggagagcctagtcactgctgacagcacctaaccatgactgaacatttcctcagtgttgggcagttgtaagtgcttttctttttaaagttactttattttattttttagagacttggtcttgctatgttgaccagtctgatctcaaactgctggcctcaagccatcctcctgcctcatttcttctgagtagctgggactacagttgtgtacctggatataacccaacagctctatgaggtagatttcattaataccctgtttcatacatgaggaaaactgaggcatagaagacctgaagctcacaaaactgttggactccttggccttaatcacccctgtaggatcaattggaatttccctctgccgcttctccccaaaggaaacccagaaaaaagctaattataacaacagggccggccgggcgtggtggctcacgcccataatcccagcactttgggaggctgaggcgggcggatcacgaggtcaggggttcgagaccagcctgaccaacatggtgaaaccccgcctctactaaaaatacaaaaattggccaggtgtggtggcgcacgcctgtaatcccagctactcaagaggctgagacaggagaatcacttgaacccaggaggtggaggttgcagtgagccgagattgcgccattgcactccagcctgggtgacagagcgagactgtctcaaaacaaacaaacaaaaacagggccttacagtctcccagggcagcggtgaggtggtccatttgcatgggactcatggggcatgaaactgccccagctgggcaagcagagcccatgtagttaagaggggatgggctgactttagaaagagctcactcggccaggcacggtggctcacacctgtaatcccagcattttgggaggccgaggcgggcggatcatgaggtcaggaaatcgagaccatcctggctaacatggtgaaaccctgtctctactaaaaatacagaaaaaaattagctgggcatggtggcacacacctgtagtcccagctactcaggaggctgaggcaggagaattgcttgaacccgggaggcagaggatgttgcagtagctgagatcgcaccactgcactccagcctgggcgacagagtgagactctgtctcaaaaaaaaaaaaaaaaaaaaaaaagagctcactctaaattagctcaggtatcacagcccagaggaactgcacctcccaaggtacctagaaaacttacgagcttggtcactgaccttcctgccacagacatcaaggaattggagcacatgaaagatgccctgggacaggaaaggaaagaggcagggcccacctccctttcatcatgtcatgagatgtgaaagtactccaaaaatacacactcctgtgcgattgatggcactggatgctactgcagtagattccagatggatgttttggcaaaactgagaggggccgagctagcaaaacttcactgtgaacaagacacaccaatggaaactcctaagtcttttagatgaattattttggggtttttttgagagagagtcttgctttgtcacccatgttgggagtgcagtatcatgatcatggctcacagcagctttgacctcccaggctcaagtgatcctctcacctcacacccctgagtagctgggaccacaggcacacaccacatgcctggctaattttttttttttaatagagatgcggtctctctgtgttgtccaggctggtctcagactcctgggctcaagttatccctcctacctcagcttcccaaagtgctggaataataggcatgagttgccatgctcagcctagctggattgttttttcattgaggtataattcacatgactatattggtttttgcaggtttgctagacagaaaagtcagggaatggtgtcttcataggggacctgaatttcagcaaatccctgtcttgcccggcatcctgtggaagcctcagagcattctgcgttggatgacagttacatgggctcattaacatgcgataattataactgcagattaactctttatattttcttttctgttgggtttccttccttacagtaattttttcttctttggtatttttatttcctttatgtctgcctctcttcttttttttggctcctccctttcttgcaaatacatttcctgagcatctgctctgtgccagccctttgctaagtgctgggtgcacagtggtcagcaggactgcccggttcctgccctcctggagctcacagcctagcagaggtggagcacagtcagtcacatcatgtctgcaagtgaggcctgtgagtggaggagacaggctcctgaggcttatagcagggcatctgtattgcttataggatgggcttccagtgggagccgtggtctccatctccagtccttagtgctaagtcctgttggtgtttggattggttgcagacatgactgccactgtgatcaagttgttagatgtaataaaaatgtgggaagggcatgctggctgatcgaatcagtatctgaagagaacttgagtggatagaatgctggaattactgaaataaaatgtactaggtttgcaaaaccaatagcatgcacatgtgttgggctgaggttcatgtgtcagagactcagttgtagaaggaactttgaatctggcaggcacttaactgtggctgctcagaactaatgtatctggggctgcttgagcaggggctgaggtcagaggcagggagtgagctctccatcatccttgactcagacccagctccgcaggagctccatggtcatccctggagctcatgtggagtgcaaggtccgggagtgggggcgctgacagaaacaaatctggggggatcagccagggtcagcaggggacagagatcatgtcttttagaagaatgtgggcttcctgacctatagaagggcagctgttcaccccctgcagatgatagcagggatgatctggggcctcaggagcgcctttctgttgttggcccaataattcaaagacaggaactgggcagtgcccttaatatctgcgaagacttccacattcagtgtctcttacaaggagtgagttccaggatacagggggtatctaaggccaggtatggtggcgtgcattggtagtctcaactacttaggaggctgagcccaggagttccaggctgcagtgagctgtgattgcacctaagaaagccactgcactccagccagggcagcatagtaagaacctatctctaaaaaaaaaaaaaaagaaaagaaaagaaaagaaagaaaaagaggtatctaaggagtctgtcacaaaatcctccttattttcagtcttagaatttgcaaggagggttacatctgtgctatgtaagtccccttcaatgtaagcatgttcatttcccaaaagggccttactcatttagaaaactttaaagtaaacaagggaggaagctagtgcttcattaatcagtataaagtaatgttgcttcattgagcaactatgttattttattctgacatttatctttgatgcactgctccatattctgaacactagacacataatctgcaagaatcacttgattagagatgaggatgtgggctgtgcattccctttgggattctcaattctagcctacatcagaatcacctacagggcttgtgaaaacaaagcttgctggagcccagccctggagtttgattcagcaggtctgggatggggcccatcatttgcagttccaggtgatgttgatggttcagggaccacactttggggacccaatgttctagtgaaaattatttgatacttattagatcacatgaaaaataacccaggacaagggccaggcaagtttcctctcttttagaattctcatcagaatccctggagattctgaaacatgctttagctggaattcctctgggagtcctgacctggcaccctctatggggtgttgaagccctgagctggcctgagaggagggccaagcagagatgttgtctgctgtttcctgtgtcctcttctctcttctcttgctggagggctagaatgtcccacttgtggggacagtgaatgggtgactggttaggaagctccgcgggcttaggagagtgaatgtgaaagtggtcaggctctctggatcagaacgccagctctgttttccactagctgcgcaatggtgagcaggctgctcatcttgatatcctcagtcccctatccccaaaatgtggctctcagtagcgtgttcccagggctattgagggatatgagggaacgtgatcatgagacacctcattgctctgaggcatcttgatccctgctcagcagtcaccattgctgtcaaaagtgcttgtggtctctgcccacagagcaaggaagatgtacatcgatgttgctcactttatagaactcttacttctcggggaaactcttctccatcctagcccacgttgggcaagttatttttctgccaagtgggtgtgaagggcaggggaacactgaagctggtgaggatggcagcagggttcattgttggcaattatagaccccatgggagaccagtgaccagagcttcttgggaaacccctagaggctggacggaaccagcaagaaccccagtgccccctctacgtagaagcaaagagttcactttgcaatgttcagaaatggcataatgttaatattctccaagcagttggcaaatagattgtggttaattttttttttaaacagcttacacagaaaaactgattgcctctgaaaattcatggagtgtcagttttgtccaccagcatgcagaacaatattaacatttaaagcactgaaaacaattaagaaaatgcgtcagctgtactgagagcagagtgcagagattcggggtggcagtgggagtgtattggcttctaacatttcctgtctttgctctctctttccctgttattttttgtttcttggtggccagaactctccatgccttccgatcagtacgagttgcagcttcagaacagcatcccgggccccgaaggagacccagcccggccggtggctgtcttggcccaggacacgtcgatggtcactgcactgcagctgggacagagcagcctcgtccttggccacaggaatatccttttcttgggcttgtgtgttcttaggcatggcggagctgctgtttggaagtcaagtctttttttccctgaaagctcggcagggctaaaaatagccgtttcccctcaacggtctgaaaatcagaaagaactgaaatagcactgctgagtggaattgctcacggctgtgggtgactcaccccagaggctcccagcggtgggaggtgatggcaggagctgagtgtcgttcctcgtctccagaaacttctccagtacctgcagccttctcagagggggcctggcgggggctgtttccatactagcataatggagtgttgatgccccagacttgttgttgtgtcctgtgcggtctccagtgtccctcacagagattcccctttgctagtgtggcaagcgcagtgtggcctttgattctgaaaagtgcctttgctctacgtggcctaagccaggggagttttcatcccctcttcttctctccatgtgatgtcttgatgatcaggattctgagccaagctgaaactggccagccagctggtttatttgctgtcatatgtcttgccccttaattcaaaattcaggtattcgcatgcaaggtgcttctaggttacccaacagcactatctacgtggtcgaacctggatacctaggtgagtgtgggcctcctgggccctcatggatgctgctcagttgtgactatatgagtttaaaaaatagaaaagaagcaatagctccacagaaaatgcttccctctggccagctctgccacttgctatgaccatcattgcccagggcactcaccagcccttccctgtttggtgtagaaataggtagaatgagccaagccaggcaggcggcaggctcagcaaggagagaaacagaaccgggtagagtggtgaggggcttgcaccctcctggttttcataccacggctttgcccagacctgaccattgctatggacatttagaggttggggcccagtgtcagctcaattatagagggaccctaaggtgacatgacagtaggcaggtaccttagcagggaggggaggaacatgatgatgatattgaaggcaggcattttctcagacagagcttcttttgcgggaaggtgtcctggcagagggaattgcttaggcaatggtgtggaagtgaaaaagtacactgggcatcccaggggacagcaagagtgctgtggtatcctgtgttgcaggggactgagaacctgggagggcagggatgactcatatggcaagagtgctcagtgacaggcttcagagtgtagacctgctgagatgagtccagggttggtcctggcgaggtcagctcaggactgagagttcaaagcagagaactgttgtggattcagagcgtagacctgccgagggttcagagcgtaggcctgctgtgtgttgaggacagagttgctggattctgagtgtagacccactgaggacgggaatgagtttgaaagagccttgatcagacagagtgggatgagtccagggttggtcctggcgaggtcagctcaggacttagggctgaaggtggcattagacttctgctcctcagcagaaggaggaggccagggccatagttgtggggcctccaggtgggtggtgtagggcctgcaggtgggtggtgtggggcctgcaggtgggtggtgtggggcctccaggtaagtggtgtggggcctgcaggtgggtggtgtggggcctgcaggtgggtggtgtggggcctccaggtaagtggtgtggggcctgcaggtgggtggagtggggcctccaggtaagtggtgtggggcctgcaggtgggtggagtggggcctccaggtaagtggtgtggggcctgcaggtgggtggtgtggggcctgcaggtgggtggagtggggcttctcgtgtggatgctgagggcccctgtgctgagggtggtggtcccatcctcctccaccctgctgcccctgaggcctgagtgctcaggctccctctgcctgttttagggttcactgttcaccctggtgacaggtgggtgctggagaccggccgcctgtatgaaatcaccatcgaagtttttgacaagttcagcaacaaggtctatgtatctgacgtgagtgcctgttcaggtcctggctggggggatgaggtggggtcgttgtctgacgcggctgctgaagagcagcccccaaagcaacaggagcccccatgcaggctgaccgaggaggggtcctgtttctagtggcgctcccgggtctgtgggaaacagtgctgaggcatcccggggcatctccagagcctgtgagcctgcacaccggcctagctgcagagcccctgttgggctggagggcagaggttgccacagcggcagggctccaggataggaggatagggaggaggtctctgcccgccactctcccgcccccttttccccaagctggggacctcagagaatccattctcctcctgccctgcagagagtcacggagcacgtcctggctttctccgtactgggttccagaaatacctggaaccctgcatgacagaggccgagctcagcacactttctggttctggaagggggtgtcagacagatgaggaaatgtgcaggagtcttggctgcctctctgtcccctgtgagaaattccaggctcgtcagtgagcacccccaggcccttcaggtggcgttggaggttttagaagaaaaaggcgaggttcctctcggtgtccttgaagatgtcgttgctttgctcatgttatcaaacaagggctgggatggtcaccatttgcagttagctgtaggggacgtgatgtccttttttttgtatttactggttccttcttgagacctcggtaggctccaagctgccccaggtgccacacggggggatgaaatcgaagcgcaggtcatcaggccatgcagggagggtggcctcggtggggacaaaggccatagtgatcagacctctgttccagggcccagcccacccgtctgctgctagtggaggctgctgagccccagggggccccttggcctggcctggctgctggtttcagtcctgtagcttcgtgcccaaattctgactttctggagtcaccccagaagcacctctctcctgtcctgcctcaccttccagaacatccgaattgaaactgtgcttcctgctgagttcttcgaggtgctctcgtcctcccagaatgggtcataccatcgcatcagggcactaaagaggggacagacggccattgacgcggccctcacctctgtggtggaccaggcaagttggtgtctcccctgcgtcgtgccttgtcctatgaagccaccctctgtaggcagaaatgtcagcccaggagggccatgagtcccagggagttgggccacctgcatcccttttcctgtttgggctacttgcatcctgggttctattttccttagtctttaagaagcccatcagccttagggagcagagctttgctgattggaaaatcggcctgggtgttcccattttcctaccccgcacagaaggcctcctggcctggaaggggcagcaggctgtaacaggaagaaatgcccatgcaccgacagtgactcctgccagagtcggcctcctcagctctgggggctgggcgggctgctttagctctcaagcctcagtttccccatctgtaaagttgggggggacaccacatccatcctgctggggtgccctgaggattcagtcaggcagcatttccagaaagcacttcacaaagccatccccgtggagaaagagagggcagcagggtgtctggcaccttcctctccactcttcccccaaatccacctttgtgacccgatccccagggaggggtgggggtccggtgactgggaaagactgatgatgacatggttgtcatggttacgtgtggcaccctcaccccttgtaggatggaggggtccacatactacaggtgcctgtgtggaaccagcaggaggtggaaattcacatcccgatcaccctgtatcccagcatcttgacatttccgtggcaaccaaagacgggcgcctatcagtacacaataagggtacgtgagacccctcacctctgcgtgcattcctttggtgttttcatgggattgtggctttttgtccattctattacttttagtattactctctagtggttgtggagaattttaaatcacagtctttatgtttcctgaggtttccatcatagcaatgcattctggtaattaggaaaaaaaacaacaaaaaccaacaatgaaaaaattgagaataaggcagggtgcggtggctaacacctgcagtcccagcactttcggaggctgaagtgagaggattgcttaaacccaggagtttgataccaggctgagcaacatagggagacctccatctctactcaaaaaaaggaaaaaaaaaaaaaaagagaaaaaatagaataaagaaaacctggaatacagttttgaatttcattaatgtttatttttctaaaaatcttttttgaaagcattatatatatacacacacccttagagaaaacattaaaatttaagggataagtatctccaacctcatcacatgggatggatcactgctctgaccttaatacttccacctggcattagccagcaggactcgccttagacagggctcgagtcctcgtggtcagtgcagggcacatcagtcctgctgtcccatggagtggtgacaggtgtcctgtctgtgcactggcaccggctctctgctcaggtgcgtcaccatcctggccccttgggttttggggttgtttcctctggtctgggagcagaggtgcagtcgctgacctcccagcagacaatgaggaatgggcaggggtgtgtgctgggagcttgtgtctggtcagggaggcagcatcctgcaactggctcggtgaccaagggttcgtcccactccagcctgagctctgggaggtgccaccaggttctggggcctctgtcatgggcgtgtgtgtttgtgtgcatcggtctcgaggtccccagaatatgaggacagaaacgagacaggacaaagagggtgagggcagggggagcctctagccagaccctagctgataccacatttttccctgctgtgggcatcgaccttgtgtgtcagtgaggaagtggccacaggtgttttagagcctgtgagagtgtgtatgtgtttgagtgtattggtgcgagtatatatgtgtgaacgtatgtatgtgtgagaaagtttgtgtgcgtgtgaggataagctggtgggagtaggtgaatgtatgtgagtgtaccgtgggtgcgaatggtgagtgggtgaaagcgtgagtgtgaaggtaaatgtaagtgagcatgtgtacgaatgagtaggtgtatgagtgtgcactgtgggtgtgagtggtgagcatgtgagcatgagagtaaatgagtgtgagcaggtgagtaggtgtacgtggtgtgcactgtggatgtgagtggtaagtgagcatgagtgtgagggtgagtgtgtgagtgaatgggcaagtagctgtacatgtgagtgtgaatggtgagtgtgtgcatgggtgaacccatgagtgtgaggataaatgtgtatgagtgtgagtacgtgcatgcacacgcacgtgtctctgaccctctgacttccccagcaggctaagggtgggtggctggtcctgtgatggcttttcctccgcaggcccacggtggcagtgggaacttcagctggtcttcgtcaagccacctggttgccacagttactgtcaagggcgtgatgaccacaggcagtgacatcgggttcagtgtgatccaggcacatgatgtgcagaacccactccatttcggtgagatgaaggtgagatctcagggccaagacaccccctgggaggctcggatggtggtctccagccgccccctctgagcaagcctcgacttcactcagaaacacccccaaccttgggtcctgtacttaggagctcaagccccagcccttcccttaggagctcacggccatgtcaggaagatggacaggatgtctcacaccagccaacaatgggcccagaaaggccagtgtccacagagctgggtttctggaggggagataatctaagagccattctagaaaattccccagacctgaaagatagtaatctccatttggaaggtccaccaagcactgggttgtaaactcacagtgaaagggcaccaccaggctccgagagaccaggccagactcctctctcttcactcacctttgggtacaaaggcaggtgttccctgcacaggtccccacacctggcttttggccctaagtgacatggggccatctcacttcacaatggtggcaggtggtggtggtcacagctgagcctctgccagccccacctgtggccactgaccccaggccatacttgcctagtgctctgacctcagcccctttattccttcatttggggcaggaaggggtgtcccatggagtccagctgcagcctgctcttacagtattggggacagggatggataggctggccagtcttccgcttgagacccagagccacctctatctaaagtgaggcctgattctcatggagagggggcttcacacaggcccttgagatgaagcatgaggtccagcgttgggataaactgggacccctgtcctctcaccccagtttccccttgtgccactgttcgcccagcagcccagccagatcctgaggacagttcctcaggaggcagcgtgcgttctgggtagaacctggcttccggggccagctggcggggcttgcactcagacccagcatgctgtaagggagcctgccctttcccttcaggccagtgcttcgccaggtgagtggggttgaggagagcccctccttaaccaggaggtgggattctagttttatgcaatcatggctgtgcttacctctctcctggctccagccgctctaccagtccatctgatgagccagacattcagaacacatcccacatctcactggtcctaacacgcctgccctggctcaagctgtcgcatctctctctggggctttccaacagcctcctcaccacactgctcacctggctgctgatcggtacacagaagccagggtggtggggacctctgaggtcccccagctcagccacagtaaacactgattcctcaccatggttgccagccccgtctctttccactgcccctgcacagtgcacttcagcacactggactccatgttcctccaaggtgctggcctggtaggtgctgcagggcctttgcacgcaccatcccttcacccagagtgttcttcccccaggctttgcctggctgccttggctgtggctctcagatctgagctcctaggccactcctcagagaggcctcccctgctctctgtccctgaatcaccccactgcccgtgacaggcttctcacagatgtatcctcagtgctcagcacacagcagcacttaggatatccgagcaacaggccctgcctctcctgtggaggcagctgagcccaggccatgcccctgtcttccaggtgtatgtgatcgagccccacagcatggagtttgccccgtgccaggtggaggcacgtgtgggccaggccctggagctgcccctgaggatcagtggcctcatgcccggcggggccagtgaggtggtcaccttgagcgactgctcccactttgacttggctgtcgaggtggagaaccagggtgtgttccagccactcccaggtaaaccagcgctgctgagcaggtgccagatactgggattggggccagattgtctgggttctcagcatggaccgccagattcccaaagagagggcttgaggcagcagaggggctgcaacataaggaatggcagttgtctcctgatccacagtctgttcctgtctggcctggatcttgcccaccgtgtgacttcgggaaatcagtggcctcgctcagcctcagttttcacatctctaagctgtgtgtcatctacatagaatcacatcaaagtgcctattttagtccctggaatgcagttggtattcagaatgcgttgtcaataggggtttggttaattctagggtcctctcacctgtgacaggcaaggcccacccatctgttctctgccgcatctgctgtgggattttgatggtgacattggtggagtctgactgtgatagtttatccagtgtcagtcctgtcaggacaggacaggcactttgcatgcctgacctccttaggactttacaaccaccctaggagaaggatctgttattggcccatgtgacagatgaagaaactgaggctgtgtagctgtagctgcctaaggtcacacatggcctgggacagggatggggtgcagatctgggcgtggctgacactgaccctgtggctttactcacctgtgaaacgggccttaaagataaggaaaggaagggcttcctctctgatttgccgaagaagaagaccaaaggacaggtgaactattgaataggagtaagatttgggcagagctttggaggttaacagggacaccatttggtgagcaggggcgcctgtaccagggcccagaggtgggcagtccgtggtgcctgtgcacgtggaggactgggaacagaggacccgttgaatcacagcgtgttttggagggcttggacctagtgtccaggcagtggggagccactgaaggtttttgaacagaagagcgatgtgatcctggcagcgtttaggaagctttattggcagaggtgtttgtaggatcgcctgtggtgccaagtggctgtgcgtgcaactgtagctgtaattacgtgcagagcttttgcagtttgaagctgcacagaaggaggccagtatctctgaaaaatccctgagcatactgcatccaggagaaactaagctcatgaagtctacagtgtcattgccaggtaatcatttaggatggaggaaaagtcttgcacgtgggagaggcccgctgacagcaggacacgaaccactcccctgcactgcctgccacaaccgtcctggagggagtctgcagggtgctgctcaggcatgggctcaggtccccgggaggaaagttcagggcttggagttccacaggcctgggtctgagccactccactcccttgctggctgtatgatgctggtgtgctgcctagcctctctgagccttgggttctttaactgtaaaatgggatgacagctcttgcttattgtgatggttacaagtgaatatccctcagcacgatgcagggcgtttctccaggagtttgacttctgaaaacagcagtcaagatgggaatcctgtggtgtcaaatttctcttaggaagtgccttgtaccgcccctggtgtggagtgtgcatggtaatgtgtagggaggtgtgtagggcccaggctgtatgaaaatatgtatcttagaaacctgggctctgtcaggacagagatgctcaccccacagaaacccatggggctcaagagcaggttggatcagcaggttgacctgtccctataatacccaccctggagcttactcagctaaagaaacaaatttggtcccatgttaggtaaactccctctgccacctcccaggctcagagcacaggtagccagactctgatcatggctctgaggaggagccctggtagccctggcccaggctggcctcccctctgtggctccctctgcttactgcagttggacttggcggtcccatttctgccttgccctcttgggtggcatcttcttgaaagcccctgggctgtgggcactactgtaactctctcaacacggtgctggcatagacagacttacagaatagaatactgagcccagataaaaacctgctcgtacatggtgaaatgatttttggtaagggtgccaagactgtccaatggggaaaggacagtctatttaccaaatggtgctgggacaaccacgtatcgacatgcataagaatgaagttagacccttccataactccaaacacaaaaattaagtcacagtggatcaaagacctaatataaaattgaaaactataaaacttctaaaagaaaactggaggaaagcttcaggacattggaatttggcatttttttttaggtataacaccagatgcacaggctacaaattaaaaatagacaaactggactacaacaaaataaaaaagttctatatatcaaaggacaccacagagtacaaaggcaacctacagaatgggagaaaacatctgcaaattgtataaggggttaatatctaggatatgtaaagaactcctacgtgtcagcagcaataacaccaataacccaatcaaacagtaggcagaggacttgaatagatatttgtccaaagctgatacacggacaataagcacacgggaagatgctcaacatcactcatcatcagagtggtgcaaatcaaacccacaatgaaaagcactacactccttaggatggctgcgatcaaaacaacagaaaacagcaaatgttgacaaggatgtgaagacactggaactcttatgtgctgctggtgtgtatgtgaaaggtgctgctgctgtggaaagcagtatggtggttcctcaagaaagtaaacatggagttaccgtatgatccagcaggcaatcctgcatctgggtgcacatccaaaggtgttgaaagtacgatccgaaagaggtatttgtgcacccatgttcatggcagtgttattcacaatagccaaaaggtggaaataacccaggtgtccaccgttggaagaatggatgaacacaatgaggtctatccatacagtggaatattattcagccttaagaaggaaggaaattccgacccatgctgcaacatggaagaaccttgaagacatcatgctcagtgaagtaagccagtcacgaaaggacaaatactctatgatcccacttgtatgagatacctagagtaataaaattcatgaagataggaagtataatggtagtggccagggactggagtgaggggaattgggaagttactgtatattgggtgcagagtttcagttttgtaagttgaagagttgtgtggatggatggtggcgacatccattcacaggctgcataaatgtacttaatgccactgaactatacacacaaaaggtgttatggtgggaaattttatcttagttgtattttatcagaatttttttaaaacttttttttaagataaaattttaggctgggcacggtggcccatgcccttaatcccagcattttgggagtccgagatgggaggattgcttgagcccaggagtttgagaccagcctcagcagcataatgggaccttgcctctacaaaaaaatgaaaaaactatcctggtgtggtggctcactcctgtagtcccaactaatcaggaggctgaggtaggagactcacttgagcctgggaggtggaggttgcagtgagccaagattgtgccactgcactccagcctgggcgacagagcaagaccctgtctcaaaaaaaaaataaaaattttaaaatttaataatggcagggatgtagggcagccgttggcagcagtgtaaattgacacaaccactttgggaagatatttaacaacagcaaccaacaatttctacagctaaacacatgcacgccctgcagcctagcacttcctctcttagggacgcacgcaacagaaatgcccaggtgtgtcccccaagaggaaggcacccagatgtttacagcaataccgtgtagcacagccccaaactggaagaaacccagatgtgcaccatagcatgggtcagtctattgctctatattcatgcagcagaatcatatggagaatgtggacaaaggatcttcacggtgtgaccaatgagaaatcccatgaacactgctgagttgaggaagccaggcacaaaagagttatgcccatggttccctttatgggaacaataccaagcatgattcagttgtgctggtaggcgccaggggggcggttttcctttagggaaaggccaaataccagaagggtttccaggagattctgggggtacagataatattctatttgttgatgtgggtgctgcatatagggtgggtccagtatgtggaaaaatcattgtgaattatatactcatgtgaattaaatattatttatttttctttaactgagttttgctccctcgttgcctacgtgggagtgcaatggtgcgttctcggctcactgcaacctccgcctcccaggttccagcaattctcctgcctcagcctcccaagtagctgggattacagacaggcgccaccacacgcggctaattctgtattttaatagagacgggatttctccatgttggtcaggctagtctcaaactcccgacctcaggtgatcctcccacctcagcctcccaaagtgctgggattgcaggtgtgagccaccatgcccggccgtgaattaaacatttttatttttcttttgagacagagtttcactcttattgcccaggctggagtgcaatggtgcgatttcggctcactgcaacctctgcctcctgggttcaagtgattctcccgtctcagcctccggagtagctggaattacaggcatgcgccaccacacctggctaattttttgtatttttagtagagacagggtttctccatgttggtcaggctggtcttaaactcctgacctcaggtgatccgcccatctcagcctcccaaagtgctgggattacaggcgtgagccaccgtgcctggctgaattaaatatttttttaaaaatcagggccgggtgcggtggctcatgcctgtaattccagcactttgggaggctgaggggggtggataatgaggtcaggagattgagatcatcctggctaatatggtgaaaccccatctctactaaaaatacaaagaattagctgggcgtggtggcgcatgcctctaatcccagctactcgggaggctgaggcaggagaatcgcttgaagccgggaggtggagcttgcagtgagctgagatagcaccactgcactccagcctgggagacagagtgagactctatctcaaaaaaaaaaaaaaaaaaagaaagaaatcagatcaaggatcaagcctgggatgaaagagggggcccccagcctgttgtgccttccccaccaaaggtgatttcagggctgggcacagtggctcacacctgtgatcccagcactttgggaggctgaggcagattgatcacttgaggtcaggagttcaagaccagcctggccaacatgatgaaaccccgtctctattaaaaaaaatacaaaaattagccgggtgtagtggtccatgcctgtagtcccagctatctgggaggctgaggcaggagaatcacttgaaccccggaggcggaggtcgcagtgagccaagatcatgccactgtactccagcctgggcaacacagcgagactccatctcaaaaaaaagaaaaaagtgatttcagggtgaccatctagttctctcctttctgtagggaggctgccgccaggctctgagcactgcagcggcatccgggtaaaggccgaggcccagggctctaccacgcttcttgtgagctacagacacggccacgtccacctgagtgccaagatcaccattgctgcctacctgcccctcaaggtgagccaggggccctgccctttaccacccccctgcccactccttcccagatgcaaattacccatttgctctgacgaatttgcatgataaacccgattccttcaaaatagcttttggcacagcttcctctcccatgatttctggctgaaagcaggattcatgtggaaggagcagagcctccctgatggggcagtggttgtgggcatctctgtggttacgcgagacagcgcttggcaggcttggcaggacaccgacctgccagcctctcccaacgaaggtaggagtgtgggctgcaagggcttcagaagtgtgttcagcaagggtcagaacaggggagtgcttctgctccactccagagctaaccttcagggtccccacagagccctagaattaggacagcggccgtgtggtatggcagatgctgaggcctccaagactggggtcagagaggatctgccctggcctagtgtgcatccatcctgctccccatctgaggacagtggtggccacggcctgtgcggagcagaccacatagcctcagtgtccataccaccctcctgagctgagaccagcctgacccccacccactcttgggccttacattccctgcctgtaaaatgggactgagacagctcttgcctcatggggtcgtgatgaggatttgctgagctcacaaatggaatgagctcagaacacagtctagggggtagtgcaggctcaggaagggttagttattatacacggataaaaaagaactgggccttcctctggggtgggtgtgaaggctccgtgcgagggctgccatgcaggaggctgctgactaatcattcctttctttgaactctgcctagcttgcaggaggcgcagagagggtttgttgatggggagttcctgctcctccttccagggagggctggagagcagtcctaggggagccccagactccctggcttggtcaggcagtccttgcatttttctgctcccagtgtcagccttgaagacagctccggtcctcatggtttgtcccatttttttcttcctctcaggcattcattggaagcaagcctggtgatgttaggatttctttttctttttcttttatttgtttattttttttgagacagagtttcactcttgttgcccaggctggagtgcaatggcgccatctctgctcaccgcaaccattgccttccagggttaagcgattctcctgcctcggcctcctgagtagctgggattacaggcatgcaccaccatccccggctaattttgtatttttagtagagacagggtttctccatgttagtgaggctggtcccgaactcccgacctcagatgatcctcccacctcagcctcccaaagtgctgggattacaggcgtgagccaccgtgcctggcgatgttaggatcttttatctctgaacccctagccctgggttcagtgcctggcacagagcagacatcaaccaagggtggttttgtttagaatgaacgtgtgaggaaatgtatccaaggtcacccagccagggcagaagccaaggcctcctgacctccagagcaaacataacagacacttctcagatgtccattagtgatcagaggcctagccctgctcctcatcctccacacatttgttcctttagcacacaggcatgaatacctacctacttgtgcaatcccttctgcaggccctagagttgcaccagggcagagaacacagaacctttgtccccatgaagtgacattctggcaaagagaggtagagatgaccataaacaaagcaaagaatgtattttacctctgcttgccatgaaaaaagtagagcatgaaggggtgatgggggtggaagtttaaaatgaggagatcaagacctgcccccacatcccaactcaagcacagcactgcagcaggtgagagtgtcagagagcagagtggagagagttgaaatccccgagcacagcaggcattctggggttgccctgcgcaccttctgggagctagagcatttcaccaggcacctggagaggggttcttcagggcccctcctggctctggattatcagggtgtttggctggagcagcagaagccagaagctgagctcacagtcctgagctgggatgtaacaatgaagataaggtagacatgtccctcagggaggtggcttcctgattggacagattatagagaaaagtggatatggatctcttctcctttcatctgtctccttcctagttagcaggtaagatcaggtttatttacaaggaacaaaagccaagtgacagggacttaaccaatagaggaattgatgtctctgttgcacgtgaggaatatttggaatatttgggctttgacatccgctgaggagcctgcacaattcatgagcatccttcatcagctgcgttgttaacctgtctccttggcacagggttccatgatactttcatgcctaagggagagaattaaacaggaaggtgataattcctcatcctccagttgttaattgtagaacacacagctccttcgcacagttctttcactttgggctggtcatgaaaatgtctttggcaagatacacagtggcctgctttgcccatagtggggttttattggttgtggccatgagatgtgggtaagagcatgggatcaagagtcagaacagacccgggcccaccagctgggttagcttggtttagtgtcttcatctgctgggatttatccttgctgtctataaagtggggatgacagttaataatcataacagtttctaacagcaggggccattgattgagcgtgtgctagtcacatattcaggtctttcattccagcccctgaatcacaacagtagcaccgcgaggtaggcattatcattgtacccatttcacaggatggggaaacagccttgtagacattaacttgtttaaggtcccacactagcttcactccagtggggacagagaagcaaatgatggtatatccagtgatgtctgaggggcagagatgaagagttgagctggaaaggaggtgacgggggaagggagaccctgcttcagacaggctcagcagaggcctgcctgaggaggtgacgctcaggcagaggcctgagtggcatgcagaactgggagttctgagaggagcagagatgaaggccctgagcatacttagtgcttctcctgcaggaaacaggggccacgcctggctctgttgaaggtcgagtccggggatgggttacagcaggggcaccgcgggctccttggaattgtttgtgtgtgagcacacatgtgcagggagggatgcccagagacagtcgataacctatatcagatcccaaaaatgttcatattcaaaaacaaagtcaaaaggacagaattctcatttgagaagtcatagtctgttcaggtcgccttaacgaaacaccttggactgggtagcttataaacaacagaaatttctttcttgcagtttaggagctgggaagtccaaggtcaaggcaccagcagattttggtgactggtgagggcttccttcctcatagatagccataatttggatgtttgtgtccccacaaaatacatatgttgaaatgctgacccccacagcaatggagctgaggcctttgaggggtgattagatcatgagggcagaagcttcacggctgggattagtgcccttataaaagaacccagagagctagcatgacccttccaccgcgtgcaggggtggaagaggtttttttgtgggtggggagggaatatttttcttataaggtttttccttcctcatgtggttaagatcatgccacagacagagaaggaaacagacacaccgtaccctccacaagcctatagcatgatcagggagacctctcaggccatgaagctccttcagggtgaggagcaccaggtgaagtgggggccagagaagagtcgcctgggctgcaggttggggctgggttggggaggaagcagggctttctggaggccagtgtgctgagccctgcagtgtgaggaggggtcgcctaagtgagacaaggacaggagggtagcctcttcgaaggcctggggacagctgagcctggttctctagaaggatgccactagtctgaagctgggactggagccaggttgagagagcccaagtcccaggacagaagctgagcctgtattccaagggccgtgggtgcgtggaatagtttaatgcacaagggacagggtcaggtctgtgtcttagtgagggacacatgggcagctgtttgaagggagagtagatgggtctagcagggagcagactgacaagtgaggacttggcagtcactgcagtgggaccctctgcagtgggaggttagcccagctgggcagggattcaaggagcaggactgcgggacccctcagagtgaatccctcctctccgcacccctgctgtgtgtcactggagggaggagtcctcctgtggagtctccacgtcttcctggaggttggctgggaatgacaccctgttacatagaatctaagcactgccattgcccacaccaggaggccatggggccctgggcaccactggttgccctaggccatggaggaaatgagagctttgtgtgaaatactactttaattcttcctttgtttactgggtactttaaggactccatagttttacttgccaactcactttcattcaacaaagaattgctgagcacccgctatgtgccaggcatggttctaggtgccacaaaactcaccctcgaagctcgtgcatacgtggtgcaaagtatgggaagcccagcggctcagaaggaagggaatggaccactggcaatgatgccagcaaggacaccacaggctgcatctcctttggtcacctggtggatatctctttaggatggttttatgctttttacagcaacatgattgtgatcaaacggcaccatcagatttgtatcctgcacttgtagatctttgcgaagactgctttgggggcccgcataaggttccatcactgggaaacaccatgtgtactgagccccttgtgctggattgtagattattgttggttatttgctgtgggaaataatagtgtgatgaacatctgtctgtacattgacatgtttctctccattgtgttgttaggttaggttccagatggggaattcctgggttccagggctgtgggtattttcaaggcttttaccagattgtttgacgaaagaggcaaatccatgtacaccctccagcagtctgtcagagtgagggcttaattctatctacaccccattcctctggatctttgcaatgatccctgtgagtgctgcagatgacgagaatgagtttcaaacaggagatggggcttgcctgaccaccagcccccacaagcggggtgaggatgtggggctgggatgcccggctcctgcccgtgctgccttagaagaatgccaagtcttctgcctcttctgtccccaggctgtggatccctcctctgttgccttggtaaccctgggctcctcaaaggagatgctgtttgaaggaggtcccagaccttggatcctcgagccgtccaaattcttccagaacgtcaccgctgaggacactgacagcatcggcctggctctctttgccccccattcctcccggaattatcagcaacactggatccttgtgacctgtcaggccttgggtgagcaggtgagtgggcagctgctccagaccctccttgccctaaggcaggggtggaaaatgactctctcagtattgttttatttactccttggagtaacgctgagagacagccactcctattgtacccattttacagacaggcaaactgaggcgtggtgaggtggaatgtgactcaatgaacgccaggcaggtgtggcaatagggacctcccgctatgccagctttcatagagtaggccagttgggtggcttgccacctccatgggcttcagcatcccccactaaccaaaccagagctggaggctttgagttcgggggtcacaagtccaatgtctccagggtcgtaaatgaatgaggctgtagacccaggtttgacacatcttgttggttcttgaggataacctggaaatcacaatatttttttttgtataggtaatctcttaagttttttaatgctgaaaaccaaaagctgaggaggctgaggggaccagacaaaacacatgtgtgacctgaatccccacatgctggctggagggcttcttgctgttcaggcgccttggggcctgacactccttccccggggagggtgagctgagagcttgtggggcttctggtgggcatctactgctctgtttccaaggcaggaagcccaaagcaaaaggggtattcggcgggaatcaggaagatgggagagagcccatttctttgggacgtgaagggtatttcctgcatgtgtgcagggcaaagaatgtcagttggcaataaaacgcacatgcatgcctcccacggtgcccttatggtatcagccatgccacagctgccctggtatggccagaaaagatgcctggtgataggttccactcaccagtggggtggttttagaaaaacaataaaacaacaagaacaataacagcatcataataaataatacaataagaagaataaaattcctcatgaattaagttggatatatttcttatccctggcatgaccccaccatccctgtcccctctcagggctgtaagaatgtgacctccaattggggttacctctagggccctcccaatccattgctctgtggctccctcacatgcggcaccaggtgcagacagaaagcctgtgtggagtcacggaggacactgcccttggtcctgccttatggtcaggaggggtaggggctcgtgtcctccatcaagtgcatgttatctgaggaggctgagggtgctacctcaagatgggccctgagccatggtgctccaaaaaagaggaggccagatatgacttctgaggtcccagctctccaggcagacaggtttccctcttttcttgcaccatggatttccctctctgcagcagcccctggagctgcagagcatgagcaggcggagggcaggccctgcctccaggctgcagctcctcctgggcgttgtcctgcagagctcctatctgattcgcttgccctgtcatcattctgcagcatgcacttcccacgtctgttcctcgttccatgggtgttttcacctccatatggactcctcattgaagcatccttgaacttgtgaattttctaatgcaaccgtggggttttcccagggtcctgggaaaccatgaagcctcaccgggtctacctcttccctgggataggagcagcccatagggcacatgggctcccatctgagagtctcttaggtgttgagaaagtgcattcccacctgtgtgccactgggcctttgttaagaccctgtggcatgggtatcgtcatcactcccatcctatagaggagaaaactgagtcagagggagctggggtggggtgtggcatagctcagagaggagtgagaactcaagcttgggggtctgactgttcactgtgccctaccaggtcatcgccctgtcggtggggaacaagcccagcctcaccaacccctttcctgcggtggagcctgccgtggtgaagttcgtctgcgccccaccgtccaggctcaccctcgcgcctgtctacaccagcccccagctggacatgtcctgtccgctgctgcagcagaacaagcaggtggtgagtgtgggctatgctcgggaggaggtgagggtgccacccgcttgggcaggaggacattggtggcctcgcccatggtcccgagcattgcaacggacatagctccacgctgcacttccttcgtctcaacaactggccctgtgaggacgctggtttcatttgtgttttatatgcaggggacacacagcttggagaggtgagagacataccaaagtcacagctactagtggcagtgccaggtgaagatagagtcctcttccacatttgctgcctgcctttgtttggcactcggtagtttaaaaacaacttgttgtcttctgtgccttgagggtgttaaaatggggcttgctgtctatggacagggtatgtagggtcagagtaggcgtgggggctgctgaggagaggtgaccagctacagcatccccatgatgtgggtgacgtggggttgtgtttcaaaagtaagtgttgggagaggaagaaagtcccttgggagtcttgtctaacagcagggatggtaggggaagccacaggtctgctccccttggacttgagacacatccatgccttagtccctagggcattcagagcccaaggtgctgagtgtgtccagggtaagggacatgggacatcctctggccagcatcagcccccagccccttttcagaggaggtgggtgagcagctcctcactccttgagcatgtacttatggagcatgtcctctgtgtcagatacaggtctgagttttggattgcacactaatcaggacaggcaaggaacctgcctcccagagatgacagggagaccaggagatgcacaaataagatggatcagaggtggcaagcgctgcaagggaagtgaaatagggcacgcagcagagtgaggaggaggctgctcaggaggagcggagtggggctctgaggagggcatgtgcgagctcaccgctatctaacgctgtggaactcactccattgattctttgcgagtcctagagcagaccctggctcataggaggagctcagtaactaggagcgaaggatgagtgaaccagcgaatgcactgtgcatgcgccactcctgtcttcacccttgactcttgcagactcgtgggtggagaagccacactgctggagaactggccagggagtagctgaactggagagcaggtcctctctggacaggcagcctgctcagctcagggacagtcaattcaaccccaggctggcccagctttctcattttcaaagaaaaacaaatcatacctatgtgcatcttccctgtccttagcgttgtctgtgagctgagcgggccaccttggggctggattggtcctggtctgtctgttggccaggacctctgctttagcccagtgttgtctctctggacttaaatatgatggctgcagggcttgactctgatttggctttgcacatcatagatgtcgccagaaaataatggacctcaaacacggagtagctgtgtgatccatcagtgctcaggttcctgagccaccagccagccattcaggtgtgactctggcaatttacagcctcattagggaacttttgtttttcttttttttgagacacagtctcgctctgttgcccaggctggagtgcagtggcgcaatctcggctcactgcaacctccacctcccaggttcaagtgattctcctgcctcagcctcctgagtagctgggattacaggcatgcgccaccacacccagctaatttttgtatttttagtagagacagggtttcaccatattggtcaggctggtctcaaactcctgacctcgtgatccgcccacctcggcctcccaaagtgctgggattacaggcgtgagccaccatgcctggccagtcattagggaactttgagaaagatatattcctgcaatgcagcctggatgcaggatcaaggtaattttatactctccaacttcagaggctacccaagatgtgtttgcagattaaattattggtgaggagagacaccagaatggaattgactgatcagaatgacaaggtagagccaggctcagcctgaccctggccctctgagcaggtcctctagcgtgtggctcactcactgtgggtgggcaccagttgcatgggactgattaggggcttgaatggggctgtccccagattgagacaccagagattggccacactgagtcaggggaggtccttgggctctacaatcaggccagctgagttccacccctaaacctgtgtgaccttggacaagtcattcaacatttaacgtccctggacctcagcctccctgtttgtaatatggggcttatgttgttgcctcaaatgggccagttagcttgcacatgtgcttggccagtgtcaatttccttccctggaggagcattggttttccagccaggattgcatctgggggagccatggagcacctaggataggtccctacagcccctgcccaaactcccggcttctatattatgaataatgatgagacctttgcatgcctgctgatggtgctggcctactcagagcagggtgtggattaagaatttgtagcctgcttgaatcaagtgttctcttggggcaagagagctagaaggagttgggaggagccctcatggtgcaggtggggtgttttgtgactgtatcggtcaggcaggcggggcctggccaggctgccatggcaaacaagcccacatcccgtagcttcacatggcacaagctcacctcttgcccatgctgcatgagcctctctagttggctgggagacctgctttgtgtcattgtgatcttcattccaagacatgggctgtggagcagccaccatgttgatcatggcaggtgccactgtggagagaaagggaatgtggcaggtcgggatctggcagtgaagcttccccctagtcccatttcactggccagaacaagtgcctcagtcacttctaaccagaggatgagagaagggtagttcttcctgcaggatccccctctccccgaatggaaaactagccctgtttgtgaatgatgctcatggctgcccactttcctacccgaatgtaggaaggctctaaaatgaccttgcagtccccatatttaaatccctcagttgtgctttgtgtgtcatagctggagaaactgaggctcagggagttcataacttgcctgggcactgagaggtggagctggggctgagtccaagttgtggggtcagagacacttggcctctgctttatggcccagcccacactgcccccatgctatgtggccagagaagggagggatagcccacaggaaagaggcttgattcagctggtttctaaggggagagtccgctcggggagcgagagatcaccccagagtggtgggaatccaggatttggacctgcagcctggcgctcccattgcgaacctccttggatgagctcctttccctgactgggcttgtgcttccttcacgtggggatgaccccttccaccttcctgggacatttaaggattaggcgagtattccactttcaaaggagctgtacaaacccagtagctctgggacatcttaggcgttgaaatctgcattcctgtgaaaccactagtggggccatcctagaggcaccgacatgtgcctgggtgggggatggcaatcatttgggaaggtgagggcagaggggaaggagagcagcctgcccacagtagtaggtcaggatggtggttcccagcttcagcactgttgacgtttgggaccagatagttcctgtggggggctgtcctgtgtatcgtagggtgtttagcagcatcatggacctctcccgagtagatgccagtggcaaccccctgactcatgcgtagggacagccagaaatgcctccagtgttgctgaaggccccctagtggttctcattccactgagagctgtggtctggagccagaggccagcttggacagggccatggggggacctggtgggtggcaatagtgaggattgctttctggcatatcccattccctcaccagcacccccaagagcccacagggcagctgctggcctcagagtgcactgcgtggtcagtgtccaggtccagtcctgggggtgaccacaacatctgacctgtgttccctgcaggtcccagtgtccagccaccgcaacccccggctggacctggctgcttacgaccaggagggccgccggttcgacaacttcagctctctgagcatccagtgggagtccaccaggccagtgttggccagcatcgagcctgagctgcccatgcagctggtgtcccaggacgatgagagtggccaaaagaagctgcacggtgagctgggcacaagcctgatggcccaggcaggagaacagagaccagacaggaagcctgccaaggtgggccagtgcctgtgggagcttagttatctgtgcttagatcctgttaactcttacaatccacatagtttcaacacacacagttgtctgttttcagattcgaaactgcaaatcagaaggagggaggggctgcttcaggggtggtgatgggcagacatccaacggtggcttccttcttcctggtctcaggtttgcaggccattttggttcacgaggcatcaggaaccacagccatcactgccactgccactggctaccaggagtcccacctcagctctgccagaacaaagcagccggtatctcccagggcccagtggtgggtgggctatgggtagcggggcaagcctcctacttctgcttaaattccaccgggtatcacagtgtcctgagtcactgtctgcttgaccaccactcccccaccccagcctcttggaggccccaggagaggcactgctattaatagtaggggaccaataggtacattggaggtgggaatgggaagggcttctcaagaatagcccttcctggatgacagccacctcatggggggtacagccacaaggaaacttaggtcttgaataaggtggaggcagcaggtacaggctggaaggagaaggtgggactgtaactgtattcccatggtccctaaatgccaggatgaggcacttctattgtcctcttgggagcaaactttgaaagaggctggggtcccgtgggggcagcactggggaggctggcctggagggagggggtcactgaaggggcacacctgtgcctatacctgatggctcagtcctcactggcaccaggattcccttgattgggagtgagggggcgtcacggcctcctgcctgatgcctgagcaccctgacatgttatccccatgactttgcacttcctccctgccctgatgtccccccaccccccatagctgagtcactcaggcttcctccccttgcagtctgtgttcccctgagagctgctctcccttgcagacaccttccttgtccttgtcacccacaatgcacaccttcctgtcattgactcactcttgctcttccatccgtgcattggagtcgcctctccctgccggcagttgctgcaccccgagtgcctggcacacctgtggccctgaggaggtgctcaaacacgtgattcctgggggcctcagatctgggtggctcctttgtgtgacacatggtgggaagcagagctcagtgggtcatgtgccaccctaggggatgagggctgtcattgtcctctcctgagccagccttggccacacttccaggggaccctcccccgatgcctggcctggccagcggccacatgctctgaagctgaccctttgctgtgaggtcctgcaaggcagggcgtgtgtgtgagttgcccaccactggggcctggtgggttggggtggcgtcttctaagctggattgctcccaaccctctcctcagtctggagtggaggagccagcaactcattccacctcaggaggctgaagggagacctcaaagggtctgtggccattctgctgggctcaggagcaccaggggcttgtggccaggagcaaggccaggccctagggcttttgggcctgttcttcccgaggggcagcctaatcatgtcctcctggatctaatggccttgcccttgtccttcagcatgaccctctggtgcctctgtcggcctccatagagctcatcctggtggaggacgtgagggtgagcccagaagaggtgaccatctacaaccaccctggcatccaggtacagtccttgccctgccaccttcctgggcaagacccacggggggactcctcgccctcccacatgcggcccaaccctccctgcatctgcctcctgcaggcagagctccgcatcagggaaggctcaggttacttcttcctcaacaccagcaccgcagatgttgtcaaggtggcctaccaggaggccaggggtgtcgccatggtaagcttgggccatcggtccccactgttggttttcattccttatctgggctgttgtgtggttaattgattgatcattttgaaagctagcacttgactcacactcggaatcccagaactttgggaggtcaaggcaggaagatcacttgagcccaggagttcaagaccagcctggacaatatagtgagacccccatctctacaaaaaaaaaaagaaaaatcaaaaattagctgggcatggtagcacaggcctgtggtcccagctacacaggaacctgaggcaggaggattgcttgagccccggaggttgaggggtgcattgagcagtggtcatgctccagcctgggcaacagacctgggtgagaaacccagaccctgtctccaaaaaaaagctggcacttaatcacattagctataattagcaaggtctttagattctctgattcattctacaactttagtcattctcatgaaacctttgtgatttgtattccctgtccacaaactgttagttacctaatggtttcctttcaatcaatcctttaagattaaaatattattccataaggagcactgtaacagccataaagaaaattgcttttaaaagatgtctcacctttctctatttttcctgtgtttctctcttgaccctctccctactcttgcaagcattgactttagctgtgctcatggcatggaagaatttaatgttctgcttttattatgttattttaagtttttatgtttttgcgtgttgctaatgtaagctggcagtccatcttcaagtttgctaatgctttcttttgccagtttaaatctactcttgtgcgcttctagtgaatttttcatttcagctgttatacttttcaatttaagaatttctggccgggtgcggtggctcatgcctgtaatcccagcactttgggaggccgaggcaggctgatcacaaggtcaggagattgagaccatcctggctaacacggtgaaaccctgtctctactaaatatacaaaaaaaaaaaattagccaggcgtagtggcgggcgcctgtattcccagctactcgggaggctgaggcaggagatggcgtgaacccagcgggtggagcttgcagtgagccaagattgcgccactgcactccagcctgggcgacggggcgagactccatctcaaaaaaaaaaaaaaaaaaagaatttctattttttttcctgtaacttttcccctttattgatattcgctgtttgatatgagattgttatcaaatcttcctttactcccttcatcgttgtttggttggaaggctttgcctggtgaatctgatctctggtggccctcacagacagtttctgtcatctgccttttttctggagtacgggtcatgttttcctgttttgttttgttttttgttttgttttgttttgttttgttttgttttgttttgttttttcatgtcctataattgttggaaactggacattttaggtaatgtattgtagaaactctgggtactgattccccatccccatgctggagcttgttattattatttgcttgtttacttctttagtgactggccttgttattttgctgaagacacaaaaacacacgcgcacacacacacaaacacacaggctgtgttattttgctgaacacacacacacacaggctgtgttattttgctgaacacacacgcacccacacacacacacttttccccagtaagaagtctctgatactgctcttaggggataacaccttggtatgtcctttgtcactctgggatgactgtggcctttgcagggctttttttggctgtctttcactgaccactcaactgttgagctgcactaattgaggctgattgctccactgtcttcagtaattccctggggcacacattcctacacaactcagtccaatcctattcaggatcctttgaagggaccctttccctagaagatgtttaaggtttgttctgaccccaggagagctcttcctacctctctctttttccgtttgtctctggcaaacttgccggcctccagtgtagcccacacctcccaggctctccgtcacctcccagttgcctttcagcacaacttgcagtgttttggagagtgtgcttaggcttggacttctccgagctctgttgcgcatgaagtcagttccttcaggagcaactcacacctgttttctgggtgcatttagttgctgtgcaccagctgctttcccaggcaaactctctgagccagagctatggtgctgggcacagtggtgcatctctctctggtgacacctgcacgttaggagctgggtccttggtgagtggggcagcagctccagtgttccttggctggcctctcttagcagggaaccccaccccatgagccagggaagggcagccgggccccagtattctcacgggtgccgcacccaaggcagagcctccatcccacgaatgggttctgggtggaagatgagagcccccacctctgagcccactttcctgggactcagtctcagcaagctgtagctgggggcatggtaagaaaagaaaagctgacatcctgcccctcctaggaaacgaatcacctgaccgagagctgggggtgagggagtcctgtgatcttggaggaaccagtatggagcggagccccgctcactggggtgggaggtcagggaggatgggcatcttatttcacgcaccacaggcccttgttcttcccagatgtcagcaggctttctccaataaatgcttcttcatttgctgttgcccttggaatcatcccagagattttaaacggctgtgtgtatgtttcatggggaagtctgtggcctccttacactgtcctgcagaactggcacctccggctgttttttgatgtgtgggggtgtgggcctgtgaggcaagagcttctgattttcaagagaaaatagagatctctatttttgtgtgaaacaccccctgtttaataagttttttaattcagtttttttgtttggtgtttggggtgttttcgaaaaccttccttcagcgtttgatgttggtctccagctgtcttgcaaagaggatgttttctcagcgccgtgcctcaaggagggggagggagtcccactgttcctgttcttctcagaggcagacccttggatggcaggacgccctcagcagctggggacatgcttgtggttggaggacactggaggaggcgaggagcctgagaccacaagcagcgtctcctaagcattcttatcccctcatagaagaaagaacaattccccagctcttcctccagccatgcgagtgaagagaatcttacatcttaattctgactgcttgacatatgccttgttttgtttatttttggaaattaataaaaacttccccattaccaagaagaggggagttccaagttagggaaaaatgtgtacagtgccagtgaaaccgaggcacactctcattcacatttaccttgcacctgtcattctgtgcaagctctgagggtggacttgtgaccagagggagacctttactccaagaacaagagttcctagaggtcggtgatggactaggctgccgctgtaggtagtgagctccctgtctctggaggcatttgagcagaagctgggacacttgtctgaaagactcaaggtgggattccagcatgggagtcaagtttccccaggagacctttaaacccctcttgaatcctaaaatgctgcaattctaggagtgcctctgcagttctgttttacaggtggccacaggggagctctggcactctctttctgaattgtggaatggccgctggcctggttgagtggcacagagtgcccattgcaggcaggacccgggacgagtctcccctatggcaagcagcagcccgtgccacaggccctgcgaactgctctggtccagaagtttccttccatggaggcgccctgcccactggggtcttcacctcccttcatttcaggcttgtgccaaagactctcgcaactccaatcaggccctggttcctctggtctcttctgaagcctgcaggaggaattttccagggagtattgacgtcagcagcaagtcctggttgcttcagaaacagttgcaggcgactgtttccgagggatgtctactcgtggctgtggctttttccagctgcagagcagcagcacagagatagacaagcccccagcgctccccagttagctcagagaaagggtttctttccttcctgttgatacatattcagcacggaaggatggcttgcgggaatgtgtggctttggagtgtctctggggggctctctggggctcacgcagcaggggtcctgtgggggtttttatccccacacagtggacatggactgtgcagggccgtgatgaattttgctcacacagccccagaacgctctgtaagggcctttattttgttttcggctggtttgcacataggagtgtttatccgatttaagcctaagttttccttcttttcaacgattctttacatttcaatcaagtcctctaggcggaacccatgagatgaccagagcaggggaaggagcctgctgggcactttacatttcccattaactcgtgcactcagagacgctggagtgcttatcgtgtgccaggtgctgtgttaagcactgcggattcaggagggaatgaagccggggggcccagctcctgtgagccgcagctgtgtctctccatctcctgggtcctatgagctgcggctgcttctctccatctcctgggtcctgtgaggcgcagcccgtcatggggccattgttcaggtgaggacatgtgtccaggatgagtggggagtgggtggcaattgcagggcctgaagtcaggtgcatccaccttttccctgagactgatctgtggacagtggtgcacgtccccagtcctcgcccttgggaaggtcacagggctggccgggtccctgtgtgaagtttcatccagcacccaggccagggccccactcagtgcctgtgattttcatgtgagcttaggtccttccctgcttgccttgagggcgggtaatcaggggcacactcgcttggcacttcctggcccatcacgtgacgttgacaagcagcctgcaggaaatggaagccgatgactccagtgacattcaaaaatagctgcaaggtcccttatcccctgcagtcgccacctgtcgggacaaatctgaaatgtgatcagggctccaggaagcggggaccgagatgatgtgggcagagccttggggcctggcaagctccgaggtatttgacagtttcagcccccacatgcacagagctgcctctggctgcactcagcatcttaatgagcaatgacacatttgtcatctctgacttgacagaactttcctcttggctcagtgtttcccaatgttctcaggtggcaccttcaacactcagaaattaaaattcatcctgggcatgggtcaccactacctctttcccctcgcaaacattctcccatgtgtcaatcaggaagcaggtgtgtccagaatgcatggagaagctgtgtggtgtgagctgcatgcacagtgtagttaggagtgggtgcagggtctcactctgccaccagctagcggccaagtgccctccattacccaagcctccagagtggcctggtgggcacgcccttacagcatcgctgtggggtgcatttagctgctgtgcaccagcctgaggggcaggccacgcttcgagggctccagagatggtagctggatgcccatcccctgggaaatcgagtggaagagcaattgatttccccactgccattttatgtctctgtttaaaatgtgcaagatggttcttttaaaggaggaaaaaagagaaaaagcccttccctgcattgccctgtgttgccctgcgtggggctccgcagtcggtgcactatggaatttcttcacattgtgaaggacctgcccactcctgacagcagtaactacagtaggagtttcaggttggagccttaaattgggttctcaaagaaagctgtcattactctctgtaatttttcaatgagttttctttgagagaaatgtaataacctggggtcaatcagccccagcaaaaccagaaacctggtggctcctggaccctgctcctcagcccatacttgacaccaggctcatgtggcaatggctccagtcacaaagctattgttttgtagtgtaagtgtgatgtccactccgggatctttattcatctactgtaagtcattgtgtggaataacccaggcatgctttgtctgtattgatgtacccatcattacacgggtggtgtgtgcagctcgggccagctcgttgatcctccgtgcccccagccagctgtgggcttgggctcttctcagctaggcctttgcttttgtccactctccctcctccccagccccgcagttccgttctggctgcaggaggcctccagccccattctcctgggaagtggagagtcggaggaggagcctaaactgggagttagggtatttggttctatccccagctctgccttttcaaagccatatccctgtcccatcatctgggcctcagttaactcatttgcacattgaagtggttggaccagaatcagcactttccaaataagtgaaggtccatgagggttgcaggtgattttcagaatttccaagtcttaacaaagctggttttactctgtaaagctgagcaggctggagcaccaggttccatgaccttatccagaattactcagagcagcggccctggatcttcatccaatcaagatgtgctcgtaggaggctaggctgtaccagatgctgggctgagtcccgagggcatgtgagtgctagggacagcctggaggggaaggccaagtgcactgtgggtcccatcaacactgatggcacccggcaggaccagcccccagaagaggggagaagaggtgctggaggagctgacgtggatgcaggaagactgttctgaggaaggacgctggacctgggcctggaggatgacttggagccagcaggtggaggctggggaaagagtccaggtctttaaggtgggctgcgaggcccggaggcaggcagcagcaagctgtctgtatgagtgggagagaaggcctgcgtggctggagcgtaagtgtagtgggggagggtgatgtgcatggaatctggagtggaggcaggagccaggccataccaggctttacagggcgtggtaaggctttgagctcattctcagagcactgggcagctgttgaggggttgatgttgggagtgatgtgatcctatttggttgtcacctttgggtcagaaactttatttttattttatttatttttattttttatttttttgtagcttcttgatattgaaactctagctttgcaaaccctgaagtgcttactttaaaacctcttgctccccaccccatgaatatgagaccacaaagagcaagcaacaaagccaggcccagatagaggagtggggcagcctgctggactcgcctcatggcctgtccctacttgcccagctccaggaccacctgactgaaatatgcgcctaagtagtaagacaagctgtatgaattccatcataaacagacatgttacttgtgtgaatgcccatcttctgcagcatgaaagggtgattgtgatgcactttcttaggggagagtcttaaaggtagaatccctaaaagtgggtagagagaaaaggattaaaaggtgggctcttgccttgagcccaggagtttgaggttgtagtgagctgtgatcccgtcactgcactccagccttggggacagagtgagaccctgtctctaaaaataataaataaaataaacaaatgttaaaagggtctctggcagtgaaaaggctggaaaaaactagctctgatttgttcattcactcacaacaccttggcagtcactgcttcacacagagctagggatgtgatgagacacaaagatgagcgagatgcacatagctcacactggggtggccttgcgggtcactcccaggctctgtggttccatcagtctgattgggacttcctgtgcaagctgccgtgggaaagcatctgcctcgttttctgccagcccctgacttgcggtttcacagaagaccccatggggtgcttctctagcaccagggctgcagcagcaggtggccagctcaggatgtggcatcctgggactgcatcctcactctgccctcaagttggtgcacgtcccaaggctgctgactggcccccttggagcagcttccattttcttctctttgtaaaatgtgcaagtggagatcaatgctctgtgagatccagcctggcactaatgtgttatatcccaagcccatctcctggccagcagtggggctcatgacgagaggtgggcagggcactacttggggtgatttcccttgtccactgcttcccagtgctggcctggcgggctctgccactggcatcccatgaggtgataggctggtgctgagggcgaggcactgctcacaaacctgagcagaggggggccctgcagctgcgtaacccaccacccacccctccacctccgccccaaccttgcaggtgcaccctttgctcccgggctcatccaccatcatgatccatgacttgtgcctcgtcttcccggccccagccaaggctgtcgtttacgtgtcggacattcaggagctgtacatccgtgtggttgacaaggtcagtggaagcttcatgacggggcaccctcggctgacctgcaggaactgggagggaggggactgtgggaggaatgttccgcatggcctttgcttttgctcctgtggtctgcatcccttcccctgtgagcttgcggagctgtctcccatctccttcgctccatgtggaggatccagagtcccttcagtaagggacttcttcatcccagatgacatacccatgaggcttggcagtaaatcctgctgtctctaaattagccatgacctgggaattcatgtcttctggctggtgtaggttattaaccaacgaggcacatgccctgctgagcatgtattttcttcccagaatataggttttgggttcactggggtgtcagtggcaaatgagtacaactcacccatgccaagcgccattgcaaaaagagacaagggatagatctcggtttatctttcacactgatacagaatttttattactccagatatctgaggtgactgaagctgggcttccagagggttgcggtcaggttcctcagtggatagaagggctggtaattaaaaggggagtgttcatgtggcttaggctccttaagaagctaatatgctgtacccagcctcacatactccttgtataatctcatttccactgctgtttgctaatcatctgtttcttcgctgtgtatttctgattcttatttcctaaagttcttactgtattatacactgccaggtgtgagctgttcagtcagtgagcatttattgagctcctactggatgctgctgttctaagtggtgtctcatctccctaattagtgtattagttacttaagagtagaatgtggaatttatgcctctaagtatccccaagctccccctcatcgattttcatttgctgactggctgatagtccagaagtcaacctgggtgactctcctgattcccaggtctgtgggttgaggttagtgatgctatctcagaaagtcacggagcaccatagatggtaggattggtcttttggaggctgcccctgaacctctgtccccatgatgcaggtggagattgggaagacagtgaaggcatacgtccgcgtgctggacttgcacaagaagcccttccttgccaaatacttcccctttatggacctgaagctccgagcagcctccccgatcattacattggtgtgagttctcctaggggtcagaggagggcacctcagagacagtgctgaccccagctgcagcctttcccacggggtggtcttggagaagtcccagcccttccctctgtttcagggcccttgatgaagcccttgacaactacaccatcacattcctcatccgcggtgtggccatcggccagaccagtctaactgcaagtgtgaccaataaagctggacagagaatcaactcagccccacaacagattgaagtaagacgagttcttcccacaccatgtgggatcagcccagtgctgggggttgggagtgtctttatagtacagtccaggaagctactgtagagaagccatataaaaatctgtgtcccacaatgtcctctcatcaaaaggcagctgttacgagctctagggatctgggaggcagcaaagttagactggcagaaccagagggagggggccaagtgacttgacctttcctctgtgacttgggggattgtgtggctcagagaaggggtgtgcctggtcacatggcaaggggacacaccaggactattcccagaaagcactgactgggtggaagcttagacagatgctgactcatgtgtagaagaactccttaaccattggtcctgagccttagaacaggcacttcgagggcagtgggcacctgtcacaggggctgcgtgagcagaggtatcataaagggaactcctgaagtaggtgattcctggatgaagggagctttgaggtccccacaccagctcagtgtgtggtatggggctgtctcggggcattaggttatgacaggagccccactgcagccacaggccatggcagttgtggcccaggcattgttttaagtctattcacagcagcggcattaaaccagccctgccagcatccaccctgcatccgggccactcgggggctggtgagcgtcattaatctgtgatccgaagcaggtgggtgccatctgtgtctctagatggaggtgcacctttcttctggtgatgagaaatttgtttctgcccatcaatagcacagctacagagaccgatactcccacacaagtagcaccctggccacctcctgcgtccactcacctactcttgccaggcaggctcttgtaggggtttcaggaggagcaggtgggggcttcacctgctgcaaagagtggcaccaacgtccctggtctcctcccaggctaatccggagggtgtgctagaagagcaacctctgggggtctgggtgctcccatatcggcagggctgtcctgtggggccacccctggctccacaggccaggtggctggggctgtacattgctaatgtgtccccaggcgctgctgacattgctgcttagtgaccacacactgagaaccgctgctctaaggggatggctcaactgcataaaagccatccctccaaggggacggcccagcttttgggttttaacatctagggaaagtgaaacacagtcacaaacagaagaacacaccccagagaaccagggagcctcggccagtggctgggagacagcccccagcattggcccaggaccctgggccctctggtcactgctcagagagaagtgatgtccatgtcccaggttttcctctcatgaaacatgtagtgtgtgagttatgcttggcgccatgggcttggggcacagtagtcctttctctcctgtgtctctcaacaggtctttcccccgttcaggctgatgcccaggaaggtgacactgcttatcggggccacgatgcaggtgagagccaagaggccacgtcctgctccagccccagtgcaggccaccacctggttccaggcacgccgcctctggccctgcgtgcagtgactgggagaagaaggcagaagctgcctgcactggggccctggctctctgagtgggaggtgcgggctgcctggcatgacgggcactgacacgccgctgtttcctccccgctcaggtcacctccgagggcggcccccagcctcagtccaacatccttttctccatcagcaatgagagcgttgcgctggtgagcgctgctgggctggtacagggcctcgccatcgggaacggcactgtgtctgggctcgtgcaggcagtggatgcagagaccggcaaggtggtcatcatctctcaggtaacaggcgtgctattggagactgggcagctgtgcctgggacagaagcctctttactgtgtttgagttctacctctgaggaccacccctctccaagggtgctgcttctgccccctgggtctgcagtcactgcaggggccctggtgcaggacagccctgccaatatgggagcacccagacccccattggttgttcttctccaagctgagtctcccagtccttccagctgctccttatgggacagggtgttcagcaactcccggccccaaagggcccttccagtggaggatgatggcaatcatggtgaaggcagatgctgctctgagcactttgccttcatctccttgaatcctctcaaggctcagggctaaaatcagggcctttgcattctccctgacctccttcgccagcagtgacttgcagaagcatctcggaaggctgctttggggttccactcacagctgcgccagaaacctggtctgtaagaagagccttctgtgatgtgtaatgcaactgtggacagaaacctgtttcagagtcagtcataccattcctcatgagaactaggtcccctggaagcagtccgtgcagtcctgagttcagaacctgtaaacacagcaccccagaagctggcaagtgcaccgccctagagggggtgcagggaaatgcttgttctcagaggctgactgtgatccgtcattgagttcattgatttactccttttcccagtgtgtgtcaattatgaagacaaagagaaagacttggggatgtaaaaacctgtcctggggatggggtagggttcagatgggcttcctggagcgtgacattccagaccacaggagactctgtggttttttttctctaaaaaggagtgcagcctcaggagctggctgatttttctcctgagggcgtaggtaaagggcagctggctagaaattcagcaagaggggcacagggccctgcgtattccttgtctttgtggtctaaccttgctgggcaccctcccttctaggtcccccatctggcaggttggggaggtgctggggaaaggccctggtggtccttggcaggtggaggggctgcaccacgagccctatctgaaaggcatgttctgagcccaggcaggcagaggtttcacctgcggcgccttgtccatgcctggaatgtgattctggtcagatgcttccagttccatctgtccaatccagagcacacaaccagcaccccaaggccgtggggtgggccaggactagcaggaagagactgagcagaaagatgagtgaaaggaggggaatgggtgcttttcaagcacttactgtgtgccaggcattagcccaagtcatgagcctcaagatgggctcagcctgagcacgtcagagagtctaagggttttaatagcctcagttcagcatgactcagcagcactaggaagaagccaggagagttagtctttggccagattaataggagtgtggagttcagaatgaaggaggttataagttctgatcagactctacagggctcctgcattcgtccctgtaccctgctcagtcagagacaggcaggctggatttggggttgggagggcctggagaccttttgcttgagggcagccaggcctaaggaagagcaggcaccagtccccggccccaagtctgcagtgctgacctggaacagctggatcagacagggcagcagcctcaggggactgggttgggacctgcggggccttgggagaggcagtggctggcccatgaggggagagccactcacaaagccaggcctccctcggcagaggagcatggtgctggtcatcctgaggggccttctcgccacagactctgagccgcagcctgcttcccttgaggggtcccttcctgaaacatccctggccagcactgcatccccacacctaagtgccaccctgtttccccaggacctcgtgcaggtggaggtgctgctgctaagggccgtgaggatccgcgcccccatcatgcggatgaggacgggcacccaggtgaggggacctcctgggctctgaatcctggttcccgaagagccactgctgggaccctgtcctcaagttagagtgcttctccacctcctccatctgcctggcccgggtatctagggcctgcttcccacctgtccccacccagggagacaccctccattgctctctggtagccactgatgaaggcctgcttcctgctggcctgtcaccttcccacatctggaatagtaccaggtgcctaacaggagcacagtgactgtggcacttaactcaactccgtgctgtcttggacattaatccatttggtgttcatagcagccctgggaggctggtgtcagaaccatcttcgtgtcgcagatgagcaaatgaacacacagaaagcttaagacccgtgcccagggccacacagctaggaagtggcagcagtgggagtggactgggcagcctggcacaacacctgctgtggccttttgccgtcttgcctccgcctgtgccctcaagccgacacagcaaatagagactaaaggagccagggaccccacccacacgtgccctgtgagcagggaccccagctagattaggagagaggggcccggaggaaccagcactgtggggcagcacgagctgtgctgctgggggacccatggcctcctagagctccagggactccttccggaaatgagtatcttggccatggagaggtgcagcccgctgcaggggagggacagtatggggaaaacagtcccacctctggtttgctcgtttgatatttcatcaaaattcccaaacctgtgccatgctcttctctagttggggaggaattgggttcatctcccactgcttgaaggaggcagcaaagcttctgggggcattcccagtgctgggagctactgctcactgggcctgacttctcccctgcagatgcccatctatgtcaccggcatcaccaaccaccagaaccctttctcctttggcaatgccgtgccaggcctgaccttccactggtctgtcaccaagcgggacgtcctggacctccgagggcggcaccacgaggtaggtaaccaccccctccagagctcacctcccacccctgtcccaggccagcaccccgagtggcagggagggttcctgccacattgtcccacaggaagtccccaccctcacacctagagaggcccgcccactttcttccctctcccgaggctcatcgggactcccttctcccaaatgctaaacacatagacggggtgagtaggtgcctctcccaacagaagcagccgtgtgaggaagtcacaaaagtcctgggaggtcagagtctgcagcttctgaccattttctgagatgatgcctggcagccctcggtttctcctggttcatcccagaggccaaattccccttcccttagcccagcgaggggccctggcttctcctaagatgtcagagctggaaggtgccagggagactactaagtctgtctgtgttaactgaggccagaaacgggaagggacttgcccagggttgcccagcaagccagtggggaaatggtactgggcaccagcccctgtgactctaggcccaagcccaggtgggccttggacacacaggacccaagtggagggtggcttgaaaggtcgctccctgcctgattcagggacagtggggatggaggcctggaaagagaccaaagcccagggataggatttcctaaaggctgcctgaagcttgtctagtgtgggacgaatgccccccgaccccacccagtgggaacagagtcctgtccctggtgcccgggggctcccccagattgctcccatggaacacaaacagtgagacttattagcagatatccccaaacagaatagtctgcagggacacactgcaaaacccagcatcgctctgggtgacctagaagcactgaagtctgagggacatcctgtcatgaaggcccctggcttacgtgggtgggcccagtgttttccaaatgcatctgtgcatgttgtgcgatgcaggcagggcaggacccgggcacccatgctggggaagccgggtctgcacagctctggggttagcagacccaacccaggcaggaaggcagagcccttgagaacaggccagcagctaccaggactggggggctggggggtctggggctactgtccggctctgcctttttgaggacacaggggcctgggccttacccctgaaaacgtgtttgatgtcttcccaggcgtcgatccgactcccgtcacagtacaactttgccatgaacgtgctcggccgggtaaaaggccggaccgggctgagggtggtggtcaaggctgtggaccccacatcggggcagctgtatggcctggccagagaactctcggatgagatccaagtccaggtaggaggcaggtggaaaggccacagggaagggggagaggaagtgccagctgcccaatcttccttcggggccacatgttgcatgggcaggggctgagagacctgagaagctctcagtccgtggggatgacagtggtccatcgcagtggggtaaacatccgggtgtgattggtgctatgggagcccagaggtggggccaagcaaaggcttcacagaggagtaatgtttcaggatgggaggggctggcaaaggcctggaggtgggaactcacttgatgtgtggccaaaagagcaaagaattctgagcttggggctcactgtgtctgagtggctgataatttaatcgtttgtgtttatttaacacacatagagcacccaacagaggctggggcgcccttgcacgtttttcagtattgctgcctccagtcctcaggtgaagcctgcggggcaggggctgcaggggctgccacctgctgatgcccctgaggcggggagggtcaaggtcacagggtaagttgggggtggcctcaagaggcctggggactgtgccctgtctgcatttggaaaacagcctcagagagggaggcgccttgttcagagccaggggtcaggactgcgtctagtggttctcctgcctggggtgcagccctgtgtctgtatccagcctgtccctgctacttataggatgggctgtgggcgagttcctgcccctctgggcccctctgcaaggtggagagttggcaagttggctctgaagagcatttttgtcttcaagggcctcgttctgctcctctgggcctcagtaacccctgggtgctcctaagctgtaaagaaaaacaaaaagtgttccttatatgtcccaagaaaagaaacagtttctagtccccgcctcaagaagaaataaactatgtctaacccaagcacctccctgatcaggggcaaagaagcaaacttttcaagaaagaaacacccacaaaaaaacccccaccgatctgccaacccctcacccctgcctgcacatgcacacacacacgacacacatgcacacacagacacacatacatagagacacatacatacaacacagaggtacacatgcacatccccacactcaccaaatgcatgttctttgttaaaaggaagtaagtcctggagcctatcatggaattaaaggcagggttttgcagcttccaaattctgtaacctcagttgggtcacttggcagctctgtgcctctgtttccctatctgacagcaggtagagtttgagtaaatcagaaactagagaatctggatccagcctacaaacgtgttttatttggctcactcaggcctttgagacagcttgttgtcatgtaaagataggaagattccaggtaaaaatctaagatgcagcatgtcctaaagatatggtgtctgccacagcaaaatcagcaggcaatgagaagcaaccttgactccattagagctgcactctccagtttgccacaggccccgccactccctgttttctccctgacagtgatatcaagtatcagttgccatttaccatggtgctcatgctgttgcttttcttatagttaacaggaaagtgggaaatatcttacaactccccctccatctaaagagagaaaataggaatgcatggtttaaaaaaaaatagaaggaatcctatttatgaatgtatttaccaggcagtaagtgtgtccgagtcagactcagtgaggtggcttccgtgtggatgccggaagggggcatccgagtcagcctcgtctcacctgacgccaaaaccccacccagctcccaaaggctgtttctcaccgtttgggaagtgttgttcctcctgtcacctcatatggagcccacaactctcaagacaggcatggagaggacgttagttgtggaccatgttacacacaaggaaatctaggcttacgtggacagagcacagaggagctgggaggggtggaatcaggccatcttcctctcagagaatcactcgtcagatccgatgatattggccatggcccagggctcaggcccgaggggtgtccacctggtctgatcagaggccagtggagagctcagggcacagctttacctgccagcgagtggttgcccctgagccaggctgggaggccgaggaggcagcagccctgaggggcctgagagaggggacttacacaggtggtggacacatctgaagtcttgcagagaaggggcctggagttcccaggtaagtgctgttgccatgggctcggggagccaccagggccttggagcacttgggcgtcccaggatcagatctgagccgacctcatgaggctgatcatttgccggactgagctcctcaccaggcccctgtgtgtgtctatgtggatcctgcaagaacatggccagagccagccagaggagcctgggaggtggaacgggggttgttctgagatggtggcagtgaggagcaggatgtctctgtgagagaagggagcagttcggtggcaccttgcccaggctcagtcctggcacagttatcctgagcaaaccctggtgctggagttgtgtgtgctgccctccgcgctcacatcctggcaggtaaagttcttcctcactgggcacggagggagaggcctgtgtttccaggctccttgaaggagctcccattagactacacaaacatgagcctgcctgtcttttctcatcatatctttggccatgtgtgtgtgtgtgtgtgagatagggtcttgctctgttgctcagactggagtgcaagcctcagcctcccaagtagctgggactacagttgcacactccatgcctggctaatttttaaaattattttgtagagactgagggtttgctgtgttgccttggctgagctactctacccggccacacctttggcctcttaaaggtcagcccttcacatcatgtcatcagtgacctgacagacgagaaagccgcttttctcctctctggcccctcctcggctcttgctgctaggagagaagcagacatctggcctgaatgtgactccagtgccccatcggaagtgaaacttgccctctcttgcaggtgtttgagaagctgcagctgctcaaccctgaaatagaagcagaacaaatattaatgtcgcccaactcatatataaagctgcagacaaacaggtacgtgactcagctcttgtttccagcaaagttgtgcggctgtgcttgcatccgacacctcatgtgtcaacactgtcaggagccatgggtactttcagggaggttttctcctgctgtgcttggaatgggtgaggcctctgcctgctccttctcttctctgtggtgctcctctgcttcttgaaatcacttctcactgtgggtctctttttcctccttgtagcctagaaacatttttatgcgaggtactaaaattcagtctttaaaagggaaaaaaacaccagcttagaaatgttgtgtttcaagacttgccactcagagtgtagcccatgagccagaagcatcagcatcaccgggaagagaagatgcagctctcaagccccaccccagacctgcccagggagaagctgcaccctagggagatccccaggcgagggggccgcacagtaacgcttgggaaaagctgtttaaagctcttctgcaaacctaattcctacctttgattccaaggggatgcctttcgtaacagtggcttgcatttgaatggcagttgccaagcgggagactccacgggccacaggacacttacatgttgcatgaaacacatacatgttttcattcagccaaaagtaacaaagtgccaggctccatgctgggctccaggaacacagatatgggtgacatagggtgccccggaggagggtagcaggagaaggctattaaaaagcaaggtgtagtattcaaaccagagcccaaagaagggtgctgtccatggggatttaggggaggcatgtcccagatggagatgctcgggctgcagttcttgaaggatgaataagagttccccaggttaagaggaaggggttggtgggggaagaatgtttaggcagaggcaataacatttgctcctagtcatctatagggctgtggaagagacagagatgatggaaactagccgtgggagctggaggcctttgcttcctgggtttctttattatattaataaatatgtaaaagggtaacagatacggcataatttgcttcctacccagtacatagtatcagtagtttgctaacagttttcttagcgggtagtctgtttttatcctgttgacagtccttagaaataggacaagacaggatcattacacaccttttaccaagtaagaagtcaacgccgagagaagaggggacataatgtgcacacagctggtggcaggacatgttgggaccggctttggattctgtcggactcaaagccccatcctccactatgccaggatgccttgcttcagtaaattgagaacaatttgctgcagaaatgatattttacagtagatgtcccatggagctgatgaaagaaactgccctcatagtctctccctccctgctggctgacccacggcaggcactgctctgggaagagtgagacgccacactttgctcggaaccattggatttctgaattacttttccgtgggtgactgatgaagcctcagacaactgacggcacgtggtcctgaggtccgtggggccaagattgggccttttttcctcccaggagcatgaggagccacagactcttagatctcctggcattgtatccaggcccactcccactgctgccatctacaaaaacagctctgttttgttttccaaagggatggtgcagcctctctgagctaccgcgtcctggatggacccgaaaaggttccagttgtgcatgttgatgagaaaggctttctagcatcagggtctatgatcgggacatccaccatcgaagtgattgcacaagagccctttggggccaaccaaaccatcattgttgctgtaaaggtagggttgcattctcctcctttttggagtaatgaaagcaatagcactgaggtaatatgcctctcaggtgtaaaagtgaatacgttcaccttccagctaagaaactgtagacaggcatttagagtaactcaggggcaaaggtcctaggtagataaaaagctacagcatcttctggtcatcagagccgaagatccttgggaaatcattgattccaagaacttcatttcatagatgaggcccagcaaggtccatgattggcgtaaggttacagagctgggactggcaccacagcttcctgactggagtgcgggtgctccacccactgtgcctggccactgatgttatcaccacccatggtggagctcctgttctgggccagcccagtgtctggaacatggtctgttcttaagagcattgaatgttgtgctcagtacctgccatacaagtcgtgacatccagtacgtgacatccactgtggttttgagaatgaggtggcccattttccagacaaggagactgaggctcagagtgagagtgacttgcttaagcttgcatgggggttgagtgatggggtctgtctggtttgggccgtgtccttctgccatatcatggcactgccctctgccgttctgtgttccttacggatgggaccttctccatcagcatccctgggtcaggtcctggggttttgctgaatggaattttctttccatgtctcatcatcaccacttgctgaaccctggatgacagaagacacacactcacttaaatctttagactctgcctgggtcacagacctctttcattaattcacatcattttgtttcaaaatgggtgcctggcagcaaatcccccgctctagtttttggtgagtgaaagtgactgactgctcatcctatttcaacaaatatgtactgagcactagctgtataccagacactgcaccactgaactttgttaaagaaattcagacctttggagcactagcttttgagcgaggatagattttcacctggactcagagaaacaagggctgctgtttatggagctcgggttcttgggctccagaaatccccatttccctccttcccctggtggcctgcagggcatgctgtggcctgcttagcgctgcccctgcgatcgaggaggatttcgtttctttaaatgccccaagagccaggttctctgaagaaactggacatttgcagcccagggggccctcttgcaatgtaaatagtgatctcatttattcaagtcatggattgggacactcctgggtgggttttctcatagagaggccagtctgctgtgttgggaagtaagaaccttgtcactaggttgggacactctggggagtgtggcctttactcctctcaggacccctaagtccagccctgcattgttcctgaggtggatcctgctgggggcaggtgtcccctccttgggaggtgggttttcctggaggccagtccctggcactgaatcctcatcatacctgtatgttgtcccttaggtatcccctgtttcctacctgagggtttccatgagccctgtcctgcacacccagaacaaggaggccctggtggccgtgcctttgggaatgaccgtgaccttcactgtccacttccacgacaactctggagatgtcttccatgctcacagttcggtcctcaactttgccactaacaggtaggatgtgggcaagggtcatttctcctatgaagtcctgtctggtacctggtagagacaactggggataacacagaaagtctgctgctgttgaaggaagatgtgtattacttcagtttccaagagatgtgggcatgctgcaccatgcagggccacgaggaaacaccactgcccttgggggatgtagaccagctcagaggaagacagacaggcatcagcccccaaaggaggaaacagggcatggggcagctccagggagtgctccccgaggcacaggaaattggcccttcagcttcggctgcccacaggtcctgccacagttgtgtttccctgttgctgaatgcattcaaagacaggtgtcaggggtgttgccttatggaaagaactggggtttagagtcaggcctggttctagccccagctctgcccttcgtgggccctgtgagtaggtcaccatccaaaaatctgtttccacacctctcacgttgggcaatatggcctaggttccagggctttccttcagctgagggagtggtcatgaggaccgctggcaaaccatggcactccgtgtgtgcgcacataattgccatccatcagtttagggcatgtcctggaggaaatggagcccagttctcccagccctttggctgcactgcaggtcattctggccttcttgtagcaggagcacctgatagagacctagtcagcactcagggtcagaaggtgtggtggaggcaaggatgcagccatgatccctaacccaaactgtcaccccacgcagtccacacttctgcaccaaagctgccattgccaacattgactgagcacctgccctgtggcaggtgcctccccactgctgacctcatgtaatgcttatgccaggcctgcgtcacggtcacgtgatgatccccatttttcagaggaggaaaggggcagaggctgcttctgcagtcaggttgcatagtaagggcagccttccctttctggcatgtccagttccctggtgggaagagcgtgaggaagcactctggatctctttcccctcggggcctcagcttcctttctgaaatgcaggaatgatgctgctgccactgtttggctgcgagctgcatgtgctttctggcatgacaagtgaggaggtcgagcctgtgccacctgcctgcagtggtccctcatctggggccactgcttggtaacctcgagttggggccacacctgggacctcagtcagttgaatgctttgctcagcagaggacatggattacgtttctccctttgggagttggaagcttctttcccgagactgagagccctcctttctctcctgtgcctagagacgactttgtgcagatcgggaagggccccaccaacaacacctgcgttgtccgcacagtcagcgtgggcctgacactgctccgtgtgtgggacgcagagcacccgggcctctcggacttcatgcccctgcctgtcctacaggccatctccccagagctgtctggggccatggtggtgggggacgtgctctgtctggccactgttctgaccagcctggaaggtaagatagatcctgagcaagggaacctgtggagtcacggacgcttgcaaagctgggtgggggctacctgggcaggggctcggcaccagtcacgggggcctacaggcagacctgcaggatactcaggagcagtgctccaaaactgctgcccggagaccagatccagcctgtgcctgttttctgcaagtaaatttttgttggcactcagctgtgccatgcattatgtatggtcagtggctgttgtcaccctaccactgccagattgtgtggtcatagcagagattgtatgggctgcatagcccaaatgcttatgtccgaccttcacagaaagcatttgccagcccttttctggaacagctctgccaagtcggtgggggggtcccctgcccctgtggggcatcctgtctctgcatagtctcactcagttcctctagccaggagacacacggatctctgctgctgctgaggaactgaattcaccattttagtgaattctgtgggaagtggccgccatagtggacagcacaggctgggagacttaagcaaagaaggacactgggctaaatcaggggcttccaaatttcagccatgcccaggtgacctgtagtacatctgtggaacacgtgtacaattatttacttagcttttattttcaaattgtctccacctttttttttaaccttactaaattcattttaaaaggagatgaaatactacctttaaggaaaaacaaatataatttgccataaatagattatggttgagtcctttaattgtacttattatataatgtgattggcttttaactcagatgtgtatgtggtgaaagctctgagcctcacacctgctgtctgttgctaaaaaggaattgataaggcaacgaagggatggggaggggctgtgctttggggaaggagctacagagggcagggcctggcagcagcaccagaccattcctgggcaggagtcagctaaagcttcatgccaggatggtcaggagattccaggcagggagttgtgggtcagggagagcaggtgctaggggccacagccctgtagagggcgggtgcagcagggtaggagagctgatggctccaggtggctggagtcaggagcatgaccggcactggggcaggcagcgtggctgtctcctgaggctgctgagtgagcccccatgggggtagcggcagccagcgaggaagctggcctgtcatccaggtgagctgggctttgactggagtgtccagctatggaaagggggctgacacctgtgcttcctctccaggcctctcaggaacctggagctcctcggccaacagcatcctccacatcgaccccaagacgggtgtggctgtggcccgggccgtgggatccgtgacggtttactatgaggtcgctgggcacctgaggacctacaaggaggtgggctctaagcagccggaggcacatgtggctcagtggcctgtgaggcgggcctgaccttctgggaggattatgaagacttttccttttagggaaaagccgtctgaggggttgggtctgggagtcatgagtctgggactggccacttgctgactctgacatggggacaagctcccttttttttccaggcttcagtctccccatgttcaagagggtgtgatgaggacaggcagccttgtagggtggattccagctcccatgggcttgggtctggcaaccccggagtgggcacttcctgggagccggtgcttccctgtcacctgcaaggctaagactccctgtgcaagtcaccctttgagtctggaggcgacaaaacctgctgtctcttccattcatctccagttgagaatgaatcagtggggcaagtctggctgagatccaaatgcatctcatttttagaggcagcatgtgctttatggaacctagcagtttaacctaattgtttgcatatttagtgctgcggctctgcagtttgggcgagccagttgcagacagaggcatcctgtgacaatacagctgtgctctcctggaaagagcctctggtcaggggatggggtggcatggacaaaggtgtgtagggttcaagggcagagcctcgggggctggaacagagggtgtgggagaagcatggtctggctttgtgatcagatcagaaaatgcaccagattccaggcagtttggtgcaggttgagggtggggcatctacagctagacggtctaggtcaaatcccagcttggccactgcgaggctatgactgagcaatcattgagtctcgctatgtcccgattttcttgcctgtataatggggatgatagcgttgtgaggatttagtgagttagcacgtcagaagcccctagggtggtgctcagctcatagccagtgctcagcagaaattagctgctgctgctgctgctgttccagggtgaaggggtagaagcttatgccacactcagtggagttttttaaacagtgctatagaccaaggctgtgtttgcagaggttacctggcacctggaggagctcgagagagcagtcgctacagggtaactggccagagactgaggccaggccctcagctgggatcactgggtgtggcagaatctaaaggcaggtttgggagagacgggagggagggaggcacatcagagctccatgagcatccagaagtgaggctggaggggaggaagggcttgggatgaccaggctgctactggtcctttgctgagaggggcacacagaggtaggtaggcctgcagggaggtgaggagcctgggccggggagctagagatgtcacagctctcccaggtgaggcaggaggcacacctgggtgggtgcggcaggagcactgtgaggaaggctggacagggtgggggcctcagcccagaagtggcctctgaagccctgggagtgggtgggagtgcacgggcactccaggagtgcaggcaggagaggggccaggaagccttgggcactctctgagggtggacagggaggaaggggagaggagggccagcgttggggggtcccaggctagagagtgggacacagcctctgtcagtccctggaggtggatggtggtaagccctgagcggaggcaccgtgagtttgacagtgatgcctggtcacctacagctctgcatgggccacatccctgggagctgcaggggcttcaatcgcatccctgctctgaagttcacctactggtagaaatcagatctcctggaggcagggagcgctggtgcctgctgagagagggaggggggccttcagctgcaggaagtggccttgggcctgaagggtggatgaggctgggctctgcagagaagatgggagggtgtcctagccaagggagtgcagggaggtctccagcctggggctgtttgggtgtggccaggtacaggatgggcacagggggaacagctgggaaaatctgggcagactggattctgggtggggtgtggtgctgtactacagagaagtgatcatggctgtccgaacagccaaaatcctcagcccacccagatcgattaatgaattcaggcccgctgctcagcgtccagtcagctgctgggggaagcagcttgttcaatgggagaactgggctgtgaagtctgaccagactgggctcaaaccccctctctgccacattctagcaaggcgtttaggctttgagcctcagtgttgccacctgtgaaacgggtgacactatgtcacagactgcagggtgaggttgtggaaacgcccagcatggaccgggacacaggcggcgctccatgaagcttccttggctccctctctaggtggtggtcagcgtccctcagaggatcatggcccgtcacctccaccccatccagaccagcttccaggaggctacagcctccaaagtgattgttgccgtgggagacagaagctctaacctgagaggtacttaatgaggggcttgggctgtcttcagagtacctgggagcggggaggtggcttcctgtgtcctctggatggagtttatctgcttctcctattcacactcacaccaactccagagagggcatttagcccccactcatccactccttccagcgtttctgaaattggagtcctccaaaagctgagccagtgaaaggaatcttcataatggagcccagctcccagaaggtgcctgttctgcactggaaatgtgacttcagcccgagggcaccctagcaaagaaagccacaatttcccaccgtgaatcccagaaactaatgaattagcaggactcgtcactggttttaatttttgtaatgacctctcccaggtcatgcatagaatgttgaaccccatcccctgcccatgacagccctgaacagcagctgccagaaataagtaagtcaacagggctgttttcttaaaccacctcactggcagagtgaagcaccgcccttctcgtcctgattaacgaggcagctctgttccatcatggcagcctctgctccttcctcagcgcaagtggacagcactgtgccgttgcctaaatgctgctcagatgttagtggagaactagtgccctctgaatgtgcagaagtaaattgccgtttcccctgctgacagggacagaagacaggcattagtgggcctagcccgtctgccgtgcccctggatgcaaggtctggaacaaatgctgaaattctgacttgaagctccctgtgatgccgatggcatcctcttccatatgatatgtccttggctttaccaatcctggctgcatctcaaagctttgagccgccctggggccctgctggaagacatgcaggggcaggtggcatttgcagcccagccagcctgtgcaggcctggtggaatttggtgtggtggccatcgggcctggcccacaccctctcgtctctcccctctctaggcgagtgcacccccacccagagggaagtcatccaggccttgcacccagagaccctcatcagctgccagtcccagttcaagccggccgtctttgatttcccatctcaagatgtgttcaccgtggagccacagtttgacactgctctcggtaattgcgaggatttgaaagtgaaagggacttggagacagtctctgtcttctgggcatcttgcggcttccacgtgcccagctcaccatggccgtctgtccagagggcagagattgtcaggagcccagcctggggattgacgccagggggacttgggaggactgctggtcacagagggtatcctagcttggccaaggcctttataggggattcccaggaggactcctggaggaggtgacttctcacctgggctttggaggatgcataggaatcccctggttagagaagcagggagaagaaatgacatcagtgcacgggcaggagaggggacaagacaatacacccttgtcttcgcaggccagtacttctgctcaatcacaatgcacaggctgacggacaagcagcggaagcacctgagcatgaagaagacagctctggtggtcagtgcctccctctccagcagccacttctccacagagcaggtgggggccgaggtgcccttcagcccaggtctcttcgccgaccaggctgaaatccttttgagcaaccactacaccagttccgagatcagggtctttggtgccccggaggttctggagaacttggaggtgagtggcatctgcatgcctcaggccaggccggagtcaggggcatcaggaaggccctggaggaagagggaatgtggtgtggatgtcctgggccagctctctttaaaatttatttttacaattagaatttttaaattgaagtactcttttctttttccatagcactgttgctgtctctcaggctgcgtgattgtattaattgttctgaccgctgctggtcttccccagctacaagttaagcttgtgggggcagcagtgagaaccccagaaaaggtgccagtgagcgtgtggtgcgtggcatcgcagaattcagtgcaggagcatctgccacagagcagggaggaaagccctaatccctgctgggacaagtcccctctctccaggcctcacttcccccatgactaagtcacggggtgggattggtgggtgaatgatccctcaggcccagagcctggcaggctgggaagagttcgggggtgagagaaccaaggagttcctcggcatttccgcctgctcctcctgccttgctgcagccagcgtgatcgcatgttctgcagaggcagggaatgctcagcatcgctgatgagggaggagggccagcccgctggcggcgtgagcagagctcgggctgctaccttggagagctggtgcttggtgatacttcatgttggtttagcctttttttttttttttgagatggagtcttgctctgtcgcccaggctggagtgcagtggcgcaatctgggctcactgcaagttctacctcccaggttcatgccattctcctacctcagcctcccaagtagctgggactataggtgcctgccaccacacctggctaatttttttttagtagagacggggtttcaccatgttagccaggatggtctcgatctcctgaccttgtgatctgcccactttggcctcccaaagtttttttttttttttttttgagacggagtctcgctctgtcgcccaggttggagtgcagtggcactatcttggctcactgcaatctccacctcccgggttcatgccattctcccacccttgcctcctgagtagctgggactacaggcgcctgccaccacatccggctaattttttgtttttttaatagagacagggtctcaccgtgttagccaggctggtctcgatctcctgacctcatgatctgcccgcctcagcctcccaaagtgttgagattacaggcgtgagcaaccgcgcccagcctggtttagcctttttgtaagcagcagttgattagaattaaatgagcttgaatttgattctgacattcatattgatttgtccttccctcaaaaaacaccctgagtatggacagggcttcccgactctgcagagtacacgccgtccatgagcagtgcccaggtgtcattacctgcccatgagatgtgacctgggcaggggtccccacctgtacccttgggccccaggagggaagcccagcatgtcaggctgaagcgggggtgcttccagagatggccatgcagagcagccctcccgcctcggggtcctgaggccccgctcagtggtccccccactctgcagaatgtgcacccccagctctgatgtctcttccaggtgaaatccgggtccccggccgtgctggcattcgcaaaggagaagtcttttgggtggcccagcttcatcacatacacggtcggcgtcttggaccccgcggctggcagccaagggcctctgtccactaccctgaccttctccagccccgtgaccaaccaagccattgccatcccagtgacagtggcttttgtggtggatcgccgtgggcccggtccttgtgagtcacggaacgacatcatctgggacagaccaggatggggagggacaggcaggagtggtcctggctatcagtagaaacctgaggtgtaagaaatggaggagtcagaaatgcagaatgtccctcaaagtgatcgctgctcattggggccatgatgcaggctttagttgcccagctttcccatctgttctcaacatggcagccacaggggctgtgcccctctgctcagcagcctgcgccaggagaagaagtgccagggtaccaagaacagctgtgggcccgggcctccagcaggtggcctggccctctgagaccaccatccttacatctaagagggacctgtggactgccctgtagacgtacagtagggcaggaacgtgatgggatgccacagtgggcctggtggttttggtaactcatcttcccattgatggcagatggagccagcctcttccagcacttcctggattcctaccaggtcatgttcttcacgctcttcgccctgttggctgggacagcggtcatgatcataggtgaggaggctgcctgtatctctgggtctgttcccctgccccgacctgctctaaccaaccctgtgctcttgcagcctaccacactgtctgcacgccccgggatcttgctgtgcctgcagccctcacgcctcgagccagccctggacacagcccccactgtgagtagcccccctgcaggcacaaccaggcagagctgctgagaaagagaagagccctgggggaggggtcgaggctcctgaaccctaagtctcaacaggcccttgcctgggccaaaggagcctgaggcccagaggacagatgtgggagccaggagggtcggggcagaggggctgccagtcctggttcagcaagagctttccccaggtagagccatgctgggtggaggtatgggcagcaaggagctctgtctaggcaggagtgcatgctaggactggatgcccaattgctgaggctgcctcagaaggctctaagctggggttggacgagctgactcacagatggggattctgggtagttctgatgagaaatttcccagaagaatgggcaaagtcatttatttcaatggtctaactgtctctctggtgaccccgaagccctggtgaccctgcacagctccagggagcacctcactgtgtgaatgtagtttctctctcaaacaatgcagtgcccagcctgtactgctgtacgtgaaggccctttaatgtctcctgattcccatttgagggttctctcccctacacaaagagtcctcgagctcgtgtctgctgacatgggggcccatggaccggcttcaggggggtccctgaatttttttgaaagaagacccagttgtgtgggtagaagcactttcctgggtaaggagagcccacacgcccttgtcttctgcctgacgacttctctacctgcaaagcggcacccaggggaggccacgggtgctcggcctcctcgcggctctgctgccttctgcagctgctctggcagcaggtgcctgccctttctagctgcctctctcagcgtgctcctccctgggttttgggagccacacctggatctctgcaaggtctccggagcactgcagaatcgctgctcccctcggggtctttgttcctgtggcgctcttgcccgaggctgcattgcattcagatgcacggggcctccctgcctcatgccccctggacagatgctgctgtggtcctgaaacttgagacacgttctccccggaaggctctgcgctcctgggtgttagggtggcatcccaggcctctctgtgtgaatgaggccagctcagcaggtgcccgtggacttccctctgctggccggggaggcctcggggcatcactgtgagagtgtcctgggtgaggcaggcgcctgctgaatgctggctgtaactgaagagtgcgccgctttccctggctctgctgctaacatcgtctctcttcccaccctagatttcgctgcctcatcacccacatctcccaatgcattgcctcctgctcgcaaagccagccctccctcagggctgtggagcccagcctatgcctcccactaggccgcgtgaaggttcccggaggatgggtctcagccgagcctcgtgcacccccaagatggaacatccctgctgcattcacactggaacaagcccctccagatgagtgccccggccccaggccagcttcactgccgtctcttcacacagagctgtagtttcggctctgcccattagctcattttatgtaggagttttaaatgtgtgtttttttcctttcaagtcttacaaagctaagactttttggctcattcctttttgcatggttgtctagggtttctggacaatgtgctgttgcatttttattttcctagccttgctaaaatctttcccttctcaagactttgagcagttagaagtgctctttagaagttgtctgtgggtgatgttactgtagtggtctcagggaaaggattgtccagttactttagggggtttttggtggggtttttccccctgtgaaaacttactttgcccctagtctggctgctgctaggacttctgaggagcaatgggacatgagtgtccctgtatctgcgccactgccgcaagggaagcctcaggaaccagcacctggaggccaggatagccaagccctgggtgagcgagaggctggagaacacaggagctcacccagggctgctgcccaaccatgggccactgtgaacagacttcagtcctctgtttttgtttcataagccgttgagacatctgatggacttggcttaggccctgctgggacatcccacgtgtgatccctttcactccatcaggacaccaggactgtccttaggaaaatgtccttgagatggcagcaggagtcatattttctgtgtgtgtgtttcggaaagccgctgtgtcctgcctcagcacaaagacccagtgtcatttgctcctcctgttcctgtgccactccagaacctcagcagatctgagccaccgcctgccagtgtgagaggcggccactttcatggcagctcatcaggcgcagggccccagacagcttcccagcaggccctagagcccggcctgggccaatgatggagggcggccgccagcccagggcctgcccatccagaagggactccccagggcctgggggaggagacccttggaaaagtcctctcttcccagctcctgattctggatctgagattctcagatcacaggcccctgtgctccaggccgaggctgggctaccctcagggagatccagagactcatgcccatggccatccatgcgtggacgctgtgtggagagtccaggatgacgggatcccgcacaagctcccttcagtccttcagggctgggccatgtggttgatttttctaaagctggagaaaggaagaattgtgccttgcatattacttgagcttaaactgacaacctggatgtaaataggagcctttctactggtttatttaataaagttctatgtgatttttt

SEQ ID NO: 37680 - DNA, 344497 bp, Homo sapiens; identical to SEQ ID NO: 36659

SEQ ID NO: 37681 - DNA, 281984 bp, Homo sapiens
aggagcggcggggaggaaacgccgcgcagcgccgggctggggcgggcggcccgggacaccgacaggtaggggccgagcggctccgtgccgggcggggccagggtcgggaactgcagggccggcgcggacccgcgggccgccgctagggctccgcctggacatgggggcccgggcccaccctggggagagcgatgctaggagcctgggggccccgtcgtccggcctcggtctgagcccctcggggtaaccctgggcgtctgctccccccgggccccaagcccgccacctccggggacccctgcgtccgagtccccgcgagctccccaagcacaggctcggggctggctgaacctctgggaaccccgacgtccgtgtcctggggagcccgagcccccgctggaccccggcacactttccggggtcccagcagcctggcgccctggaattggggggtgtcagtccgcgcctgtccgcctgagccttggtctcaatgcaggaccccagtgtgcgagccccccacattacgccgaagagtggggtgtcagttctctagaatgccttagccacctcccttaatcagccacccgaggtcacactctcgcgtggagacatcaggcctaaaacctctctttaccttttgccccccagggtcacgccctggcccagccactcctcctaggtgtgggatgccagacatcaggcctaaaacctctctttaccttttaccccccagggtcacgccctggcccagccactcctcctaggtatgggatcccggcgccgttccctccaggttttacttgggtggtggggtctctgtcccctggagggggctgagggttccgagagctgggggcgggagggttgtgggagcgtcgccttccgggcagtgccgttcctgtggggccaccggtcgcacagccgtccccgccccggttttggagctccctggcgccggcagcgttcagccctggccgcctcggggagggacgcccaggtccggttgccagtccttcctattcccggtctggccgctcctcaggggaggggcctggctcaaggtcatgcccggctgtctgcccgcccgtgggctcagcactgatccctactgtcacccgccccactgggtaggggagcccaggtgggggttagtgccagtgccaggcagctgcctagaagtcctgatggaccggagtgtaaacactttgggactctggccagtctggcggcccttgctgacactgaattccttcagggaatccttgaagtggcctcaagcacggtctagatgcttagcagagcaaataatgggtgctttctggtttgggcctcaatgttactgaccaggttgcctcacaatgctaatcactcatgcttttaaaatctgtgctttgcattcttttccgtttagggcaagtagggtagggcctgaacttgtttacaaactgacagttgtttcccttgatttggagataattggtaattggcactcagagttggcatttagggccgaaattagtggcaataactacaaaaataaagagtactctgaccttggcttcttgctcaaatttgtttggagtccccatagtaagattagtcagtttcacatttggttttcacaaatttactcctttcaagttataatagtggccgggcacggtggctcacgcctgtaatcccagcactttgggaggccaaagtgggcagatcgcttaaggtcaggatttcagaccagcctggccaacatgatgaaaccctgtctctaccaaaaatacaaaacttagccggggatggtggcaggtgcctgtaatcccagctactcaggaggcagaggtaggagaatcgcttgaacccaggagatggcggttgcagtgagccgagatccgagatcccgtcactgcactccagcctgggcgagggagcaacactctgtctccagaaaaaaaagttacaatagagaaatgtttcttttattcagactgttgagcattttttttaaaaaattgttcttataacatcttctttaaacaaatgtagctaataattagttttatgtaactctacccttaaaaaatatctttatattccatttgcagaaaaaaaaatctttggaaagaaattggtcaaatattttaccaaatgctgtttttttctttttgctgtcactgttgaccaataaaagttaatcttctctggaagtacaagatattgttgacaaacaaaagccagtttttccaggagattgaattcattcttgtggaggccttgtgcttcaggtagttgttggatggcagcctctcagttgggataggtgtatcttctggcactaagatgaatcactagaggtggggcagcgtgcttggagaggatcctgaaagtaggctggctccagtgggatgcgtgccatggcaagtctgtagtgcctggcagggtggctgatgactgacatggtggatcagaacaagatttgaggctcacagtttccactgggatcttctagttgagcaatctcagaacccagttaaacttttgtgtctcagtttccctcatgttgactttttgtaatactaaaattagtctttttttttttttttttttttttttggtaatactggtaaacaccagttattataacaggcagtagtacctacaaaatctaaataccgtggctggagccagaggatttctggagtttggggtttgtaataatcgactaagattgttcattgtatcagcgtcatctggtgcccaggtaccagtaatgcagttccaggacatttaagaacagtgataaagcactgtcgcctctctcccatgtatattattttataagtgatcctcatgaacaaatttgagacatttaatttgggcggcctaaatgaggatcattaaagaatgtgaattctccccccacccccaactttattcaggtttgtttcatgagtttctttttctttttttttttgagatggagtctcactctgtcacccaggctggagtgcggtggtgtgatcttggctcactgcaacctctgcctcccgggttcaagggattctcctgcctcagcctcccgagtagctgggattacaggtgcctgccaccatgcctggctaagttttgtatttttggtagagacagggtttcaccatgttggccaggctgggtttggactcctgacctcaggtgatccacctgcctcggcctcccaaagtgctgggactccaggcgtgagccaccacccccggcctctttcatgaatttcattcagacaatctcttacggcattttctgtcttaatctaggataaggtttcttaacattggctctgttgacatttgggttggataattctttgctgtgggagctgtcttgtgtgttgtaggtttagcagcttccgtggtctttattcacaagatgccagtagcagcccctaagtcatgataaaaaatgcctccagagattactaaattatgcccataggagaacctctgatcacggcagtctaatcccaaggtaaatcaacataagcaagcaatggacagttacactgaaaagatagacagctttgaattgtaggtaatttttggtaaatttaagagtgactattccctgaagcagcatcagaatgtaggtgttttggtttggccctccagttactgatggggacatcttacagagcttcttgcctcatcttttaaaacatctgcagccgggcgcagtggctcatgcctgtaatcccagcactttgggtggctgaggcgggtggatcacctgaggtcaggagtttgggacaggctggtcaacatggtgaaaccccatctctactaaaaatacaaaaaatcagctgggtgtggtggtgggcagctgtcatcccagctacttgggaggctgaggcaggagaatcgcttgaacccgggaggcagagattgcagtgagccgagattgtgccactgcaccccagcctgggtgacgagagcgaaactgtctcaaaacaaaaacaaaaacacaaacaaacaaaacccaacaaaacatctgtgctttgcattcatctaccttcaggcaggtagaggaggaaattggcttagaaaatcatcctgtttttatgttgattttcattattttcctttcatagatttttctgtgaccatgaaagagagaaataaagaatgatccatgatttctaaacaccttttcctgaggatatagtcatgttggaaggccttgtagcctgggttctcaatacctatttgggaaaatatgtcaataacctgaacactgaccagctctcagttgcacttctcaaaggtgagtatttctctgggtgagatacagctttataggtggcgtttctatttttgtattttttttgttgtcctgagaatcataaaacctaatgcccagatggctttgtactaaatgtatgtaaaaaggtcccatatcatcctgatgatttttccagagtaacttaagtttatagctatattgttgtagattttaaggaactattaaatattaaaaaacaaaaacaaaataagctacactactggtgactgtgcttagtcccagttaacttttagctttatgaagctttatggaggcagccacaatgtaccgacagtggcattgactttggcttcaaatactgttttgtcacttattagctatgtgaacaatagctcatattgaaattccaagcctcagtttcttagacagagataatatacctccagagggttgctttaaggatcaactggaataacatttaaagcccctagcctgctggcatatagtaagcactcaataaaagttttaaaattgattattgtgaggtgttcaacagaatttctgaggttttgacttgcttagtagtagagtacctgaagcttcagacattttaccctttacaggcctagacttggtaaatgcagtccctgatttggcatgggaattcgaaaactgcattttctccctttccttgttttaatttaaattctctttgctcagctcaaaatggagctttttaacatacgtagggaagagaagaaagtcagtttgccacgtgtgtaaaatcataggaaatgggaaggagacttcaaatacagtgaaacctcacctttgtggatgtgagttttggtaagtggaccagagcaggttagagagaacagtgacacagctgtttgcgtagtctgagaatagagtaccggtggttcacatgttccattaaatgtgttgctttccggccaggcgcggtggctcatgcctgtaatcccagtactttgggaagctaaggcaggcggatcacgaggtcaggagtttgagaccagcctggccaacatggtgaaacctgtctctactaaaaatacaaaaattagctgggtgtggtggcgggtgcctgtaatcccactactcgggaggctgaggcaggagaatcgcttgaaaccagaaggcggaggttgcagtgagccgaggtcacaccactgcactccagcctgggcaacaagagtgaaactccatcgcaaaaaataaaaaataaaaaaaaagtgttgcttttcatgtttttctgaccaaatgattgtggcagcgctaggccatgggcagagccgtcatggtcacgcctccccactctcttcctttcctttcctattctcctggttttcctcttgtcctgaaacgggagctaagtggaaagtgcgagtgagcagtctgtcagggaagaggatgcattcaaagtgcaatagtagtgtcaagttcacctctctggtctcttattgaagttctcagacccactgtgaagctaactacgttgtatgacgtatagataacagggcctagaaagagagctgcagaccacgaccctgctaatcaaagagctggttctgtcaggaatcatgtggcaagagcatttgccaaagaaatgagtaaatagaaatggatatctgatgtgttacagagtcgtactaacatttctcagcagttttagaatgtatcttgtaacaactgtgtttatctggtactttaaactgcttttctgcccttatttcctttctaaaaacattattctttatggcttttaatgaacctgtggaacttgaagaatgcttctccgcagggtagaacaatgctttttcttttgtaactggtgttagtatggtacccaatgcttatggatccaaagcacatcacagagcgtggccagaacaatcttgggggcatggaattgtactgagggaatggcttcgtaaagaagttggtgctgcttgttcgtctctgacacagttaagcagtgtttgggaatagagagggtactagataggaatgagaatgttctttctttttttttgagacagggtttctttctgtcacccaggctggagtgcagtggcgtgatttcacctcaatgccaccttgaccttctgtgctcaagcagtcctcctgcctcagcctcccaagcagctgggaccacaggcatgcaccaccacgcccggctaatttttatatttttttggtagagatggggttttgccatgttgctcaggcagctcttgaactcctgagttcaagtgatcctcccacctgggcctcccaaagtgctgggattacaggcatgttccactgcacccggccgagaatgtcatttcaatccatctactgatatttactgttctagatgctttgggagatgcaaagaggactgaaatagtggtcaagggtattgatttttttagctaaactatgtgtttgaatcccagttcttccatttaccagtaacctgggtaggttatcagtttcttcatgcttcactctccctttttgtaaattggagataatattaactatctcgtaaggttctgaggactaagaaattaatgtgggtcagagagcttagagctgttcttggcatattgtaggctctcagtcaatgttagttatcatccatcctcatgatcatcagtgtatgattggattggctgatggagtggacttcaaagagattgtgtgtgtgtgtatatatatatctgtgtatgtatatatatatgtgtgtatgtgtgtatatatatatatctgtgtgtgtatatatatgtgtgtgtgtatatatatgtagattgcatccacatatgaaaagtaacaaaatgcaaagtaacatgagtgtttaagaatggagatagcatttaaagacaaataaaaaaaatacaaagtaacatgggaggatcacctgaagccaggagttcaagactagcctgggcaatatggtgagatcccttttctacaaaaaaaaaaaaaaaaattagctgggtatggtggcgcatgcctgtggtcccagctacttgggaggctgaggtgggaggatcacttgagctggagaggttgaggttgcattgagttgtgttccctccactgcactctggcctgggcaacagagcaagatgcttttcccccaaaaattttcacttgttcagtcattcaaaaacatttattgaggtcgggtgtggtgcctcacgcctgtaatcctagcacttcgggaggccaaggccagaggatcacctgaggccagaagttcaagactagcctgggcaacatggtgagatcccttctctaaaaaaaaaaataaataaataaaattagctgggtgttgtggtgcacgcctgtggttccagctacttgggaggcccaggtgggaggatcgcttgagcccaggaggtcgaggctgcattgagctatgttcttgtcactgcactgtagcctgggcaacagagcaagaccctgtttcaaaaacaaaaaaagttcattgttcagtcatttaaaaacatttattgaggctgggcatggtggcttacgcctgtaattccagcactttgggaggccaaggcgggcatatcacttgaagccaggagttcgagaccagcctgggcaacatgatgaaaccccgtctgtactaaaaatataaaagttagcgggggtggtggcgtgtgcctgtagtcccagctgcttgggaggctgaggcatgagcatcacttgcagtgtgctgtggaggctgcagtgagctgcgatgtcaccactgtactccaacctgggtgacagtgggaccctgtctcaaaaaaaaaaaaaagaaatatatgtatatatatctcccccccaaaatatatatatataaaataatccccaaaaaatcccccccaaaaaatatatatatatacttgtaatcccccaaaatacatacatatatatgtatacatacaggcatggtggcacatgcctgtagtcctggctactgaggaggctgaggcaggaagatcccttggtcccaagagtttgaggctgcagtgagctgtgattgtgccactgcactgcagccttggcaacagagtgagaccctatctctaaaaaatagtaataataataaaattacaaaaaaattttaaagcaaattgcttgttctctaagcctttttttttcctccacctcaaaaattgagaaactaatattatttatttgtattgttgtgaggattaaatgagataatgtgtatgaagtgcttggacacagtaggaccacactaaatggtagctgctattctttttttttttttttttgagaggaagtctcactctgtcacccaggctagagtgcagtagtaggatcatagctccctgcagcctcgaacttttggcgatcctgaagcgatcctcctgcctcagcctccagggtagctgggactacaggtgcatgctaccatacctgggtgattttttattttttgtagatacagggtttcactatgttgcctaggctggtctgaaactctgggctcaaatgatgctcctgcttggcctcctaaagtgctgggattatgggcatgagccaccatgcccgtcttgttattccacctctatagtccctgatctcagaggactgttaacctgtttgggagacaaattatacggtaatacaaggcagtatagattaaatgattattctggaaatacaggcatcatgcgatggggtgtgaaggaagagagctgtccattttgcctgtaggactctgggaaggttatggaggtagcttttgagtggatctttttttcttttttctttttttggagacagggtcttgctctattgccccaggagtgcaatggcaccatcaaggttcactgcaccctcaacctctctgggctcaagtaatctttccatctcagcctcctgagtagctgggactccaggcatgtaccaccataggtccggctatttgttttattttttgtagagatggggttttaccatgttgccaaggctggtcttgaattcttgggctcaagcaatcctcctgccttggcctcccaaagttctgggattataggcgtgagccactgcgcccagccttaagtggattttagcaggatttccataggtggcactgggcaggtccccacattcgaggtggaatgcaccctgtgagcagaggctgaaaacttgcagggtgtttttgaaatggtttggggccagaaggtagaggctgccagtgccatgtcaaggaatctgaacttcagcctgggggcctatcgtatatttgtaacccaaaacatccatttcccctcctttttgtttttataagctccgaaccttaggttgactctttaaataacctggagcagcgggaagagagttcagtagccattagaaattactgagaaatgacctacctctaaattactcccagtttagtgagtagatttcttgctagcctgagatgaggagtttttggatgagacatccgtgagtaagtctgtaatgtctgcctggagtgagtgacccgcattatcatttataaagcactcagtacattggggtctgtctggagtgagtgacctgcattatcatttataaagcactcagtactttgggtgtttttctgcttggctctttggagggacctttccctgcagggccagtgggtgcatatttgagtgggtggggactaggaaaccttcagtcttaaactacggccatgctgttttgccagattcatttgcttttggcttggtgtaggctgttgtttcttctcattttttcctttacattctctctctcctttctagatctcctcctttgccctcttatgcttcagctttaatttttcgtggtgcgagttgcctgcaattccctttactttcccaaggttgtacagctgccagggaagcccagagctcacctgcctttgtgacagatttgggtattgaaaaataaggtggttcgggctgggtgcggtggctcacgcctgtaattctagcactttgggaggccaaggtgggtggatcacttgaggtcaggagttcaagaccagcctgatcaatatggtgaaaccctgtctctactaaaaatacaaaaattagctgggtgtggtggcgggcacctatagtcccagctactcgggaggctgagactggagaatcgcttgaacccaggaggcggagtttgcagtgagccgagatcgcgccattgccctccagcctgggcgacaaaagcgagattccatctcaaaaaaaaaaaaaaaaaaaaaaaggcagttcgaagcataaatcatgctcttcaaaagaagaaactatttaattgcccccattaagtctgtttcaaccaaggaaaatgtttcatgatttttttttccccttatgttcattttctccccaaatgtggaaatggggttgtttcgctggggttacaaactttttctttctgttagtcgtaaggtatggtggtggggcggggtggggggtggggcatggcccatgtggacaaatgttcctgcaaaaatcaacaaataaattgattgtatttgttcagatccgccaagttgctagatttgaattctttttcttctttttttttccctttttctttttagagatggggtctagctttgtcaccaaggctgggagtgcagttgtgtgagtatagctcactgcagccttgacctcctgggctcaagcgatcctcctgcctcagcctccccagtagctgggactacagatgtgtgctaccatgcctggctaatttttaaaaatttattgtagagttggggtcttgccgtattgcccaggctggtcttgaactcctgggctcaagcgatttcccagcctcagcctcccaaagtgctgggattacaggggtgagctgccgcacctggcctgaattcttctttagaagccagtaacccacaagtcctgaacaatcatttaaagggaaacataatcatgttttttgcattattttgtacttggagtaaaaggctctcttgcatttcttactaattaatggttgttgtctgtactccgtgttcttgaaaatgtatatctcagacagatttaggttgctcaaaaattgccttgtgtctcgcaaacaattttgtaaaaacaatggcagtgatttaaggatggggactctgccttctctttttacattttcagtggccatcacagtgcctcccacagagcagggctctatatatgtgagggtgaatggcttgcatagccgggagagtgatggatctagctgccctcttgtcagttcactttcgggtttaagtcataaaagttgggtctgaaaacaattttcagcggcggtcctgttccttcttttgctttctgatcggttattacacttgtaagtagaggtgctaaggagttccccagaagagaagagtataattccttttgaagaccagtttcatttaattggatcatagacttttgaatactgtttgcactatactcattttggggaggggttgggggtggaaggaacttgttagaaactgcaaatttctgtgcttcaatcccagagattcagaggtagttggtctgcgggtggggcccaggagcctgcatttcatcctaggtgagtcagattttgatgttcctctggtaaatattagcctaagcaaggggtcagcaaagagacccgccggccacatctggcctgcagactaagaatggtttttgcatttttaaaggttgataaaaaaaaaaaggagaatacgcaacagacatcatataaatcctaaaatatttactatctgtcctgttatggaaaatgtaactcttggtctgaactcttcatcagcgcctaagcttcagctctcatgtacgtgttagagcggacggcctggaaattcgtttagatgaagcgtatgggctggtggtagcactacacatgataagcctgttctagatgtaaaactttccctttaacctacacatgatatagcctgttctaggtgtaaaactttaacctacacatgatgtagcccgttctagatgtaaaactttcctttaaccttcacatgacgtagcctattctatatgtaaaactttccctttaaccttcaatgctttacacacagtaggtggcctactgtatttgttaaatggatatttcatgatgctgtttttatttttaggtgctgttgaattagaaaacttgccattaaagaaagatgccttgaaagaattggaattaccatttgaagtcaaagctggtatgtggaactaaaggagggggaagaaatttgagtcttaaattgtttgagaggtgaaaactgagagccctggagtttgtattgatttggccagttagaggaaggatatagcaaatgttagagtttaggccagtcttaaagtgtggtctttgggccactcgtatcaggatgaccttgtgatggtggtggggaggtcaggtgatacccggaccgactgaatcagaatctctgagggaatgtcattgaacctacagtgtttaataagcactccaggtgattcttatgtttactcaagtgtgagaacctctgttctacattcaaggtttccttttctttcccctttccctttttctttttcttttcttttcttttttttttttcagatggagtctcgctctgtcaccgaggctggagtgccgtggtgcgatctcggctcactgcaacctctgcctctcgggttgaagcaattcttctgcctcagcctctagagtagctgggactacaggtgtgcaccaccatgcccggctaatttttttgtatttttagtagagacgaggtttcgccttgttggccaggctggtcttgaactcctgacctcaggtgatctgcctgtctcggcctcccaaagtgctgggattacgggcgtgagccaccatgcctggcctcctttttatttatgtatttatttatttatgacagggtcttgctttgtcacccaggctggagtacagggatgctatcatagctcactacagctttgaacttccaggctaaagagatcctcctgcctcagcttccccagctattagttggaatagttgaatacagctgcgtgccaccaagcttggctaaatttctgaatttattactggattacacggttgatcatttgatgttgtcattaaaaataccattgttggactggacttggtggctttcacctggaatcccagcactttgggaggctgaggcaggaggatcacttgaggccaggagttcaagaccagcctgggcaacactgcttgactcttataaattgaacataaagaaagcttgtattctaggaggcttggctagaaatggaagaacttgggaaataaatatcacaattctaccgagccgtttggctttctcatcagcccaggttctcatgaagcatcagaattctttattgagagaaggccagcaccatttacctatgtttcagtttgtggtgggtatgttcaagattgaatatatcataggtctgatgactccaactagtgcttatcaaccagacaatgactaatgaacaagaaatgagtttagtgtccatgggcttgtgcgggacccggggaagaaagacaccctgagcaagtgtaagatgtactccagttggaaaaggagatagtttctagaggagggatgttactgttgatgtggtaaagtcttcgcgaactttttccagcttatataagtcattataccttattcttacagatgtcagcctcctaacacttgtttcacatgtgcaagagcctgctgcctgttgttttaaataaaaaaaagtagtaacagcaatccatgctccttaaacaaaattgtaaaaataccaaaaaatggaaagaattaaaaatgtgtacagatggtgaacaagactttccttctccttccaggcttcattgggaaagtaacccttcagattcccttttatcgcccccatgtggacccttgggtgatctccatctccagccttcacttaattggagccccagagaaaatacaggatttcaatgatgaaaaggagaagctgttggaaagggaacgtaagaaagcactacttcaagccctggaggagaaatggaaggcaaggcagagatcttctgggccataagagcagttgtggtgacacgtgtaagatgagcaagaacactagattgagctaatgctgactcttgtctttgtagaatgaccgccagcagaaaggggagtcctattggtattcagttaccgcctccgtagttacaaggattgtggagaatattgaagtaagtcctgctgacttttataaaagtatcaacgtgaaagggatttctcaggtttaaacgtgtttctcctcttagtttctcatttctcgtgggctcagctgatctagggtgtagatggggctggctgctcaggtctgcccttttgtaggctgtgccaagaggaaaacctgacaagcaagtcctaggctctgtggcagacacagagttttcttgtttctgctggcatgaggaggagttttcacatctcttccatttcacttcccgcactttctttttgaatgttggaatcccacttgctcaaggatttatggcctaagaatccaggttacttgaccttgatgactgtatggtttcagggtaaatcacttcacctctctggtctcagtttcttcatctgtaaaagagagaggttggatgcctggtctctagttggttacatagtgagttgtgaaattgcgaacagctcactaagatacctaacctcttgctggtgtatctggtggcaatttgacgagttacaggactggggctgttgaccttgcccatgttttctacttcaattatacttttgtttcatcctcaaaaacttgatcagggtcccactaattttcgtgaatgttttaagagtttgtccatacttactacctctagaagtttcttgcagtgccaatgtgacagaggccaaatgtgttcaatgtatgtcatgttcccaaaaattacagtctgaggtttttgatttcgtaactttcctttgacaaacaaatttataaaatattagtcattattttcattttatcttagtttaagtagttttattgagatatagttcttatgccagaaagttcagtcttttaaagtgtacaatttaatgttttttagtatatttacaaggttgtgcgttggtcaccactaaataattccagaacatttttatcatcccaacaggtagtcactgccaaagctgggcttcgtggcatgtacctgtaatcccagctacttgggaggctggggcaagaggatgacttgagccgaggagttgggctgcaaggctgtagtgagctataatagtgcccctgcaccccattctgggcaacagaccaaaaccctgtatcttaaaaaaaaaataataatttaaaaaagtagtcattgccaattcccctctgccttcagcccctgtcaatcactaatctactttctttctagatttgcctattgtagacatttcatctaaatggaatcatgtaatatatagcctggccattttcacttgacataatgttttcaagggtcatctgtgtagtagcatgtgtcagcactttattcctttttatgactgaatcatatattccattgtatggattgtcaaagattaaacaaagctggacctcagagcaatgaaaacagattttactctgtaactactgacagtagaggaaagagctgagctccaggctgacttgtgtggaggtagctgggccttttaaagagagcttgagggtgcagggaggtggagtgagtgggtactcaagtgaaaaattacaaggcgttggtcgctgtgaatgtcattaggctaactgtgtccgctggcagtgatcaaagttaggattctatcctccctcagactgggagattgagccttacccttcctgatgattacatttcaaaggagtggctttcaggtccttaagaaagacactcctgagctgtaggagatacaggtcgagtatcccaaatctgaaaatctgaaatcctccaaagtttgaaactttttgagtgcccacatgatactcaaaggaaatgctcattggagcattttggagtttggatttttggatttgggatactcagccagttaagtataatgcaaatatttcaaaatcccccccaaaaatgaaatccggaacacttcttgtcccaagcctttcagataagggatacgtgacctgtacatatacatctctcagagaaatgtcacagttgaattgctctgcaaacctataaacccttttcagtaaacgtgctataagaaaggaaggtcaggggcctgtgtcaggtgttgtctggaataaagggtacgttcttttgatagtcctgagctttaccaggcaagaactcagtagaggactgtgttgtccccagggacatggcctcgggctgccagaagccatattaaagtttggtcaagtctctttggaatggaatgttcttgctgagagtccttgcgtttctcaggacatacgacattttgtttattcattcatgagttgctggacatttgggttggttctcctttttgctattacgaataatattgctgtaaacatttgtgtatagggttttgggtgaacatgttttcagttgtctcaaatagatatcttggagtagaattgaggaattatggggtaactctgtttactttttgaggaactaccaaactgttttccaaagaggctgcactattttacgatatcaccagcaatgtatgagcattttgtttctccatatcctcatcaacatttattattgattatggggctgggcacgcctgtaatcccagcactttgggaggccaaggcaggcggattgcttgaggtcaggagatcgagaccagcctggtgaaaccccgtctctgctaaaaatacaaaattagctagacatggtggcatgtgcgtgtcgtcccagctacttggtggggaggctgaggcaggaaagtcgcttgaacccgggagacggaggttgcagtgagccaagatcacaccattgcactccagcctgggcgacaaagcgagactccatctcaaaaaaaaaaaaagcctgcagaaatggtgagatagcattctctctaacaccattcaggacagaaagaaaaaaattaaaaaaaacccaaaaaaaacccaaaaaaaacaaaaacaaaaagcaaacatttattattcattgtgtactagtgggtgtgaaatgatgatcttgctatgatttcgatttgcattttcttaatggcgaaggatactgaatatttttccgtgtatttactggccacttgtgtatcttttttttggagaaatgtctatttgaatcctttgccacaattttttttttttttttttgagacggagtctccctctgttgctcaggctggaatgtggtggcgtgatctcggctcactgcaacctccgcctcccggattcaagcgattctcctggctcagcctcacgagtagctgggattacaggcctgcgctatcatgcctggctaagttttgtatttttgtattttttttttttttttgagacagtgttgctctgttgcccaggctggagtgcagtgcagtggcgtgatcccggctcactgcaaactccgcctcccgggttcatgccattctcctgcctcagcctcccaagtagctgagactacaggtgcctgccaccacgccccgctaattttttgtgtttttaatagagacggggtttcaccatgttggccagtctggtctctaactcctgacctcaggtgatccgactgcctcggcctcccaaagtgctgggattacaggcatgatccaccgtgcctggccatcctttgcctattttacaaatcagtttatctttttattgttgagttataagagctctctatatattctgaataccagattcttatcagatttgcaagtactttctcccattctgtggattgtctttttactttctgttattattattattattattattattgttattattaagacataatctcactccgttgcctaggctggagtgcagtggcaccatcataccttactgcagcctccatctcatgggctcaaacaatcctcctgcctcagcctcctgagtagctgagactgcaggctcgtgccaccatacctggctatttaaaaaaaatttttagtagaagtgaggtcttgctatgttgcctaggctggtctctaactcttgggttcaagtaatattcctgcctcagcttcccagagtgctgggattataggcatgaatcactgtgctcaacctgttattattttttaattcattgaagcagagtgcctttcctgtagcccacttacagggaggggctaggggaaatacatatatacatacatagtttatgtgccttgctggtttccttggtccagatgtggggacatagaggcaagatgaagatatcaacagagcaagaggaacaattgtctgtatacaatggctttgctttctttaattgcttttttttaaggtgtcttctgaaatgatttaatgaaagtattggagctcttttggtaaaactaatcacaaagtaacattcaagagagttatgataacataatataacataacataatataacatattataacataacataacaagagagttattataactcccttaggaacttataggacactggatatgtgtgtgttgtgtttgtataaagtgcctggtgtggtttcctttagtggctcaagggcagtttgacccctaactatagtatttcacctacagcagttatctaaatgctttttcttttttcttttctttggaacactattctgcaggtgcatcagctgctttttcttttttctctttgcagttaaaaattcaagatgtccatttacgctttgaagatggtgtcaccaatccctcccatccttttgcttttggcatctgcattaagaatgtgtccatgcaaaatgctgtgaatgagcctgtgagtatgaaatgtgatgacaaagcaggaagaaagccatgctctaggaatctggggctctgccttttgccattttgtgttatgtaaatgaatcacattcttttccattgccttctgtgataggcatgggtgtctcttgtgtatttgcaacaaatcaaatttgctgaaatagggaaacaggtaattttctctgacctttggttatatcactttcattttatacatgaagaaactgaggggcagaaaggattttatttttgatttttttctcgtgttatgtacactccctgggtaaactcactgtgtttcatagttgtagctaccacctgggaatatttgatgatggcttccacatcttgaactccattctccaccctttgaccttcatattcgtggttttcttaaaactactgcttgtctcaaaacacactctgtttcttcacactctacacaaaaaacaacacttttgacaccagacgtgtgaggattttcccccacacgccaagcagttctccacatatcaactcagtgtcctatagttcaagtcaattctgacactaatgggttactgcagaccccgctgggtaagggcttagtcccataggaccgcctcccacttcagatgccagtcacaaggcccaggttgtgaccggtgcttctgactagaagttggagttcccacagttcccctcctcaggtttggtaatttgctaggatggctcacagaactcagggaaacactttacttacatttgctggtttataataaacggtgttatgaggatacaggtgaatatctagataaagagggccacacccccctccagtgttcagcaacctggaagctcagcagatctcatggttcaaagtttttatgcagcttaatctccagccccatcacccagaggtcagtgagtggtgctgaaaggcccaaccctctaattacttgatctttctgtgatgagccccatcttgagcctgtctagggaccccaacaaaagtcacttaattagcatatactggggtgtgatcatgaggctttttatgaacaacaatgacactcctgtcaggaacttccaagggttttaggaattctgtgccaggaaccagggaaaaagaccaaatatatttcatgtatgccacagcttgtcataactagaatgatcctgtgtattccatctgcccattttgtcccctaaatgacgtatttttctttattccctaacgttactgaatgtaaaaaccaacaataacagttttgagcccttttatatggcaggcactgttcttagcactttccatgatttaactcatttaattctccttgattttcaccactgctgttatcctaataaccctactgaggacactacggcacgagaggcggagtgaaaagtggagccaggtcttgaacctgggtggaccagctctaagttagggcttggcacactggccggtggccgagtctggttccccatctgtttttgtaaataaaggtttattagatcccagccatgctcattagtgttgtccacggtggagtagtgtagttgcagcagagactgcatggcctgcagagcctaagctgttgactctgccatgctcattagtgttgtccacggtggagtagtgtagttgcagcagagactgcatggcctgcagagcctaagctgttgactctgccatgctcattagtgttgtccacggtggagtagtgtagttgcagcagagactgcatggcctgcagagcctaagctgttgactctgccatgctcattagtgttgtccacggtggagtagtgtagttgcagcagagactgcatggcctgcagagcctaagctgttgactctgtggccctttatggaagagcgtgccatccctgctcctcaccctgtgctcctgcctgccacactgatctctagaagctgtgtgctcctcctttcacttcttatgcttcagtttccatatctagttattcacagtgtcgtgctactttttctgacaaagcatctcaaacatagctcttcctgtccatcctcatatgaccgtcaccttgcaggatgctgtcaggttttacctggactaatgaaattccctgttctgtgatctccaggatctttccatttgtcctataccaatgctttccagtgttttccatgtcaggacccacacagtaaaaagatagtatttgtacagtacaccggggcaaatggctgtggctgcttggggctggaagcggccagctgagagtaaccacgtttctaagatgtaacttgatcccatacactggctcatacttgagacactcataactttttttttcctggcacactgaagggaaagccctactttacactgtcaccagacttctttttctgaaacatacctgattgtggtatctgcctgcatcaaaacgttcagcagctccgcatcacctaaggcctgaagtccaaacaccttagcatggcataaacttcctttcctaatggatttgataaccagggcagccctaacacattgccacaaaccagatggcttaaagcaacataaatttattctctagacgagaggtctgaagtcaaggggttgtggctgatcagtcccttctggaggctctgagggagaaaccgtcccatgcgtctctccttgtctagtggctgctgacggtcattgagattgctcagcttgcaggtgcttcacgcagcctctgcctccgtcttcatgtggccttctccttgtgtcctttttcttcttgtaaggacaatactcgttagattagggcctccactaaaccagtatgacctcttaatttgattacatctgcaaagacctaattttcgaataaggttacatacacgcttctgtgtggttatgactttgttttgggaagggaagacactattcaacctagtgtatctagtaacattccaagctacttttctcaactcttagctaactcctcatcccaaatatgtattcatccacatgtaccaatactgcccccaccgcacacatccagtgttccagttgtacagacagactcactgttccctgaagatatcaggccttttgtacggtcacccttccatatcctcaggttccatatccatggattccaccaacagaggatcggaaaatactcccccactggctgggtgcagtggctcacgcctgtaatcccagcactttgggaggccgaggcgggcagatcgcctgagttcaggagttcaagaccagtctgggaaacatgatgaaaccccatctctattaaaaataaaaaaattagccaggcatggtggcatatacctgtagtcccagctacttgggaggctgaggcaggagaatcgcttgaacctgggaagtgaaggttgcagtgagctgagatcatgccactgcactccagcctgggtgacagagtgagattctgtctccaaaaaaaaaaaaaaacaagagaagaaaatattccccctccccctaaaaaacaaacaataaaaagaaaaatataacaacaaaaaataatataaaaaaaaattcaggactgggcgtggtggctcatgcctgtaatcccagcactttgggaggccgagacgggtggatcacctgaggtcaggagttcaagaccagcctggccaacatggaaaaaccctgtctctactaaaaatacaaagttagccgggcatggtgatgcatgcctgtaatcccagctattcgggaggctgaggcaggagaatcacttgaacctgggaggtgggggttgcggtgagccgagatcgtgccgttgtactccagcctgggcaacaagatcgaaactccatctcaaaaaaaaaaaaaaaaattctgtataacaatgatttacatagcatttatgttgtattagttattataagtaatctagagatgatttaaagtgtacagggaggatatatgggtaggttatacgcaaatactatgcctttttaagagacttgagcatttgcagatttttgtatctttgaggttcctggaaccaactccctgctgatactgagggaggactgtatggttgacccagccctttcctcctacccgaccatttgcctgaaacttatatatctttcgacactcatttgcacagtgacgttttcttgtttgctcatagcatcgtatagattcttcttctgcttccctctgtgtcattaaaattatgtatttgcctgtttgtatcgccagttagctagattttgaactctgtaagagcagaagcatgttttaattgagttatatgtccacagcaccttgcaaagtacctgacacatgattctttacaaatggtttgttgaatgaatgacattcacgaataaagacagtcatcctattttcttctttgtcttttttacctcaggtacagaaactaatgcggaaaaagcaattagacgtagcagaatttagcatctattgggatgtcgattgcactttactgggggatttgcctcagatggagttacaggtacgatttcggcagggagatttgttgcaagacagcatggaagggaagcggcgtagggtcactgccacgggggcttttgtctcttgcctctctgattccagttcccacccactgttcctctaaagccattcactctcaagtgtgtttgcttgaggtacttgctatgtatgtgacttcgaacaatatatagtgctttgttttatgtatgttttaaatttatactagactatagttttctttggtttattttattcagtgaaagctatgtttttaagatgttgctgtttgtacttccaattcattgctctgaccactgcatagtattccaccgtttgcatgttcacgtaacatacttacacatcgagatgttttccatcatttatttatttatttttgtagagatggggtctcactctgttgtccatgctggtctcaaactcttgtgctcaagcaatcctcctgctttggcctcccaaagtgctgggattataggcatgagcccccacacccggcctaggcatccagattttaaatgaacagagcaccaggactgaatcttaaagaggaactttcttaccacatttatgtttaaacttcacctttggtggcattcccttaagtgatatttaaaaagtcataaatcatcagatatattattgtttgtgaaggattaaaaaaatctcaatcttttttttttttttttttttttttttttgagatggagtctcgctctgtcacccaggctggagtgcagtggcgtaatcttggctcactgagatctttgcctcccagatggaagcaattctcctgcctcagcctcccaaatagctgggtttactggtgcccaccaacatgcccagctaatgtttgtatttttagtagagatggggtttcgccatattggccaggccggctggtctcgaactcctgacctcaagtgatccacccgccttggcctccgaaagtgctgggattacaggtgtgagctaccacacccggccagtttaatccttctgtaaataatttgtaggtggtttaagtgaaacgggggaaaataactcatttttttcctccacccagggttatctttcacttggatactattgtacatgatggctttcttctttttttttttttgagacggcatctcgctcggttgcccgggctggagtgcagtggcacgatcttggctcactgcaacctccacctcccgggttcaagtgattctcctgcctcagcctcctgagtagctgggattacaggtgcatgccaccacgcccagctaatttttgtatttttagtagagacgaggtttcgccatgttggccaggctggtcttgaactcctgacctcaggtgatacacctgcctcggcttcacaaagtgctgggattacaggcgtgagtcaccatgcccggcaggtttttgttttaattcgattacataaacctgtatccatacagtaaaacaatatgcagctataaataataaaggtaaagatctttatgatgagtatgtaacagtctctaacatatagtatgaagttaaacaaactaaggtaaaaacagcatatatagcatttatttaagaaaacagaaaattacaggtttatctgcatatgtacagaatggcttgggtgggagacataagaagctgatgtcgttggttgcctctgaggaggtaagtgggtggctgggggatgagactaggaaagagatatttgaccttttttttttcctttaaaattttaaacgatgtgagtgtattacctattaagaaatataaaggttgggcgtggtggctcacgcctgtaatcccagcacttgggagactgaggtgggcggatcacaaggtcaggagatcgagaccatcctggccaacatggtgaaaccccatctgtactaaaaataaaaaaattagctgggcatgggggtgcatgcctataatcccagctactcgagaggcagaagtaggaaaattgcttaaaccggggagtcggaggttgcagtgagccgagattgcatcactgcactccagcctggcaacagagcaagactcgtctcaaaaaaaaaaaaaaagaaagaaaaaagaaatataaataataataaattaaaaatactagagagttttataacccagttttatagtgtttttggattttgatataatacactattgattagataacataccaacatgtaacttgatcctaaaaacatttgctgttggccaggcacagtgactcatgcctgtaatctcagcactttgggaggtgggaggatcacttgagccttggggttcaagaccagacagggcaatatagtgagatcctgtccctatataaaaagaataaaaatgaataaaaacaaaacagacaaaaatatttgccgctgtgacacagcctatggctgagctccactgtttgtcataaaaccccaacattgtaaaagagtgactaccagaaggaaagccattcggagcagagcaggtgttcttgtgacacacaggaggccatggccaggagcatggagagtcgcagccatcactacgtcctggagcctgtgtttgcatctgctcttttgaagagaaactgctccaagaagcccctgcggtctcggcacagtccccgtattgattgtgatattcagctggagaccattcccttgaaactctctcaggtatgccctttcttctcagtggcatctacttactgtcaaactggtgactgcagtgaaagtcttgatattaacgtatcctcagcaggaaagaaagttcatgtgagaccatttccctccagactaaagttgtgttaggtataaaactcaccgtctgttacatagttaaattgggttgatctcaggttagttttttttttttttttttttaattagttggtggtatggattggaaaggaggctagttttgttttggtatttttaagagctgaacaaaaaatacaagagatacggcaatgtataggcttaactgtcagggttcagagaaacatgtcacttgatgctgatattttggtctttcagtttgcactgggtttcaattcagtggatcaactaatgtgaattgttcttgttagatataggtcttaactgagtaaaagaaacaaacctattctaacctagtatctcttaacctctaatacaaagctgcaataccggcaaatcatggaattcctcaaggagctggaacgaaaggagaggcaggtgaagttccgaaggtggaaacccaaggtggcgatatctaagaagtaagggcttctcagtgtggtcatgaaattcatgttagagcctgttcttgctatgtacatagatcagaaatatgcctcactgtcctttacccatgtttggagataaaagtacagttgatttttctggtccttggaatgccattcccattgtttatcatcattgatattctttctgtatatttatttggtgtcattggcttactcttagactgagtgtagtaaaattcagaggatcctctcagtctcatttagcaagtagactgatgttgctctggtgggatctggtgtgtattataaatactttaaatattctttgaacctacttccctgtgttttttctcccaggttgtttggtcaacatttacatagtactctttgcagcctccatagcaaaactaaatcctgttttcatgttgcagtgataaacttgaccagtctgatataataaagctttttaaagatcctatgtatttccatgtctttagttagaagtattcacttaaaaatctttagtagtcaaatcctcggtaattatcttaagatggtatttaccttacagtcagccttcgatattctgtcagtagaggggagggatattataattcaaaccaattgagaactgtgttattgatatataaattggggatctattatttgatgttctttggcagatttgccttctccacctagtggtttaatattaagacgaacttaatatataaactggtggctgacaagagaaaagatgtctcaggagaggagtggggttatgtggattgtcctggattggtagccttttcgttgcttttgttgtaagaagtgattacatcgttatggactatttcagctgccgagaatggtggtattttgctttgaatgctaacttgtatgagatcagagagcagaggaaacgttgcacctgggactttatgttgcaccgcgctcgtgatgctgtatcttacactgacaaatatttcaacaagttaaaaggaggcctgctgtccacagatgacaaggtaagtggactgtggtcttgtgtttcttgtcttattcagaagataagaatgttctctcaaagactaaagaaaatgggatctgtgaagtaataaagtcccatgccaaaggggctaaattttataggatagagttggtcttagtagagtgagaactaagccaggagcatcctccaccttctgctgcccgaggagagccgggccatggggtaggaggaagaaaagacaccgtggtcctgctatgcctttgcgcccacacccctgccccccagctcaagagactgtttcatacagtcacccgcctctcttcaaagcctgatcccagtcctaattctcttacttcaaagtctgtaatctctgtgaactttggcctacgttttctataatcccagtggacttgattgaccttggatatttaggttgtagaggctaggcagaaaagggtgaagtacgtggtgaaggcaagctcatgttttagttaatagtagggctaaaggcccttagaatgccccctcctggagccctggcatgggaccccaccccttctctagctgtctgcctgctctcttttgggggaaggtattggggattgctttgcttcttgttttatttcagttttgtgagcatcaatttttgcagtagcagcttagactgtgtctgagattttggctcaggtactgccccttaactaaccacttgtttagtagactcttctaagcacaaaggaatacttttcccttcagcacctgctgtgtggtcagtgagggcaatgctgaagccctagtggttagtgcctctcctgccggcaccctgaggctgtggcccattcactttgctaatgcttttatcatcagtgtcagacatggttactgacacaggaaccttatgagaaggataaaataaaccagacattttggatgattttcttttcttttcttcttcttcttttttttttttgtgtgacaaggtctggctctattgcctaggctggaatacagtggcatgatcatggtcactgcaacctccgtcaccctgggctcaagccattctcccaactcagccttccaaatagctgggactacaggcccgcatcacaactgtctaattttttaatttttatggagatgagtttcatccttctgcccaggctggtgttgaactcatgagctcaagtgattcacctgcctcagccttcaccacccccagcctactctttttattttttttttttttgagacaggatctccttctgtcatccacgctggagtgcagtggtgcaatcttggctcactgcaacctctgcctccttggttcaagggatcctcccacctcagcctcctgagtagctgcacgtcaccatgcctggctaatttttgtatcatttatagagacagggtttcgctgtgttgcccaggctgatctggaactcctgggctcaagcaatttgcccgctttggcctcccaaagtgctgggattacagacctgagccactgcgcccagcccttggatgattttcttaaaggcacacacaaagacatagaagaagagaaaatcttatttacaactgagatgagcaagtaaagacgtaaaatctcctttgttcttaatgttatggtgtaagaagcagttcaggacagctaattccgcttttaaaaaatgtagctgggtatcatggttctttcctaactagagtgaaacaagtgaaaatgaccacgttcttgctaatctcctacatgaagtataaaagagctagggcctgcacacttcctgtggaaacttggtcctgggtttcaggaagagcgataactaggctgcttactcctcatctgagctaaggcatgtggaagccctttgtaaacggggtcagtgctgtccaaagtgtgggtgctgcaatagtccatatgctttagtgacttttttttttttttttttttttttttttgagatggagtcttgctctgttgcccaggctggagtgcagtggcgccatctccactcactgcaggctccgcctcctgggttcacaccattctcctgcctcagcctcctgagtagctgggactacaggcgcctgccaccacgcctggctaattttttgtatttttagtagagacggggtttcaccatgttagccaggatggtctcaatctcctgacctcgtgatccgcccatctcggcctcccaaagtgctgggattacaggcgtgagccaccgcacctggccacactttagtgactcttaaaactgagtactgctgttcttcgctccctctccattcaccattcatctcaggtgtcatgaaacttgttagtgattttttttttccccttctttcatagagctcaatttctggagaattgttggtgatgtttttaagaccaaataacatctactggattatatggaaaagctacttaagccagaaacagcaatcatggaactatttatcttgtttcttggccttcagtggaaatgcaggggaccagagaggtttctgtgctttacttttagtggcttgtgagggtgtccagtgtctctggatctacaacgtttgtgtttttgtttatttgcttttgttttcacccaaacaggaggaaatgtgtcggattgaagaggaacagagctttgaggaattgaagattttgcgtgaactggttcatgatcgatttcacaaacaggaagaactagcagaggtaagaaatcctctacaagaggatttgttcagacccagcacaccctgagtgctacagttttgatgtgcttgtgctcctgtggggaaacagcagcatatcacagcttgcttttatctttgagtactcatctctgctcctttgtgattgacacagagtctgcgggagcctcagtttgattctccaggagcctgtccgggagccccagaacccggtggaggcagtgggatgctgcagtatctccagtcctggtttcctggatggggtggctggtacgggcagcagaccccagaagggaatgtggttgagggactgtcagcagagcaacaggagcagtggattcctgaagagatcctgggtacggtgggagctggccttcacttgattcaaacaaattcgtctgttatttgtgcaacagcttgtggtatttttcaaatttaacaaaagtagatatttggagaacagtttatgttcatagaggctgagagaagaagtattttgggagatactccatttgtaactctgtgactaaatgtgcgtattaatgcagtttcagaaagagctgagaggcagagcgtgtaaaagaactaaatttgagcaagttcaacaattttaaactctgaagtttgaataccagtctagagcctctcttaaacctgcagtgtccgatatctagccataggcacaaatggctaactaaaatttaattcgaattgaatacaagtaaaaatttagtttcttaattgcactagcacattagccacgtgtgctcccagtgctcagtagccacatgtggttagtggccactgtactggatatcgcagatgcggaccatttcaccatgctgggcagcactgctttataccatcccttatcatgaatcttatcctccctggtttgataataagttgataagatcccttaaaaaacaattagggttgttttacattaggaaatattataaaatagtcacccatgactttggagttctttcttaacaaagggaaaaatagttaaataacatcatcataactgtgatcagtctgcttgctggtgcttttttattcttccacgttttttcttacagtcttttctcccttaccatttaggcactgaggagttttttgaccccactgcagatgcctcgtgtatgaacacgtatacaaagcgagatcatgtctttgccaaactgaatttgcagttgcagcgaggtacagtgactctgttacacaaggagcaaggaactcctcaaatgaatgaaagtgctttcatgcagctcgagttttcaggtacactgcccccaagaaactacctgccactgttgtctctctgtgggccaatgtccaggcgattctcattatttgctgtggggatagtctagaaagtcagtgcgaaaactgtattagctaatgtggaaccattgctcttaggggaaatactgggttaggttcatgtgaacctctggtcataacattcatcaactgatcagtacctaaccttaatttttaaaatgcgtgtctgtatttaaagacatttaatatagatatacagacagtccttgacttaggatagtttgactttggatttttcaactttacaagtggcacaagagttatacacattcagtagaagtcatacttcggattttgaattttgatcttttcctgggctagagataggtagtatgatattctctgaagatgctgggcagcaacagtgagccacagctcccagtcagccatgcggtcatgaggtaagcagctaatagtctacagtggactgtgtggccagatgattttgcctacctttaggctaatgtaagtattctgagcacttttaaggtgggctaggccaagctgtgatgtccagtaggttaggtatatgaaatgcatttttgacttactgtattttctttcttttttttttttttgagacagagtcttgctctgtcgcctaggctgcagtgcagtggcatgatcttggctcactgcaacctctgcctcttgggttcaagcgattttcctgcctcagcctcctgagtagctgtgactacaggcgcgcgccaccatgcccagctaatttttgtatttttagtggagacaaggtatcgctacgttggccaggctggttttgaactcctgacctcaagcaatctgtcctcctcgggttcccaaagtgccaggattacaggcctgagccattgcgctcagctgatttatgatattttcaacttatggtgggtttatcataactccatcctaagtcaaggagcattgtgttattgatttattaacattgaactcatggcctatagcactatacctcatgcctgaatgaagtttctctaatactcatattttttttgtaacgcacatcacagtcttcttgcactcaggaccactaggcagcgttttagcactaggggcttgttttaaacagtgaaaccacaaacaaaaagcacagaagcatgaaaaacatggcgccaaatagaagaccatgggagggatgcttgttcacagtgtgagagctgaaatgaggaggcagagcgttgccatgtttgaactcaggtgggaatgtgcatatcaggtggcttgaatttttttctgctctgtgagtgtctgaatgacagagtgccatgaggattaattttggagttacaaattttagcaagtaaacaaatgtgcaaatatggaatctgtgaataatgaggattgacttgacagtatttgccttctttttgtgactttgaattaaaggtgtataaataaatatgcagatgtttttgtgactttgaattaaaggtgtataaataaatatgcagatgtttggacatctcacaaatatttttatttcggtccataaaacagcagcttatttgagattcctgagtggctgaaggacaaatgattttttttaaaaagccagtttgtttgacttcataatgtagaaaattgagctgtcataaacttagtattaactagcagattacttgaactgaattgaaaaggcactatttaaaattccttctgctaggaaacttctaatggtgtttgtgtgtttagacagctggatagatacaggcacacttgattttattgcactttgccttattgcacttcatagacaccacattttttacaaattgacagtttaaaaatgagcaagtctataggtgccatttttccaacagcatgtgctcactttgtgtctctgtgtcacattttagtaatttgcccagtatttcaaacttttccattattattctgtctcttatggtgatctgtaatcaccaatttgtaatgttattattgtatttgttttggagtgctatgaaccatgcccatagaagatggtaacttagtcaatattgtgtatgttccaactgctccaccgactggccatttccttgtctcttttcctctcctggggcctccctattacctgagacacaatgttgaaattgggctaataaccctacaatggcttctaaatgttcaggtgaaaggaagagtcacatgtctctcactttaaatcaaaagctaaacgtgattaagcttagtgaggaagacgtcgaaagctgagataggccaaaagctaggccacttgtgccaaacagttagccaagttgtgaatgcaaaggaaaagttctggaaggaaattattagtaaaagtgctacttcagcgaacacatgaatgatcagaaagcaaagcagccttactgctgcaatggagaaagtttggtctggatagaagatcaaagcagccacagcctttccttaagccaaagcctaatgcacagcaaggccttaactcatttcagttctgggatggctggaagaggtgaggaaactgcagaagaaaagtttgaagctagcagaggctggttcatgagtttgaaggaaagaagccatctccataacataaaagtgcaaggtgaagcagccagtgctgatggggaagctgcagcaagttatccagaagatccagctaagatccttgctatgctaaatgatagattttcattgtagatgaaaaggccttctattggaagaaaatgccatctaggacttttcatagctagagaggagaagtcaatgcctggcttcaaagcttcaaagaacaggctgactctcttgttaggggccagtgcagctggtgactttaagttgctgatttacctttctgaaaatcccagggcccttaagaattatgctcaatctcctctgcttgtgttctatcaatggagcaacaaagcttggatgatgccagtacatctgtttacagcatggtttacagaagattttaaggccactattgagacctactgctcagaaaaaaagattcctttcaaaatattactgctcgtggataatgcatccagtcactcaagagctctgctgggagaagtataaagaaattagtgttgttttcatgcctgctaacacaacatccattctgcagcccatggatccaggagtaatttcaacattcaagtttgtttgtttctttaattaattgcttaatttattcagagatgagctctcacttttttggccagggtggtctcaaactcctggcctcaaacgatcctcctgcttcagcccccaaagtgctgggattgcaggtgtgagttaccactcccagcctcaacttttattattcaagaaatacattgcataggctgtagctgccataaatagtgattcctctgatggacctaggtaaagtatatagaaaagcttcgggaaaagattcaccattctagatgccatgaagaacatttgtaattcgtggaaggaggtcaaaatatcagcattaacaggagtttggaagaaatcaaccctcttggatgactttgagggattcaagacttaagtggaggaagtaactgcaaatgtggggtaaatagcaagagaactagaattagaagtggaacctgaagatgtgactgaattgctggaatctcatgatcaaacttgaatggataaagagttatttcttacagatgagcaaagaaggtagtttcttgagatggaatctactcctggtgaagatactatgaacactgttgaaatgacaacccaaggctgggcgtggtggctcacgcctgtaatcccagcacttcgggaggccaaggcaggaggatcatttcaggccaggagttcacaaccagcctgggcaacatagcaagaccctatctctactaaaaattaaaaaaaaaattagttggtcatggtgacatgctcctgtagtcctagctacgtggcagactgagaggtaggaggatcccttgagcccaggactttgaagttacagtgagctatgattgcaccactgcactccagcctgggtgacaaagcaagaccttgtctcaaaaaagaaaacaaaataaaaaaggaaatgacaataaagtttttaggatactaaatcaacttagttgctaatggcagggtttgagaggattgactgtggttttgaaagaaattctactgtggttaaatacatgctttatcaaacagcatcacctgctacagagaaatcttctgtgaaaggaagagtcagttgatgtagcaaacttcgttgttgtcttattttaagaaatcaccacagtcaccccaacacttcagcaaccacgccttgatcagtcagcaggcatcatcatgtaggcaaggccttccatcagcaaaaagattacaacttgctgaagattcacaggattgttagcactttctagcaataaaatattttaaaattaaggtatctatattgtagtttcaggcataatgctattgcacactcagtacactactgtatagtgtcaacatcacttttctatgcactgggaaaccaaaacatttgtgtgacttgctttattgtgatcctcactttattgcagtggtctggaaccaaacccgcaatatctccaatatgtgcctgtagatagatagggtttttttgtttgtttgtttaatttcaaggaaaaatagttcatctataataatcttctgtaaaatagaatatctaatattttcaaaaacacattaggctctcataagcattgtatcaactattttatttatcttttatagatgtaaaacttctagcagagtctcttcctcgaagaaattcctcgttgctttcagtccggttgggtggactgtttcttcgagacctggctacagaaggaactatgtttcctcttctagtcttccctaatccagtatgtacaacagttggatagttaatgtatctaaggtgttggtaaattgtagtctgttttaggcaaatgataactgattcattctgacatttgatcatcttgagactgatgggctgggattagaaaagtttcttgaaattgttaaagagcaaatgttggtgacattaatggctatgccttcttgcactcctgtattgtagccaccatggtatattttgctctgatttggaagaaaatgctataagaccactattttctgcatttcaaggtcaatgtttgggtttcctctgtatctgacagtcattttcatgccttctgacccttagttactgacatgaaatctcgtctcgccagggtcccaaaacagaaacatctcaagttttctatatatatgtaatttttaaaatataatatacgttattaacgataagatctttgatcttaagttggcaacaagctgtctaaatggctgagtagttaaccccttattctgtccatagttttgttttggttgggggaacgttatggagagggtgggaaggctgacttaaagtttgaaaagttagacatgtttaattttcatttagcaactgttcattaaatgtgccgagtgcaaagtagcatattgtcagtacaaaggaaaagatgtggtctcactagattggaaaaagggcagaaaacgaaacaattctgcaagtagtcaatctgaggtaaagtgagttttgatttgatggtgctaagggagtgtgttgctgaagggtaagatgggtttgtttagtgaattgtcccctctcacgctgacgtttacgcatttttgtgtgtttgtttaatagcaaaaagaagttggcagagtctcacaatcttttggtctacaaactacatctgcagacagaagtgatcattacccaggtaatttgtcctatgttgtttttttaaaatttttaaattttttaaattaatttttctttgagacagggcctcgctctgtcacccaggctggagtgcagtggtgtgatcttggctcactgcaacctctgcctcccgggttcgagtgattctcatgcccttgccaggattactggtgtgtgccaccatgtctgggtaattttagtatatttagtagagatggggttttgctttgttgtccaggctggtcttgaactcctgagctcaagccacccaccctccttggcctcccaaagtgctgggattacaagtgtgagccaccatgcctgagctttttttttttttttttttttaataatttaaaaattctttttgggggactttccaacaaaaaccagatcagtagtctttgatcagtagtaaaagagggaatgttttctgttttgtgcgcagtggtttgctgtgtacaccagggtttcacttgaagacagcctggtcctctctcagtggagctgcgaacttggggctaactgggcaaccttgcagggtcttcaggtccttggtttccatgatatgggagctaatacaacaggccagtctacacaattcctgtggaaaattaaacagtcaatcctgatgaggctttctattttaaagataggcataaatgtgaactaattgaaaaataatttagaaaatgtctgtttttccagaatccctcacaggtctgttaataaggctatagtttttgccttgttccgtgttcttattcctgttctttcctttagctgcagatccagatggccccgtttttgagatgctgtatgagagaaatccggcgcacagccactttgagaggcggctcaatgtcagcacaaggcccttgaacatcatatacaatccgcaggccattaaaaaagtagcagactttttctacaagggaaaggttcatacctcaggttaacttttttgtttgtttgatcttatgttccttttgaaaaacatctttattgttatttctggtgttctggacaagggttattcagatgctctgatagtgacaaaaaaggcctgcagagtaagtcaatagggttgccctgtcctgttactaaaccagggtagatatttgtggacagtcttttccaagagaaatctatatccttaaatattttctctttgtttgcctccatttagcgtgtattttttcatacttttcatttctgttttttttcccatttttatttcatattgtcattctgaataatggcaccaaagaatagcagctgtactttttgaaagccactacctttgaatcggtacctatcttaaaatattaccaagagtaattgaaaggcaataaaatagtatggggtgggggagttcatcatcttttttaggtttctcaattgcaaaacattcttataaaaatagatgaaagtactacaggcataaagtagtttcatgatattgatttaaccatggctgtatgttcagccagaattgtaactggaaatctgcatcttggaactgaaaagcaatgatctccatactttttatttcactatgacagtggtttccttggctacccaggatattttagaccagtgaactgaggaggaatgttcaagaatttccttctagatgacaggatcagtggtctctttgacctcctttgtgcagcattaaatactgcaaagttgtaaatgtaatcactgatttatttatgcctccgtttgttctccaagaagatttgaaacagtaggtgcagaaaaaatacttttatggacagggagatttataaaacaatagtattttcctaaatgtcccttccccctttattacaatgaatctgttttagtttttggactagttttttagtctcttcatataaacagtagccataaatgccgtgacttcattgctctgtcactgatagaatatagaaggtggccaggcacaatggttcatacctgtaatcctagaactttgagagtcgaggctgggggattgcttgagcccaggagtttgagactagcctgggcaacatagtgagacctcatctctactaaaaataaaaataaaataaaattaatcaggcatggtgctgtgtgcctgtagccccagctactcgggaggctgaggcagaaggattgcttgaggctgggagttcgaggctgcagtgagctatgattacaccactgcactccagcctgggcaacacagcaagaccctgtcttaaaaagaaagaatatagaaaggctgggtgtggtgattcacacctgtaatctcagcactttgggaggctgaggcaggcggatcactagaggtcaggagttcaagaccagcctagccaacatggtgaaaccctatctctactaaaaatacaaaaattagctgggtgtggtggtgtgcacctgtaatcccagctactcgggaggcaggagactcgcttgaacctgggaggcggaggctgcagtgagccaagatcatgccactgcactccagcctaggagacagagcgggactttgtcttaaaaaagaagaagaagagaaaaaaaagaatatagaaggcatttcctttgaaattccattttctctttcagtgctttttaagaattttgaaatatagtagtttggaatctttcagaaaatggcttaagaaattctagtaacttaggtacacttctctcacttgcctcctctccccccatggctgtccattcacttacgcttttttgtctcattcctgttaccctgtattatgccaggtcatactggagtaagaaactgttgttactgatttgtttttttccttgagacagggtcttgctctgtcaccccaggctagagtgcagtggcgtgatcacggctcactgcagcctcagtctcctgggctcaggcatcctcctgccttggcctcccaaagtgctgggattacgagtgtgagccaccatgcccagcctgatttttttttttttaagctttgatggacattcttggtgagaattgatgtagcacttttgttcacccagccgtgtgaaaattctgactctgctgtgtatttccaaccttgcaggttttggttatcagtctgaacttgagctgagagtggctgaagctgcccgaagacaatataacaagctgaagatgcagaccaaggcagaaatccggcaaactcttgatcgtttgctagtgggtgatttcattgtaagtgggcatccataaacactctttggggattggggaaggggcaggaattctttccgtcaagtcactacttactgtagataggcttacttatatcaattatgctgactgagtaaactgaaaatattaaatccttatcagctagcatagaatagaatcttgtgtcttttatagtcagggtttagctaataaaatgaatgactgtgactagattctgtgtctccttgcaccaggatgaggttactttcaagactcatctttgtgctgggtgctatggctcacacctgtaatcccagcactttgggaggctgaggtgggcagatcacttgaggtcaggagttcgagaccagcctggccaacatggtgaaaccccatctctactaaaaatacaagaattagctgggcatggtggtgggtccctgtaatcccagctgctcaggaggcggaggcaggagaatcacttgaacctgggaggcggaggttgcagtgagtcgagattgcaccactgcactccagcctgggcaacagagtgagactgtctcaaaaagaagaagaaaaaaaaaagactcgtgtttgttccattttccagacctgatactttgtgcatgtttcatgtgagagtttctcttttttgcttactgttaccagaagagacaactggaatgatgccccagcttctattctagggtgtgatgattaggtactttgtgatgccaaatggccagctgccatgaggatgccatagatagggagggccaagagacatcttcacagtccagtaggtaggctgggcaaggtggcccatgcctataatcctggcactgggggaagcggaggtgggatgatcgtttgagctcaggagttcgagaccagcctgggcaacatagtgagaccttgtctctacaaaaaataaaaaaattagctgggcctggtagcacatacctgtagtcccagctgttcaggaggctgaggcgggaggattgcttgagcccaggaattggagggtgcagtgagctatgatctgccctctagcctgggtgacagagtgagaccttgtctcaagaaatcaaaatagtccagtaaagcacagtttctcaggtgacatggaggtgcactgctacaatacagcagcaggtggcacagtgagaaaaagtgtggcttcttttggacagtgcagagtaagttataggtgtcagagaagcagaaatgatccaagtaaaatgtggtgtgtagtatgggatggagaattagtcctgttttttgttttggtgtgtgtgtgtgtgtgtgtgtgtgtgtgtgtgtgtgtttctacataaagtatgacaattagtattcttgtaaacaaaagaggtttctttttggtaatgtaaattagcttttgccacatacatacagttgaggctgattttggttggagggaagaacaatgaacaaatcatgaattggtgtgttatttatatttcaaatgtcaaagcttatgtttctcactaagatattttggcatggaagttcatggttaccaatgcccctgaataagtaaaaatgtttagaattctatgtttatttgaattctataatttctataatcctttaaagtattaaaccctgtaaattagaaacaaaatctttcttaagtacagactctcccctatttagttatttgctattttttttctcccctgttcagatacttgtctgtggtaatttctcagatcctcaagcatttacatctacttttgtcttagactttttgctgtaatacattagatcactgagtcactccataatcctagctgcagcttccagaaatgcttgagcaccatggataaagctgttgggtttcggcagttatggttaatgactgttttatttgtacaggaggagagtaaacgatggaccgtgcggctggatatttctgcccctcaggtgatatttcctgatgatttcaaattcaagaatcctgtgttagttgtcgtggatctaggaagaatgcttttgacgaacacccaaggtatagtgtgagtgggaaataatgaaaacctgccttggtagatggatgatctatctatgattatctaagtaaagcttaataaaatgtttatgtaacatttttatatgtaacatttttaaacttcaaggttcatctgtaactttttaaataatgaaataatgaaaacatatcttggtagatcgacctgtctatgattatctaagtaaagcttaataaaatgtttacataacattttaagacctgagggttcacttgttacttttaaaataatagctttattgagataattctaagttttaaatgtatagtgcggttgtttttggtatgtggatagaattgtgcagttctcactgctatttaatatcgggaggacttttgcatcttccccgactgaaactctgtgtgtacccattaaacaccaattccccttctcgctccccatcccctggcaaccactaatctttctgtctctggatttgtctgttctgaacatttcatatgatggaataatgccatatgtggccttttttgtctggctttttcgtttagcatgacattttcaaggttattctgtgttgtaatatataccgatacttccttccttcgtatagccgaataatagtccatcgtgtggctgttccgcgttttgtttatcctttcatttgttcatggccatttgagttgcttccactcttttgctattaggcatattgctgctgtgagcattcatgtacaggtttttgtataaacatatattttctttttcttttaaattttttttcttttttatagacccccatttctgcaatgtagacatatatttttaattctttatttacctagaagtggagttgctgagccatgtggtaactctatgttttaatattttgaggaagtaccaaattgtttttgtttgtttttttgagatggagtctcactctgtcgcccaggctggagtgtggtggcgccatctcaggtcactgcaacctctgcctcccaggttcaagcaattctcctgcctcagcctcctgagtagctggaattacaggtgcccaccactatgcccagctaatttttgtatctttagtagggatggggtttctccacgttggccagtctggtctcaactcctggcctcaggtgatccgcccaccttggcctcccaaagtgctgggattataggcgtgagccaccgcacctggccaattttttgtatttttagtagagacagggtttcgccatgttggccaggctggttttgaactcctaacctcaaagtgatctacctgtcttggcgacccaaagtgctgggattacaggtgtgagccaccacgcccggccaatttttgtatttttagtagagatggggtttcgccatgttggccaggcaggtctcgaactcctaacctcaagcaatctgcctgtcttagtctcccaaagtgctgggattgcaggtgtgagccacgatgcccagccccagtggtgtatttttatagttgtcttggcgcactgctcagctggagaaagaggagctgattgtggactctggggccacacaattgcatattgatcagttaccgctcaccaagcactacctcggcactaggaagactgtgttgaccaagaaagatgagacctctcttctctcagaacattccagtggatgctgggccgtggtggctcatgcctgtaatacccagcactttgggaggctgaggtgggtggattacatgaggtcaggagttcgaggccagcctggccaacatggtgaaaccctgtctctattaaaatacaaaaaattggccaggtgcggtggctcacgcctgtaatcccagcacttagggaggctgaggtgggtggatcacctgaggtcaggagttcgagaccagtctggccaacatggtgaaaccctgtgtctactaaaagtacaaaaattagccagtcatggtagcaggcacatgtaatcccagctgtccgggaggctgaggcaggagaatctcttgaacctgggaggtggaggttgtagtgagccaagatcatgccactgcactccagcctgggtgacagaatgagactccatctcaaaaataaataaaaataaataaataaaaatgtaaaaaatacaaaaaattagccgggcatggtggtacatgcctgtaatcccagctgcttgggaggccgagacagtagaatcgcttaaacctgagaggcagaggttgcagtgaactgagatcgtgccattgcactccagcctgggtgacagagtgagacttcacctgaaataaaagaacattccagtgggggaaacaaatgaacacacagaaaaaggaaaagaaataaaagactctagagagggacgtaagaaagggttggtgaaagcagctcacgcccatggcaaggcaggggagaagtggggaggcagcattgggtcagcaggtggcgctcatgtcagggggcctccagcttttttcgtgtccatacttttttatatttgtgttttgatttccaaatttataggtaaattcacacttagaaaatggtaaacaaagatattatgcttaagagttttcctcagttttcttaaacaaactggggttggttgattctctacctttcataattattacattaagggaaagaggagggaaatagcagacatatatttgaatcttcttttttttatcttcagataactccaggaggaaaagtagggatgggtcagcatctgaagagacccagtttagtgatgatgaatataagacccccctggccacacctcctaacaccccacctcccgagtcaagcagcagcaacggagagaaaacacctcccttttctggagttgagttcagtgaagaacagcttcaagcacatttaatgagcacaaagatgtatgagaggtactcgctgtcatttatggacctccagatcatggttggacgagtgaaagacaattggaagcatgtccaggatattgacgtgggaccaacacatgtggtagagaagttcaacgttcacctacagttagagcgtcgattgatttatacttcagatcccaaatatccaggagccgtgctctcaggcaacttaccagacttaaaaatccacattaatgaagataaaatatctgcactaaagaattgctttgctctcctcaccaccccagaaatgaaaacttctgacactcagattaaagaaaagatttttccccaggaggagcagcggggaagtttgcaagactccgtaatgaatttaacccagagcattgtgttgttggagcagcatacccgcgaggttctggtggagtcgcagctcctcctggcggaatttaaagtgaactgtatgcagcttggtgttgagagcaatggccggtacatttctgtgctcaaggtgtttggtaccaatgctcactttgtgaagaggccttatgatgctgaagtctccctaactgttcatggtttgctcctggtggataccatgcagacatatggtgctgattttgaccttttgatggcttcacataagaacttgagctttgatattccaacgggaagccttcgggatagcagggcccagtctcctgtctctggaccgaatgtggcccacttaactgatggagctacactgaacgaccgatcagctactagtgtttcacttgacaaaattcttaccaaagagcaagagtcccttattaagttggaatatcagtttgtgagttcagagtgcccatcgatgaatttagacagtactcttcaggtgatttccctacaggtgaataatttagatattatcctcaatccagagacgattgtggagctaattggttttcttcaaaaatcctttcccaaggaaaaagatgatttaagtcctcaacctttaatgactgattttgaaagaagcttcagagaacaaggaacttaccagtctacatatgaacaaaacactgaggttgcagtggaaatccataggctgaacttactgcttcttcggacagtgggcatggcaaatagagagaaatatggcagaaaaattgcaactgcaagtataggtggcaccaaagttaatgtctcaatgggtagcacgtttgacatgaatggttctcttggctgtttacagcttatggatttgacacaagataacgttaaaaaccagtatgttgtcagcattgggaattctgtaggctatgaaaatatcatcagtgatattggctactttgaatctgtgtttgtcagaatggaagatgcagccctcactgaagctttgagtttcacgtttgttgagagatctaaacaggagtgttttctcaacctgaagatggcttctttacattataaccactctgctaagtttttgaaggagttgacgttatccatggatgaactggaagaaaattttcgaggtatgctgaaaagcgcagccaccaaagtcaccacagtactagctaccaagactgccgagtatagcgagatggtatcgctctttgaaactccaaggaagactcgggaaccctttatcttagaggaaaatgaaatatatgggtttgacctagcttcgtctcatttggacactgtaaagctaatcttgaacataaacattgaatcaccagttgtttctatccctcggaagccggggagtcctgagttgttggtgggacacttgggacagatattcatccagaattttgtggcgggagatgatgaatccagaagtgaccgtctgcaggtggaaatcaaggacattaaactgtattctttgaattgcacccagttggcaggtagagaagctgttgggtctgaaggaagccggatgttttgcccaccttccgggtctggcagtgccaacagtcaggaggaagctcatttcacacgacatgatttctttgaatctttgcatagaggtcaaggtgaggagcatcagtcttttgttctattttgtttaatgattgaaaacccagctcacggagtcctttgcgtaaaacagcaacaataaaatccttttcttttagaataatcctcagttaatatttaagaaatcaaagagttttaatagaatgccttgtagtaggttggcatgttttcacccttttccatttaatgtcatatttgacaaaacaggaatttacttacttttatttttatttttttggttttttgagacggagttttgctcttgttgcccaggctggagtgcaatgatgcagtctcagctcactgcaacctctacctcccaggttcaagtgattctcctggctcagcctcccaagtagctgggattacttacaggcacccgctaccacgcccggctaatttttgtatttttagtagagacagggtttcaccatgttggccaggctggtctcgaactcgtgacctcaggtgatctgcctgcctcggcctcccaaagtgttgggattacaagtgtgaccagccgcgcccaggcaggaatttatttttttgaagtgttccagcttgaaactgtatgagtgctcatttacagagatgcttcagtggatggatgttgttaaagtattgtttaatttggtcaaatatatctgattttctgttcccaagctgtcgatccttcctagttaaacattttagcccaagatgcctcaaggggttgatgtaaatagtttgtggatattatcttctttaatattctgccatcttcttctataatgggttggtccaaggttctaagaataaaagcttatgtttgtattctggatctgatcagctaaaaccaaacagtccaatctgttggtcttggcacgcagagatcaggtaagtcctagagcacgcctttatttattggtgatgaaattaatgcctttgagaacttacccttctgtggtcatcagatgttaattcactgatttgtttttatacttatcaaaagatagctttctctgcttggataaaagttgtttacttagaacttgtattgtcctagattctgatttaggcctaataagagggatacatctgtatctgaaagctaggtaaggatgaataattcggtttggaaaatgccagcttgggtggctcagagaagcataatgtagtctctggactggaataatgttcaccacatcgtgctttgaagctaccaagtggagcatgtgatgaaaatattgtttctttttttgtgtaaatgtatcttgtacctcagcttgctatgagttttggcctcaggatagctgtcaaggtttgctctcaatcatagaccccgggtgccaggctaacctgccctcctggtctaagtgtaactcatgggctgtattttgtatattctacgtttaatcagcagtaatgaagtaaatattaaggtttatggtctatcatttcatctcttttatgccagcttttcacatcctgaacaacaccaccattcagtttaaactggagaagatccctatagagagagaatctgaattgactttttctcttagcccagatgacctgggaacttctagcatcatgaagattgaaggaaaatttgtcaatccagttcaggtaaattcatgtcagggcagttgaagtcatatgtttatattagtactctataaatatgatatatatttatgtatattacatgttggaaggaatatatattttcaaagatatatcacccatgcataataccattgttgaaaccttgttccaataattgtggaatccttttgtcatggggaatccgtcttgtcagcctttttcatatggaggaggggtgggttatctagaggaagacggcagattcttaattccattgacattcagaaatggggaaatgattgcttacaaagtcagagtctcctttcccaggaggatatcattcttgtcacacttagacatacttaacacagccagtgaaacattgtgatcatctgagctgtggacagatcctttcaacagagaattagtcctgccctctctgaaatgaaatgggccaggatagggatttctttttttatgggcatgcatgtatgtatacaccttttcttttttttccttcaaaagtgtcattttccctgatttcacagggacgagagcaaagagtagtacattataaaacagcagtgacaggcaggctcttaggacggtctgtggtctgtgtctggcacaacagtagttggtctgtgtctggcagctgttctggagtaacccaggagtgctgttgatggagtgggcctgccttttgacatttgtggttcctcccaggggtctctgggacccctgagagaactactccaaagctttcccttctcagactaagcttttgccccatcagtggtagctaccaggacaaatttttcaccttaaatctagcatgtgatgtaaattctattggattatgttgacttacttttttttttttttttttgagacggagtctcaggctacagtgccagtggtgtgatcttggctcattgcaacctctgcctcccagattcaagcagttctgctgcttcagcctcctgggtagctgtgattacaggcattcgccaccacactggctaatttttgtatttttagtagagacggggtttcaccacattggccaggctggtcttgaactccttgcttcaagtgatcctcctgccttggcccccgaaagtgctgggattacaggtgtgtgccaccatgcccggcctatgttgacttatttttatggttaccattgacttaactgttgttttgatgaaaatcttaaaaacgttattgtagataattctttctttaaaaataattaagataattatttgaattctttaataattgattagtaattaatttaataatttaattttttaaaaagttgattatgaaagaatgtaagcctatacaaaagtggaatagtctaatgagctttatgtgcccatcactctgattccacttatgaagattttgccacatttgttttatctattttttttttttttggtgaaatattttaaggtaaatcccagatgtcatgccattatcacccctatgtatttagagtgtatttccaaaaactaggtgcttcttcttacataaccacagtggtatttcatgccttacaaaattaatgagcattctttgatactatctagtcgattttcagatttcagaaatattttggatcatttcaaaaatgtctttgttttgggtttgttggaatcaggatacagacaattggaagcattgcatttgggtgatacattgtgtaggtctctgttcatctagtttccctctcttttttgtccccccatgtcgtattttgttgtggaactaagtcagttgtcctgtggaatgtcccactttctggatttggctgttcgtgtgccacttaatttgttctcccacatatttcctgtaaaatctatagaacaggtttagttctataggtttgactggattcgggtttcttttttggcaggggagttgggaggtagacttcaggtaggtggtgctgtatacttcatattactttatatcaggaggcacataatcaggtcttttttctctcttattgatgttaaagtggataattgtatttaggtggcaagagccttgatttctccattgcaaaattccctgtcagtcattcacataatggtttattccactaatgaacttcgatggcacacattatttaattaggggttacaaaatggtcactttttctaattccatcattatttctgtatctattggttggaattcttctgttaaaaattgcccttcattaaataaaaaacttgcctgaaaattttttttttttttttgagacagggtctcactctgtggcccaggctggagtgcagtggcatgatctcagctcactgtgtcctgcacctcctgggctcaagcggtcctcccacctctgcctcccaagtagctgggactacaggcctgtgccaccacactctgctaattttgtattttttgtagagacaagagtttcaccatgtagcccaagctggtcttgaactcctgggctcacacagtctgcctgcctcggcctctcaaagggctgggattacagacgtgagccactgtgcctggctgaaaatatttttaataagaaattgtaattaaaaatgaagcaaaggagaaaggaaacataactaatcatggatcatcatcatttttatctaaaaagtactaccagtactaaacattggctgttactctaactggtgatgatcagccagttttagaaccatgaaccttgtttctcaatcctgtggtgtatccacgccagacttttgtcaacactcttcagtttctgcattcatttttgtggggtcagaaaaagtgactttgttgattcaggcataatccgcagtacttattgaactcttattgtatgtagattattgtgtagggtgctgagggagggccttgtgaacagaagtgggtcataaagaggtaaggacaaaataaatgaaaagagatagtctttgctatcaggtaacttacagcctcatgtaggaatcatgtggcaactgtagacatttatgggcattacatctacgtgcatttaataataagagtaactgaatttttctcttttcaatacaggtggtgttagcaaagcatgtatatgagcaggttttacaaaccctggacaatctcgtgtacagtgaagatctgaataagtatccagccagtgctacctcctccccttgccctgattctcctctgcctcccctcagtacctgtggagaatcttctgttgaaaggaaggagaatggattgttcagccactccagcctttctaacacctctcagaagtcattgtcagtgaaggaagtcaaatcctttactcagattcaagccaccttttgtatatcagagcttcaggttcagctaagtggagatctgactttgggggcccaaggtcttgtgagcttaaagtttcaggactttgaggtggaattcagtaaagaccatccccagactttatctattcagattgccctgcattctctgctgatggaggacttattggagaagaatccagattctaaatataagaacctgatggtgtctcgaggagcccctaagccatctagtttagcacaaaaagaatacctttctcagtcttgcccctcagtgtccaatgtggaatatcctgatatgcctcggtctctcccttcccacatggaagaagctcctaatgtcttccagttgtatcaaaggcccacctctgcgtcccggaaaaagcaaaaggaagtccaagacaaggactatcccttgaccccacctccttctccaacagtggatgagcccaagatacttgttggaaagagtaaatttgatgattccttagtccacatcaacatattcttggtagataagaaacatccagaattctcttccagttacaatcgagttaaccggagcattgatgttgattttaattgcttggatgtgctgatcacactgcaaacctgggttgtgatattagacttttttggaatcggctccactgcagacaaccacgcaatgaggctgcctcctgagggcattctgcacaacgtgaagttggagccacatgcctccatggagtctggacttcaggatccagtgaacaccaaactggatctcaaggtatcctcagttccctttggctcccttaagctctaaaaatggatttgggcttgttgatttaaatacaagcactttacatttactttggaaaatatctcttgttggcaggggagctatctagtcttctaggtgtttgctacgaaaggtagacatgaatattttgggaaaggttttactgtaaatcccatctggaggcagggaaaataagtggtttaagaatcttacctttcctttgagctctataattcagtggagttactttgcttctctgaaccgtagtttcctcatcttccatcatctaagatgactaaatgaggtgatgtgtggaaggcacctagcaaagtgtgtaatctgtaatagcaactttaaagtgtggcttttgtttctgtctccccattctctcagaacattatttgcttgcattgagggcaacagcgtaactgttaagaatggtctcaaaagttggactccgtgagtttgagtcctggtactttcactgtacccatatagctatgtgacctggggcaaaccacttggcctcttttgcccttaatgttttcatgagtaaactgaggatgttcagtggtgcccccatcatagggttgttgtaaggccctccacacagtgtgtggcacacaataaggatttaatgaatggtagccattattatttttatattacatggattaccatacttataacttgtccttgatactcatactgtaagtattaagaaaaaaaccataaaaaagacagcatttgagtttaaggctattctgctctgtgtgatagaccagtaggatgtgaaagcagttaacctgaatagcccattcgagggcacataggcctgctgtcactagcactcgtccagagccctggaaccccggccgtggctggtaacatttgtgtgcctcaaggatgttctttatccacatgtcttagcatgtgtggacttgcacttcctgctggggagaagtcagggaggagaatcacattttatcctgttgccattttcttatttcccttgctgatagtaggcctcattcctctagaaatggaagacatctcagggtagagatgggaaaggaccagcttacctttcttgttcagtgtctggtgaatgaatgactttgcagtactccgaggcctctggtacttttggtttagcaaggtggatggaacctggagaggcgttagccattcctttgggcttcatgtgtctgtacctggaactttattcttgcagtgtctgtgatgatctgcgtcaggaactctttggtgttgaatatgcagtgctcccagagggctttgccttgattgatgtggctggttctacaagggaataggactggataagtgttcctcaacaatgcattttttaaaataagaatttttgacaaacatttttattgtgaaaaaattcagatacatcacagagaaacagtataatgaacccccatttgcccagtcctataattcatcacatttactttatgccttttcttctttgctgaagtattttattttatgtatttatttatttatttatttatttatttattttttttttttgagacggagtctcgctctgtcgcccaggctggagtgcagtggcgggatcttggctcactgcaacctctgcctcctgggttcaagcaattctcctgcctcagtctcctgagtagctgggattacaggtgcgcgccgccatgcccatctaattttgtagttttagtagagatggagtttaatcatgttggtcaggctggtctcaaactcctgacctcaagtggtctgcctgcctcagtctcccaaagtgctgggattacaggagtgagccactgcgcgttgcctgctgaagtattttaaagcaaattccagatatatcatttcactctacatacgtcagtatttatttctaaaaaaacaatggacataccacaatgcattgtcacgtccaactaacaagaattccttggtattttctaacaccagtccataatcagattctctgattgtctcaaaaatgcccttttattggtggattgtagaggaatgaatggtttaagaaacttcttgtctttctattctgttggtctctataattcagtagaatactgtgcttttgtaagccaaagttttctcatttacaaaataaggagaattaaataaaatgatgcatgaatttctttcttcctttcctttcctttcctttcctttcctttcctttcctttcctttcctttcctttcctttcctctcctctcctctcctctcctctcctctcctcctctcccctcccctcccttcccttcctttcctttccttccctttccttcctttcctttctttccttcttttcgaaggagtcttgctctgttgcccaggctggagtgcaatggcatgatcttggctcactgcagcctctgcctcctgggttcgagctattctcctgcctcagtccctcgagtagctgggactacagatgtgtgccaccacaccctgctaatctttgtgtttttagttgagatggggtttcaccatgttgcccaggctggtctcaaactcctggcctcaagtgatcggcctgccttggcctcccaaagtgctgggattacaggcatgagccactgtgcccagcctgatgcatgaatatttttgaatcaggatccaggtaaggttccatgttacatttgctgtcatgtcttttaaatctcttttaattatagtgtatctgcccccctccaaccccaccgcctattgacttgttacagaaactggattagtgccttgtagagtgtcccacattttaggtttgtctgttttcttgtttgactgtttgacttcttttatcctctattttaacaagtggatgttagctctagagaccccatcagattcagttcagcttggtaagaacatgccagaggggctgctgagtgcttcctgttgcattgaggcaggaggcatacaacgtctgatcatcatctgttagtgacactaagattcgtgggaagagctggttcaagtggtggtggtggtggttggattcctccaaacaaagcatttttagacccagtgtacatgttcttttggtaaaattaaatgactagaggttttcattatttttattttatctttttgagacagggtcttgccctatcacccaggctgtagtgcagtggtgcgatcttggcccactgcaacctctacctcctgggttcaagccattcttgtgcttctgccttccaaatagctggaattacagacacctgccaccatgcccagctagtttttctgtttttagtagagacggggtttcatcatgttggccaggctggtcttgaactcctgacctcaagtgatcatcctgcctctgcctcccaaagtgctgggattacaggtgtgagccactgcatccagctgactagaggtttttaatttccccatgatgatctcgccttgagattccttctgtgcctgggtcagtgtcagaaatcatactgcaagggaactggagttccccccacaaagtcattgctccagctatagtaacccattgctttttctctgtcttcttctgtaaatgattttttttcttcctttccttctattacattccttttttcttttcccatctttttatcctcctgattattcatgcaccagacatttcttgagtacctactttgtggcaggcactgaagacaaaggggtgaaggcatggtccttgctgttaaggagtggagggtgtgaattgaagattaaatctgctctcagtcttttcctcactccttccttctcttccatcagtgttttgtcccctgtgatgttactcaaagcaaaaaaggttgttgggaactgactcaacaaatcctagacatataagatctttttaatagttacaattacaatattgcattatgaaatttatttgttacaaagaatgctacttccaagacaggggattttttcttctatttgtagttgtccctaggaaagaaaatctttgattatggcttttaggtgaagtctcagttggttaatggtgggcttctattaaatatttgttcagaggcagtaaatgggattctaaatcatatttatcattttgttttgaaaaatttatcaaaatgagatttaatggatctgtttgagttactatagaattgtataatattaatgatgaatgccaaaatgagaaaaattatttttataatgtaaagcatctcatgaacagaaaatagacaaggcaagcatagagaaggcaccacagaaactgaaatttagactgtccagtctccgccctgtcctcaggtcgtggtttctctggcttaagaaagctgaagtgaaattggcattgttaaaagcattaccttcaagtttcccaagcctttttgcattttccttgattgctctgccgttttcctgaaagataccttttctccccagtaatattggccttgctttatcttgtctgttcctaggttcattcactttctctagtgctgaataagaccaccagtgagcttgccaaagcaaatgtgtccaaattagtagcacacctggaaatgattggtaagtggtggggggtggagggaagcaaacttgcaaaatctggtcagcatttgaacattgtgatcacaaattgattgtcctcacgtgctgagtaaggtgtggcagtggcttgattgtggttattagtctggccaggattcatggtggtggttcccaaatgctggcttatggatcagaatcatctggatagcttgttaaaagtgcaggtgttggcacagcctcttccctcctcctgtctctcatctccttcccaagaatctgattaagttgagatggagccctggtgtctatctgtgttttcaacagactctatctagggtgcccatataacttttttttggttcaaattgggatatttttgagagttaaaggggacatcattaatataattacccctagaaaacgggcatacaacagggctgtctctgggaaaccagaggatatgactgcatctagagtcataaattgggggagctaccagtagaggccatggtgttatgcaggaggacattgtagcaaagctggcattctttattctgtgtttttgagacaggatctcgcttggttgcccaggctagagtgcagtggtgcagtcttggctcactgcagcctctgcctcctggattcaagcgattcttttgcctcagccttccagatagctggaattacaggtgcatgccaccatgcccaactaatttttgtatttttggtagagacagtgtttcactgtgttggccaggctattctcgaactcctgacctcaagtcatcctcctgcctctgcctcccaaagtgctgggattacaggtgtgagccacagcacctggccagcattctctctaatgggactttgtaagttaaaattcttagttgaatacaagtgatcaactacatcaggttctaaatagtaggattttaaaaaaataatattttaacttatttttttaaactatagagacagggtttcgccatgttggccagactggtttcaaactcctggactcaaaccatccatccactttggcctcccaaagtgctgggattacaggcgtgagccaccgtacccagcctttagtagagatttatgaaatgtgaagtaaaacatttttcctttcctaattatcaaagattacaaagctcatgttgatgctgtagtaaaaacaagaatgtcttttggggaaggaatgaactgaggctgaggtttcatgccttgtgcaattattttagaaaagcttcttagaggagattggcttttttttttttttccttcttacagcgtattcctgttaatggcctttaagattggtaaaagcttggttatttttgttagaagacattaggtatctaaaataagtatgtggctgggcacggtggctcacgcctgtaatcctagcactttgggaggctgaggtcaggagtttgagacaagcctgggcaacatagtgagacctcatctctacaaaaatagtaaaaattaaccagttgtgatggccagtgcctgtagtcccagcgactcaggaggctgaggtggttggattgcttgagcctggaaggtcaaggctgcagtgagccatgattgtgccactgcactgtagcctgggcgacagagtgagaccctgtctcaaaaaataaaaaaaaaaattgtgttttcaattcattgggagctgaactagcatgccaaatataccttagtaattgttttatcacgataattatgataataaattttgttttacagaggcaacggttcagaatattcctttttagtatccatacagtgttaataatgactcattatagattcacattctagtcgtacatgtttcagtcacgtcttctttcttctttccaccttccagaaacttcactcatatatcagagtagtttcaaatctgtgtctccagtgcctatctacctcattaattttggtctttcattaaatcatactaaaacatgcttaatgttgcttgaatacctaacatgtttctgacacgtcctcctttattcttttatccagagtataattaatagacctaatgatgtttatttctagttagtggtctcatctcagaaagcatcaagtttctgtctgtatttataaaggttttatcctttaaatatgtaatgttgccgggcgcggtggctcacacctgtaatcctagcattttgggaggccaaggcgggcggatcatgaggtcaggagatcgagaccatcctggctaacacggtgaaaccccgtctctactaaaaatacagaaaattagtcaggcatggtggtgggcacctgtagtcccagctactcggcggggctgaggcaggagaatggcgtgaacccgggaggcagaacttgcagtgaccccagatcgcgccactgtactccagcctgggcgacagagctagactctgtctaaaaaaaaaaaaaaaatgtaatgttgctgtattatttcagtcccctttggacttctgcattgagactttttttttccttttttgcattgagactttgttttaaatattgcataaaatattttttggggtatattggaatatgaaaatttgcttttgaggtttgattacaaagtgaaaagtctgaggcatgtgtataccagcttttgttccagacatatttaagttgtgtgacaaaaaaggatacatagtaatgtgttctaactttatcatccctagagggagacctggccttacagggcagcattgggagtctgtctctaagtgacctcacatgccatggagagttctacagagaacggttcactaccagtggtgaagaagcactcatcttccagacttttaagtaaaaatgtcaatctttttctgacttgatattttatcataatacttgctgtttcagattcttgttggctagacaataaagaaaacttttaaaaatttttaccttcttagaggtgaaattgagaagttatggttatgaggagttcttcctgactttaaatttcattaaaatggatctgtgttgaagtgggctacttaaagcttcataaacagatggggtatgagttaggtgcggtgggtcatgcctgtaatctaagctctttgggaggccaaggcagatggattgcttaaagccaggagttcgagaccacccttggcaacatagacactgtctctatagaagaaaaaagccgtctgtgtgtggtggtatgcaactgtagttctagctacttgagaggctgaggtgggaggatcccttaatcccaggagttggaggctgcagtgagccatgactgtgctactgcactccagcctgggtgatggaggggggccttgtctcaacacacacacgcacacccaccccagatagggtatgattgaatatttctgattattaaaagccctgggctctcttgctggttttccacgaacttggtgtatgtcctgagacaagtcatgcagtcttcgtgcatcagtttttctatatattaaggggactgaatcattagaacatttctgagcttccatgtagctctaaaagttctggaatgatttcagcctcagaaggttgttgaggttatgagttcattatgcatttttgtttataaacatgatctatattgaattgtttctatgttagattttagaaagggatcttcaggcatggctggttattaaagaattattttctcagggctgggcgtggtggctcacgcctgtaatcccagcactctgggaggctgagggaggcagatcacctgaggtcaggagtttgagaccagcctggccaacatgatgaaaccccatctctaccaaaaatataaaaattagcggggtgtggtggcaggtacctgtaatcccagctagtcgggaggctgaggcaggagaatagcttgaacctgggggacggaggttgcagtgagccgggattgtgccactgcaccactccagcctgggtgacaagagcgaaactccatctcaaaaaaaaaaaaaaaaaaaaaaaagcttttctcagaaaatagggagtataaaatggtggttttcaacccttttttttttcttttttttaatctaagaggtattagaaaatatagatgtccaggtctgcctctacatattctgatttaattggtctagggccatgctcagtctcttttttttttttttttttttttgagacgaggtctcgctctgtcacccagactggagtgcagtagtgtgatctcagctcattgcaacctctacctcccaggctcaagcaattcttccacctcagccttctgtgtagctgggaccacaggcatgcaccatcacacccggctaattttttgtatttttgggagatagggtttcaccatgttgcccaggctggtctcaaactcctgaactcaggcagtctaccggcctcggcctcccaaagtgttgggattacaggcgtgagccaccgtgcctggccagtgtgtgtgttttttttaaaatgctgatgttcaaccaaggttgagaaaaactgtttcaagaagatatctgagggctttttcatttttagggggttatatggtaccctgctgagaatggatttgtttgtgttctataccttggtgtcatgaagtccgataattaatgtaaaattctcaatttcccgcctagcccaaaataagtactcagcaatgttggttgactgtgtcctatttaataatatttttatggcaccatgctccattaaactcagaacaatttgtagaagtcttctaatttatcttcgactatagattccagaactctttgacttacatttgactaagtaaaaagatgtctttctgcctctagaagacagtttttcctagaaacattgattctgatgcctaattttctttacccattaattcatggacttatttttattgtttttcacacatcctcacaatctttgccaggaacatggtgagcaggaatacttacctttcagggcagggagaaaggtcagagcctcaggtggcctctgagtgacctcagtgctagagctgtccacctgtttatactcctggctatcacacctttatcccatcacagaagcttacaaaaggagtaattattagagtttgctttgtaaagcctaattttggatttccatttaataattaaagctggttttagggaagcccctaaaccaacctgagttttcttgaaatactaacttgtgtcttgctgttatctgagtcacacttttatcctaatttttagatacggacggcctgaccctctgctccggagagaacacgacattcgcgtgagcctccggatggcctctgtgcagtatgtgcatactcagcgtttccaggcagaggtggtggccttcattcagcatttcactcagctgcaggatgtcttagggcgccagcgagctgctattgaggggcagacggtaggtagcctgggccctccaagctgcttttccagtttgactgatcagtagaacttttaggcctctagagatgaatctggaagagtaaaggtaagttatccttgctaatatgttctccgtgtagattagctacagacatctttgtgtaattgaagagctttgttccttatttattgtatctcacttaaattaccttcaaactttagctttcactttctgtaaaaaaagataagggaggtttacaaagaacacttaagacttctggtcccttttaggacttcagtggggatgtttctcttggaaagtggtaggttttttctaaatgcagtagatcagaagttctaaactgagttcgtggcccccgtggggtcctggtagtttattcatggcacatcctaggccaaaggaaacacctaatggtatttccgtttacaaagtaagtcagtctaaacaacaagtacatatgtcctaacaacttagtaggtgtttgaaaaaataataacacataaatggaaagaataatattttatttaattcttaagtaaccacaatgactggtaggaggtatgtgcctgttaggtattgcataacttctcaaacttggaatcaggttggacattacaaccctcacttcctgtccacatttatcttcttatggtacttgctttttctcacagcaaccgctgaagacccagcttcgcaaagataataccttactgaaaggagtatagaatgatctattattgaatgccaactaccacaagctactagttagtgcagtgtctggcagatgttgtttttccttcaaaaatttaaaatgtcctggcagccgggtgtggtggctcacgcctgtaaatcctagcactttgggaggccgaggcgggcagatcacgaggtccagagatcgagaccatcctggccaacatgacgaaaccccgtctttactaaaatacaaaaattagctgggcatggtggcacgtgcctgtagtcccagctattcgggaggctaaggcaggagaatcgcttgaacctgggaggcggaggttggagtgagccgaggtggcgccactgcactccagtctggcgacagagcgagactccgtctcaaaaaaaaaagtcctgacagctgcaagcctttgccaccctgtggtgtctcagtgcagtttgggaaccatagaaaataacaatgtacttttgtaacaacgtgttatttttccttttttaaaaaaactttatggccaggcgtggtggctcacacctgtaatcccagcactttggggggcgaggcgggcaaatcacttgagctcaggaattcgtgaccagcctgggcaacatggtggaattctgtctctacaagaaatacagaaattagccgggtgtggtgaggcatgtgtctgtagtcccaggtacttgggaggctgaggtgggaggatggcttgagcccaggaggtggaggttgcagtgagctgagatcatgccacctgcacttcagccttggtgacagagccaccatgactcaaaaaaaaaaaaaaaaaacaaaactttattaggtaaaagattataatttaataaatagatactttatagtggcagcatttttaaaaattacattttaatttaaataaaaaatgtttgacttggtagatattgatttggtacagtagcaaagtgaaaaagggcatttggagaaaagtctcctcaattatttttctccaactgtctagtttctctctctggaagcaacgagtgctgtcggtttcctgtgtatcttccagagaatgtatttttaaaaaatatacaagtagcataatcaaatgatagaaaatctggaaaaaagaatcatactagtatctctgcactatagcatgttttaatttgtttctgttgttttctatacatttttctctgaatttgctcatggaatatataacctttttttctttctttaacaactcaaaaaaaatttagcgttttacacctataaaagattatctgtagcatgtatatatgtcacagagtatcataataagatgaacatctgtgaacccacctctaactaaaaattaaagcatcaggaagacagctgcctgcatatgctgtgttccttccctattccgttcccctgtcaactcctcgtggaaccactctggtgatttttgggtctataagatcctttaaaattaaaaagaaaaaatttctaaacggtatcttttgctttgcttgtgatctttataaaaatggtattaaaccgtatttaatgttccttgacttgcttttccccccatttagtgtgttgataagattcattcatattgttacatacgatagcatttatttttaccattgcatttcattctgtgtataaatgatttatccattttcctttggaacacttgggctgtttacagtgtttagctcttatgtactgtgagtcctgatgcacatacttgagactttctctgatctctgagatacctggcagtggaattactgagccatagggtgtgcgcacatttctcttcactagataaagccagatcgttttccaaaacagctgtctcaatgatagtctcccatcagcagtgtataataatttcttttaattcatatctttgccaacactcttattgtcagactttttatttgatataaaatgatattacatttatggtctgcatatgcttttataaaataatttagattgagaaatagcatacagtgtatcaagtatgtaaaacactgtaattttatacatgcacttttagaatccagctatttttcctagccttttttagaatctttttccatcttgctttgcatttttcatagatatcctatgtagcaactatataatctattagtttaaccattttcctatttttaacatttaaattgctttcagcttttcattcttatgactaatgcttccatgaatatctttacagaagtgaagtttttttttcactttttgaattatgtttacagtattgattcctacaaatggtactgttttatcaaagttatgaacatttttgtgactttcagtatgactctgctaaatgttttctgttagaattgttgtgtgcatttaaaacagttatttttacatgtgtggttgaaacagtggtaagtcttatggtggtgaatcatttgggttaggaaacgagatacttgtatattactgagtaattgggtttaacttcctgggttaagcagagttgaacaataagtctcaagttttgctttatcaaattatataagacaagtaggaggttaaaggaatgtctttctattttgaacattgttcaatatgtaggctttgaagagaagctgatcttctcaagaatctttaattctagctgtttgaattaggtttatatagagctaagatctacttttatttgtcgataagattaagaggctattttgtttgaaatttaaatttctttcaccttgtattggtgacacgtgtttttgacatgtagctgggtttttattcctacattttctgaggtctgtaaataatgattcagtggaactttgaatttctttgtattcttaatgtttgaaattttaagagtatcagttataccagatgtgtttggccaaatataaattatttcccatatattttaccccagaagtatgatgcagtttttctatgccttccactttacatgtaacctcttatatttgttacacttcttcattcacctagcaactggtatagtaaagtaatgctgtgcgttagaaatcttgggacaaatatcttgagtgggttttgcttccattagctatgtgaccatcagggagttatttttcttactattcttcccttgactcagttatagtaggaatacggagatagcagaattaagtagcctgtacttttggcaataattatttatattaatgatgctttggagttttcaaagtgctttcctacacattatctcatttgatccttataacaaccctgtttgttcatttcttcagtaatttaggaatgagtgtgtcatgcagcttgccaggtgctaggaacagagtggaaaacaagaaagacaaggtcattgccttcatggagtttatatttcagtgggaggatataatcaaggaaaaaaagataattagttatgataatacctaatgaggcggtggtcggcagatgtgttactttcattttataagtgaggaaacattgttaactcttagccctggttgtctggctcatgattcagtgttttttccattaacatataactgaacgcatgttcaagatgtaagtgctagtcaggatgcctgtatatatataaatacatagctgtgtgtacaggaaaaaaagactgaaaagatatggtgttgatgtggtaataataatagctgttacattttcacctcagtttctgggtgtattgtctcatttaatccctatacctctttgaggtagggcttatggcttattattattcccattttatagataaggaaacggaggcacagagactttaacgacttaaccaagataaccaagctactaagtggccaggggtttattagttttatcttttaaaataaccaacttattcaggcctgtattatggccgaggcatactctcagccaatagaccacctgttcttataaagaggatatgttctgggctgggcacgctcacacctgtaatcccagcactttgggaggccaagacgggtggatcacatgaggccgggagtttgagaccagtctggccaacatggtgaaaccccatctctcctaaaaatacaaaaaatagctgggcgttgtggcacgtgcccgtaatcccagctactcgggaggctgaggcatgagaatctcacttgaggccaggaggtggagtttgtagtgagctgaaattgtgccactgtactccagcctgggcaacacagcaagactctgtctcaaaaaaaaaaaaaaagtatgttctgtggtttttgggtgcagtcatattctataaatgtttaattgatttttctctgattgtcggtttcctatatcattgacttatgctttttattttcttccttctacttcagatttaatttacttttctttttccagcttcttaaggtggaagctttcaattactgatttttaagtctttattgctttctaaagtcgtggtgtaaatttctctctaagcatagttttaagtgtatcccacaaattttaatgtattatgtcttccttatcattttagtgaaaatatttttctgtttcccttgtgatttcttctgacctaggggttatttagaagtgtgtagtttactttccaaatatttggggattttccattatcttcttgttactgacttccagtttaactccatggtggtcatagaatatgctctgtatgattttaattgttttataaactcacgaaacttttgggaacctgaggttatttggtggtaaaattagggaattaattatcctctgagtcagttttccttcctctttcaggtgagagatcaagcccagcgctgttcacgggttctcctggatattgaggctggtgctcccgttctcttgatcccagaaagttccagatcaaataatctgattgtagcaaatttggggaagttgaaagtcaaaaataagtttctgtttgctggttttcctggcaccttttccctacaagataaggtgagcaatcagtatccatttccttttccgttcagctagtatttgatcactaattgaaaaatttgtatgctgctgtaagatgatccataattgctattacttttgtagggtatgtggcttgaagaattttttttggcattttattgatatttcagttaaccttatgaattgaggtagtgtaaattataactcttagtaaatgtaggtagtagaattttttttgacattttattgatatttcaattaaccttatgaattgaggtagtgtaaattataactcttagtaaatgtaggtagtaacttgttttagcaaacaaaccaatggaatcaaccttccatctttttataatgctttctttatataaaagcattccttctataatataaacgttttagactctgtggcttttttcagaggacgtgattggcccgtggtttacttgaagccatttaaaaatgtcttaataataacatctgtacagtatattgctttacagttttaaattactgtggcacctttttttttttttcaacttttgttttagatacagggggtacatgtgcaggtttcttagatgggtatattgcacccagatagcatagtacccaataggtagttttccgacccattccccccaaccccccgactccgctctagtagttgatgttaaacaagtaaacgtgtttccctgagttttgtgagctctcttagcaaattatagaaccttaggagggtatctgttgttctcatatttatgaccatccatggatactcaatgtttagctcccacttacaaatgagaatgtgtggcatttgctttgcttttttttttttttttttgaaacagagtctcactctgttgccaaggctggagtgcagtggcactgtgttggctcactgtgacctccgtctcctgggtttaagcaattctcccgcctcagcctcccgattagctgagattacaggtaccaaccaccacacccagcgagtttttatgtttttagtagagacgaggtttcaccatgttggccaggttggtcttgaactcctgacctcaggttatccacccgccttggcctcccaaagtgctgagattacaggcatgagccaccatgcccggccacatttgcttttctgttcctgcattaattcgcttaggattatggcttccagctccatccatgttgctgcaaaggacatgatttcattcttttttatggctgtgacttatccatttctcataacagtgtttggaggtaattaggatgaggactgttgttatttgtgttttacattggggaaactaggattctttgagaataaacagtaaaaatggaaacacctagtaattcacagacccttaaagctgagaggaccttttagatggtccgattagtcccccttcatccatttttgcatttgaggagactgagtgacatttctggaaccagaaatgaggccttgtcattcttggtgtgtgttttcatcattccttgctggtttccacagcagctcttcagtctatttgcttattccttgcaaactcgttttagtgtgtcagaaaagcacttactgaaattcccagctacttatgcctatttttagtataatagctaataacgtagggagagagatggcctttgagatgtatgtaagatttgattgtaagatttaaaaactgccgaaaatagcaatacatagctgccatttgctgaatgcttattatacatcagccagtgctgtgctctttacatataaaaggaaacagctcccaatgcttctgacaccagatgtgttgggttttcccccatactaaccattttccgactgtgcagataccaacttgtctataatttaattatgacattaaccacttggagttagcttaagaccccacaggtccctaaagactgctccccactcagacaccagtcacaagtacaggtctcctgtatgtctgacagactagctataagcttggggttcccacaatgcctcctgaggttcagtaatttgctatagtggctcatagaactcaggggagcacatttactggttgagcataaaggctgtaataaaggatacagccagatgaagaggtgcatagggcgagaccccgcagcgtcccgaacacagaagcttttgtgccatggaattggggtgctccatctcctggactgcggatgtattcaccaacctgatatctctctggaccccattgtttaggcttttaatggagtccccattacatgggcataattaattaaatcattggccatttgtgattagactcaatctctagccccgctgctctccctggaggcctgggcactgaaactgaaagttccaaccctctaatcacacggttgcctgtacttccagcaacccccgttctaaagctatttaagggtttttagccaccagttatctcgttaacatacacaaggacattttatcactctggagattccaagggtcttggaaactcttgtgtcagggactaagaccaaatacagttatggtcccttagctacagggagatacttggaagaatgatgcatccttaggtgatttccttgctctgtgatcatcatagagtgtccttacaaaaccgaaatggcttagcttactgcacacctaggctctgtgctatagcctgttgctcctagaatacaagcctgtacagcacagtactgtgttgaatactgtaggcagttgtaacaccatggttaagtatttgtgtatctgaacatatctaaatatagaaaagatacaataaaaatgctgcattataatcttacgggagcatcatagtatatgtggtctgtggttgactgaaatggcattatgcggtgcacaactgtatttatttgtggtaaatctttactttgaggccatactaaaatttttaggaggaaatcagttctagccagattgtgtgaccaagttcaccaggaccatttttgtttctctatccttcctaaaaaggtactggccagagtttccttatcagatatatctatgtatgggtttaccagcaggccctgaagttagcctcggcagaagaattgccaagatactgaagacatttttgcaaaagggttcctattttttaagtcaaataatagcacagagtttgtagtgttttaatgaaaaaaatttccctgtatttgtttttgaggatttgattttaagtggcagtgcatacaaggagcgctttttcttcaaggtataatgtgctttttttgcaacctgactattctgaaaaaccttatgggattcagcagtcaatccacattcacatgctttaaaaagaaaattaaaaccaaccctttaaaatatctcattacttgagaaagcctgcttattaacttttttttttaagtgtttgaattactttcatactatgtaaagatgttgttcttaaggcccattgaaaagaattcctttttttttttttttttttagccttcactagtacgttcttggtgatcttattttatatccttaaatcttagaaaaactatcttactgggtaccagtgattgttctgtagaattccataagggctgtttggagtgtgttgcttgttcaagtatttgtaagcagataaacacatctgtgaagttcacctccccatgcatacagttaaatataattgattacagtctatatgaaatgaataattaccttcttcaccagccatcattttgtatttgcatttgcctttgaatacatttgcatgtgtgaggtttgtctaatatgcattccagtggttaaagaacaggaaataatcctgaaatcaaagcttggagacgggttatttgcccttgagttccaggactcctgtgtgtttggaattgttttacataaatccatgtcttaatgagtacaagattgagtttttttgcatatgcttttatttcacttttctcaaccatagcttatgcttaaaccacaatttctaagtcaaaatctttgaaaagctttgggttaatcttctcaagccactgatttatttaaaccaactacagagaggatgtagagatgaatcaaatgaaagggcaacaaacactttacagagtttaaataaactaagtgagagggaaaggttttaatgttgaaatacttaaataatgacatttacctagtaatctgccttgcaaaaaaataaaaaaattgcagaaagcaagaactagtttcttttacttgtaattactacttgagagaactgtgaaagggagcagtgtttttgtattcttttccaaagctgagaggagtcaacataaaggcagccctagagggagagccatccttcctctcttcccagattcggttgagaatggcaagatgggaaccatgatgctacgggagctgtgcagacatgtagctccgaggcctccatgaagaagccctgggaagcttaaaagtcaattattgaattgttctggtgaaatagattttcctctgttagcagttaaccgaatgaaggtactaagtgtgtaagaaaagagtagtattttcaatagaattactgaatcattttattctctgttagcccttcttaatttgtatgtccttgagcagaaacatcataggaatggctggcctcttttgttttcatttctacagttacttagatgggaaatgtaaacccatgaggggagacatctagaaggtacaaacacattggagccatgttgccattagatgtcttttcttaaaacaatatgcccctccccaaaagcaaagcaacaaactgtcatatagctgagagacttgcttttgccgcatttgaccttgattaaaccacttgaagcaattggcatcttcacatttgctcttgagccaaaagatggtatcttcctgcagaagttttcagcaagtattgaactatatgtaacatctctgctgataattttttgtggcagtaaatgtcgtgatcctggtagcctcttgtttatgggatctgggaggctgagggaagtataagtattatagagtctttgaagaccctagggactgggataggactttggagatattaaagatagagtcccaccaccagtgctgcccccttcccatttcctgcattctagttttattttgttccttcccaggaatctgtgccttcagcttccccaacgggtattcccaaacacagtctgaggaaaacgacaagcacggaggagcccaggggaacccattcccaggggcagttcacgatgcctcttgctggaatgagcctaggaagcctgaagagtgagtttgtgcccagtacctccaccaagcagcaagggccgcaacccacactgtctgttggccaagagtccagtagtccaggtaaaagaggagaaaagcaacataatactgaaggtggggaaattcacaggactgttgaggaaactgaggggggtgggcattgtgttcaagcaaatgttaacgaagagatagcatttctttaacgatgatgagattctgattttgctttacaaggtttaagagttttgggtgtagatttatcattggatgacttgtaaagtagggttaaattagcacgatatagtgtaattaaagagatttttagatagcctattaggacttttttcttataggtgaaaatagttgccaccagatagtgatagtataagtagaaagagtcctgcattctgcaagccactacccagacactgtccttgcaaaccactaagtctaaaaaatataaaagaacacattaaaaaatattagcgtaaattaggcaacaacagaaatgctgtagcacagagtttaaaagacatgaaccatctggttattggtgttcttctctccaatataagaattagtcattccaaatgagaacattattttggaggcttttctggttttatgtattttttttttcccctcaagacagggtctctcactgtctcccaggctagagtgcagtgttgtgatgatggcttactgcagcactgacctcctgagctcactcgatcctcccacctcagcctcctgagtagctgggactacaggcatgtgtcatcacgctcagctaatttttgtgtgtgtgtgtttgtgtgttttgtagagatggggttttgctatgttgctcaggctgggtcttaaactcccgagctcaagtgatcctcctgcctcagcctcccgaagtgctggggttacaggcatgagcccccgggcctggcctcttttctgttgttaaatgtgttctggatgagtcatgtgcccgataagtgggagctgctctgagctgctagagacggaggcagaatatgatgagctgcaaagatcagtccagtgtgatgagactttgcaagatgcaggacactagctgagagaggctgctgagtgtcttgttacatagatccgaggaattgttagctctctctggtaccttatagtcctagaggtgacaggaaagtggttttaattgtgttgatcatttaacaagataattttcatccccgtagtagtagttgtgaaacactatgtgccaaacattgtggtgcattatttacattaattattttgttcacattacactcctgcagggtttttatttttctatttttatttttatttttatttttatttttttgagatggagtctcactctgttgcccaggctggagtgcagtgatgcgatcttggctcactgcaagctccgcctcccgggttcacgccattctcctgcctcagcctcccgagtagctgggactacaggcgcccgccaccacgcctggctaattttttgtattttttagtagagatggggtttcaccgtgttagccaggatggtctcgatctcctgacctcgtgatccgccccgatttcacagatgaagaggcaaaggcttgcagagattgggtaacctgacctgcccaaggttatgaggtagtaatggaagagttggactacgaattttggcagtctgactccagaaccgaattgtaactgaacatgatactgcttgccagtctgtctgcatgcacatctagaacacagagggggctgcacctgagggccactcggcatatggtgcttgccgccactgatgttatgacgtctgtgatgattaggaacaaggccagtcttacatatgtattggtggatgcctttaagaagtgatttgggatgttttatagaaagaatgtctcttttttaacagtatatctcctactgatttgctatttgtttctgaaatttcactattaatgatacattgtcttggattaagacagtggttttcacactgtttccatgtaatcctaggattccatagcagtaccctagagcagcagtccccaacctttttggcatcagggaccagtttcatggaagacaatttttccacagacagggttggggatggtttcaggatgaaactgttccaccgcagatcatcaggcattagattctcataaggagcacacaatctagatccttctcttaggcaattcccaatagggtttgcaccccaatgaaaatctaatcccaccgctgatctgacagtaggcagagctcaggtggtaatgctcgctgacctcctactgtgagtacctgtctgtggcctggggatttgggacccctgccctggagaatctccaaagcctgcttcattcactttccttacccccttctagcagatcagctctacttttatctattccatgtatttatcaatgtaagtaactaataaaaaactaattttttcagtgcccacgtaatgccaggtgttatgatattttattccctagtatattaacatgctgttagacatggctcctcctacagtgctacttatagactaatgaaaaagacattgagcatttaaatattgatagattataataaatgttatcatggaaaagacagaagaagagagaagactgaatttagatgagaggggcgggccatgccacctgtaaggctgttgaggcagcaaagagcttggcattttgggggtaacaaaggacagtaagcctgaggcctagtgagcaggagagagaatggcttgaaatgagcttgggaaagaaggcagtgggcttgtgcagggccttgtagggatttgggggagttttacagaaataattttgtttcttttttgttttgagatggagtcttgttctgcccaggctggagtgcagtggcgtgatcttggctcactgcaacctctgcctcccgagttcaagccattctcctgcctcagcctcctgagtagcttggatttgggcgcccaacaccacccctggctaatttttatatttttagtagagactggtttcaccatgttggccaggctggtcttgaactcctgacctcaggtgatccacctgcctcagcctcccaaagtgctgggattacaggtgtgagccaccgctcccggcttacagaaagaattttggattaaccgtagccagtaagtgtataaaataagtgaatgttatggactgtttatttttttaaggattactcaggtatttggtggggagagtggttttgtgagggctagaatggaattatgtaggcctaatggaggagagttctttttggtctaggcaagaatgaaggtggtttggatctggtcagtggaaatggacgtggttacatgtggcagtatttgtttgaaaaaataattttagtgctggagaaagtttgtaaaccttttggtagcattgtgcgtggggagggattgcctatggagtcagatttcgtcatcaatcccccagcctcagttgttgtcacagcatgggcatgagacaccgtagaactgtgacgcggtctgtgcttggagtggaggcgggtgggcagggtgtgtcgagcacatggagctttgcataaggaggtctggctgccatagtggagactcctggacagccagttttctgagtagtggacagtgtggggaagcaggcagctgtaaacattttcaaagacagaatgagctttgcattttttatttgtttagtgcaacccctttttgggtccccttttcttcattacctctctttccttgggtccttgtagaagaccatgtctgcctgctggattgcgttgtcgtggatctccaggacatggacatctttgctgcagagagacatccgagagaatactcgaaggcaccagaggatagtagtggagatctgatcttcccttcctattttgtgcgacagacaggaggaagcctcttaaccgagccttgtaggctgaaattgcaggtggaaaggaatttggacaagtgagtgtttttttttttttttgagatggagtctcgctctgttcaccaggcagggtggagtgcagtggcgcaatcttggctcactgcaacctccacctctgaggttcaagtgattctcctcagcctcagcctcccaagtagctgggattacaggcacatgctaccatgcccggctaatttttgtatttttagtagagatggggttttaccatgttgtggtcttgaactcctgacctcaggtgttctgcctgcctcagcctcccaaagtgctgggattacaggcgtgagccaccatgcccagccaatgttttatatctgaataactgtctatgataagtagaatcttaacgtggaaatcagtgctattaagataagtttggaagaactagttattcacttatttcttcgtctatttaacaaatgtttattgagtccctactatgtgctgaacatgagggctactgtgatgaaagagaaaactaattcctttgaaggaacttatgttttgttgagggatacaggtagttaagcacatgattctaatttaatgtttgatttgatcttttttttctttttttttttttttttgagatggagtctcactctgtcaccaggctggagtatagtggcgagatctcagctcactgcaacctccacctcccgggttcaagcgattctccttcctcagcctcccaagtagctgagattacaggcgcatgccaccacacccagctaatttttgtgtttttagtagagatggggtttcaccatgttggccaggatggtctcgatctcttgacctcgtgatccacctgccttggcatgcccgccttggcatatggacatggtggctcatgcctgtaatcccagcactttgggaggtcgaggcggcagatcacaagttcaggagttcaagaccagcctggccaacatggtgaaaccccgtctctactaaaaaaaaaatacaaaaattagccaggcatggtggcgtgtgcctgtaatcccagctaccgggaaggctgaggcaggagaattgattataccagggaggtggaggttgcagtgagcctagattgagccgctgcacttcagcctgggtgacagagcaagactcagtctcaaaaaaaaaaaaaaaaagaaagaaagaaaaacaggtttattatttgtatagagcatgatttgaatctctttttggccactcccttcacagttcttggtttgggcaagtcatttaatgtcacttttttagtttctttctggattaatgatacaacttagctgttctcactgggatgtttgtgtttcagtcttacgtgttattcaagtgctccctggctggtgttcagttatggttggcatgggctatatttggttttactggctaagcagtcttaagaggagcttcgttatttagaaattgaacactttgttttcttttcaagcaatgctttccaaaaaacaaaaaaaaagctttcctattcagcttatctaaactttccccactcccatcagtgtttctgtgcagataattgtattctgttaggcctgatagaaggtgatgctgaatgcaaggtgtcctgtcagtctcacactgcacacacagcaacccgagatggcacttggtcagccgtctctgtttttctttgttattgcatcattgtcttttaaaactctgttgtatgtcggcttttctctgcagacaaaataacttttcttatatacctctgccatttcaaacactagccctctctatacttagagcatagtgtctgtaggattcacaatgcccagttcacccatgggaggttagagaaagctttttagtattgagatgaggtacagatgtgtgcccctccccctcttcaactttacttctgtccatcccagctgagatgacgaacctattcagagtttatcctcatgtcccatctgggctcagtatgaaacactggtgtttgcctttagttaccactaaatccaaagagttaaataaagatcttggcatcttttctttattgctttcccaagtgtaatatttaagctctttgtgagtctcatgaggttttccttattaatagattagttacctcatactaggtttaaggatttccctccctccatttcttgctccttccttccttccttccttccttccctccctccctccctccctccctccttccctccttccttccttccctccttccctccttccttccttccctccttccctccttccctccttccctccttccctccttccctccttccctccctctctccctctctccctcccacagggtctcactctgtcacacaggctggaatacagtggcacgatcacagcttactgcacccttgacttcctgggctcaagtgaacccccacctcagcctcctgagtagctgggaccacaagtgcacaccaccatgcccagttaatttttgcattttttgtagagatggggtttcactatgttgtccaggctggtctcgaactcctgggctcaagtgatcctcccacctcagcctcccaaagtgctgggattataggtgtgagccaccacacctggcctggtttgaggattttctaaatgtaaattttgggagaaaaggggctttttgtagttgaagcatgacagtcatattaacttgcttcatttggagctacatgaaatttttgtcattggaagtaggaattacctacttgataatgtaggtgagtacattttagccccgttgtttgggcgtgagctatgtcagtgttaagttagtgacttgtctgtgtaagtgatcttttttctttttcatagagaaataagtcatactgtgccagacatatctatccatggcaatctctcctcagtccactgctctctggatctgtataaatacaagctgatccgcggcttattagagaacaacctgggagaacccatagaggaatttatgcggccttatgatttacaagatccaagaattcatgtgagtgagaccttatgttcttctgtcactctcatagtctcagctgacggtcaccctgtgtatctattcctcaaactcacttggagaaagaaggtggagcaacaagcaaattagatttcttggcgtatgagcctgtttttaggatggcatcatcagctgtggattgacgagcattttccttttgtagactgtcctgagtggagaagtgtacacctgtatgtgcttcctcattgatatggtgaatgtaagtctggagcttaaagatccaaaaagaaaagaaggtgctgggtccctagccaggtatgcctttgattatattattatactgttagtaacagtatccaaataatacacatgttttgcattgacacagagcagaggttgcagagtggtggcccacagatggaatgttgtctgcagagtgtcttttggttgatctacacagtgcttttgaaaagtttagattcatgctctatcagtcaacataggttaggttatgctgtagtaacagacaaccccaaagtatcagtgacttaaaacagtgaagatctttttctccctcatactctgtgaccattgtgggtctgggctgctctgcttgttgtagtcgcttagggtgacagagcagctagtgttttgatgtgccagcgggaaaaatgagctctgaatggtgttgaatggcaactaaatgctctggcagactttgtggaactaaaatatggtcccacacagggtgatggagtcagaaagtcctgtcttgctgtgtgtctgagtagttacggggtgggagatgcagaaccacttgatgtgcagcattgatgccttgctggccaacattttcaaagttaggggctaggcgcagtggctcaggcctgtagtcccagcactttaggaagccaaggaaggaggattgcttgaggccaggaattccagactggcctgggcaacatagtgagagaccctgtctctacaaaaaattaaaaaactagctgcgcatggtggtgcatgcctgtagtcccagctactcaaggcgttaaggtgagagaatcacttgaaccaggagattgaggctgcagtgagccatgatcacaccactgcactccagcctaggtgacagctgaaacctggtccctcccgccccaaaaagttgcaggattttatataaaaggtttgtatttagcttcttttgaaaaactggaagctttggcaatactaggtccatgttctcacttggaagcatctggaagcggagtagcaattgctcccttgaaatggggcatatgcttacctagtccttcgcttatttctgtcacttccttagtcagtgtaaatgtatgaattcgtgattactggtgtggaactttaaaaagtgcatttcacacttaataaccttttcatgttgatctcttatcagtcctgtaagctgggcgtacatcactcttttccagatagagtttctgactagcttaaggtcgtatgactgggaaagtggtttggcatttgaaaacaggacttcaaggccagtgattccctgctgaagcactctgtcttctagttagtctttctgttgaaagtccgccacggtctgtacctaactcagctggtgagagcgttgcatactgaaactgtggtcccacattggtggtcttgtgagctagcaattttattctttccttttttttttttttttttttttttttaagacagaatctctctctgttgcccaggcgggactgcagtggtgccatctcggctcactgcaacctccacatccctggctcaagtgatcctcccacctcagccccaccgagtagctgggactacaggcatgagccacgtcacccagcgattttctgtgatgattggctgtgcccttagtttttctcaatatggaataattctgtatgtattgtcataatggtaccgagtaattatgaattcctcattgcagctttctcggttatgaaaaaacgatggttccaaatgcatttcctgttggtagattagttgaattattctccatgtgaagagtattatttgttcccagtacactacagcagtttcacataaacagttggacagaccctggagagtgaaacatccaggcaagctagaagctgacagatgaaggcccagagggacccttgacatcctttggggatatacagccttcttagacttctgatgggtcatgggaatgataacggattcagaatatgttaaacatgtggtattgttacttctcatgccgttcctatgaacaagatcatctctttggaactggaaaagtaagatccaaggcacagtgacactaactccattttgaggagtctattaacagaatcaacaagaaaactcagaatgaaagttattctccttatgggacttagatatatttttgattttgctcgttatctcgaacttatatacttttgtaaaatggaagagttgtgtttcacatcttgcttgctttcttttctctcttttagatttgacttcaagaaatgcaaactgctctatgaaagtttttccaaccaaaccaagtccattaacttggtttcccattccatgatggcttttgacacccgttatgctgggcagaagaccagccctggcatgacgaatgtgttcagctgtatctttcagcccgctaagaacagcagcaccacccaagggtccattcagattgaactacatttcaggtagcaggtccagacccttctctgcctttctttgtggagacattcccttttgggtcacgtctttgttggctttagaacatcaaaaaaccaaggaatcactagacagataaatagataatggcttaatcagtgcagtgtactgtatattaatgcattattcctataatcttgcagtttcatttattggccaaaagatgtctctgttgcctttaaaaataaagtagttaagaattgagccttaaaatcaatctccttgtaagctgtagactgttttaatttgtaaagtggcttggagaaggaagaaattatgctggtttaaggaaaaaagtaaaaagacttttggtctttacaaataatggaagggaaggtgggtttgacttgaattacccattcaagtcttactgactcattatccatgtatacatagtttttacctttttgaattaggttatatttttctttctggtattatgggaggcagtgttctatatagaaagaacatatattttggaatcagacagatctgggctgaaaaccttgctctcctattatctagctatgtgtccttagacaagttgtttagcccctttgagcctcaacttcctcttatataaaatagaaaattacctatacccacctcatggggtagaggtaataattaaagtaattctggcatattgcttggcacagttggcagctgtcattgttatgctgatataacatgttgttttatgatataccatttgctgatgttatggctgaacatagaccttaaaactgaaaaattaggcctggtctaaagaagtctttcagtgaaaacccaaaaaggagaccctcccttctgttagtgcttcatgtcatcagacatgttgtaagtataaaccactaagtaaaaagattgtgaaaaactttgtgtttaagcaaaaaacagaacaaaaagtcatcaggattattcttacatgtttctgtatgcctgacatttcaatgtgctgttcagaattccccagggtttaggttttgttttgtttttcgagagaggtcatgatttcttcatatgcctttaggaaatctagcagagtagacatttacatttttttatgaactttaaaagttcaggagtaggaatcctaattgcctcttattgggccctgccatgagccaggcactttagctacgctcagtataatcctgacaagtctgcagaggggatgacttcttcctcattttgcagtttccaagttagaaacttggataagggttagttcactcttctaaggtcacacagctcgtaggtcaagaaatcagagctcaaacctgggtatgtgatgttaaagcccatgatgtttccaacagtctttggacctatcaggtgtctcgtcattgggctgattgcagtcatgtgataagatggccccattttgcagttcatttggttgaagatgtttcctttgaacaagaggctggcatctgtttgttccatctggagaaacatttcttttttttttttgagacgtagtctcactctgtcgcctaggctggagtgcagtggcacgatctcagctcactgcaacctccgcctcccgggttcaagtgattctcctgtctcagcctcctgagtagctgggactacaggctcctgccaccatggctggctaatttttgtatttttagtagaaacggggtttcaccatattggccaggctggtctcaaactcctgaccttgtgatctgcccgcctcagcctcccaaagtgctgggattacaggtgtgagccaccgtgcccggccgagaaacatttctttttgagtttactttattattattgatctggcttcttagactgtcaggtagttgtctccttcttatcatatttttaatatacagggagcctggaaatatttgtgtattataggtgtataattggagtcaaataataaagccttaccttggctcttgctaacagaaatactattgttagcaagaggagtgaaatgttctttagatgggaatttttgaacgcctttcgtgtctgaagaagaattactcttctgttgggatcttgtgtgtcaaatataaatcacttcacagtgtttaaaggcttgaaatattttccagaaaagggatccaacacactgtgactttccagttaaatacagaactctgacaatctatgttcaaaatggggtggaaaaattttactgagggcaacattttttctccattacacaagagtagagtgtttctgtgaaaaatgctgtgtctgtaagaaggagccatgcatcatgctgcccttttactagaggcagtgagccaggtttaggggaaatgaggagcagagaaaccagcctcagaaatatttccaagttagcttttcccacataggaataccttttatgtcagggaaccaggtacatgtagtagctacaaccccagagtcgcttttgggcttacggaaccaagttcaacccagaaaaccgcattcaagtgctccagcccctgtttctcttgtcctactcatctgaggccttatccattagtaggctgggcctgctgatgtactaatagggcctggatgaagcccctgactgcatcatggtttgaagtcaggcctgagagtcctcgctgggttttcacgtcaaatgtagacttcggagcaatggcaacttgtccccccacccccaccccaactctacctctaggttacttaggggacatttatccctggtaaatgtcatcttacttgttctcctcgggccaaaagatctgggctgtcaggtcagtttcaattagagaaacaatctagtactagtgtgtgtaaacttggtattatttataaagaaatgatcctagacgtcaaagaaggagtgcctcattgatcttcttgaaatagcccatagggaaagaaagtgacatttatcaaatgactgctttgtgcctggtgctttatttcttatcatattaatattcttcattttataagtagggaaacaggctgagagaaggtaggtggctttcgtaagataacacagctcgtaaatggcagtatttaagtctgcgtctctgacttcaaagcctgtgctctttatcataccagaatttcttgaccttagcactatcaacgttttgggtcagataattccttattatggggctgtcctgtacatcgtgggttagttaacagcatccctggcctctacctatactagatagcaatagcaaccccctctagttgcaattgcaattgaaatgtgaataaaaaatgtctccaagggccaggtgcagtggcccacatctgtaatcctagcactttgggaggctgaggcgggaggatcacttgatcccaggagtttgaagttacagtgagctgtgatcgtgccactgcattccagtctgggcaacagagtgtgaccctgtctcttaaaaaaaaaagaaaagaaataatgtcttcaggggagcaaaaccatctgattgagaaccactgagctatactacctatgctgctttcttataaaatgttccttgttgtttaaaaatatgattaacttattatactgaatgtgttattaaaccagtaatacactgaatgtgttattcaaccagtgttcaaagtttactgatactcaaagcaggcagtttggaaaataccggaataccacctgccaaaactgagcagtacatttgcaggttattgaaataaccatgtttcttttttcctatttattttctcctgtcttctttttatagatctaccaaggattcctcctgctttacagtagttctcaacaatctccgtgtgtttctcatatttgactggctactgttagtccatgattttctccacactcccagtgatattaagaaacaaaatcatgttactccttctcgccaccgtaactctagcagcgaatctgctatagttcccaaaactgtgaagagtggagtagttaccaagcggtcttcccttcctgtgtccaatgaaaggcacctggaggtcaaggtcaatgtaacaggtgattatatgtgggtgtgattcattggtgcttagtttggatgttaggctcaatatctgccttacaggatgattgctcttttgcctcccatttttcacgtgagcacttacacatttgcctcttttacagacctgcaagcatcagaggtcttggcctccattttcaggtgggagctgtctggcccactgaagactgcggggtcgcttgtccctgtcccctgcctgcctagtgcttgtgtctggcccgagcacccgcctgggcagtggtctttttttttccagtgtacagtctgtctgtaatttgccgtttgatctttagggccctaacagatgtggtttatggagtttaggcaagtttcgtatgtgaaaacctcagttttgaagataagtaagtgaggagatttttattttcattacaaaaagaatatttttctttgtatagatgaatttactatggcatttgttgactagcgaactcatctagtgcatctgtatgtatttgtgtatttattgttatgtttctgatacctgtacctgcttctcagtgattttgatgaagctggctagcacaatgcgttttacatgagttcagttacaagcttgatctgtatatggtttttgataaaaacacagtttaaagcagagtgaatttactattaaatatatacacataagttgaaaacttactgatttcaaaaatctcgatattaaattggtctgttctttgtaaacaaccttgtaaatagctacttagatgcatagtgcctgaccagcattagtagctgagtcttctccctggaattttcagtcaggtcatcacttagagaaaggatgattttgtgaacttctgaatatctcctaggcctcccaggagaactggggtgcagtttctctgtctagtttagaaatattctaaagagagaaatcacatcccagtctttcctgctgctgcagagctctgttggttcagctgcatgtggccagatgcagagtattggttcaggatgacactgttagtaaatgtcagcagacattttggagaaaaatcttactggttcatgttgttgcctggtggaaatgcgctcgctgccttgtttgcaacagcctggtgttttccagcttcccagctctggcttgattgacgacgttgtcctttccaggtacggagtttgtggtcattgaagatgtgtcctgcttcgacaccaatgccattattctgaaaggcaccacagtgctcacctataagccccggtttgttgatcgccccttttcaggaagtttgtttggcattgaggtaagaagtctatgtgttgatcacagcactgcgtgttggctcacgagcaaagcatctggaagagaattttccctcttaaactttcatgaggggaaggaattaatgaaattggaagacccttgccctcttttcctctttgttttctccccaaatctacctggctattctaatgcatggattcagtctcccagtgttagtctataaatatgcagaggacatttgcctctttctcttacaccctttcttcctcaagaagttcaaggagacttttccagtccccactgccctgtcaggcaccttgttgtgccctctcgttctgcagacctcgtccatgaaggtgaggccgtgggtctcatttcccctgcatccctctcctcacctggagtgcagccctgtgaagagctagggctttgggaagggaaacctatttatacagagtgctaaggatcttatatgttatcctttcaggaatacctgatccataaaagggcagctctgcagagtcctgcctggctgaaaggagcgcatggataatagtggtgctttaggctctcatgtcatctcatgaagaagataatttgtgttggagtggcctttgtagctcggaaatgtcattatgcaatattaggccaaaagtgctttgtctcttgttaagccatggggtgtggagacagaaggggaatcgtggcaggttcttgtttctatcagatgtttgtacttgactcatctcagctcacattccccatgccacactgttaggatatttggtcggggttccttttgctttacgatcggccttttcatgcccctttctttccagtggtattgctcaaagtttgaaggaataaaacttattttcactgttaggagtatatggtttatggttttgagacaaacatagtggaataaagcctgtagggactctacttcttgaccacttgtttctgtcttgtaaagaaacctccgtttgagaggaaggatttgcatgctggtgtgatgtgagttgatcatgaaattgcaattcatctgccttccaagccaccacaatactagctttgaatggagaatcttgctgattgattaatgaactgtcaggtacaattgggttttgtgtagcagaaacccctgaaggaaaaaggaaaatgaaactgttctgctctgaagtcttaggacaactacatggcaaaatatttgagatcgctggaaactcctttcagtcctgcctttgaggcagcacaattggatctgaattttaagaccagcttgataaatcatcaggggagaatttataaagtatgaattttgaatatggcaaaggaccttgctgtcacatgtttttcacagcactaggataggtcccaaaaaggtggtggagggggtgaagagggtaagaaggacccaaatgattggtcttttctttccgctgtgctcttcctgagcatgcaaaataatttggtcctagaactggagtcctttctctctctctcccttctttctctctcccaatgaatgtatttattttttaaccttttattatagaacatttcaaacatatacaaagtaaacagaataatataatgaactccatatatacctatcacccagttttaataatatgtttatttttaattatgaagatattgtgaggagggaaaataatcatatatgatttctgataggttattttggtgtgtttctttccttaaagttggggagtaacattattttgggttgtgttttcactttgtgttgtaactgtcttcttaaaatccatatggtcttttttgtcatttttaaatggctgcaaatattccattgagtagatgtgatataaccttggctgctcttaattttttttaactattaaataatggtttagtgaatttttttcttttttggctagttcctagagagaagtaggattactggatcaaagggtgtgagatttgtaaggctttcggggtgtattgctaaactgccttttcctctgggtgaaccactgcgtgtgctctcggcagcggtggggggcttcactcttcacagtatttatttcagcagttgttatgggtcttatgataacacatggctgactgcttctgagatagcctctttgtgctggtagttggacccttcctaaatcagacattaattctcgccatattgcatttcattctgtaggtgttttcatgccgactagggaatgagcatgatacagctctttcaattgtggatcccgtacaaattcaaatggagttggtggggaattcttcttatcaaaatagttcaggattgatggatgcattcaatagtgaagatttcccacctgtcctggaggtaatgatgcaaaatctgtgcaatacgttgatatgctctcaaacactgtcctatgcaggcactcttatttgctctgagcccaacaacctctttttttgttttgttttgttttgttttttgagatggagtcttgctctgtcgcccaggctggagtgcagtggtgcgatctcggctcactgcaagctccacctcctgggttcacgtcattctcctgcctcagcctcctgagtagctgggactacaggggcctgccaccgtgcccggctaattttttgtattttttagtagagacagggttttaccgtgttagccaggatggtctcgatctcctcacctcgtgatccgcccgctacatggtgcagttttgtgaccatttgacctcatagttgagacatcttaccttacggttattagtgcttactttcaagatctttgcaatcttttaaatgagaaatttggtgcagtatctgttggacttttagaagttgaaataggaattacatctgtaagagatatggatgtaaaaccaatgcagctttaaaaaattgctaccttttttacattttgttagattcagttacaagccctggatatcagactctcctataatgatgttcagctgtttcttgccattgcaaaatccatcccagagcaagctaatgctgcagtgccagactcagtggccctggagtcagactccgttggcacttaccttccaggtgcatctcgcgttggagaggaaatcagagaagggacaagacacaccttagatcctgtcttgggtaggtgtttaactataaaacccactcagtcttgctaataacgcttcttctttttgactcttaaaattttcttttgcacaactaaattgtacacagtttaattgtatgtcattaagtataactgtaagtcctaagtatgactctctcattttttaaaatttaaaaacaaacaaaacatccctaaccaactactccactatttttcctctttcagttttttccagagttacctggataatgccaaagttgagttttaagctttgagagttctcctctgaaattatatgagtaacactaagttttatttttaagcttttattattaatttattggtttatttttagacagggtcttgctctgtcacccaggttggagagcagtggtgtgatcatagcttattgcagcctcaaactcctgggcccaagctatcttcactcctcagcctcctgagtagctgggagggactataggtgtgtgccatcatgcctcactaatttttaccttttttttttagagacggggtcttgctattttgcccaggctggtcttgagttcctggtctcgagtagtccccctgccttagcctcccaaagtattgggattactggtgtgagccactactgtgcccacctctaattttaagctgtttcaaacacagtcaggggaaaatgtaggggccagatggtggaatgaaggggccagatgcgaaatagaccttccccccccaccccaattcctggccaggacaccactttaaaaacacagtcaatatgaggaagagactcaaagatttcagggtacacttgatagaattctccaattaggagtccagttttgcttagagaaatgaaatgttttagtcacgggtttttaaatttcttttctttttttctaaaattagtttgtagattaatttacataaaattatttatgaaaattttatgctatttgtttcctagagttacagctggctaggctgcaggagctgggattcagcatggatgattgtcgcaaagctcttttggcgtgtcaaggtaatttgaacagggttctgttacccgttgtttatcttgatgatatgcttccttcccatttcctctcttacttccacaaggtgacttagagagctgagtgtgtttggaggacgctttatgtgtcttctctggactgcatatcatcttaggtcagtaataataacgtcacccaggctggagtgcagtggcgccacctcagctcactgcaacctccacctccccagttcaagccattcttctgcctcagcctcctgagtacctgggtttataggcatgcgtcaccacacctaggtaatttttgtatttttagtagaggtggggtttcaccatgttggccagactggtctcgaactcctgacttcaagtgatctgcccgctttggcctcccaaaatgccgggatgacaggcagcagtctttagtagtggataagaatttgggttctgaggccaggtgcggtggctcatgcctataatcccaacactctgggagcagaggcagatggatcgcctgaggtcaggagttcaagaccagcctgaccaacatggcgaaaccgcatctctactaaaaatacaaaattagctggcgtggtggctcatgcctgtaatccagctactcaggaggctgaggcaggagaatcgattgaacctgggaggcggaggttgcagtgagccaagatcatgcccctgcactacagcctaggcaacagagcgagactctgtctcaaaaaaaaaggggctctggagctggctgactgggttcagatccttactgtctgccactacctattaatgactttgggaagtggctttaacctctgtgaaccagtgcttccttatctgtagaaagaagataagaggctgtctccctcagagatttgatgtaagtaaatgactatatgcaaagcactaagaaagtgctagcacacagcaagtgctctataaatgttaaccactgttactagtggttgtgctaatggcggtgatattgataattatgaccatttattgaagtcctgtatgcctatctttgtgttttctttttgcatcctcttcacagcccttggaggcagacattattattcccacttgaaatgaggaaaccagctcagattggttaggtaaaacttcttaagtaaacttggtggaggtcacatcttagtcccctacgatggacttaaagccaggtctacctgcctcctaaatctgtgttctttctactccatctcacttcctttccatctccatgtttccctttctcttcaaaaagagaagtacagcacaggctgcatttccttccatcttttttttcccccttttttaaaagacagggtgtcactctgttgcccaggctggaatgcaatcatagctgtggcgcaatcatagctcactgcagcctccaactcctgggctcaagcaatcctcctgcctcagcctcctttccagtctttacacttgtgtgcactttctctctttctacttctctttttttttttctttgagacagagtctcgctctcttgcccaggctggagtgcagtggcgcgatcttggcccactgcaacctccgcctcccaggttcaagtgatactcctgcctcagccttctgagtagctgggattacaggtgcccgccaccatgcccagctaatttttgtatttttagtagagacagggtttcccttttttgtacaggctggtattgaactcctgacctcgtgatccacctgccttggcctcccaaagtgctgagattacaggcgtgagccactgtacccggcctctttctacttctctacctactgtggacagtatatccaacacacacacatgcacacattacatttttaatgtactggtagattctgttgccaatacaattttatagtcttttaaaaatattttattgaattatgattgtaattctgttatgatatacttaatatatcagcagcatcttcccatgtcattgaaattatttatcaatactgatctttttacattgactctaaggatatattataatttacttaatcattctttacttgttattcaatattatacacacttctatgtagtaaacattttttggtgtgaacttttgtctatgtcttttaagtatatccttggtagagtgatctatattttaaataccagaccaaagggtatagatatatttttcaggctctttacttgatttctttttttttttttaatttttcttttttaaaattttttttggggctcttgaatcgacaaatctttttctaaaaaaattgtatctgggttattccagccaatttatgtgtgaaaaggcttgtttcatgacatactggtttacattaacttaccttttggattctgaaaaaaatgaaggtagacctagttctcatgtgttcttggttttgttttacccagtcattagtttttggtttaattaattttataccccttaatgtttacttttcctatgctttttactctttctttaacaattcgagcacctttttttttttttttaattaaagttctgagaaccttttggatttttttttttttttttttttaattttagatactgggttttgctctgttacccaggctggagtgtagtggtggcacaatgatcatggctcactctagcctcaaactcctaggctcaaatgatcctcccacctaagcctcctgagtagctgggactacaggatgcaccaccatacgtggctaatttttaaattttttgtagagacaggtcttgctatgttgcccaggctggtctcaaattcctgacctaaagtgatcccttgcctaaacctcccaaagcattgggcttataagcattagccactgtgctcggcctctgtttggtaattttttttttttttgaggcagagttttgctcttgttgcccaagctggagtgcagtggtgcaatcttggctccctgcaacctccgcctcccaggtgcaagcgattctcctgtctcagcctcccaagtatctgggattacaggcacatgccaccacgcccagctaatttttgttatttttagtagaggcggggtttcaccatgttggtcaggatggtctcgatctcctgacctcatgatctgtccgccttggcctcccaaagtgctgggattacaggtgtgagccactgcacccgaccagtaatttttatttcttcagtagataaaacttaattccatcagtaattaatatgataatagcaactgatgtgtatctgtaatgtagataatagcaaataatgtttattacactccaggcttcactctgagaactttccatgtactcattcttccctcttcctgtcagtccttttaagtgggtgctgtcgggcacaaagagatcaaataacttgcccaagagccagcagctggtaagggcagaacaggacctgaagccaggccatcttgctctggagcccatgccctcgatcatttacactgtccctggtactggcctctggtgacttaggtaccaagtggcgccgtgtctggatcctctcctgtcctcttctctcctctccttcaacagatggcatggtagagagggatggcttcctggaggcattttgggccagatcgtgaaaggtgtggtaaatttgagtggaaggtgtgcaacaaaatgtttgcttaaaagcaggatgattattatgctgagattccctcccaccccccacccccaccacccccaccctccttttttattaagtccaagaatacttctgggatcaaggctctcttggcttcccagtaggtctctagagaattttatttctctgtttcctctgtgagtggctagggtagctgtggaagctggtagaactgatcacttcttaatttctttgaaggccaattgaaaaaggcagcaagttggttgtttaagaatgcggaacctctgaagtctctttccttggcctccaccagccgagatagcccaggggctgtggcagcgccattgatctctggcgtggagatcaaagctgagagtgtgtgcatctgtttcatcgatgactgcatggattgtgatgttcctctcgctgaactcaccttttcccgtgagtgttgtactggttttcagattcatcttgaatatttccagtcattgctgaattatttggggcctttttttttttgtcattcatactctatttagtcatttgggtgaaatttagataatagttttacatatgtttttcattatgtatgttttaaagaaacttttatttgccatatgtggccttcagcctatagcttgggaataggaatggtctttgataaaatttccattgtattaacatctctagctaaataattcctgatctcttcatttttcttatctttttatgtatctaaagattgtagtgaatactgctaggcatttaacagataagctcagacaataatggttctgttgtattatctcttgaaaatcaaaaacaagaatcttactagaaagtgcacttctgagtctccaccacagggccttgtaaggggtaaaacactgtttatatgtgagctgtcctttgctagagtggggaccaaagtaggagtactctatccttttttttttttttttttacctcaaaggtgaggtcttgttttgttgcccaaggttggtctcaaacgcatgggctcaagcagttctcctgcttcccgagtggctaggattaaagtggcccaccatcacttctggtgggagtacttgatccttaagtgcctcactgcaagcagtgtgaagttgaggtcttttttttttatgagacggagtttcgctcttgttgcccaggctggagtgcagtggtgcaatctcggctcaccacaatctctgcctcctgggttcaagcgattcttctgcttcagtcccccgagtagccgggattacaggcatgtgccaccatgcctggctaattttgtatttttagtagagacagggtttctccatgttggtcaggcctgtctcgacctcctgacctcagggatctgcccgcctcagcctcccaaagtgctgggattacaggcatgagccaccgcgcctggcgaggttgaggttttgaggagagtaaatgaaaatctccctactctgtttagttttaactttccattgtttcgatcttgccagcctcttcttccttcaggtaaagtttgcttctggggcttgaatctggcctcttgcacattacagagcttgccctttccctgagcttctatctagggcaccaccagggctacttggttaaaagtgacaactggaattttgactgttttgatgaatatcttttctgcagagactaattagttgatttcttatttttctatgtcaatcttaacattttgagctaatatttatcagaacatgacttctctaatcagtctgccctcttatcatttttcaggtagaaatatcttttttttattttttatctttattttttgagacaagagtcttgctttgttgccgggctggagtgcagtggcgctatcttggctcactgcaacctccgcctcccgggtccaagcaattctcctgcctcagcctcccaaataactgggattacaggcgcccgctaccacgcccagccagtttttgtatttgtagtagaaatggggtttcaccatgttggccaggatggtctcaatctcctgacctcatgatccacccaccttggcctctcaaagtgctgggatttacaggcatgagccaccgtacctggccagaaatatcttttatgttcccacaggcttcaggtacacctgggtgccagggctggcactgtgggaaggcaaatgaggtacttgcctcaggcacagagtttaagagggtgccagaaaactcagtcatggagataaataatatctcagtgccatatttttaaaaattgatgcaaaaaagtacatgatgaacaaagtatcagaatgttgtgtgctctcctttgcgagtattagctctaatgtttctttaatgtcatcagcaaaaggcagttttggttgctcctgccctgccgctgcagtaaggtttgctttcattgcaggtctgaattttcttcagcgtgtaagaactagccctgaaggctatgcccacttcaccctttctggagattattataaccgtgctctttcaggtcagtataaagcatatgttatcatgggatttaaaaaataaatttaaatgtttgcctggacctattgctacgtaaattttacatgaaggaaagggcaggggtggggtgggacggggaaagatgaaaagcaagtagactgcataaacacagaaaataaggattttctgttgtgctaaaaacatatctgatatgttgcaactaaaaagatgtttttggctggacgtggtggctcacgcctgtaatcccagcactttgggaggctgaggagggcggatcaccctgaggtcaggagttcgagaccagcctggccaatgtggcgaaaccctgtctctactaaaaatacaaaactagctgggcatggtggtgggcgcctgtagtcccagctacttgggaggctgaggcaggagaatcacttgaacccggcaggcggaggttgcagtgagctgagatcacaccactgcactccagcctgcatgacagagcaaggctctgtctcaaaaaaaatttaaaaagtgatgtttttatagttaattttttttggatcctgcagtttggctcattctagaatatgccattgctcaatagtgaaggatcatttatttcgccctgagagtagctaaatttcaagggagatttatgcccacaagcatttttttgtttgttttttgagaccgagtctcactctgtcacccaggctggagtgcagtggcacgatctcggctcactgcaacttctgcctccaagttcaagtgattcccctgcctcagcctcccgagtagctgggattacaggcgcttgccaccatgcccagctaattttttgtatttttagtagagatggggtttcaccagactggccaggctggtctcgaactcctgacctcaggtgatccacctgcctcagcctcccaaagtggtgggattacaggcgtgagccactgcgcccagccaagcattttaaacctcaagtcccttcactccccactgggtttgtttgttttattagaatctactgagtcagtgacactatatattctgccctacctgctccctagaaaaaacaaaaacaaacaaacgaaaaaccactgctgatcagagcaggctattttttgggagacgtaaacctcaataatatcgcaagcattttcaggtttctttcttcccatttgaaagaccaaggtaagagcctatacatacaggttgaaattcagaagccataatatattagggccaagtggtttgagcagtgaactttgccttaagagagctgaaagaaggtctcatcggaattggtagtaggcatggacagaataatcagagtagtgctgggcagtccaaggtgtaaacctccgacggcctgctccctttaatttcagtaagaaattaaacctcgatttgttgtgctgctgctgagtgttctagagtatttatcacatttaattttatgttagttaacattttccctgtgtaccagactcacttaaagctaacacccttatttcttcattgttcaaaatgtttcactttagaatgtaatcccagcgctttgggaggccgaggtgggcggatcatcaggtcaggagattgagatcatgctggctaacatgatgaaaccccatctctactaaaaaaaaaatacaaaaaattagccgggcgtggtggtgggcacctgtagtcccagctactcgggaggctgaggcaggagaacggtgtgaacccaggaggtggagattacagtgagccaagatcgtgccactgcactccagcctaggcgacagagcgagactctgtcttaaaaaaaaaaaaaaaaaaaaaaaagaataatggcccaagtctttctagttgagagaaactcttgcatgtgggagctatttttctgagaatcatttgttttcttaggccaaatattgcttacttttaaagttgtatgaacacattcaggtcactaaatgtcaaatggtgtaaggagtctaatgtatctactgtgtgttacatactgatttggatttgttcagtggctgattgtgtgagtctatttaaagatctgttaaaaattaattggctttgaaaagttgagtcttttaagtcacagtgatgtaccatttttcacacccaagagattagcaaaaattaagtgggacactactaattattggaacatataagccatagtacttgctattagaactatacattactaccactactgtgtaaaacaatttggcatgacctggtaaatttgagtgtaagcatactcaacaaccccgcaatgtgttgcttctaggtctgtaccgtagagactgtcttgcctgtgtgaactacagatgtatataaggctgcttatagtatagtattccaatagcaataaaactggaatcaagtgaatgtctttcagaagtagaatggataaataaattgtatattcattataatgcatgttaatattcagtagtgaaaacaatgtaccacggtgacctgcgtcaatgtgatgtagcagtatgctcaacagtatgctcaaagacatattggtgaacaagaatagaaacttgaaaaagaatgcgcatggggattccatttatgtaaagatcacaagcaggacagtctaaatgttcttaagaaaggtatatatgcttggtaaaattataaagaagagcaaggaaatgattaactaaaaattcaagtgaatggtcacctggagttgggtgggagagggttggtgggaaggaggggaatgagatggtagggaatggcccttgggaacttgtaattttctatttcttaagttgaatagtgagtacacgagtgttagtggtattattttatatgttgtttatatagtttttgtgcatattttaagaaaaagaaaaagtgagccttcatatgtacctatttattcaaccaatgtattggtcctgtaaccaggagaatcaaatttaatagctatttaagacactttattatttttccaatcttagtctgagactcctttttccatcttgagtgtctcaacacatcccacctgttctttagtggaagagggcacatacactgcctgccctccttcctgccacctctggaagaccatcgtgggggtacatatatgcctttccacttgtgtcttctggacaacgcagacatctgtagggtgacctgtagctaaaggtggttggtgcttttgttgtgaaattgaattggaagtagaaagctattaagctcgagtttgtccttgctgaacatttgcgagcagtgttcccctataaactcttgatatctgctgaacagatgtcttatttcctgtgttcttttaggctgggagccatttattgagccttggccatgctctgtatcctggcaacagcaggcagctagtcgtctccatcctcctcgactgaagctagaagccaaggccaaacctcgtttggatatcaatatcacttctgtgctaattggtgagtagaaagttgtctttcatagactgatacctttccgtacctaagttctgagtctggaagactattaatcctggtttagcaaatacctgggcctgtaccaggcatcacttcttcatcctgactgctttcctgatcaaccctaatagcctcttgattctcaacctgtttctccaccgttggcatcccataatgatgctatcagtggttaagcaagaacttagattacttaggaaacgtaaatggccgtgatggactttctcctcataatgcttggtcactagagtttattaaatgtcctggaagtgagtttagattaactttgctcaagctattcacggactaattcttaaaaggtgtgattttgaccatatctttatagtagaataagttgcctttgttgtttcccattatcattttgacctaactctgaaaatgacttgcttaagggttgccaggttagtggtgtgttatctaaaagtatctttggcaacactgaaatgtacatctctggattcaatgtcatgaataaaaactgctctattgttacagttctgccatctaaaaggaaagcaatataatcatacaatcaagtagtgtgtaccttcactgtgaaaactcacattcattgtttgatttattgatctacttgatctgattttggaattactatactttatctttgagcgataacacatactattgcaaattgtgaacttcctttggtgtgtatgttggattgaggctgttagaatatccacttccttacgcatgtcagagttggatggaaagaatgtattgtgaaatgagaccataagtttgttgaccccccaaatttaaaaccactgtttatatgatcagatttcatccactaatttgcctagttgttaatatcacctagataatagtaagttgaccctgtgatttctctaaactgtattgttttgactcctacattgtttctcacaacatctcttactcacaacatctcttactctagaaggttagagaaagtttgtggtagtcttttgaaaagctgcagtaaacaagagcttacctaaaggttcttattggtgtttctgatgagtacagtatatgtctctttaagaatatcttctggccgtgcacattggctcatgcctgttaacccagttcttcgagaagccaagatgggaagctcatttgaggccagaagttccagaccagcctaggcaaaattgtgagaccttgtctctacaaaaataaacaattagctgggcatagtggcgtgtgcctgtagtcccagctactcaggaggctgaggtggaaggattacttgagtgcaggagttcaaagttacagtgagctatgattgtgcccgtgtactccagccttggagacagagcaagaccctgtctctaagaaaccaaccaaacaaaaaatcttccaaaaggcattctcgtcagtggtaaaatttgttttgtttttttcaccttcaattccttgttccgaatactatactgaaacccagaaacgtagctatgacctcttgtgtttaaataaatattacttctgtagccaagtgttctaattgaaaaccagaaaccaataattcttcttccaaaaagtataacatcttaattagtataaaagatcttcatctaggtgtggtgcactgtaattgtttttgttaacctgctatccccattgtaattctctcacagaagtaaaactacttgtggagaattgtctgctgaatttcagcctctggagtgcagtggcatgatctcggctcactgcaacctccacctcctaggttcaagcgattgtcctgcctcagcctactgagtagctgggactacaggtgcacgccaccacgcctacataagttttgtatttttagtagagatggggttttgctatgtgggccaggctggcctcaaactcctggactcaagtgatccgcctgcctgagcctcccgaagtgctgagattacaggcgtgagccaccgcgtccggcctccatataaattttagattcagcttttaaaattccacaaaatgccctatgggtattttgatggggattttattgaatctatagattggtttgaagagaatccacatctttaatgtctttcacattatgatagagttttgtggcgatggttgtctattcatggtaatctctttcagtggagcgtgaggctctccagggcatagactttctcggaatctagcacaggccaggcatgtaatgagacactcaataaaagcttgttttgctgaattgaaattatttgactcgaaccctccatcttttttagttctcttaatatctctgggggattctttctagaccagtatgtaagtaccaaggaatcgtggatggcagattactgtaaagatgacaaggacatagagtcagctaaatcagaagactggatgggctcttcggtggatcctccatgttttggacaaagtaagagttttcactacatgtgtttaactaaatcacttttgacctacaaagcaatgcttcactgagaaattcaaatggaaccatcattctgcgtggaaaaacctacaggaaattctgactatcttctgtagttctgttttagtctttgcaggagacagttttctggcatgaactactgaacttataaatgtgggctgtaattccacctttgcgggggagaaaagatctgcaacacgtaattcctaaatcctggtaataatgcatatgaactggtgcacctgagaatgcatcaggatcagctgtggtttgtgttttactctgcaaaacattggttttctaattgatcggatttttttggccagatttttaaaagcatctaaaatggtcttctaaatctagagatagagggtttggacatattcttgaaaagagggcgagcaggagcccatgtggaaaaagttgttaaaaagggagccctgtgctgttcatagagtataaaagaattgaatgccctgcctcttgaagaaagaggagtcagcttgctctctattgatgatgctttctttccttatttaatgcctcgccagctctgttttcctcagagctggggagatggtgatggacaactgcatggtcttagttgttccacaagccattgtcatccaaattcaactcagctccaactcttacaatgtggtttctttggggagtcttggctggacttcacatagctcatgaatacttaaatattccatctggtctgcaaacgtgtcatgggaagattgggtgttcttagtgtgtgaagtaattgtactggttcatctctcctcagggtgaataagtggactttctgtctgccttgtacttctagaaagagacacaaagaaatgtcagctgtgcttgttctctgttttcccaggctgttgcttctgagtctcaaggtcattacttaggagccagggcttttcagatattgtcagctttgattttagctcctcctccaaccttcccaatttgtgtgtcaagaaaatgtaacatagtctacccagaagactctaaataatctttgtaatatgtccaagagagtgtgtttctaaaacattattcatgcaggggcatcttcaattcagagtcaaactctagcaaggcctggtctgcaagattctgatgaaagattttcttgtccctctctttcttctttccttcttccctccctgcctccctttcttccttcctttttaaaatttttgtccctctctctttctctatagttaaaaggcttcctcatctatattaaatgctggtgctgagttaaagcttgatttttatttatttaaagatttttatgattacttaggcttataaaagtgtaatctatctttttaataagacataacttgaatatgcataaatttccaaacctcttttcttattggaaattcctggatggtagtacagtacattccaggattgtattcttttagcaggcctactaaaatgatcattgggaatttattttgaaagtgagtagggttcaaccttgttgaactaatcataaactttcaggtcttattcaagaatagtaagtcatattcctacaaaagttatgctttttattcagactggccttaaaacaagctcttgggaatagcccttaacatgaaatttagcctaagggacctgctgctttctcactgtttctttatcaggggaaagaaaataccagcctccttttgacaaaattgttggctttgttcagtcagggctgagattttgcaggtaaacctgggcggtgtggcacttcattgaatttattagttttgtattccaaggacattttatgaaaatatcaaatattctgaaaacttccatgcttgatttagaatttaaataaacactatgagacaactccttggtagagattgtttaaatttggaacacatactgactcttcccctgaatttttgagatcccctgagactggcattttacttctgtgttttaccagttggaatggagcaaccttcactaaaatctgtactgatggatttttgtaactttttaatgccatttaagaacataacacctttaaattaaaaatcttcaaaaggctcgtcattctgttcaagagaaggttcaatacatattcttctaattcaggaaaaaaaaaaaaaaagcatgttactttgatccagcctccacaataaaaactagcataaaaatgtgttcactttgtcaagtacattcgtagtgcttagtaatcactgatgggaatgactctgtacttgcatgatgcttgctatttttgtaatgttctctatttgtgcttatcgtttggaagcaagtcttcttatttcactgtatttattcttagcctctaactttgtctctcctgtctaccaggcctcccccttgtctaccttagaactaggagtacagccagtctgactaacctagagcaccagatctatgctagaggtacagtatagccaagcgagggcttgctttattttcctgttttaagaacttccttgtacatcaattttttttttaatgagtgggagttgaattgggggtattccatgtcgtgagtactttagtaataggaaagaacatttccaactgatgaacagagtggtgcatattatcagctgattcttatattgtttcccttccatctcccttaactttggtggaaatggaataaactccacagtgtatgatgcagaaatatgttaatacaatgtcagttagaggtgatttctcatattgaagagcaagtggattgaggagcaccatgcttcatcaagcagtggtgccacaagtcttaagtttataaaatacccactgaaaattctcatgggaaggcatggggctctgcaacaggcactataataatagggatagcggaaaaaaaattctcagtaaataattgcttagacacaaaccttaatttctttggatgtcagtttttgtgtttaggagataaaaaagaaaattttctttatttctatctctgatctttgaaagtttcttgagaaattcactggtaagtgaatgtggtagaaaacaccataatcattgaggaattggagtcccaagatgttcagtttttgttttagggagtgcagtttaatctgaatgatttatgtgtgtacatggcaaattccagattattcgtcatgatttttttaaatagaaagagaccacaggaactccctctaccaggaatatagaacagggatgttaatactcagggtacattgccctgggttttttttttctggacaattttaccagggtggatgtttgagggagggctcacaaagaaagcccagagctgaatcttaatttatttgtgtattcctgcttctaagctttctatatgttacttaatctttcaggcttagccaagcattattcctatttagctgataaggacagtgaggttcagagacactaggtgatttgcctttattcacttgacctcctagtagcaaacctagtattttaatctgcttcttatgatttacaaaccaggtcctttctgatggactgagctgcttacatagcatgacaacctacactgtttataatggcaaaattactgtgtgaaacaagtccgaaggggtagaaatttccttagctggagctgtttgaagctgaacttggatacgggtagctttagactctctctcagcccatgaagaaattgggtttggtcactaggggcagattttctgaggccattagggaataatgttctctttgatggacttgggaacttttgtctctggtgctgtgccaaaggcaagtacatagtttatttggaccctggtgcagaagatgtcagatttgttgcctgatgttgggcttggatttgcgtgcatgctgtgtatttttatcctcagagaaatgggttattgaagcctgtgccattatgtctcatcaatgcaagaagcttggagacctaagcattgtgcctacccatgctatttaactccaaagcagtatacttgtgaatatatttgtatggattcgcagcactttattctgtataacaaactgatcaaagccatctgccacctgttctttttaaatctaatttgcaaatggaaacttacagtctggctcacagtgggatatgaaagcacatctggcttctttttctcctgggccctttatctactgtaataaaagcagctctctcattgcactcatagaagagggaggtgcctttcaaagtgccacagtaaataccgtttaccctgcagacagctcttaaattttttactccccctctgctcttgtcagcagccttacagctactccttaattttctacttgatgagcactaatttttttttttaaagcaaactttgggagctaagtaaggccattggggtgagaaatgggcatattcctagtggagattatctttagatgtatttggggtatctctaaatgactgaccacaaaattgtgggaataccctggagactgctcatttgtttagcagattactatatcttagactcccctgaaccatcgttgttatcaaaatagaacttgccttgacccaaaattgcttggtttgcattgtttacagtactaacctttcaaaactttaaaagaggtaagagaaaaaagggagtgattgctttttaaaaggcagtgacaattaccgactgttatgatacagtcccagcctcagtctggaggttgcagaaggcaggacatgttgcagtttgtcttctcgattttgttgacagaagatgtcctgtaggatgaattcagttttgccttagtgttctctgcagttagcatttgcagcttcctgtagatgtcattttctcccagctgcagagcatgtgggtcatggtctttctcacgctgtcttcctactttaatgctagacacataagaagattgagccacacctcccttttttttgttggttgtgtacgtgtgttgtgaacatgtcaaccaggaggctttctcacactggtttgctgctgctgcctccctatttgtgtggccagtggaggagacaggtccttggttagaggagctgctgcccttcctttcagtactctgtgttccatgtggaaccacatagcatgggcagtggtacctgcagagggatctgtctgccaaagcagctggggcaccagaaagcctgctttgggtttcttacaatgtttatagtcaggtcaccgctctttagaatttggttacttacagttttgtattgattgttgtttctttccacattccctgattagaagctttttgtgcaatgaagccatattttatgttccttttatggcttccatggtacccaccttataatagatggtggtggtatctatgtttaaaaaatgggctaacaattttgtttgaaaagctttgagatggtctacttctgcctttccagggagacaaaaacaactattagtataaaagaataggaaagaatgtttttattttattttgttacaaaatgcatactatgactgtagggtaacttatgtaaagggagacttccttaaggtaaaggctttttggacaaagtttaaataagtacatatgatatatcttgctacattttaggttacccacttagaatatagttcttggcagcactggggaggtccatttttatttctttcgtgattcccaccaagttaggtcctgatgccttcttctgagagataaggcctgtaagagttgtggaagaattgggggctgggaatagtcaggcagggaccaaattctcccatagcagccagcaaatacgtggagcttccatttgtcctgttccttctttcttgcttccaccttcagcccctttgcacaagagacaaatttgggcactgtctccaggttgggggagggtctctgccatgcagataggggcgtctgctcatagccttcttctgtttgtcgtagcagaggtgaaaacccccaagcgccggcagccatttgtcccctttgctctgaggaaccacacggggtgcactttgtggtttgccaccctgaccaccacacccaccaggtaagcagtcagtttatattaccccgagtcatctctgccaccaaagccttcttgtgccagcccagtagagcaaggtgggccccctcttgaggctcttgggatgatatttgaatgaataacttgctgtcttgctgagatttatgatggaggttctggttttgtagagaatctatagtcagagaagcaggtcctgagtctaattatgatcttgtttttggtataccttatgtttaaaagccaagcaaattaaggatgtgagcaggaagtatgaaaaagccattccatcttttctcctcgatctctaccttctttcccattttaaagagctatgtgtggttatcacaccaaatgttttgccattttattccaagattgctttgaaaacatccccattctccctctatccctaaagaattctttcatacctaaaacgcacttcaacccagatggaattgggtggagtttggagaacaaaggagactttacctaagccaggcgagaaccttttctaacaactttctgcctgtttagatcttggctcagccttccaagtacatggtggtcgttccagctgaggtcatgaagtgcatggcatgagtaacagaatccattgatttgaaatcacatttctccgacctcccccaagtatgagactgctctagaagagaagcttttttgttttaacagtgtaggtctgttaaattccaactaatcacttaaatgccacttgaaaaagtcatgccttaattcacatgtaccagattctactgcctgaggtaagtggctacagagtgacagctttcagctgtttctaaaatgtcaaataagttgtgattcagcacgaagatagctatagttagcgaccctcaaggtcattctttgtagctaggtcatgcagccttttattgctgggaattgagttgtgagaaggttctgctcttctgcacggggctcctgtgagagggagctgggaagaaacagggacaggctgatgtcatctgatttggttccagagctgcactctctcacagtgggagtccaggggtagttccagaagggaacggaacatttctcgatgatactcacaatgttagtgaatggcgagaagtccttacaggtgaagagattccctttgaatttgaagcaagaggaaagttaagacacaggtaaagtatggtttattcttttctttaaaaaaaagaaagtggatgtaagtgagggtccctagtgttttgtctttttactttccttataaatgattttattttattttattttatcttatcttattttattttatttttgagacagggtcttcttgctctgttgcccaggctggagtgcagtggcacgatctcagctcactgcagcctctgcctcctgggatcaagcaactctcctgcttcagcctcctgagtagctgggattacagggatgctccaccacacctggctaattttttatttttagtagagatggggtttcatcatgttggccaggctggtctcaaaatcctgacctcaagtgatccgcttcggcttcccaaagtgctgggattacaggtgtgagccaccacacctggccccttattaatgattttaatgtcttctttttaaaagatatttcgtaaatcagtgtttccttttattattttattttattttatttttgtagagatgaggtctcactgtgttgcccaggctggtctcaaactcctgggctcaagcagttctctcacctcggcctcccaaagtgctgggattacaggcgtgagccactgcacccagcctccttttaaaaaataaagactttgctgccatcttggaaatacatgtcttttcattaactatccatttatttgacatatgaggtgataacctgtgtgtttcacagaatttggtggaaacatagacatatcataaccctcaagtttattgcatcttggcctgattttcatgatggattggtgatatggtattcttaaaagattctcaaagcatgttgatttcaattttaatttacatatatgccacgtagtacttttaacaagcagctagtttcaggactcaaagctaataagaagacaaattctgattctaaaaagaactgatctggggagactgctagctgatgcattcctgaagtacccatactcaaaactggaatgaatgtgagaaaatgttctatctgattactgagagatcataaaatatccaataaagtgttgtattatttacaagtatttttctatgcacaggctatccagtggatatgaataggttaagacagcatttgaataggttaagatttagtatttgagcctcatatttgttttcaagctgagctgaaattgaagagattggctttagctttctgtaatcatgtgctttttgtggtgctttcagttcctgagtgtaaacttgctcccaagtcaagcaggtttccttttgcatagctttggtacccacacacattattcccaagaagcaagagttctgaacgtgtgggtctccagggattttatagggaaaaaaaaaatcactatgctgggcacacatgtgcttggaagccactttagcttccaggtaagagcagtgagcattttcctgttggtccccacagttcttggagaagctaactacagaactgttgggaacatttctggataagcccatcctctgtcatatcagaaagggtttgacctctttgtcatttctgtttttgtttccgtatttcataatccatttcaggtcccactattctgcttgaattcttcaaaataaatgccttttctggctttttccccttttggcacactgcaccccactccttgcctccctccccgcttcctgtcagcctcaaatctagttccccatttcacttctggcttgaattaggcaaaatctaaaatagaattaaatgtgcagtttcctcctgttcctcctgttctgcccactgccttctgctccagtttcagtcgagcacaggagccctgaaatgagcgctgtgcctctcctgccctgtctgtagtcacgtagggctggagccaaacaactgcatgtggttctgagcgaattaggatttcaacaaaggaaccaagaataattttttatgcatttccaagagtatggttatatgattaaatcgctactgcatttttaccaccccagtgacatcattatataggttggggtgagggttggtgggggaaagaccttggctcgtgtttaggttttgcgtggtttgtacaatggaggataaatgccactcttactcagtcaagctttacagatcttgcagtttgtgttgtaagtgtaaaacccagttaaactgtgctcctgatttcccttgcattaggtaatctccaaaaggtttagccaactgggtttttacatcatatgtactaaatcagatttgtgtctttgcttctacttttcatcccttctggagattgtgcctaatatctttttctttgttctgcctgacagacacacccatgacctccggattcatcaactgcaagtgagagtaaatggctgggagcaagtgagcccagtgtctgtggacaaagtcgggaccttttttcgatatgcagcaccagataaaaattcatcttcctctacggtgtgtgacattcaggaagtcagatggttaagcgactgtcaggaagtcagatggttaagcctgtaataagcttactctaatgaaactttcttgttctttctttcccctaattctaggactgactgggtcagtcataggcattggtaatcaatatgtagataagccagccaatggttagtttcagtagaaaaacaagatttaaaatcagcagtaacacatttcctcacctctgtagatccatttcatgctagctggcctgactggcagtttactagtctgctgaacctgagtcttgtttttatttcacatattgttatgctgtccatatacactgtgtttttaatatttcttataatgcagcaccttgatccttttactctgtgtctccaaatctttctctgtggcacaaagagagatgtccactgtcgtttattttctgatcacacatgctctcacatacccttcctgcctgtagtcccagtggttggagggacagcccaggaaatgatgcaggtggcatccctgacttgtacatgcaggtggaggctgacatcctggctgacagagctgccatgggtcctcttgccccatcctccttcatacttcatggaacacttgcacttatttttgggtagccagtagtgaggtggaaatgcagacgtgcagagatattgcagctttcttcatgaaaaatattcttagaaaacactgttgcacaactgtccatttttactgttgctcttgtgccccaagtttcttacaaaaaaacaaaaacaaaaacaaaaacaaaaccttttcaggattacttttcagcctaagtttatgtctagtaatgacaggaccagttccctcataggtacctttcttactgcattgatgtgttggggagaaatttggcatacgttgaatggttataaaatgaatattgttttttccatatctttaagaggagatgttttatcttcatagtagactatactttacttgaaagtatttacaaacacgaccctttgaagaaaattatgttgtcattgaatttaacgttgctaattatcttaagtctgtgctgactctaacttttgaaatctttttcagattggcagcccaagcagcagaacaaatattatacatccccaggtttatgtaagtatgattttcctgttgtcattgtgtttattgcgtatatacactgcacctgaatcatgtggatatacatttcttaatgatcagagaaactttatgacatatatgcgattgaaatttatctctgcccttttctattaatgattaccttccttttccaaaaacttgcaagaaaatgttttcacctagcttggtgtgtgagactaagtattacagggaaggagaaggaaaaggcaaatgtttggtccaaggtctccttttcattctaagttaaaatagaaatgaaccctggtatgaccatatgtgtttcatagttttgggtccaaaggtcatgaaagtaaataagaaggaaaaagtagcagtttatttcctctttggcttttgaaacatcatcacgaaatgacattaacaaacttattccaggcttttatttataatttcttctccctgatgattgtaggttttgaaacaaaatttcaggtaggcctgaacaatatcaaggtttgaaacaacatcaggatttcttttttttttttgagacggagtctcgctctgttgcccaggctggaatgcagtggtgccgtctcagctcactgcaacatccgccccccgggttcaagcaattctcttgcctcagcctcccaagtagctgggactacaggcacctgccaccacccccggctaatttgttgtatttttagtagagatggggtttcaccgtgttagccaggatggtctcgatctcctgacctcgtgatctgcctgcctcggcctcccagagtgctgggattacaggtgtgagccaacgcgcccagcctaggattttaagtaattgttactggctttgactattggggccttttttgggttgggtcactggaagctggagcttcgatgatgatttatgcctaggattgtgtccttctaaaaacactctagaaaattgtagtttgcctttttgtttggacttcctagaagtcttggttcaaaacatggagctcttcattttattgtttattggattgactttcacttgctgtttgtcttaatgagaaagttggcagaatgaaaagcttgaatgtcatgccatttgtttctccagtaaaaagcattgttaatatgttctggacactcattctaagagtagtactttcagactttttctttggtgtacctaacatgggatttttctacttttaagaaaatttcctgtcacatggtattagcacaaaatgtgtgttgaatgtgtgaatgaacatatggaaaaataacgtaatggcggtaacccaagaccaaaataaataattgcccttcattatgttgagtttctgaaccttggtgtcctttttatgaacaagtgattatttttaaagttctttaaaatacagacattggtttttgtgtagacatgtcaacaaataatatatggacctaaataatatattttatgacatttagaaaaaaagaagttattatttgttcctatgaaaggcacaccaatgcagacaattctttcttttacactttctggattttacaaagacaaatgttaatctcagaagacttccttctgtttttctgtatttgggcagtacccaagccattgtttggatattaatctaggaggaaaataacacagaaggtaaatcatttaatgttttgcaaagtcctacctcattatttctaattttaattgtgttggatgttctttatttaattccctgccagtagagtagaagacaagcctttttcagtttcgttgtaaggaactcaggggctttatgaatcaaggataatttccagcagatactttcttaccaaattacaggaagtttggaaaattggataggttattatcacagtctcaggtgaatgtttttaataatgtttctagaggcttaggactgatttttcttagtgacacactttgtgatatcacatctgagtggattatctgtttttgtagaactttttagaatttttttttttaacagtgtataggatgtttactccctttaaagttgaatggctttagggttttatgactgatttcactgaagaactatagtagtaataagacacttttaaggtagacattctgatcgatattattgtattttatatgttttttcagaaacataactattttgtctttatcgctctttcacagttctcttcactcccaccagtgcgggtggtctttgcagtgactatggaaggcagtgcacggaaagtcatcactgtccggtcagccctcattgtgaggaacagacttgagacaccaatggaactaagactggatagcccatcagctccagacagtatgttttgattgtctagcatatagtaaatgctgataaatacttcttgactgttgtcaagtctctttttccccagtggtatcttccccagcagtcagtatatatggtctgtcttcttttgtcctgagatggtcaatctttggggtggaggaccattgcctgaaagtgttaacccttatttctgtggcagagccagtggtgcttcctgctatcatgccaggggattcgtttgctgtgcctttacacctcacttcttggcggctacaggcccggcccaaaggattgggtgtatttttctgtaaggctcccattcattggaccaatgtagtgaagactgcagaaattagtagcagtaaacgagagtgccactctatggacacagaaaaaagccgatttttcaggtatgtagcaccactgcagtgacatgtcacttttgccttttttttttcttttggaatgactattaccattctttctctaaagacccttagagattcagttatctttatttaaactctaaagttcttattccttgagttttagttagagttcatgagaactcaagtgctaacggttggtggggtctggggaggctttattacatgggagagacagccaacacacatgctatttacacatacaagattagaagtttgtgttgtacaacagcataaagagaggacatatagagacgggaaggaaaacaaacagaaaataacgagttctcattccaaaattggaaagcaaaatcctggggtttggagttttttgaatgagagatttcaaaataatttgaaggtttatgtacctcatactgactttcttgagaactttgacaaaattgcctaaccatttaaactcctgttttcccattatacgggagtatgttactagattcagtgttggaaataatactggattgctatgttacaccctaacaaatttagactttcaacttatttaatgaggattagctttagtttcttttatagtgaagacaggcattcatttagtctaaacttagagaaaagatacaagaatagtgtaaagaatttcattatactctttacccagatctgcaaattgttaacagactaaaggaagaaatacatcaaatacatagctggagttggtgattttaacacttctatttcagtaatttatagaacaaagaaatcaataaatatgtaaaagatttgaacaatgttatcaatgagcttgttataatagacatttatatacagattatacattcttttcaagtatatgtggaacacttatcaagagagatcatctgctgggccataaaacaaagatcaataaatattaaagaactaaaaccatacagaatgtatttcctgatcacaatagaagtaaactagaaataaacaataagaagatacctaatcccaaatattgggacattaaacaatgtatttgtaaataatccatgggtcaaaaaagagaaatcacaaaggaacttagaaaatattttgaatcaaaaggtaataaaaggcagacatgtttaaatatgggggatgcagcaaaaccagttccgagggtagaagttatagtttgtaaatcctcatattagaaaatggggaagatctttggttaagtctcaattaatttaaaaaaagaaaagaaaatgaagaatatataaaattgctgatttaatcttctgccttcagaagttagttaaagaacagcaaattcaaaacaaataggaaaaggaaacaataaaaatatggatggaaatcagtgaactagaaaatagaaaatcaacaatgtcaaaattgacataaatttgacaaacttctagcaagacttgctgaaggagaaaagacagaacacacaaattaccaatataaggaatgaaaaaaatgaggcactattacagatcctatagacataaaaaggatgaaaaggaggtaagaacaattttatgccagtacattccagatgtaaatgacacctttcttgaaaaacacaagttatcaaaactgatacaaagaagaaatagaaaatccaaataacccagtatctaaattaaaagaacttcaactgttagaaaagcctttgtccacaaagaacactataggcccatataacattactagtgaattctaccagacgtttaaggagaaataataacagttttacacaagatctctcagaaaatagaagaggaaagaacaattccgaactcattttatgaggccaacatatccctaataccaaaacctgatacagctactatgtaaaaactgtgagccagtgttccccatgaagaggtgcaaatatcattattaaaaattttttcttgttttttttgaggtggagttttgctcttgtcacccaggctggagtgcaagagtgcagtcttggttcactgcaacctccgcctcttggattcaagcgattctcctgcctcagcctcctgagtagctgggattacaggcgcctgccaccatgcccagctaattgttgtatttttagtagagatgaggtttcaccagttggccaggctggtctcaaactcctgacctcaggcaatccacccaccttggcctcccaaagtgctgggattacaggcgtgagccaccgtgcccagccaagtttttctttttttgattgagacagagtcttgctgtgtcacccaggctgcagtgcaatggtgtgatcttggctcactgcagcctccgcctcccaggttcaagtgattctcctgcctcagcctcccgagtagctgggattacaggcacccaccaccacaaccggctgatttttgtatttttagtagagatggggtttcaccatgttggccaggctggtcttgaactcctgacctcaagcagtctgcccactttggcctcccaaagtgctgggattacaggtgtgagccactgtgcccagccctttatcaaaatattatgaaatgcaatccagcaagtggtttatcccagaaatttaagattagcttaatatttgaaaatcagtaaatgtaactcatcatattaagagactaaaagaaagtcaagtgcagtggctcacggctataatcccagcactttgggaggccaaggtgggcagctcacttgagatcaggggttcgagaccagcctggccaatatggtgaaactccgtctctagtaaaaatacaacaaattagccagacatggtggtacacgcctgtaatcccagctactccagaggctaaggcaggagaatcgcttgaatctgggaggcagaggttgcagtgaactgagatcacaccactgcactccagcttgggtgacagagcgagactctgtctcaaaaaaataaagaaggagtacacaggccacagaattggaaaaatacatatatctgagaaaggatttttgcatggagtacatgaagaacttcctacagatcaacaataaaaagataataaaaagaatagacaaaagaacggacaatttacagaagaaaatacccagccaatagacaaatggaaagatgctcagtgtgattattcactagggaaatgcatacagtgggtaatgttttactctaattgaaatggctgaaataaaaaaagaatgacaacaccaagtgttgacaaagatgtggagccactaaactctcataagtagctagtaggagtgtaaaatggtataactactttggagaaatgtgtggcaatttcttataaaagttaagtactggccgggcacagtggctcacacctgtaatcccagcactttgggaggccaaggtgggggatcacctgaagtcaggagttcgagaccagcctgaccaacatggtaaaaccccgtctctactaaaaatacaacaaattagccagacatggtggtgcactcctgtaatcccagctactcaggaggctgaggcaggagaatggcttgaacccaggaggcagaggttgcagtgagccaagatagcactattgcactccagcctgggcaataagagtgaaactcagtctcaaaaaaaaaaaaaaaaaaaaaaaaaaaaaaaggacccagcaaggccactctggggtatttacctaaaagaaatgaagatatatgtccaaaaaatacttgtacaagaatgttcatttaaccctaaactgggaaaaaccaattggctatcaagaggataatgaataaattaacagcaatttattcataaccatggcatactactaggaagtgaaaaattatcaaagaggatgtatagaacaacatggctgaatcttgttgagactttaagttttagaagccagacataggccgggtgcggtggctcacgcgtgtaatcccagcattttgggaggccaaggcaggcagatcacgaggtcaggagatcaagaccatcccggctaacatggtgaaaccccatctctactaaaaatacaaaaaattagctggacgtggtggtggtcgcctgtagtcccagctactcggaaggctgaggctgaagaatggcatgaacccgggaggtggagcttgcagtgagccgagaccgctccactgcactccagcctgggtgacagagcgagactgcatctcaaaaaaaaaaaaaaaaaaaaaaaaccagacataaagagtagtacatactgcatgattccacttatatatatgcagttctataacagaaacaactaatccatagtgataaatgttagaaaggggttgcctgaatgatggaggagaatatcgattggaaaaggacatgagggaactttctggggtgagggaaatagcctataatttattttggatggtgtttatagaggtgtgtataattgtcagagctcatcaaactgaacatttaaaatctatacatattattgtgcatttatatcttaataaatgtatttggattgaaaactgcaaataattttactcattgaaccatcttaatgttattctttctcatacttagctaaggagaaaaaatttaagttcttcattaagtctgatgatttttacaccattttatcttcataggttttgtgtggctataaagaaagagaattatccagattatatgccctcaaacatattttctgacagtgcaaaacagattttcagacagcctgggcataccatatatctcctgccaactgtggtaatctgcaacttgctaccctgtgaacttgatttttatgttaaaggaatgccaattaatgggacgctgaaacctggcaaggaggcagctctccatacagctgatacatcccagaacattgagctgggtaagaatgtagtcagatgatcatttgtcataatcctatgaaaatatcaatgagtattttgtgattatttatttggtaagcatcttggagaaattggggcacatataatatctcaataagccagctcaaaggaatcagtgcagttaaaaaaaaataacctttagctagaggtggcggcagtacatgcctgtagtcccagcttctcaggaggctgaggcgggaagattacttgagtctagaagttcgaggcttcagtgagctatgttcacgctactgcccaccagcctgagcaacaaagtaagaccctgtctcttaaaaaaaaagaacttatagaaaaggatgagaaaaaacttatcaagccgaaaggtttacagaggaggcactcaacagagccttttttcttacattgctacatgatgtatgattgtaggaagtcatttcatctttttaaactatgcttttcccaagcaaaatcttatgcctcttctctttttattgaaagtataaacgtttgctaagcactcactctattccaggcatacctgggctttttcacacttgtaatctcatgtaatccttatagaaatagttatttgccccattttactggggaagaaatgggggtttggaatgcatcaagtaattttcagttgtaagggttgttaaaaggaaaagttcagccaaattaaatttaaatgagtttaactgagcaatgaacaatttgcaaattgggcagcccccagaatcacagcagattcagagagactccagggatgcctcgtggtcagaacaaatgtataggccaaaaaggaagtgacgtacagaaatcagaggtgaagtacagaatcagctggattggttacaggttggtgtttgccttatttgaacacagttggaatactcagcagtgtatgagtgggttgaagtgtggcccctgggattggccaagactcagctgttgttacaggtgcataatcctaaatcaggtcttcaatcttgtctacctattaagttagctggcagttcatccacaaagattcatatagaagtacggagtcctcaggccatatttagtttgctttaacagggtgaatgaagtcaaagtagagaatcattgtcatatttgcaacacttgaaacaaagaggaatggtgatcatggttaacaatattgtatggtgtatttcataagagctagaagagaggatttttagtattctaattagaaacgatgaatgtttgagatgatgaaaatgctaaataccctaatttgatcatttcacaatgtgtatatgtattgagacatctcactgtacccccaaaatatgtacagttattattatgtgtcgattaaaaatttaatttttttttgagatggagtctcactctgtcacccagggttagaatatcaaaatatctaatttatatctaatcatatgggttaggatatctaacccatatgattatgcaatttaggctctctagtgtgattccaggccttctggtttgcttatattgatccctaccctagctagagagaaagagccattctaatgaagatttttgcagttagatacttagttattggtttttccaaaaggaatccaatttacttttgctgtgagctattttgacaaatagtgagaactctgaaagttaatagtttgtatcttctttaggggtatcactggagaatttccccctctgtaaagaattgctcattccacctggaacccaaaactatatggtgagaatgcgactctatgacgtcaaccgtcggcagctgaacctcaccatccggattgtgtgtcgagcagaaggatccttaaagatcttcatttctgctccatattggctgattaacaaaacaggtacatacaggggctgctcaagtaggtctttggcgttagtcatgggaattcagatttatttgcttagctaactaaatggagccaatgcaaatagattacttcaacagtctgagctgctgaaacattcctgcttccatcataaatgcttaatcatgctcaaaactgtctttttaggcaagaaactgagcccactaaatagattcagttttcactcttttcccgcttgatggttttattcattcaccatttgcatctctttcagatagactgggtggtattgatgtaaacttttctctccttcctaaagggttgccactgatcttcagacaggacaatgccaagacagatgctgcaggccagtttgaggagcatgagctggcccgtagcctgagtcctctcttattctgctatgctgacaaagagcagccaaacctgtgagtacagttatttatgggaaggggaaataagctcccagggaagggaagaaattagtaaaggctataatatatccgtgtaagtagaaatatactgtagataacaatcctgacttggcaggggaatagaaccatgacctaatgggatttttggggatctaatttctatgttatttgatactgaaaataaaccatttggttggtttataatgaaagctagttttattttacatgcattgaagtagttttcctattcataactctgccaacgaagagaaagccacgagttctccttctctgctctgcagtttttcttcccctgtaaacttggagcacaggcacaggagctgtcatcagaatggacataggctggttctttggtgaagccgtcagcctcattaatccaatccaggatttgtatcacatttggaaattcatcccttttacctttgaagtaaaatgtgccattttatggtctcagagcactcattgcatgtttaaaagcagggacaaaaaacaactgtgaggattagatgacatgtgcttttaatgtatggtaggagcattaattcacttttgttcttggttttgacattttgctttttacaagagtcttttaatagagctctaatcaaagataaatgggtgtatccaataatgctaaaatgccataccgtgttatcggtagaatcgtgctgacagcttaacagaaagtcttctggggtaccacacttcagtgggtactgatgtgtttacaagggaaggttggagtgtagattaccgtttgaggcatggaaagaggattgatgagagttctggatattgtaggggatgcagccagcctcttggcatgtgcagccagcccagtctcattcttctcctgaaatgatttggacagttttagatttaggacttgacatgtgtcacacagtgtgttttatctgtgaattccacagttcccaaagcatttcacatagaccatctcattggattcttcccaccatcccaatggtttaggcagggcaggaaatattgttatattttaagatgaggaaacaggctcagagagattgctacctgcccaagtttacatcgcttgttagtggtagagctggaacacacattcaggaattatgttgtcgaaatccatgacaggacactggcccactaaacagtgctttgctattgtaatagtatcaggccggctgggtacggtggctcatgcctgtaatcccagcactttgggagaccgaggcgtatcccaaggtcaggggtttgagaccagcctggccaacgtggtgaaaccccttctctactaaaaatgcaaaaattagccgggtgtggtggcgctcgcctgtagtcccagctacttgggaggctgaggcaggagaatcacttgaacctgggaggcgaggttgcagtgatcctagactgtaccattgcactccagcctgggcgacagagcaagattccacctcaaaaaaaaaaaaaaaagtatcagcccttagaagtaatgcatcatacctgtatcttctgtacatatgcttcttgtgctttttaaaatgaacccttgaaacagcagagtcaggaaaggattagtttgacttgaattctttatttttaggggaatattagaaattgcaccactttcctcatgtgttatattcatagaatcctaatgttttctcctaaagcatttagttgtagatgtcagtaaatttcacacactgttgtactgtggctgcctctaagatacagctttaaccactgatgaattttgtcactgtgctagggaatcacatgagagtgaggaagagagtcagtggtagagatggaacttgggtgataactgtattagtgtttcccaattagaacaggcagataagactttcttgtggatgaatatctacatctttgcttttctgccccacagctgcacgatgagaatcggaagggggattcatccagaaggcatgccgggctggtgtcagggcttctccctggatggtggtagtggtgtccgagctttgaaagtcatccagcaaggaaaccgcccagggctgatctataacattggtgggttacatttggggcagcgggacaatcagaaccattggctgatgacctcaggcttggaggaatgacctggccatgcattttggcctgactacaagtactgattttcttatttggcattgggtcaggtatctgttctctgaatgctacagtgatatcaacacagatctattctcctggggatctgaggagccacctaaacactgcccttttgaggtctgtggctctgtttaatttcagactcacctgtgtcaggaaagtatcagtttggcttgaatccttgtttttcgggggaataataggaacacttagcatgcctttcatcctccaagtattcccacgcattcattaaaatttgcaagccctaagagggtaagaagcattgttctccttgaaactgaaggagagaggttaagtgacctgcctagatgcaaaggggaagtctgggtcagaagtaggatcaggattgggggatacaaataaaatgcacttggtggttgtagtaattaaagcaatctccagactcactttgcttatggagatgggaagggtggaaaggggaggggaggatactgtacccatatgcctcatagccacttgagaacgctcaaaagattctctaaagggttaagataatttgattgaaatatgaatcagggtgaaaattgtagcagcgcatcctttcagtatataatttcccagcctctcaaagcaatgtttagttttgaacattggaacaccatctatgactgcatggtcctgtagaactttctgtgatgatggagatgttctattttgcactatctagtagtagccactagccacatgtggctgctgagccctggagagcacattagtgagaagtaaggcaagtatggctgaggaattgaatttttatttaattttaatgaatttagctttaaatagccacatatggctactggcaccgtattggacagtatgcacatagtgtcatagttccttcctagagcaaggaaaaactgatgtgatatcatttacatatttatcctgagtcccatggagaatcaaagatatgtttaaatgtctgaggatttattaataaaagaatcttccaagtatagtttcctctttggatttttaatcataggtttgtattcattctcccttgacatgtgaactgtcttcttaaagttgacattaagatttttaaaagaaagaaacttgatttgatcttgcagcacaggatagttatcttaacttgttctcactttcgtttgctccaccctttgaataggcaaaggctgctttatgctgagtttggctttctgctggagtgttttgcccttgatgtattttgcaaagcaagctaccacaggttgactggaagctgtagttgggacaaattgggatgggaggagcttgttccttttatagcagctagcactaagaaccacagaattcttgcagaggccagttgagcaaaccgatcagacatatgcagtgattacccatataagctgttatgctaggagcattcactaaagctcatggcatatgttttgagggctaagactgtgatttaagttttgttgatccacctagggaagggatagagggagtgggctaagataggactttatcattcttgagggtcatgaacttttgccgtatattcccacaagggaatttgtggaatctcctgcttgaatattttgaagaataggatagataaccaactccctatcaggaaagtttaaagcatagtccaaactgaaaagccagggacaggcttgccaggtagcctcacatggatctccaaaaagaacgattttgtgcctgttgatcttatcaacttattgatttatcaggggtttcccagggcaatataagatgtgaagggggaaagaagcccacctttttccaaagattgagtgtctgtattgttcagagtaccctagactctttttataatattaaattagatacatcttttgtagttagactttttattagatatcacctaactatgataatgttgatttctgacaatgaaagcttctctgcatgtcacagaaagaagtgatagggtatagttccatatcccaatattacatagcatttcttagatacagagttttagagagatttttgtgtgtgacttttctcagtctttcaggtattttcaaggcttgtgttaaaggaacatcagcattttcaagccagtttaagtgaattacggcatttacagattggaatatttataattgggattgtgttgagaaatctatgacagccggttgtcaaatgctaaggtggagttttctattttaatggttctcttgatacttgatgactgctgaatggagtgcagtccttgtatatgtcgcatcacaatacaagcaagcctgatgagggtgctgctccggaggctgactgcctggacttgaatcccagttatggcacatactagctgcgtgacatagagtcagttacttagctttccatgccttcgtttcctcatctataaaatggaaataattaaaatatctaacttagaaggttgttatggggattcagtgtaaagcctttgggggaggacctagcatgtattaagagaccagtaattattattattgttgttgttgttgttatttttattatttctatgataaatatttttatcaatgggtgaccagagctcagcccagtacgttgaatgtcattgctgtatttattgtctgaatgaatgagtgaataaattcatcccactgaattttttatttttatttttatttatttatttatttatttatttattttttttttttttgagacggagtctcgctctgtcgcccaggctggagtgcagtggcgggatctcggctcactgcaagctccgcctcccgggtccacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccacgcccggcctgaattttttatttttaaaaattgttatcagagtttttaagatatttcagtgcttttctatatttggaaccggctgtcttgagatttcctttggactgttttcttattttttcctaatacatagtaggcgctgaaaacagtaattttatagatgaataaattcttttatttatttattttttgagacggagtctcacactgtcacccagactagagtgtaatggtgcaatcttggctcattgcaacctctgcctcccaagttcaagcaattctctttcttgcctcagcctcccgagtagctgagactacaggtgcgtgccaccatgcccagctaatttttgtatttttagtagagatggggtttcgccatgttggccaggctggtcttgaactcctgacctcaaatgatccacccatctcggcctcccaaagtgctgggattacaggcatgagccaccacacccggccatgaataagttctatagtacttagcattatgtttgagctggattcttgggcaatgggctaaaataaaatactggagaagagtcagtaaagtttagaacattacagaatccaagaaagtaatctgaaatttccactgtatctgtaaaagtggcaggttctctagaaggaaattttgtgtcccaggtgtaagccaaaaagtatcatgtgaaactgttgtaagtattcagcttcataaatggaaacctaacatatatgtgactggacacctgtgtattttagttgctgttaaatggtacacactgtgtgaagaaactaggaattaaggggatgttgatcttgcctctgaacctttttaaggcctaaatgggaataaggagtaataatactttgagtacaattgctgttttcattacattcctagaaggttcaatatcctctgggtgatacagttattttctcagagaaactaagtaactgtgaaggttatttatttttgtcagaccaagagttttctctcttcatggttaactcataaaagtggttcttgttatttgtaggtattgatgtcaagaaaggccgaggtcgatacattgatacctgcatggtcatctttgccccccgttacctgttagataataaatcatctcacaagcttgcatttgcacagagggaatttgccaggggacaggtgagcagtttgcttttgaaggatgagagtgcctatttaatagcacgagttttaatgtcatcttctgtgaagactgtacgttctgtgatgcaagtaactgctctgtgcctttggtacccagatagctcctgttagagggtaaggctcagagtaggtactcagtaacacttattgtcatgaatcgacttgttgactaaagcctgtgatcctatgtgttttagggaacagccaatcccgaaggttacatttccacccttcctggttccagtgtggtgttccactggcctcggaatgactatgatcagctattgtgtgtcagactgatggacgttcccaattgtatttggtctggaggctttgaagtcaacaagaataattccttccatatcaacatgaggtaagtttgagactctaaatatagacaaaaaggtagcccctgtttgagatgcagtactgtaataacaagccttgtgtaaaatgggcacaaatatttctggctcagacagaggtcttagaacttgcaaagtccagggaagtgtgaggggataatttgatggaataaactaaaggaggtgttgcccgttttgaccatggtgtaattgctgttgtctaatccaaagagtaacactgagctcatattttgattacctgcaactttgaaaggtctgtctgcatttagatggtaacgctcattataaatatttttgtatattctgacatatttatacaaaaccttctttcatttgatgctgttctagtaaatcatctggctttctacacctaatgtggtaacactcagttcttgttaagaaaaattaaccaggccgggcgcagtggctcatgcctgtaatcctagcactttgggaggccgaggcaggcggatcacgaggtcaagagattgagaccatcctggccaacatgatgaaaccccgtctctactaaaaatacaaaaattagctgggcgtggtggtgtgtggctgtagtcacagctacttaggaggctgaggcaggagaatcgcctgaatcggggaggcggaggttgtggtgagctcagatcacgccactgcactccagtcaggcgacagagtaagactctatctcaaaaaaaaaaaaaaaaaaaaaaaaaaaatcagccttaattagcccaggatgatttaaactttcttcttgctttcatcaaatactttaaaaaaattatttaaaaatattttaaattgtggtaaaacagatatcaaatttactatcttaaccatttttaagtatacagttaactggtgtaagtacatttacattattatggaaataatcccccaaactcttttcatcttgcaaaactgaaactctgtacccgttaaacttaactcctcattcccattccccttagtccctggccaccatgttctacttggtgtctataaatttgactactctaggtacctcatgtgagtttaatcatacggtatttgtctttttgtgactggcttatttcacttagcataatattgtcaatgtccatattaacatttttgtttattcacctattaatgaacacttgggttgcttccacctttggctatcatgaactgctgcgaacataggttcgcatatgggttcaagaccctgctttcagttattttgggtatagatccaggtgtggaattgttggatcacatgatcattctggttttaattttttgaggaaccaccataggtttctgcagtcattgcaccattttactttcctgacaccagtgcacaggattccactttctccacaacctcaccaacacttgttttctttgtttttgacacaagccttaagtgatagtcccgcctctgtataatgggtatgaggtggtatcgcactgtggtttagattcttatttccttaatgattagtgatgttgagcatcttttcatgtgctttttggccatttgtatatcttcattggaaaaaatatctgttcaattcctttgccaatttttgaattaggttgtttttgaattgtaggaattcctattctaagcgttttatagttttagctcttacttctaggtctttgatttgttttgggttaatgtttgtgtatggcataaggtgagggtccagcttcattttttggtatgtggatatttggttttctcagcactgtttattgaaaagactctcctttcccattaaatgatcttggtactgttgttgaaaatcatttgaccctacaggtggaagtttatttctgggcactctaatctatttcattggtctatatgtctttatgccagtaccaccctgttttgattatagttgctttgtattaaattttggaataaggaaatgtgagacctccaactttgttgttctttttcaaggttgttttctctattcagagttccttagatccatatgaatttcaagatggatttttctgtttctgcaaaaaatgctattgggatgttgatagggattgcattaagtccatagggttttgtagtattgacatcttaaaaattatgttttccagtccctgaacatgggaagtcttttcagttgtgtctttagtttctttcatcaggccgggcatggtggctcacgcctgtaatcccagcactttcggaggcctaggtgggcggatcacgaggtcaggagttccagaccagtctgaccaacatggtgaaaccccatgtctactgaaaatacaaaaattagccaggcatggtggtgtgcacctgtaatcccagctactcaggaggctgaggcaggagaatcacttgaacccaggaggcggaggttgcagtgacccgagatcgtgccgttgcactctagcctgggtgacagagtgagactctgtctcaaaaaaaaaaaaaaaaattctttcatcaaatgcttttgaagttaaagaatctgaaatcagtgctatttcaacatgtttagaagcaaaatttaatcttttatactttatggtcagctctctattgagaacactattacaaaggaacagaagtatgataatttaacaatagatattccaaaatagttcttaaaatagtggttttgtttttgtttttgttggaaatagagtcttgctctattgcccaggcttgagtgcagtggtgcaatcatagttcactgtgactttgaacacctaggctcaagtgaccctcctgcctactgagtagctaggactataggcatgcaccaccatgcctggctaatttaaaaaaaaaaaaatagaaaaaagtagagacaaggtctcactatgttgcccaggctggtctggaacttctggtctcaagtgatcctcctgccctggcctcccaaagtgctaggattataggtgtgagccaccatacctggccccaagatagtatttatatttgacttttaaatgtattatctaattcaatagtgagcccttcttaattatactttgcccttgtcttttttagtgtgaattggatctggatatagtgggttttaggctatgtttttaggagctgttgggttttaaggaggtgactctagtgcccaagggagcctattgggtagggctctagcactctcatccctacctcaaccagcacttttgtctgttagcataatgtgttccccgtaagattttatctgggtgaaggagtggggagggaaaagggattctatagcgaaaaccaccattgttttgtatattccctgggtagaggcagcccctatctgttgtgtgagaattggaagccagtttggaggaggaggaggatgatttgtgtaatttttgttaatccttttaaaatggttttaacgggcagtcctaaactactgcgaacagacctatgccatctatttcatttactttcctcaccttttcatttggaaacaatttaaactataggaaagttacaaaagtagtaaatgaatatccctatatcttgtacctagatttaaccagttttcagcatcttgctacatgttgcttctctcttcacatacatgaacacacattttcctttctgaactatttgaaagtaaattaaagtcatcatgatacttaagccataaaaacctcacttatcacccaaaaatagggacatttttctaattaaatataatactattgtcacatactgatgaaatttaaccttgatatgttttctaataaatagttttcatagactgaatgaatgactagaatgtccttcatagcaactcccttcccattgatctaggatccagtcaaggatcatttattttagttgccacgtgtattctcttgtcttctttaatctagagtagtcccgctttgcccattttgtctttagtgacattgacatttttgaagactccaagcaagtttcttgtagaatgtcctattttctgcatttgggcagtgatttcctgtctgtagatttgggtcaaatattttcgatagctatactttctatgtgatgctgtgtgtttcccaccatgtcacatcaggatgcctgtgatgtctgttggtctcattattgttggtgataagttgttcttcacctggttaaggtggtatccagcaggcctcttttttgtgaagtttcctttgttctttgtaaataagaataatcccattgagggaataatttaagacaaagtgaatattctgtttcccaaaaacctttcattcaatggtttaatggttcttgaatcacttattacattggtggttgcgatgaaatttatttatttatttatttatttatttatttatttttggaaacagagtctcgctcagtcgcccaggctggagtgcagtggcacaatctcggctccctggagtgcagtggcgcgatctcggagcttctcgggaagctccgcctcccaggttcacaccattctcctgcttcagcctcctgagtagctgggactacagctgcctgccactaagcctggctaatatttttgtatttttagtagagacgcagtttcgctgtgttagccaggatggtctcgatctcctgaccacgtgatccacccatctcagcctcccgaagtgctgggattacaggcgtgagccaccacacccggctgcaatgcagatttttaaaaaattaattattttatttttatttttaattgagatgaggtctcaccacgttgcccaggctggtctcgaactcctgggctaaagtgatcctcccaccttggcctcccaaagtgctgggattataggtgtgagccaccatgcccagccagaaatgctgatttttaattctctaatttcctctacatttattcactgatatttttccgttaaggtaaactttccattcccttcagcgatttttctgtatatatacacacacacatacatacatacacgtacattacatccatccatcctcttctttacagcagaatatcagcgtataaatgttgaggaaatgggagaattagaaaatcaccattttgtaatcatattaccaatttctacttttttcagatgatggaggaacacacagtgggctgtaagttcagtggtattgactgaggcccaaacagtgttgtgattgtcagaaatatgagaagtaagtggatggcatcttgtctcctacattttatgtagcctcttttgtttccttgtcctgcagggataccttgggaaaatgcttcttcctacgagtggaaattactctccgaggagctacgtataggatctcatttagtgacacagatcagttacctcctcctttccgaattgacaacttttctaaggtatcaagtggagctgagagccagtttgactgtttcatgtgtgggagggtggagtgtgtactgcccttgacacaatggtacaatacattttcaacttgggtttaaaggaaactatatggataggttctttatatctggacaagcctagaaatccttaccattaagaggtgttttctgctggttattttgattgctaggcagccttgtccaggcagaagtaatcttttagctcccagatttatttattttggctagagtggttggttgacactgtgccttctgtagacatcccgttcaaacagaggaagacatcggcttgtcagtgacaatgggaatgggcaattctgctgttgcttagttacagtgagcattttaataaatttttcaagaaagtcaatatggaaatcattagattttattttaattatgctttcaaataataataggtcttatatgtgatgatctgtagccaaattccaaaatacttatttttttctgtattcaaaatatatcatagggggtttgggctagaaagatgccattggaaggatggaattgctccccttagatatttgacttggcaaagcgtttaaagcctttcattcaataggatatatgtatatatgtgtgtgtgtatctgtgtgtgtgtgtgtgtgtgtgtgtagcacatgtcttttaattggtgagtttttttggaatgtgcaagatgattagaaacattcgaaaggtgagatgatgaatttcactggggcttatttcctgtgtaagattcatttaggaaggatttggaacttaaacctacaaagcactgactcacttttcagtaaccccactctgaatgaaagtcctctttgtcctctctgccatcactctaggtcccggttgtctttactcagcatggcgtagctgaacccaggctccggactgaagtgaagcccatgacttcattggattatgcctgggacgaacccaccttgccaccttttatcactctgactgttaaaggggcagggtcctctgagatcaactgcaacatgaatgatttccaggataatcggcagctttattatgaaaatttcatttacattgctgctacatatacattctctgggtaattcttgattaaattactgttcctataaagcagaaggttctaattattaacaggttttaaatgttaagcagtttcttaggagaccaaagtacaaaggaagattctttcattctttaccaaaccctgggctcagtgtctatcttaagaggtcatgtaatttaaactcttgacttttggctagattaaaatttatccaaagagtcaagacccttcttgtgttaaagatctctcccaagaattcattctagtatttaaattttctttttgctatttattagtctgttttgcctgtttcctcttttgaaactgactaatcttcatcataattattcaagtcatcattctgactctcctcccaccatcccattgagaatactggttaagcagacacctaagggtctgtcttaatattcacctaaagccaaatatagtagcttaatttcacagaaattccattgccttagaattataatcttcactgttgtttgactagttgtatttagaaaagtcagatgaagaatattgagcttattttaattctgttagattgccacgcagagattcaaaacactgggctttcagaaagtagtcattctaccaacatataaatatagcttattgtttctgtgctgaaataacagggccaattttaaagtgtatctgtgaagaaatggaaaatagcttaatctttaacattacaaatataaatcacctgatgaatagggcgtttaaagtcacattcctttccaaaatgttcggaacatttttgcatatgaataagatttttatacatgcctggggcccagaaaataatctctgggtttttgcattatctctctcatctgcttagagtccagatttcactagtaataattgaatctgcagagaaggaccattctttctttgtctgttgacgttccctttgggaacgatggtgctaggatgtttatcttgttgtaattgagtcaatatgtttgtttgttgttaatttgtttttaaagattatggcacttaacagtgggacatgcttaaggtttaatgcctgaaaaaccgaatctaaatctggttgttagtcatgtttttctccttatgttctataaattccagtagttactaagctctttaactgaagaatcctagtggaggattatgggcttaatgggttgaacctatatggaagacataaaaagagaagctcctggaatcttggtgtgcagaatctaacagcagaattagaataatcttgctgtgctaagaggttgaaccatcttttggagtatatcagatactaattatttgcattcttggaaggaataaatgatgaggaagaatagtttttttttaattttgtttttgaggtgaaacataacataaaagtattttaaagtgaacagttcagtggcatttggtacattcataatgttgtgccaccaccacctcttcgtagttcagagcatttttatcaccccgaaaagaaaccaaaacctattgagcagtcactccccattcctccctgtctccagccgcaggaaaccacccatctgcttttggtctctatgggttgacctattctggacattcacagaaatggaatcataggagtgatcttttttgtctggattctttcacttagcataatgtatctgcggtttatacacattgtagcatgtggcaatgcttcattctttttttttttttttttgagaccgagttttgctcttgtttcccaggctggagtgcagtggtgtgatcttggctcactgtaacctccacctcccgggttcaagcgattctcctgcctcagactcctgagtagctgggattacaggtgcatgccaccacgcctggctgatttttttgtatttttagtagagatgggatttcaccatgttggtcaggctggtctcgaactcctgacttcaggcgatccacccacctctgcctcccaaagtgctgggattacaggcttgagccactgctcctggcccattttttttatgaaaagtacccagtattttttgtggctgaatactatgctgtatactacatttttgtttatccagttatttgttgatggacatttggttgtttctgcgttttggctattgtaaacagtgttgctatgaacatgcctgtacatatatttgtttgagtacttgttttcaattcttttgctttatacagaagagtggagttgctgggttctattataattctaagtttaactttttgaggaaccgccatactgttttccacagtggctaaacgattgtacattcctaccaacagtgtagagaggttccaatttctccacatcctcaccaacatgtgttggtttttgtttttgtttttatttttatttctatttttgagacaaggtctctgtcacccaggctggagtgcagtggcacaatcttggcctgctgcatcctcaacctcctaggatcaaacggtcctcctgcttcagcctctctcatagctgggactacaggtatgcagcaccacgcccagctaattgaaaaaaaatttttttttggtagagacagggtctcactattttgcccaggctggtctcaaactcttgggcccaaatgctatctacctgccacagcctcccaaagtgctgggattacaggtgtgagtcactgtgccaggcctggttttgttttgttttgttttgttttaaatgatacccatcctactgggtatgatgtggtatctcattgtggcttttgatttgcatccttagtaactaatgatgttatgcgtcttttcatgtgcttattagtcatttgtgtatattatttggagaaagtgtattcaaatactttccatatttcaaatggaattatttacctttttattgttgaattgtcagagttcttcatatctggtctcttaccagatgtatgatttgcaatttttttctcccattatttttgtgagttttctttttacttttagattgtgtcctttcaagcacagaagtttctcattttggtcacatataatttatctgctttggggggaacaaagattacttgtgcttttggtgtcatgaagactagtttttaacgctgaattaatccattacctttttttttttttttttttgctaataagggttaatagaaagaggagaataatctaaataaaacttccaaacatccctaagtgtagccaggctgcaacattccataaagcttaggattctttagcttcagagaaacgtaacacgattgaattggaggaagttgattggaaccctttgttttcttttcatcctaaagggacttctgatttcttgccaagacttggggatgcagtgatgctgatcatctgcctggcagagtaaagctaatttttggtcccttgaattgtctggcttggtttttttttttttttttttttttttttgctttttttgggggttggggcagaatctcattctgtcacccaggctagagtgtagtggtgcagtctcagctcactgcaacctctgcctctcaggttcaagcaattctcatacctctgcctcgtgagtaactgggattacaggggcctgcctccatgcccggctaatttttgtgtttttaatagagacgggattttgccgtgttggtcaggctggtttcgaactcctggcttcagcagatccacctgccttggcctcccaaagtgctgggattacaggcaggagccaccgtgcctggccaaattttttgcctttttttttggtgggggggcctctaaagatatatggttatacttttgcatctgaattttaagtcactaaaattatgaagagaagaaaaatgtcagagtatgtcttctgagagatgaatcttggaactgtgtagggaaaaaaatgcaaccctgatctttctgctcttgcatcagactttttcttctatcctttaaaaaattttctttttaataaaagttttgggcatttgcttattaatacttgaatacatgtgtgagtatgtgtgtgtatacctgtatatatatttttatgtaatatatatattttttaaattctagcttgcaggagggaacaggcaggcctgtggcttccaacaaggccattacctgtgcggagctcgttttggatgtctcacccaagacacaaagagtcattttaaaaaagaaggtaagagagcttacaatcagagtttagaatacaaggtttttagcactggacgggactcaggatcacccagtgcagagtccttatttcatgatgaggccatagggacttgtgtggaacccaggcctcttggcatttccaggtcagtgttagggcggatgagtaccagctcaggagtaagatgacttctggagtgggatgtgatcaccaggtgtgatcagcagaacgtgaataataaatatatgtggaattactaagggctgggtgactgttaagcagacaagaacaaatttctaagattaagtagcaataattgtaacattttatataacattttataacttatagaacattttcagttattatttcacttgataaggatgacagctagtaaataggtaataaaagagttacattgacattgaaaattaggttaaagtgtatgaactggcatgaagaaatggacctctcctttttagttggaaaccaagtgtagaaagtttgacattttaggtttttgtttggtttgtttttgttttttttactttttatttggaaacaatctcagatttccagaaaattggcaagaattttaccaaagtggggctgtgatgttgatttgtccccttactggtgacattaacttattgcagttgattaagaaggtgtgtggtagccttttccactgagaagtgaggctactctttttctttttataatcagtcaagattttgtggcgtggtacgttgagactacataaacctcctatttgtcatattttctatatatgtatgcatatgtatatgtgtcattcagtatgggctgctgttttattcagcgtgttatctgttactgtgtcagtatgtgtatgcgtatgtatgtatgtatttatttatttttgagatggagtcttgctctgttgcctaggctggagtgcaatggcatgatctcagctcactacaacctctgcctcctgggttcaagtgattctcctgcctcagcctcccgagtagctgggactacaggagcccaccaccacacccaactaattcttgtatttttagtagagacggggtttcgccatgttggccaggctggtctggaactcctgacctcaggtaatccgcctgccttggcctccgaaagtgctgggattacaggcctgagccaccatgcccggccagtatttattttgatgctcagtttttcttatctttggccagtgggagctcctttaaccttccgtgtgctttcagcatgtgccctcactcacttccttactttctgacacagcaagttatcctgggtcaatcttatatttttccctgcaccattcctggaatttgccatttctccagggagccctcatcccttctatcagagaatggaatttagaaacctgagattcatgaattaggtgcagttgttgctattgtggtgttgtggttcccaggctctctcagaagacagacctagggttttttaatctatgtatgcacaaatatacatatgtgtgttttatgtacatatttatatactgtacatatttatttctatgtctacatatcaaaatctagcagttcacaccaatatttccaattcaagtccagtatgacaaagttcattctaattttctccctttccctatttgtacttcccttgtccagcactgagaatatgtttattgatttgatcagttcccctgaatgtaacagtgtaactcatcctccgtcaccacagttgtcccatgtcctgtatgaacaccctggtttcttcccttgggctctgatctccatgtactgggcagccctgccctcttcccaccctgtccttcgcaggaatgccctcctcacctccctctgtgatgctcccattaaacccctccccaacctcccaacttggcttcagcccctgctctgggctgccccatcgcttaggtggatgcctttcttgttccacatgcgctttaacaattccacactgggccaccccaacccccatccccaccacacacacaagccccatggagttctgccttccacagtcccatctaaagattttagaactaaattattagggaagggaggaagggaactggaaggagaatggtgcatctcagattttcaagtggaaattttggtagtttccaaattatgatgagcctggacaaatgggcaggcagtagaggaatcccagtatggaaacttgatctcacctgggtatgtctgtgttgattcccagtctgcagcatctacaggataaccgagatgcttttcctgttgtttctggtgctgtgcagagatgctttctgtttctgtgaacagagaagcaagcatgtgggaattggagatgggaagcacagcttagcttcatctctttttgcagacagaggaggcagtagcacacagcagagacagcatgatgtgtttttaggtttgagttctggctttgccacttaaagatatatagtatctggtatttcccatttctctcagtttcatttttcaactgacctcccagatttgctggaaggattagctaagataatgtacataaagtgctctgtaaagagatgtaatgataataacacaacaaacatttattgaggctctaccctgtgccaggcatgtactaataagcgtgttacatttattacacttatcacaaaaaccatgaggcaatttttctcgttgacagatcaggaaacggaggctctaagagattaagtaacttgtccaaggtcattcagcttgtaaattgtgtagctggatctcagatcctggcattttgactccaatgttcatgctactttgttagtttttaccttgtagaatgtgataaaaagctatctgtccggccaggggtagcatgtaaatgagtttgtggtaccctgatgtgtctgatgctctggaggagttcctgcctagtgggagtgtatgtgatcctggcagatctagctggagtgtaggtgtgactgaaaaggaatgatacagattgtgctagagaggcaacatagcagagcagttaagcgtgctgactctggaatcaggctgcagagattcacatgttggacctaccatctaactagttatttcactgtggggaagttacttcatctcaccgagccttaacttcctcatctatgaggagggacatatgtcactggattgtttgcagcagtaaatgagtttttttctttttttctttctttttttttttttgagacggagtttcgctcttgttccccaggctagagtgcaatggcgcaatcttggctcactgcaacctctgcctcctggtttcaagtgattctcctgcctcagtttcccgagtagctgggattacaggcatgcgccaccacgcccagctaatttttgtatttttagtagagacggggtttcaccatgttggccaggctggtcttgaactcctgacctcaggtgatacacctgcctcggcctcccaaagtgcttggattacaggcatgagccaccacgcccggcctaaatgagttgttttatgtaagtcttatggaccaatgtctagcgcatagtaagttctcagtaagtattatgacttctagtatataatggattatatagactttcatgattgacctggaagcccaactgctgtttccaaaatatttctaaagagaaaatatatttagaactagcaatctggccaggcacggtagctcatgcctttaatcccagcactttgggaggccgaggcagacagatcacctgagggcaggagtttgagaccagcctggccaacatggcgaaaccctgtctctactaaaaatacaaaaatcagccaggcgtgatggtgcatgcctgtaatcccagctactcgggaggctgaggcaggagaattcgcctgaacccaggaggagagattgtagtgagccgagatcgcactatttcactccagcctggagaacaggagcgaaactccatcccaaaaaaaaaaaaaaaaaaaagaattactagcaatcaattagcataaccttgaatacaaccaacttaacacttgtgatacaatcaattcatgaaaattggacaccatcaatatagtacgctttccttataaacattcgggacggggaggaagacctctggtaaattctgattcaaagtcagatattgagcatatcgtatagtctttatgtaattgcactcttctttaaggtaagggcaccggacggtcatcatctggaatggcagtgatcatggcagtatagctagtgtaggaggctgccccgccatttgtttctaatttctaaaaaaggaaaaaaactcggttatgaaaataatacgtttgttaaaatgcacattatttgtaatgtttggttgtttggttcaagaggttagcatattttaccctaagaacaacaaaagatagataaccatgaaagtttgaattaagcatttatataatgtggaaaacgtctaaataaacttcctatatgagaacttatttagccctagaggaagctcttgaagtgaggagctagctgtggctgcccataatggctctttctctttttgcttgtacctacttaacaggaaccaggaaagcgttctcagctgtggaggatgacaggaacaggaatgctggcccatgagggctcctcagttcctcacaatcccaataagccctcagccgcccgctccaccgaggggtctgccatcttagatattgctggtctcgctgcagtgactgacaacaggtaattttctaggcaacttttgattcaagctcattgctttcaaattcagactcagaggaaatctacaacaaaaactaagagttctataaataaagtaaaaatgtatatttttttcaatgacaaaaacctgtcatattcccaaatatgagtattgggctttccctttaaatattttaagctttgatgaaatacccatgcagatgttaagaaacttcaaacaataaaatgggtataatgtgaaaagtgattatttcttccacccaaattccagtccgtccttattctgaggaagtagtttcttttttacatcttcctaataactttgtcaaatccttcaaaagcagaaattaattattaagagaataatcagatgtatttttatgaataaatccttggattcaaattagctctttaagtttgaataagttacttgatttgcctgtgccttagtttctccataaaaatcagtgtgttttcagttaataccttatttccagaaaaactttagttgacttacaagttagaacagaaaagaatttagaaatacaacagaaaaaagactgttggaaagattttacatgtatttagcagctattccttccatactgcatggtaagttgccgttttgagaatgcaagaagccatattactgtgtgttatgaaatctttaatgtcttactttgtgtcccctcttcatgtttttccattttgctttattcctcttttcttatcaagagatacctaactgccctaggattcaagctaactacccattcagttttaagggtggagggcattagaaggaagaagagcaaagccatcatcctcatgttcccttcaggcgtgaaacagttgactcggaggtttcatggttcattgtgtattccgttttccagatacgagccactgatgctgagaaagcctgaccgcaggcgaagcacaactcagacgtggagtttccgagaaggaaaactgacctgtgggttacatgggttggtcgtccaggtcagtcgtttttgatccccaattgcagcaagcagtggttgagccttctttgaaacaaagtctctactaagttatacatgatgaattgttcagtgggaaaactagttacagagcaatacttattctattccattttagttaaaaggaagtcagagttttgttgtgcatttgtgtatttttttttttttttgaggtggagtcttgctctgtcgctcaggctggagtgcagtggcacaatctcggctcactgcaagctccgcctcccgggttcacgccattctccttcctcagcctcccgagtagctgggactacaggtgcccgccaccacgcccggctaattttttgtattttttagtagagatggagtttcaccatgttagccaggatggtctcgatctcctaacctcgttatccacccgccttggcctcccaaagtgctgggattacaggcgtgagccaccgcgcccagccccgcatttgtgtatgtttacatgggaaaagttcttggagatggtatgcaatacatgtgttaagagtgattgccctggatgataagatatgtttttcatggcttacctggactttttctttgatgtcatatattaccaatgtaattttaaaaagaaaaaaattacctatgtaattttaaaaagaaaaaaattacctatgtaattttaaaagtccagcactaagttagatgaattagatttagacctgggaagttaatggcatagctgcaagtcctctgtaaagggttctatgacatggtgagcattcgccaggcatctacatgctcttgattctgttcattttggcctaaataagcattgaattgctgtagcaaatgtcagaatgaagattgctggacagtttcctcctcagccagtctacctcatgataaactcccagctactttctaagcaaatatgtgtttggcaaattaccaagggtttggattttctgccctttctggcttcaggctgggaatgagaacaggggtctgagaagtaggaaggtgtctaggaggtttggacatgcagtagactagcacctgcaattgtgtgtgcagttctgtccagcctgggattttacacaaaagggaaacaggagactatcagactcttgatagagaactctgagtgtacttagattgtactccagggcagtttgcaaaaactgtaaggagcctctgactgcttttggtgagatttattttctttatctctatcgccctgagcttttttcatcaaagacaagctgcttacttatatgtagcacacatctggaatggatttgtgattttcaattagcaatacaattcaaacttctagaggcaaagagggcttgttataattggtgggtttcatgtctgaccctgacttcacttctagtttgtttctaaagcccatgtaattccaatgctcttggagcattttcttccttaaaatctttttttggtgtttgttgttttgtgaatctatttcatcatttccctgcttgttagtgacagtataataacagtattcagcagagcagaatgtgttttggttagggaagtaagcttgtttcaatcttattatgctgaataaagtcattgaagacattaaaacattttctgacactgctcttattaggttgtatatgctctttctttctaaacttataatagctataaaaagctttctttgtgttgaaacctgtactataaaccctgctcaaagtttgcttttcatgagtcaatatttaaaagttaacaaaggggatttagacactctttgccattgtcttctctagccttgtgtttgctttcccacagccataatcctgtagactcgatttacttggggcatgtagcaaggtgttttcctccaaaggccttgttaaagcaaactaaatatggcctgagaaggactccgtacttctataattgaatccctgtggaccaactgtaacctagagtaatcggcaggcaagattgaaatccttacttaggagtatgtgcctgtaacaatagctgagacttggccagtcacagcagccatacttccaccactcacagatggctgagtgttcagactgtgttcaaataaggcagacgccaacctgtaaccaatccagctgtttacttccaacttctgtacatcacttccctttctttgtctataaatttgttctgaccacgaggcatccctggagtctctctgaatctgctgtgattctggaggctgcctgatttgtgaattgttcattgctcaattaaacccctttaaatttaattcggctgaagtcagtcagtctgtctttttttctttttctttcttttcttttcttttctttctttctttctttctttctttctttctttctttctttctttctttctttctttctctctctctctctccttccttcctttcttccttccttccttcctttctttctctttctttctttctttcttccctttcttctctctctttctttctttttctttctttctttttccttttcctcttttcttttcttttgacaaagtgtcgctcttgttgcccgggctggagtacaatagcacaatctcagttcactgcaacctccgcctcccgggctcaagcgattctcctgcctcagcctcctgagtagctgggattacagttgcctgcaaccatgcctggctaatttttgtatttttagtagagatagggtttcaccatgttgaccaggctggtctcaaactcctgacctcagatgattcgcccgccttggcctcccgaagtgctgggattacaggctgagccacctcgcctggcttgaagtttttcttttaacagcctgaataactgggtatcaggtgacattctcaactctgtattccattctagaagaaacaccatcttttgagtatttggattggttgtccagccataggcctgtttggggaggttttcaactcaagaattttcctcttactggaaagctgaatgattataataattattttctattttcagaatatttcagatttttaagcaaaccctagtaagaatactcaaagaaacagctagttttggctacttttttagaagtttattttaatgacaagaagttagtactagtaaaaggcagaattaaactgatctatgcatgaaattatctcttattcataattaccaaaatttatgagcataacttttcatcttactgaagtaattctcctgtttttcatcatctgcaaagctgaacaaatagtaaaggctttgttgcacattgatcatgaccctccagaggagaatgtaaatttaggaacttgtttgaaatgatgtgttaacttgtcaaagtcagtgcctctgtcttttctcacatgtctctactccaatgtcttttaggccaaaggaggactttctggtttgtttgatggagctgaagttgttcttggtcctgacacttccatggagcttttggggccagttccacctgaacaacaatttattaatcaaaaaatgagacctggttctggaatgttatccatcagagtcatcccagatggaccaactagagcactccaggtgataatttgtcataagagctgatgtgaaactctgtacttcctccacccccaatgattactcatttaacaaatacttattgaacatgtttatgccagatatgaagatatggtatcttcatctgtaaaatggggataggatctacctcacaaagttgttacaagaactaaagtacaacaaaaagataagcgtaaagtataaacaaagtatcaatgaaatatgtggtaacctaaaaaagtataagatttaaacaagataatgttaacagtgcatattaatagtgttgttaattattattaataacataatatcttaataacattaacaacaagaagatatgagatccttaatcagataattaaaatattgtgttaatgagagtaggagtggagggtgtatggaaaggatttgtattcccagatttagagggtggggagcttcctaagagaagtagtacttaaactgagacctagagtttaactgaaaggaattagccaaatagaaaggtacaggtggaggggctgtgccctcagtaataagcatgttcatcaacaggtatttactgagcagctacttgagccagcacaggtctaggtacggaacatttaccagtgaacggacaaaactccctgccttcttggagcttacattctagtggggatggaccatcattgaccaataaacataggaagtaaatgacatacgatgtggaagttgactagtgaaggcccacaggtagcagagtgatcctcagcccaagtggcacacagaatgtggtaagaaagaaggctggagatagaagcaggggccagatcataaaaagtctgagatacatactaaagaatttgtggtttttctaaggcaacaaggagtcagggaatggcatgattagaaaattgttttagatcacttcctctggctgcaatgtagagaagcagagtggggcaagactggagatagtgaaataccaggtaggaggctcttgcactaatgtaaatgaagggttatggtggcctgaactggaagaagtggcaggggtggacatgaggaggctggagagaaatggatagaaatgagagcttacttaggagtagagtcaggcagattttgtgactgaatgtgggaatgagggagaggaaggagtcagtaatggcctccaaggttctgatttgggcaactcacaggatgataatccagatcactaagggatgaacatggagcagacttgcagaggaagggaggagttaggttttggacttgttgagttaaggtaactgtgtgatatctatgtgaagatgtccataagtcattgtaactatggctctgaaacccaggggagagatctgtgatggggataagggtttattaggtcatagcgtaatcagaacaaaggaaaaaaaagatgttggaatgtagcaatgagctctctgagatagtgcatcacaattcacaacaccactttttatttatttatttatttatttagctatgtcactctctttcacctaggctggagggaagtggcaaaatcatagctcattatagcctcgaactcctgggctcaggtgatcctcccacctcagcctcccgaatagctggaacttaagtgcatgccaccatgcttagctaattacttttcattttttgtggagatagggtctcgctatgttccccaggctggtcttgaacttctgggatcaagcgatcttcccaccttagcctcgcaagtagcttggactacaggtgtgtgccactgtgccggctcacaataccactttaaaaaacaatcttaaggcaaaaatgaatgcagtgatcttgaggtttgcatattttgacttgagctataatttgagatcatctgcagatatctaaccccactacgtgaggctctcaaggtgtatagcttgagtttgccatgcagacttgaaaccaagtttgcttctttattacacaaatcttaccttaccagtgctttggaaaccattcgcttccataggattattgattatataatgacttttgacctacacagttgttctgggttagaataggtttcaataaggaagagtgaatcatcttcttgtggtgttttatttgacttcagataacagatttctgccaccggaaaagcagccgttcatatgaagtggatgaacttcctgtcaccgaacaagagctgcagaaattaaagaatccagatacagagcaggaattggaagtaaggtctaaatattgtgaatttatttatttgatcatcagttttttagaattttacttggtggtattttagaccttctgttttctttctatcctgtatgattctaaatatgagttacgcttcacagtgtttactgtttatcagtgaatgtgtgaatgtattatgtaaatgacaacaaagtttatgtggaatcagcatgtagtaagcattgctaaactattattacaataaaggaagctaaattgtttgaatttcagtaagatttaagacaaacaattttttgttttttgcttcagccatctctgacatcttccttctgttttctctgtttgggattggagagtgacaagtttgaaaaggaagatgagatgaacatgaaaaagtatatttatctgacgtttattcagtgatttttgaaaaaatcaaatgcctatgtgtaaaacactgtgttgggtgctatggaagtgtagtggataacagattatgagctttcatcccaaataaggtgaaagattaccaaataattagatttctataatgaaatgcagaatgtcatcagtcctttgatagaggtatcatcacatactctggagttctcgttggggtgaagggtatgcctagaaagcaaggcttccagtgagatgatagcatttgagccctccaggtaaataataggactcccctaagtggttttcatctgctgagagatcgggagtagaggaatgtaaaatgctttattttcttatactctcctggatactgtgagctgtgtttaaaacaatcagggtgccatattttggtttcctttcaggtgcttgtgaggttagaaggtggaattgggttgtccttaattaataaagtcccagaagaactggtctttgcaagtcttacaggaatcaatgtgcactatacacagctggcaaccagtcacatgcttgaactcagcatacaggatgtacaggtaagggggaagttccaaagctgttagtcaccttgttttcatgctgatcacccaaccagatctaatgtttgatgttctaagaactttaatgttttggaggaaatatcttgtggccttcaaaaaatcattctgtgaaatagttgtttctacctacattcgtctcattaatttttctacatacagcagaattctgcatatattagaggtaactcagtcagggtgtcatggaggaaggtgacccatggttcaccatcttgccaatagaaaaaccaataggaagtcatctaaccatcattcggagggattgaggtctgtcatagggagaacaaactaaagaactggactttgctttcagtcaagatggagtaacagggactaaatttaccctcccacctgaaacaaccccagaatccagataaataagaagacaatggtattgagacactggacatcagacaatgaaggacagtgctttgacaggtgggaaacaaacgagctgagccctgtaattgcctttcttaccaatttgagaacgtttccagggaggggagaccaagcaagtacccagcacagtggagaagttgagaaaacagagctgagagtctagagagaccaaggtatctatagttataggatggtacacttgggcatagagagctgcacagaaaaactctgaagatctatagaccgtccctcttgagtatttagccaagtattagtcagtgatgtatgtgaggaaactacccatctgaaaggatcagagggaacagtgcctgctgcccacacagggctaggaatagtgcttgtgcccaccagctggactggaaaaactaagaatttatgagacgttgggaagagtctcaggaaagccttgccctcatgattaattagccctaaactgagcactgctatagactgcctaagaaatcataaaaggaagatccgaaagaatcaacctcttcccaagtaaattaaccatatccttgaataaagctcaagaagattattggaatatgacaatttagcacccaacaaggtaaaattcacaatatctgacatcctatcaaaaattaccaggtgtgcaaaggagtaggaaaactttctatataatgaggagactaattggtcaaaactgattcacaactggcacagatgttagaatttttggaggacgttaaaactgttaatgtaactgtattctctgtgttcaaaaggttaagtagggagactaattggtcaaaactgattcacaactggcacagatgttagaatttttggaggacgttaaaactgttaatgtaactgtattctctgtgttcaaaaggttaagtagcaatatggaagacataaaaaaactaaagcttgtagagattaaaatgtaatgaaaactacactggatggaatatagcacacaactgtgaaggaaactataccaaggcacatcataatcaaattactcaaaaccagtgttaaagcaaaggaacaagaaaaaaaagacatgctatgtgccaaggaataaagataagaatgacaacagatttctttttgggaacaatgagagtgggaagacaatgagcaacatctttaaagtactgaaaggtatcagcagacccatgctacaaaaaatgtaaaagaacatcatcaggcagaaggaaaaaaatagtatcagattgaagtctgttctacacaaagtaatgaataccagaaatgataactacctgggtaaatatataagattattttcttcttatttaaagtaagagtgagattcttatcaacaatagcataaaggctgaaggggagaaatggaagtctattagtgtaatcttatacatgatgtggtatgatgtcacttgaatgtagaattataaagataaacagcataaactcttaaagcaaccaccaaaataacaaagagttataactaataattcagcaaaggagataaaatgaaattaggccaggtgaggtggctcacgcctgtaatcccagcactttgggaagctaaggcaggtggatcacttgaggtcaggagttcgggaccagcctggccaacgtggtgaaaccccatctctactaaaaatacaaaattagccaggtgtggtggcacacacctgtaatcccagttactcgggaggctgagacaggagaattgctggaacctaggaggtggaggttgcattgagccaagattgtgccactgcactccagcatggtgacagatggagactcttgtctcagggggaaaaaaaaaaaaaagaaatcataaaaaaataatccaagagaaggcagaaaacagaaagcagggaaaggaatagataggacaaataaaaaataattagcaagatggtagactcaaacctaatggtatcaattaactaaatttaaatgttgtaaacaccgtaatcaaaaggcagagattatcaaattgtataaaaaagcaagaaccaattatatgttgcctacaagaaacacacattaaggataaagacacaaataggttaaaaggaaagaagatgaaaaaagatataacatgttgacccttgtcataggaaatgagaatgactagattaacatcagacggaatagatttcaaagtaaagaatattactggtgtagtcggggttctcttagagggacagaactaaaaggatatgtatataagtattaacttacatgatcacaagttcccacaataggctgtctgcaagctgaggagcaaggagaaccagtccgagtcccaaaactgaagaacttggagtccaatgttcaagggcagaaagcatccagcatgggagaaagatgtaggctgggagggtaggcctgtctcacatgtttctgcctgctttatatttgctggcagctgattagattgcacccaccagattaagggtggatctgcctttcccagcccactgactcaaatgttaatcttttttggcagcaccctcacagacacacccaggatcaatactttgtatccttcaatccaatcaagttgacactcagtattaaccatcacaagtccaccctttgtcaactgccgagattataaggtcataattacacctaacataatacagccatccttcgtacagctggaaacacaccagtccccaacccaaatactattacataaagttaatgatgcttgaatgctgatatgaagtcaataaatctatgtcacataatgaaggagaaaggaaataaaatgaagatattttcttagtacaagtgtatacatgcacaaacatgtttttaacaaaagaaagaggaaatactcatgacaattgcagtccttgtttctgcagctggtcatgtggtcatagctagtattgatgattaccctttctactacccattctgtattccctttaccttcagcaagcacctcatcaggtcatggttttgtgggattttttcctggtggagtgacccaaaccttccttcctgaggggtctggaccatttgtagtcctgcctggattgggctgttgtagtttcccattgccttaatcacagggcatggtaatcctaagagatgccctaatggatctcctgtattccatgcataatcttccttacctccattgtggagtagtagactgatttcatcttgataatctgggtcagtcaccccagccaacactgtaactcccttcttagcctcttgacctaaagttaggcggagcccaaagtgtccaggtggtaatcttaacttccagtttaatggaatcattgttttgtctcctggtggcagtgttcctccctctggaactaagacctctaagccaggagaactaatgttgcaggaacagaaagcaaaaattttgctagtggatcattaggggtgatgatgaatggtgccacttcctcttccacccattgattcctggacctctgaatcctggccatgggagaaacagtaccatatattggatgctgattcagagcatacatagccttctggagaactttgccccagctattatcatctagttggcattgtaattgtgatttcaaaaggccatttcaccattctatcaatccagctgcttcaggatgatgaggaacatggtaagaccagtgaattccatgagcatgagtccactgccgcacttctttagccgtaaggtgagtgccttggtcagaggcaatgctgtgtggaataccatgacagtggataaggcattccatgagtccacagaggtagtcttggcagaagcattgcatgcaggataggcaaacccgtatctggagtaagcgtctattccagtgaagacaaactctgccctttccatgatggaagaggtacaatataatcaacctgccaccaggtagctggctgatcacccagaagaatggtgccatatcgagggctcagtgttggtctctgctgctggcaaattgggcattaagcactggctgtagacagggcagccttggggagtggaagtccatgttgctgagcccatgcataacctccatccctgccaccatggccactttgttcatagtcccagtgggcgatggcaggagtggctggggaaagaggccgagtggtgtccacagaacaggtcatcctatccacttagttgttaaaatcctcctctgctgaggtcacccattggtgagcactcacatgggatacaagtatcttcagtttttgaccactcagagaggtccatccacatacctattcccaaatttctttgtcaccagttttctaatcatgctcttccaagtccctgaccatccatccagccaaatcattggctacctcccatgaatcagtatataatcacacatctggccatttcttcttccatgcaaagtgcatgaccagatgcactgctcgaagttctgctctctgggaagattttccttaactgctgtccttcggggatgtcctagaaaggggctgtagtgctgcagctgtccacttttgggtggtgcctgcatatcgtgcagaaccatttgtgaaccaggctctagtcttcccttcctctgtcaattgatcatggggaattccccatgaagccatcagtgcaggctaggggagagaaggcagggtggcaggagtggagaccataggcatttgagccacttcctcatgtaacttacttgtgccttcaggacctgctcgagcccaatcacatatataccacttcatttgatgatggaatgctgctgtgtacgacccactttatggctagatgggtgggtcagaaagcacccagttcagtttgcaggtgtgcaccaccacatgcagctaatttatatattttttggtagagatggggtttcaccacgttggccagcctgatctctgactcctgacctcaagtgatttgcccacttcagcctttgtttttatttttaatttgtaaataaaatctttcatttgggtaactgtaaatctatgtgatcaaacaaaacatcttattttattttattgctttttacagctagttaagtgaagcagtggggataaacacttttactcccaaaagatgttttgtgttttttttaaatattttttttgagacaagaatcttgctctgtcacccaggctggagtgcagtggtcctccctcgggtcactgcaacctcctcctcctgggctcaagtgatcctcccacgtcagcctcccaagtagctgagaatacaagtgtgtggtgccacacttggctgatttttgtattttttgtggagacagggatcttgccgtgttggccaggctggtcttgaactcttggactcgagccatctgcccgcctaggcctcccagggtcctgggattataggtgtgagccactgcatccaacccaaaaatgttatttttcttttgccataaatgactatattaagatccttggctgggcccggtggctcacacctgtagtctcagcactttgggaggccaaggcgggcagatggcctgaggtcaggagtttggccaacatggtgaaactccatctctattaaaaatgcaaagattatccgggcagtggcgggtgcctgtggtctcagctacttcggaggctgagacaggagaatcgcttggacctgggaggtggaggttgcagtgagccgagaccactcctttacactccagcctgggcaacaagagcaagactctctcaaaaaaaaaaagtccgtgatgaaattttaagaaattcttgattaaaataatattattgtataaatgttaaaaaaaaaaaaaaagaaagcacacagttcaggatgggcagttcaggttgcgtggtgacttgatgacccatagtcagatgttcattttccaccaaagcccagtaacaggccaagagctgtctctcaaaaggacagtagttatctgcagaagatggcagggccttcctccaaaatcctagaggcctctgctgtgattcacctatgggggcctgccaaaggctccaaacagcatccctatctgccactgacacctcaagcaccattggatctgctgggtcatatggcccagatggcagagcagcttgcacagcagcctggacctgttgcagagtcttctcccattctggacccctcaaaactggcagcctttcgggtcacttaataaatgggccggagtaatacacccaaatgaggaatgtgttgcctccaaaatccaaataggcccactaggcattgtaactctttcttggttgtaggagggaccaaacgcagcaacaccgttaacttagaaggaatgtcttggcaggccacacaccactagatccctagaaattttgctgaggtagaagttccctgaattttagtcggatttatttcctatcctctggcacgcaaatgtctcaccaataagtccagtgtgtttgctacttcttgctcactggatccaatctgcataatgtcatcagtgtaatggaccagtgtgatattttgcggaagcaaaaagcaatcaaggtctctccaaataagattatgacacaaacctggagagttgatatacccctgcggttaggacagtaaaggtatattgctagctttgccagctgaaggcaaattgcttctggtaggccttgtggacaggaatggagaaaaaggcatttgccaagtcagtggctgcataccaggtaccaggagatgtgttaatttgctcaagcaatgaaaccccacatctggtacagcagctgcaattggagtcaccatttggttaagcttacgataatccactgttattctccaagatccatctgtcttctgcacgggccaaatggaagagttgaacaaggatgtggtgggaatcaccacccctgcatctttcaagtggcactaatctccacaatccctccagggatgtgatactgtttttggtttactatttttctaggtagaggcagctctaagggcttccatttggcctttcccaccatactagccctcaccctaccagtcaaggagccaatgtgggggttctgccagctgttaagtatatctatgccaattatgcattctggcactggtgacatgaccacaggatgagtctggggacccactggacccactgtaagtcagacctgagctaaaactccattaattacttgacctccataagcccctactttaactggagggcaacaatgacattttgggtcccctgaaatcaacgtcagctcagagccagtgtcctgtatccgcgaaatgtctgatcctttccctttccccagtgcacagttaccctggtaaaaggctggaggtctccttgggaaggatgggagaaagattcactgcgtaaattgtcggcaatgtagtggggtccttcctcaaggggatccggcctccccttcattcaaggggttctgggtctgtaaactggctcaagtctagaaattgactgaggggccatgattctctgtttttataattcaaactagttttttgtccattcaacctagaagttttctgcttgtataaattaagtaggaatgcagcaggcttcctattaatttcgcttctaggaacaccatgattaattagccagtgccagagctctacatgagtcagactattctgattgccactttgcctctgctgtgcattatggtagctatgcccaccttgcctttgacgattgagtgctgccacttggcaacctgccacctcgggatccagttatccccattgtgtttaaattttgtagctaatgattgctgttcccaccgttagatctgacatacagagaaaagcaattacagggctcttcaaagatgcaggtgctgcccttacaaatctgttccgcaaggcattggtcaaggatatatcttctggaccctcccagctgggatgagtaggtctgaagtggctaatccactccaccatcccagtctccctaatcctttggatcccttcctgtacgttaaaccaaaggagatcacacatttccacctctctcacggtgggccatcttttaatccatatttcagctaaccaagtaaataaactattagaaccttttttacctctccaagctgcaacattaaaagcagaatgcctacttagtgggcccagatcaataaatcctgatccaaccctatgttccttccactattatcccatacccttaatatccattcccgtatctgttctccagatttctttctatataaattagagaactcaaacagttcttttcgagtgtagtacacctcctcgtgagtcacactctcaacctcacatctaggggcctgccgggactttaggtctagaagcaaacaggggtgttgggggtgactcctgaggagaatcaacattactttgcctggcagctgcctcaagagaggtcatcactgttgccttaggcagcataggattcatctcctcagacaaaggtggaaagctgatgacagcatgggttgaggagatgttgccactactggggatggggaagctcatccttctggcaaaaaaggctcatcagagtttacaaactcagtttccccgagtttcatcagggtcctcccacacatccccattccaagttgcagggtcccattcttttccaatcattgccctcactttaacagcagacatctggtgaggctgtgtgtgcatctttcggcgtgcatctttcattgcaggtcagccacttgcatgacaagagcttgtgtctgtttttccacaatttcagctctttctctgcaggagataagactctcacttagggcaatcttagcagatttgaggctcagtatctgcttctgaagctgggagacagaatccctgagttcatcattttctttcattactttgtccactgaacttaggagcaaccaaccagcttcattatgttacttggttttctacatatggtcaaaggtattatgtatagagtcactaaaatccttgcctctcatgagcggtgaatcaggagtgtcaaatgcatttattttgcataattctccaaacggttcacgccaaggactatcagcattctccatactattagaggtagagtccttagcaattttttggggggctaatcatattcagcagccaactccagaaaccccaaagccaatgaaagaactccatccttaatattctgttcctctagaaccacacctggtaccaaaatctgtattagtcagggttctcttagagggatagaactaataggagatatatatatatatatatatatatatatatatatagttctttaagatcaataaaattaataagcctctaaccagtctgagcaggagaaaaagagaagacatagattattaatatcaggaaagagagagatgccagacaagccaaatactgacaagtctggggatgggactcctgggggagctgcaaattccttctggctgctggagtgtctgctaggactgctttgtttgcagtgtgactgtagggccgttggttttcaaggctactgtggagctggggtaggggtgaagagaataggacaaattaaaatgccacagagctcgctgttctcactgagtttcagcttgttttcttgagtaaatgctccttagattgtcgcaagttttttattaactttcggagttctgaaaaagtcgacctttacaatttttggcagagtactgttagtgtgctatcagaacaacttctatctgtttgtaacatcatacttggaacgcttttcctttataagcttcatcaaagtttaaatatgttcaggaaactagttcctggtagacatttccagaagaagaatccaaagccccagactgtggttctttttcccaaatggacgaactacatccttactgggagtgtgtgcaatgtgtctcccatgactggggctccttctctcccttaacatgtcatgcgattccatccagattgtcgaggccagaacctcttttcagaagaaatttttcttttattatatatcacgaataacagagaattcaggctaatcgtatcctatttatttgtgcacagatagaaagttaatatcttgcagctatttttccttgtcctccttttttcgaccttacagagacaattcaaggaaccatttgctgttcattagtttccttaactttattctttactttaaaaagttgtttgtttgtttatttgtttgtttattttgagatggagtctcactctgtcgcccaggctggagtgcagtggtacgatctctgcttactgcaacctccgcctcccaggttcaagtgatcctccagcttcagcctcccaaatagatgggattacaggtgcccgccaccacgcccagcaattttcgtagtttttagtagagatggggtttcgccatgttggccaggctggtcttgaactcctgacctcaggtgatctgcacaccttggcctcgcagagtgctgggattacaggcgtgagccaccacgcctggccaaaaagttgttttttcctataatacctctttatgtgatgtatgctgcaaatcatagaaaataatcaggtttgtactttactgtggttacagtgctgcaagaaggaatttttaaaaatagaaaatagagatcctctccttaggcagcatccgatctaattaggagaataaaactaggtagagttagtaattctcagttacgacgccttgtgtcagatgtgtttagtgaaagaacaaaggagaagacaatatggtcgagccctttattgccatttcatatttggatgagataggtaatgattcattcattcagtccattcttactgagcatcaagtgtgtgcccgacactgtactaggttctggagatatggctatgacttcaaaaatgcaggctttgctcttgagccaacagcctagagagaaagtctgccaataaatatgcaggcaggcaagcaaatgaataatgacattctgtgataactgctgtaaagaatagctactttagataaagtgctactttagaaaaagtggctcaggaagatcttcctgaggaaatgagagctgaactgaaacttggaggaatagaatgagcaaaccatagagatggtcactagaaaccatttcaggcaattcagagaccctgaggaaggaaggacttgcccacattttagaaacaataaggaggctcaggtgaggatggtagggaacctgaaagagtggtgtgtgatgaagctggagaatttggtgccagttcatgcaggccttagaggctgtggtgagaagtctggtttatcctaagagaaagggaaaccactgaatagtgtaaaggaagggtgtgtatgactcgatttatagtttactgaaagatcactttggctgctatatagagaatacattgtaggaggaaggaatggaagtaggaaaaaatactccaagtctcttgcccttatccctgccctgagaacaaacagaagaaaagtcatttccagttgtacagaaatgtctatttggaaatccctgcaatacaatggagaggtcagaggattcggtgccagaaatctctgcatttgtatcccacctcttccacttacaagctgtgcgaatgagggcaagtagtttaacttttttttcttttttttttttttgagacggagtctcgttctgttgccaacataatttaacttcattaagcttctgtctacttgtttgtaaaatgaggaggaataatacctagcctttaggggtttaggaagtgatatgatagggggtgtgtggaaagtacctgcagatggtctcttaggggtacccaaaaagatggtctgtcctctttcctcttcctggtggtgaacttcgatgtgagacagaacaggaagatggctgcttcctgcaaggagcctctagacatccatgcatgtctgagtgtggcaagtgtcctctgtgatggcactgatactgatcagggctgtgtaaatagagtcaaccctaatgccgctgacttaatcgtttcgttcccgagaagggagttgaccttagtagaggaaactgttacaatttggtagccatttgagctcctggttctctaatttaaattgtcttgaaggaatttggagcaagagagaagcatcgatagcatagtgtttaggagtgctggccttggggtcagacagaccgagattcaagttctagttttgccactgaccagcagtgtgacctgaagcaagggcctctcttctcagcttcttcctctgtgatataaggacagagctcatgaagttgtcataaggatggcagcaaacccttagtttaaccaccagcgttacaggtatgatgtgacttgggatcatgcatatgaagtggctagcatggagcttcgcacatagtatcacctgttttatttttttaattaaattttttgtttcattcagcaggttgtggacttaaaaaattacttttttcaaatagttgattttttttttttttttgagacggagtctctctctgtcacccaggctggagtgcagtggcgctatctcggctcactgcaacctctgcttcctgggttcaagtgattctcctgcctcagcctcctgagtagctgggattacaggggcccacgaccacgtccagctaatttttgtatttgtagtagagacggggtttcatcatgttggccaggctggtctcaaactcctgacctcgtgatccgcctgccgcaacctcccaaagtgctgggattacaggtgtgagccactgcgcctggccagtagttgattttttaaccaatgaataaaaattgtgtatagttggctgagtgcggtggctcacgcctgtaatcccagccctttgggaggccaaggtgggcagatcacctgaggtcaggagttcaagaccaacctgaccaacatggagaaaccccgtctctactaaaaatataaaattagccgggcatagtggtgcatgcctgtaatcccagctactcaggaggctgaggcaggagaatcgcttgaatccaggaggcagaggttgcagtgagccaagattccgccactgcacttcaacctgggcaacaagagtgaaactgtctcagaaaaacaaaaaaatatgtatatattcatcgtgtacaacatgatgtttggaaatatttttatgttgtggaatggctaaattgagctaatatatgtattgcctcacatacttatttttttgaggtgagaaaacaaaacctattctcttagaaaagcactcccctaatgaaatttagcatctgttattatgactgcttactttattatgactgcccttttgtgaactgctattgagatcgagtgaaatgacaagggtactttctgagcaacctgcgcattatgaggccccactcaagcgtaaaaatgaaaactgagccactggtctgtttttgtttttgctttgctacctttccatggccgtaggtggacaatcagctcattggtaccacgcagcccttcatgctctatgtgactcccctgagcaatgagaatgaggtcatcgagaccggcccagctgtgcaagtcaacgcagtgaagttccccagtaagagtgcactgaccaacatctacaaggtgggctggtggaggaggctggtgggttgatgccatgctggaacgttgatttgttctctcacagccaagtctcagagcagcagtgccgggtgctgatgggaatagctctgcagggttaaaccacatgtgacataatagattgtttggaggaattgacaggaactcctccttctcagttgtgttttcagtgaccttgcaggtgacagtttgatggtactgagtccatataggccagagtccatattcatcagagtgaagtcactgtaggaaagtatagcatcttctagataggtcaggaccaggcatgatccagatctattattaaaaatagaataaccccagctgggctcactggctctcacctgtaatctcagcactttgggaggctaaggcgggtggatctcttgagcccaggagtttgagaccagcttgggaaacatggtgaaacctcatttctataaaaaatacaaaaattagctggacctggtggcaagcacctgtggtcccaactacttacttagcaggctgaggtgggaggtcctgagcctgggagtttgaggctacagcgagtcacgatcacaccactgcactccagcctgggtgatagagtgagatgtgcacctgcgcgcgcacacacacacacacacacacacacacacacacacacacaataaccctgaaatattgggaaagggctatgatgggtctgaccttgagacagacgtgctgctacctaagttaccacactgtttaccaaaagcagatagttacaaatgataaactttctttcttggaggagtctccacgcacaagctagctgttccagcagcaaactctggaaaagtgggagccaaccaggggttgcttcccatatttctggtcctttatcaccagtgctgatgggaccaagcctgcctgtagccctcggatccacaagcccagccatgctgctccttaaattagctgccatccatctgagcacacaccataaagttcatccaccacagtgcatctgaggctggaatcctgactaatgaggcccagattgcctgggaaccaaacaatagaatggcaaaccatctattaaacatcttttggagtttttagttaatcataacaatatagagagagataacccagaaataatttggcattatagttataaagccacatgattaatgaaagcataccatgtcattgaggccttcttaatagcacagatgaatgttccttctggtgttcacactttaaatcagaatttctttatctctagcatctgatgatcacagctcagagattcacagtgcaaattgaggagaaactgctcctcaagctgctaagtttctttggctacgatcaagcagaatcaggtaatgttgaatgttctatgtctgtgtttgggaattggtccaaagatggtatttttgagtctgtttgtaaaaataggtagccccttggtgtctgataggctccctttccacatctcagcctgagctaggaagctaaggcttgtgtttcagttgtgctttttcaaagtattacttgttgtctgagttatctctgtgaactaaaggagccattcagagggtcttctggaatcctggagtatccagtggtatacctttgggaagcagtatactattcctctttgctttgcatttttttgattcatctgctctaggatgacagaaatgatattagtcatttagcaaaccattttgtttcctaacctttgtttcttaaacagactccaggccaagaatcagaaatccctttggcagttcctttggtttagttgagaaaataaaattggctagcctcaattcattaacttttgacatccaaacccttgtgcctttttgtaattacaaaggtttctgcttatttactctcttctttgtagaagagagtaagataagctattgaaaagcccaggtttccagcagtgctacagaaataattgagctgttgcttcttttcgattcctcatcacagcctttccttccgctcttagatgggcttttcatggctgtgtatacagcttagaaaaaagtcagtaatactcagtcttttgaagcctaaactaaatattgagcctgaagaaatgataagaaagaggcttttatgtttatctgcccatgttggctagagaaaaaaatcactgggaatgtgtgtacacatgtacatacatacacacaatgcaagaaaaatatttttgttctttttatcccagatttagaatttaagctttaagagtatttgggatcaagagcaagatcctgtctgtttaatgctgtgttttccactttgggttggaacgccagtgtttatttgtattcagacagccacttgggagcctgcctgccaggtatccattctgttttggtaccttcctgggaagttttactttaaatttgattcgacatgcttttcttgtaaattttcttataagttgctgtaataaatttctcctcaagcatggatttagacttttgtaaaatccttgcctgcctttcactgaagtgggagctgactaaggggttgcttcccatgtttttggtatgttgtcaccagtgctgatgggatgggacagaggcagcatgcagccctcaggtccacaagcccagtcctgctgctccttaaagtacctgccatcctgtctgtagctgtttctgcttcctcagcgtaaatgggcaggtctctgttgcagtatcatttttctgtaagtagcactgatgatagcttacaacataaatgtgtttgataagtaggtatgtgccagctctctggttttatttccaaggcacgtgaagccaaggcaaaatatgctgcccagttggatgtgcatacagcatcaagtgcaaagagcacattgctgtgttgtagcccatgctactcctgctactccttttatttcatgagatggcaagtaaaaaatctgccttgattgtcctatttaaatggatgtccaccatttgggagacagggcgctgcttgtagtgatattacgtctttacagcccgcagcctgattctttttcaggcatttatgtttcactcagattcgtgaattggtgatatccattttgattcagttacactgcactccaagaccttatttggatatgatcctaggaaaataaatttagataatctgggtcattgataataacattgctaacaaatacacctgtggcctttggcttttccatctggatgattttttccaaagatgacatctgttggatggtatggagtcacaagttaacatgctagtcttcttttttgataaacaacacaaaacagatctactcttacaaagaatggcatcagaatactatacacgtcactgtaccctcacaaactaaatcgagagtgatagatggtttcctttttttgatgatttttttctatgtgaatacaaagtggattctgtggatcatgagactaagaaattcttttttgtttttttaattcttcctttgtaccagaggtggaaaaatatgatgaaaacctccatgaaaagacagctgagcaaggtggaacaccaattcgatactactttgaaaatctcaaaatcagcattcctcagatcaagctaagtgtgttcacctccaacaagctcccattggatcttaaggtgagctgctatttgggtaaatttttttagatgatttttccttggaaaagaatgagtgtgtttactatttgttgtttgttgttgtgtgtgtgtgtgcttttttttttgtccctcatcatcattcatagcagacattttatttttacagatttcctttttcagaaggtttattgacttacgtgtatttgtctttaaaaaaaaaaaaaaaacgaaacttaaatacgacattgccgaagatcaaggagtagctcaagagattcacagataattctgtaaaacccatttgctctctgtttagctcctggcttacctcagtgagataaaagcctttttcctaaagttgtgtccaggatcaagagaaaaagcagtcaagacagcatcttctttttgtgcccgaggcctgctcaccttcctacttctctcttcctaagtatccacctctttttgaatgattgtcactaggattgtctactaggagtgtttaaagtcgactcagcccacttacccactgggatatggccttctctaccaccacatcaggatgaagcccttagaccatcttgatgactacttactagacacagcctgaacaccgtcttcattttcagccataaagtttatcttcatcaaggaagaaagctgggattcaaatccaagcctgtctgactctaaagtctattttttttttcactatactatgcttccccatagaacataaggaaccagagaattttagacctgtgagtcctcagtgatgtacttgcttggtagacagggaaattgaagttcaaagtgttttgtcagtcaaggctgtgtggctaggaagtgataggagcaggagtggatccaggggtgttagaaagtctttccttagtttgagtcaaagtcagccccctgcagcttggacccattggttctggtttttcattctgttgcacttaaagataatactcaagacctccatcttcctactaaccaccagtcgaggactcttctcactgccccatgctgcctcctctaagatgctacaagatagtcatcttgctgcgcagaaacagctagagatatgagcagataagaagtaagtctagggtcctaacgtagatgcccgcaggagctgcgctggcgatgcagcgagtggagctgcacaccggggtggtgtcgtgtctgcccaaccaggagtgcctgctccatctgaaggggccgccacaacccgctccagccgcttgctgtcatggaggaatgtgaacctggtgttgccagatcttcagatttttaaagagaaaccggaaatctggatttttatgtggaatctcctggtttttaaacattggcaaccaattcaagttttttggtttttttaaaccttgtgggcctaacaaaacacatgtgtgggcctcatgtggccgtgtctgccaactcacagcttctaaaattgacacacaggtaatgagacagtagtctggtcaacatcagatcacatttgggtaagggtagggcaagggtgacagcattggggtggcaaactggggccaagccacagggagtgctggtggggacctggagcaggaatggctcttgcagccatctctggaagagtgcagcgtgcccttcactcactgccctgtctgcttcattcgctttaatttcatgtttcccaggagattaaagatacttatagttagcatgggagtgaggggaaaaccatgggaaaaccactatcttgttaatatccacaagtatccacttgacttgtgtgacctttggaatgggtttgtttgataaagtatatattcacccagagcacttggcacttgcccagcaaaccaatgtgaagcatttcctgagggttgaggacttcttgtttttaaaatcatcttactaagaaacacagacacctcactattcccttcaaattgctcccagcagaaaactccccagactgagaaaagcagtctgattttctgcagttgaagtagctccagccccccccagttacatgatggttgtgtgtgcgctcggcatacaatcaacgaaatcatttcagttgaatgtttcatctggcactgaattgaaggaacattttcagggcatttttcaaatcattgtgaaacaattacatggagcagccatgtgatgaggtgtgtagggggcacgccgagtgtagtaagttaatgtttccagcagggtgcggggaattgggactaaagagttaaattctcagcttgtgggagtcacattttactgtgtcttgagtctcctagtggagtctgggactcataaaataatgtcatttattcaaagagttttctaacagagtaatatgcctttattagtagctcttagaagggtactatgctcttttagatgaatatataatggctaaaagtgtgtgcttagaaaatggagtcctgtccctgaacaggagtcacgagagcctgactaaaaggtaaaccacgtctttggtattgaaggaataattatcttgattcttctgactccaggccagaagtgagactgtcagaaatctcagagggaagtctcttcaggtttacactgagggtacattgttgccagatatagtgtctgttcaaaaggactgaaagcagtttcacatctgctatctcaattggattccttactctgcggtggaagaatggggagataatagtcccatttcacaaatgcagagaccaaagcacagcattcctgcctgactccccattctctccattctctcaagtttgcgtgttagaaagtggccgagtgatactgaaaatgccaggtagtttatacgtgtttttggctttttttaaagatcaaaagaggccaggagcctttaaacggtttcatgaggtggcctacagcagtcctttttccatttagagcattggggtattacaaaagaagggctttaattgagcaatctagtttggaagaaaacccacattttaatggtcagagtgagagggtgggggttagggggagtttcgaacaaagacactatttaaaaagcctaaaactgtcttctcaaaggcttgaaataatttgttgggaaacttcagaccctttacttttttcctcccctccctaaataaaaaccagatttgttaaaaggaaaaaagatccagtattgttaattgtatttcagaaagtgccagagagggaaatatctctgtagttttaaacattgtcccaagagggaaataggcaaataccctgcttcacataaacagtctctatgtaccataaataaacctttaaagaatgaattccagacagttttgtttagtgcaggataaactaagaaaggaaaggacatggccgagggaatagcttgggatctgagaccttatggtatatagacaggtatttcttctttcaactctatgaagtttctggaagacttcagcagttttcgcgtggggaggtagaaatagacagtttcctatttttattaggagcttatgaacacaagattgccttctccaaaatccattttataacaggaaactgtctgctgcttgagtaaataagcatcaactttgtatactactgtatttgattagtcatttagttactacaagaataagccctgtttggctcgttccctcatctcgactttgactgtccagattaacctgaaggtggcagaataattcataccactgggctgtatctcagctttttcaaatgtggagtcccaaaagcagtaaatgactaggtaaggataacttttacttaagggccagaatatttcctcgattcagaccaagcaccttagtcattcggaaaggtaatagtgtctatgatgaaggttttgacatttcagtagaggtttcaaagtctttgctactttgtgtggttcttctttaatatttggttgcaaggacaaagttggggtataaaagctttttaccttaagcctttgttttgatctcattttctcttctctgagaataaagtaacgctcaaagtagtattggcaaaacagagtgctgaactgattgtcagtaccctgttttcccagcgtgtttattttatgactctaagcaaagcagttgagcttactgaacgttcactcagtttctccgacagtgaaatgaggaaaataaggcctgctcacgtactttatcatcactcaccatgaggtggggtgaggcatgggtgaatgaatagcagaacatttttcaggagaaataataccctccattctggctttcatgctttctacctaataggtagttgctattgtgaaaatgcacatattcaagtctaaaatcaagtagctagccatatgactttaggccatccacttaacatttcttgttttatttataccaaagagagagagagagagagggagagttaggctgaattaacttgatgttggacttttttgcggggtggggaagacagggtctcactctgtcaggctgaagtgcagtggcatgatcacagcttactgcagcctcaacctcctgggctcagatgatcctctcacctcagcatcccaggtagctgggattataggtgcgtgccaccatgcctggctaatttttgtatttttttgtagagacagagttttaccatgttgcccaggctggtctcaaactcctgggctcaagttatctgcccacctcagcctcccaaagtgctgggattacaggcatgagccgctgggcccagctcaacttgaggttgctattaatctctaaaatattctgaaattacttagcaggaggttatcagtgacttcccaaggcaccaagtccagtgacctttctctctagccttatctttgtagcatcctctgccattttgacattgctgacttccctgttcttgacatctgtcctttctggttctcctcttgctctgttgcttctctgcctatttctgttttcgtttattctacttcttcttttcctgatctgtatgttaaaggtccagatttttctctgtgaactgtctggttatgtcacttgtctatttttctgtcaggccttttatctcttctaattttagaagctctttctaaaagttatgtctttgatgaaagttgcaagtattttttcttcagctttttgtctttttactttgcttttggcgtgtgtgtgtgtgtgtttgtgtttaattatacaagagctgtttatttttatgttgtcaaatttattagtcttttgctgttttgaatctaatttttttttgaaaactacatgttcagagaaattctctagtaacaaactgtagaaatgatccctgaaagcatagtcttgaatctgaattttgagtcacaaaaaagttttcccttctctatggttttaaaaaatttcaccctttcttccattatatgattgaatttcaattaaatgtattcttgttccaaaataatttaaggcagtctcagaagacacatgcaaaaagattataagtaagaaaacagaatagaaatgtcattaagttgcacatgaaattttaatatataataaagagactttaattcagtggggagtatatagacttttcaatagtgctattagactaaatcacaatagaaaaaatataaaattagatttattcttgacactttatgtaaggataaattccaagtgaatcagagatttactggtaatattagcatgaaaaagtgtttttatattcggtaaggaagagtatttggcatgccttgtaaacaccttgaaatatcaatcattttaaataaagatataatcagaaaatagacccatatccagagattgttaaccagcttatagcagacccaggctagttgagaacttcaagaaaagacagatcgtgggggcggggttggggagtgtccatgtgaagccattggaaagctaccaaaacagccaggactggagagttcaagatttatgagaggagagaaactcagtaaggtgagcccaacatttattttgcttttattcttgagactttttctgatttgtaagcagtgtggggagaaaggtgaagaagccaagcagaaagcagctgccaacaggcagagaatgcaagtaaagcttttggcagtctcatggggctagcaaagcaaaacttagacttcattgctactaagagagctggtaattgaagggctaatatcttacagagaagggacaggcagaaaacaaaccccaataatctgaggtactttctttcttgagatatttgatgatttctaagtgacacagtctgagagaaatcaagcaaaaagtggcagctaagaggctgaagaacttaaacagtcttctaagcagttttgtggtactagggagattaaaagtggaggaatggcattggttttcgttgagactgctaaaggactacaccaggcctcataaggactaaaacacaccagaacttagataaagactgaaacacagccttgagaaaacccaaaccctggttgatttaggcattatgcttcttactctaactgcctaccagaagctaaaaactcatccaaagtctctgtaagttttcatacaaaatgttgcattcagtcacaaattaccaggccaagatgagatgagaccaagagaaaaaacaaacactagaaacagaaccatagataaactggatgttggtatttttagacagagaatttaaaatactatgaaggtatctaagaagtttaccagaaaactataatttttttaaaaaaattatcaaataataagggaaaattatagaccagcactttttcatgaatatagaagaaagaaatctgaacaaaatattagtaaatcaaaaacagaaatatgtaagaaggctaatataaccaaattggattttttcctggaatgcacattcagtttcacatttgcagataaatttggtaatttaccacatcaacacgataaaatagaatatgattatttaaaaatgcataaaagctgtttgacaaactttaacatccatctacagtaaaaattcagcaagctaaaaatagaagataactgctttcatctgtttaggtctatctggtaaaaagctacaacaaacatcatactaattggtgagatagtaaaagctttttcttgagataaaggaaagatacccattatcaccacttctttcaccgttacacgggagttcagccagtaaaataagtcaaggatgatctttttgaaaaagaagtaaaaggcataggagctggaaaggaaaataaaaacttcgttatttgtagaaaacacgatcgtttactagaaaatctaaaagtattttcagattagttattagaataagtaaatttagtaaggtcactagagacagtatagaaaacagttatatttctacatgtcagcaataataacagagaaaagaaaaatttggaggctattaagaaaacaggtctgggtgtggtggcttacacctgtaatcccagcactttgggaggcctaggtgggaggatcacttgagcccaggagttcagggccagcctgggcatcatagggagaccctgtctctacaaaaatggaaggaaggaaggaaggagggagggatagagagaagggggaggaggagagagagatgagagggaagaggagggagggagggagggagagaaagaaaacattaactactgtatcattatctattattgtgtaacaaatgacgccaaattgcagtggtttaaaacaaccaccatcttatttgtttacaattctgtgggttaataatttggactagacctagctgggtgtttcttctgctggtctcaccagtggttgttcatatggctgcactcacctggcagttaaacgcgattaaatggtatgagatgacctcagtctcatgtccagcggattggtgctggctgtcagcagaacccctttccacatggtctcccatcttcaaggaagctactcccagcttcttcacgtggtggaagcatcaaaacaggcagtgcagaagctccaagctctcttgaggctcaggctcaaaggtcacacattattatatctctcgcatcctattggctgaagcaaatcacaaggctagtgaagattcaggtggagggaacatagacttcaccacttgacagaagatgcaaagaatatgtggtcattttaaatctaccacagtatctaagaataaacccaaccaaagacgtataagacctctacacagaaaacaattaaacattattgtgaaaaattaaagacccacatagatgaagggacataccatgtcgataagttggaagattcggtaaagttgtcgttgctcctcaaattgatctgtagattcagtacagtcctgatgaaaattccagcagtttttttggaagcaaattgacaagctgattctaaaatttctctgcagttgaaaagcgcaaagagcagctaaggtaaccctggagaaaaagtacaaagttggggagagcttacactattcgatttcagaaattattacaagactacagtaattaagacagtgtggcattagtagaaagcagagcaaagtgaaacagaagagagaatccagaaatggatgtataataccatcacgtgacttttgacagcatttatgccatactgcggtagtggaacggatgaccttttcagtaaatattacttagttcaatatttatcagaaaaaaatgaatcttggccactccctcctaccgtacataaaaataaattctaggtggagcataaataaaatctaggtgtgaagagtaaaacaataaaacttgtataagtaaacgtggtaatatctttatgaccttggtgtagacaaaaatttcttaaccaggacacagaaagctcttaccatataagaaaatattgataaggcagatttccttaaaattaagactgtctgatcattaaaagacaccatttaaagagtagtaagataagtcacagaatggaagaagatatttgcaacacatctgttcaacagaggacttggtatacagaatatataagaactcctacaaagcagtaagaaataaaaaacatgaactcactacaaaaatgagcaaaatacttcaataagcacttcacaaaaagatatccaaatggcttatgcatttaaaagttgcttaatctcacttctcaactgaaaagagactacgctgaggtaccattacacacccatcagtttatctgtcaaaactatgctgagataccattacacactgttcagattttctgggtgtttttttgtttgtttgtttgtttttgtttttggtcgttgtttgttttaagtgacagggtcagccacggtaatcccagcactttgggaggctgagatgggtggatcacttgaggccaggagttgagcaacaaagtgagaccctgtctctccaaaataaaaaaaaaaaaaatcagctgggcgtggtggtatgtacctgtagggggaggctgaggcaggaggatcacttgagcccaggaggtccaggctgcagtgagccaagatcccgccactgtactccagcctgggcaacagagactttgttttctgtttttgagaaagaaagagtgaggcagggtcttactctgtcacccaggctaagtacagtggcatgatctcagcttagtgtggccttgaccttcaaagtccaagtgatcctcctcctccagcctcctgaatggctgagactacaggcgcacgccaccatgcccagttaatttttaaactttttgtagagacaaggtcttacttcttcacccaggctggtcttgaacttctggcctcaagcgatcctcccacctcagcttcccaaagtgctgggattacaggcatgagccaccactcctagccagaatatctttttttttttttttaaacgatctataccaagtgttgatgagggtgtagaatagcaagggatcttgtagactgctgaatggagcataaactggtttgaccactttggaaaactgtttggcagaatatattaagattgtgcatgtacattctttatgacccagttccactcccaggtatatgtccaagaaaaatgcataaatgtgccccaaaagacatagctaggcagggagcagtggttcacagctgtaatcgcagcactttgggatgccaaggcaggcggattgcttgagcccaggtgtttgagaccagcctgggcaacatggtgaaaacccttctctacaaaaaatacaaaaattagctgggcatggtagtttgcacatgtagcctcacctgctaaggaggctgaggtgggaggatcgcgtgagcccaggaggtcaaggccgcagtgagctgtgattgtgccactgcattccagccaggacaacagagtgagaacctgttatctagtctgccatagacatgtctaatgttgtttatagcagcattattcataatatcaaaaagcctgaaacaacccaacttttgaacttttcatcaacaatggtggttaaatacattgttttattcttgcaatggagtatttatatggcaatggacgttaacaaactacagctatatgcaacaatctaggaaacccccatatgtaatgttgtctatgagaagccacctacaacgaagtgcatactgatgattccatttatatgcagtttaaagcagaagaacttacctgtagtgatagatgtcatcactgtggttgtctttggggaggaaggaggagggagtgggagcatgctcatggtgagtgggctgcttccaagatggggataacagtctgctttctgatctggtggtggttacattattgtgttcactttgggaaaaatcatttgggttttgaactatacatttgattagtatacttttctgtgtgtgtggtttacatcagtcaaaaagtaaaacatgacaaacagatacaaaacagactaaaaggaattatgacacaaactgatagtgtttatttctgtgtgatacatgtgacttgggtgatatatgtctgtctatatatgtatttttccctagtattttacttttatagttatagggaaaatccttatttataaacatcaaaacctgaccctcattcgaaagttaacatgacttgtagctttaatggaatctagaattatagtatcacagaaggccatcatatgacttaagtatgtcatttcctttcttccctaattaggccctaaaaagcaccttggggtttcctttgatacggtttgaagacgctgtgattaatctagatccattcactcgggtacatccctatgagaccaaggagttcatcatcaatgatatcctcaaacatttccaggaggtgaggcttggagaagtaatcattggctggagcataagcagaatgtttgttttagttgtttgggaattttggttactaaggcattactattgagaacccagttaaacatttcaactctgttgtgttacgggtcaggtcacttcccaagaagcccgtatgtgtcatgaaaatcctgagatagtacatttgacctatgagctgttagtttcatccctcagagctagtctgaggggttcctgctagattaatcatgactcttaatggtttagttgatgctttaataataacaaaataatgtttttatttaccaggcatgggccttctttcagcaactacacccatgttcttagagtctgtgggatcctgcatttgggttgaacttgaaattttttaaatcaccttggacattttccattttgtatttattatccagactgcaaagatcaaaaagtaaaggcaaggcataatcttcaatgaatagataggtcaagatcgtatcaaatttaatagctttcaaagttaaaatatattttattctcacttccttttctccattccccgtttccttttttgactatcctaattggtgatatttccacctaactaaggaaagtgatacagcagatatcactggaacctgggatcaggcaattggaagtacagaaagagtggaggggccagtcatggtggctcacacctgtaatccgagtacttggtgggaggccaaggcaggaggatcacttgagctcaggagttcaagaccagcctaggcaacatattgagaccccatctctacaaaatatagaaaaaaaagattagctggttgtagaggtcttgcctgtagtcccagctacgggaggctgaggtaggaggactgcttgagcccaggaggtcaaggctgcagtgagccacggtgatgccacctcacctcagcctgtgtgactgagaccctgcttcagagaaagaaacagtggaggtttgcttgataagtctctccatgccttcttcaggccccccacccacaccacagcttatgagaggaactgtaaatctacctctcttcctcactttccttttgtaattctccctgctggtgattacttctctatttgtaggcatgatgaaaaggagagtatgatgtatatagtagcaaatactcataagaatgcttcctgtttcatagctatttttattcttctaactggcttggaagagtatgtgtattgggatatgtgtattgggagaagcttaggtggtgctcctgaaaggacaggagattattttgcagttgatgaagattaaaagcttttaatctcgttacttgtagtaatgagaatggagaacaaaatagatttctaagctcttcgcttgggacactggtatctgcaaatataagtagatgctgattggacttttctcttcctgttccatttggcaggaactcctcagccaggcagctcgaatcctgggatcagtggattttcttggcaatcctatggggcttttgaatgatgtttctgaaggggttactggactgataaaatatggaaatgtcgggggcctcatcagaaatgttacacacggagtatcaaactctgctgccaaggtaaggaaatagaggtgaaattccattataattaacctcacgagtcctctacagtactacaatttcttttatagttaatgggctgtgaaaagttatattcatggcttttgcttcattgcccacatgccttgccttttcctcacctccagtcacctgccaccaggtgcactgagtccacctctgaaatacctcttcctccttcctctccgttgccactgccttagtccaggcattgcgtatgtcttacctgggtcactgcaatagcccccagcaccctggacctttcacgatgacccctacacctttcactgtgccaccagaatgaactcactggattgtgccattctcctgcctgagatctaccagttattgcccacagtttacagggaaagtccaagctgaagtacagccttctataatgacaacaaccttttaagccacctgaaaccagcagcagatggacagtgatgtcattctccagtatcttgcagctagttgactggtttgttcactgacatcttaattcgtggacattttcttagttcactctgtattttctggcaggaattgattatatgcgaagctggaaaaggtgaagcgagttgaaggtagttgctatttgacatacagccctccaaagagctctgctttttttctcttcctttcatctcaacacacttttcttgtagagactggctttttcatgaatgaactcatttggaggaaacacctgtactctctgcttatttactgtggagagagcatttttgtagtgagatcacaggtgtacttgcgccacagggtgatatgacataaaagtagctttaccaaagagatctttgtggcaccgcgtagaaatgtatcttgaagaggaggtaagagagtcgagttgaatagcatttctctgtggtatggtgttctcgttaataatgtgtgaaagctgagaatttattcttttttccccaaactattttctagggatgatagattggtcagatcagttctgtaggattattgaaccagactaaagtgtactgtttggcttgtggttcaaaataagcaacagtcttttctttttcttttttcttttctttttcgcgacagagtcttggtctgtcgcccagactggagtgcaatggtgtgatctctgctcactacaacctctgcctcccgagttcaagcaactctcctgcctcagcctcccaagtagctgggattacaggtgcccggcaccacaccccattgattttttgtattttttagtagagacggagttttgccatttggccaggctggtctcgaactcctgacctcaagtgatccaccaacctcggccttccaaagtgctgggattacaggtgtgagccactgtacccagacagcaacagtcttttagagagactttcccactcatggtttgaaagtggtgagactcaggttcaaagtctgaactagcgtgtacttttctgccttgaatcctttctcacactcccatgttcccttacccctcacgcatcataaaacctcatagtggtaacacagatccctcactcttcttgctttagctcttggacttgatataaatgaatgaacttaaatatttagttgtaaatgcccagttaacatattttattaaattttattaactttattgaattctaattgacataagaaagtcttcttggttttataatttctttgtttttgtaccctgggctttaccataattttaaaaatgaagatgcttatgatttaacaataggacttcctcactgtggaatagaaatgcacctactttacaggtttattgtgagaacaaaataaggtatgacgttacaaaaattttgaaaaatacagagtgaagaagataaataggtcattactttgactgtagtatttgcatggagacttgagccaccaggaagccattagtgctcttgaaatgaaaaccaatctattatgaactacagagaaggagggtctgggacactgagagtaggagagtcaaaccccatcagggccagtttgactcttaggaacctccatagttcactgggttaagaatgaagaagctgttcaagtgcctgtgacatctcaacaggagagacctcctaggagtttctccagggtctcctggcaacatcctagtgaaaggattggccctttattctccttggtttgtggaagtctcgtttgtttcctggtttttctgttttccctgaaaaactgtttttgaagcttgagggtcagcatgagattataacttaggcagaaagaaagggcagtgtcctccctacccccaccctcatcctggatctatatgaaggcctgggggcagtgataatacatttgatttggtatcatgctttgtatgttgccagatttatataagggtattgctttccagggaacgagtcctctggtatgggaacttcccttcccatggggttgggttccttcatatagttgtcttgcctttaataagctactagtattggagccacaggctgcagctgaggggattgctatgtaatttacaggcatagattgtgtattagtccattcttgctttgctctaaagaaatacctgagactgggtaatttataagaaaagaggtttaattgactcatggttgtgcaggctgtacaggaggcatgatgccagcatctgcttctggcgaagtcttaggaagcttccaatcatggtggaaggtgaagcaggtgtctcacatggcaggagtgggagcaagggaaagaagggggaggtgctacatacttttaaacagccagatctcatgagaacttgctcaatatcatgaacaccaaggggatggtactaatccattcataagaaatccacccttgtaatccacatacctcccaccaggtcccagctccaacattggggattataattcaacatgagatttgagggacaaacaccatactatatcacattgcttaacatcagggatacattttgagaatcattttactaggtgatttcattgctgtgcgaacatcatagagtatacttacacaaacctagatggaatacagcctattccacacctcggctatcggctcctaggccgcaaaactgtacagcatgttaaagatatctaaacctagaaaaggtagagtaaaagtatggtattataatcttatgggtggattgtcgtatatgcagcccgtagttgaccaaattgttatttggcacatgactgtattttgataccagcaatcttaggtgtttatagagatgtaaaaactagttatatctctaagatgagaaagcaaataaacacaaaatgaccacttcttataggaaatggtagatctaaatgggtctatcagttgaatacccattcaggtcatctgtgattctgcacgtatgtggttggactaaagatgtgcattttcttgtagttttgtgggttgaaatcaacgtttaaagttgttttaggggaatgttttatttgtttctctgtgtagaccagaggagtttgaggaagtacaaatgaccacaagaatcaactgttggcctgtgtcaattattgctttaaagagtgcctgagttccagtgattaaaaaagggtcagaggggacagaactgcacctcattgagcccctgccagtgcactgcactttactgcaaagaccagagggctttagcctggttgaatgggctttgagtgtagtggagaagttcataaacctcttaaattaattgtaaatattgtataaatgtgcatttttctgggatgagggtccaatgtttcttttgtatcctcagggagagattcttgcctccaaagattgtaagccattattatagacatacgtttgtacattgaggggagcttggggctggtagtcaggattgccagcactttaattgtatttctacctttaaataatcttttcctctgttaagagatttgtttttaacatttatgaaaagatgatggtaactccccctgtcacactggcctgaggagcaaaagagatgaagtatatgaaacccagtgaggagttaaaaggaattcattctgtcacataagaagataatagacctgtagggtttagtcatctgtggatagatgcacaaattttaaatttcaggtctatagtgtatccacttgtggaatttctcatttcttttttctccccccagagcgttcctgcaaaagaaacgtctcatttcatctctgttgtttaatttatttaatactggcttcaaggaaatataagtaggaaataacctatgcccttttatctcagttatttctctttgcctttctttctcatctcccaacgctagaaatcagcatatggattcaaatgtaagatttaagtcttagccaccaaattgtgagcatctaacccatgactcccctgcctgggtcttggcaagatgactctagcccttagcggaacttcaaagatctgatcccattcctgaggtcatggcaaggcaatcgcttctggaaggtcttctctgaatgtgatttatttaagaaaatgacagcatttcatattccaaacccatgtcagaggagaaagtttctttctgcagcatgagttgcaaaaagtatactttcttctagttgtgtgtcatgtgaagaatatctgcaagacactctaacatcttttaaaggcagagaactgggagggccccctattgatgaaatttcctctcttatagactctagcttcatttttaccttcattcttgtgtgatattttcacatacatagctatcctcaacaaaataaataaagtacttcttaaattaacaaaatctcagatattaacaatagagcaaatgatcccactgtcttttctgcccctgtagaaactgtgtttgctctgcaccgttgttatctggtcttcctaagggaagaaagccaacagcatacttaatttcttccagcaaaggagagaagcactttcagtcatcactaatgaaacctctgctcattctgtcctactttccatccccctttttttgagacagtctcactctatcgcccaggctggagtgcagtggtgcaatctcggctcactgaactctctgccctcctgggttcaagcgatcctcccacctcagcctccagagtagcagagattacaaggattacaagcatgtgccaccatgctcgactaatttgtatttttagtagagatgaggtttcaccatgttggccaggctggtcttgaactcctgacctcaagtgatctgccctccttggcctcccaaagtgctgagattacacacttgagccactgcgcccagcctcatccccttcagtatgtctttatcaagtcaatataggatgcttttgattctgggtacctttttgatcccatgtttgttttgattctgtgtttatgaatacagatattttcataatttgtcgtgttcttaacaaattattttcatagtggttatttgctattcatgtaaattagaattcattgttcattgtttgctacatgttaattttactaataacttttatagttgtatggtagttttctcttttgctttgtggtatttatttctaccaggcccaaatttcccagctcaaattctgcagatcaaatttttgtcaaggagatgtgagttttctgccactttttagttaatgcattttattctatgttgttttagccattgtttcattgtcttaaatcagttttgttttttatgaatttgacagagatctaattttttagatgatttcttggtacaaacagcattagtaggaaaaggtgtaggaacagggttgaaacactgcacttcattgtggaatacatactaatgtataaacatttgttgagcacctcctgttggttaggcttggtgagagaccctttatatacattgtcttctgtatgttaagctctattctgccaatcaggaaactgagagttagagaagttaagtcttcaaggtcacacagctagaggtgacaggggtggatctgaatccaagtccagctaattttgaaggtctttttttttttttttttcttacaggatgtttttcctttgtgtttgtaaggcattcttctaggcactgcagagaatatgaaacattaattactgctgacttcccaccagaagcctcttatttgatgtcactgtgtagctggtcagtgaccactatggtagcattcttggcacaaagcaggccctcaggaagtgctggtgcccaccgtcattctcgtgttaggttggttgtggctgtcactgtcttctttataggcaataagaaccttggcaattgcaaccatggttttactcatgtgatatcatttgatcatcagaattacctggtcagtagctagatgggcattttcagccccattatgtaaatgaagaaactgaggcccagattggtcaggtgactttcccaagatcagccaggtcactacagagctgagacctggctcttctgtactggcatctcagttctcatttttaattagacttttgagatatcacttaactacaagatttattctagacatgcctctatgtgttaaacaaataaaccaaaaaaataaaataaaaagcaaaccaaacaaaaagccctacctagtcccacagtgaactttgataacttttaggaaaactgtctgaagataaatataagcaagttgagaccgagaaaacgagaaattcagacagttcagatagttcagtagaaaatctagctaggactttaaataccattttgttccatttctttggtttctgtttgggacagcagtgtggaggagctgcttcttttcgaagcaaacctttcaccagccctttgtcccaggacaccagatttggtgcctagccatgatccagtggaaactgactttcctgtccctgcacagagactctcagccagcccctgccatcagccagccttctatcatatatactatgaccttgttgaggagagaggggcccatctgccttttgtttaagaaacagcattttttgttgttgtttactttgcagtcactgtatttataaggctcagacaaaactaagagcaatgtttattcaaggtgaaaattttatctttgcacaaaagaatgcactgagtgagtccctgcatggattctgaaggcgaaaaggcaatttatgacttgtatctgtttttgtcattatgtatgactgctccattttatagttgagctgattatccccataatagcttttccatgtacctataagcaagtaataggtgaatgccttctcataagcattggggttttagtgtatttaagttggcacaaaacttcagggtaaatgaaattcacttcagacagtgatctttcccttagagaatgtaaggctttctattttcaaaaagactttgatcctaaataagtcacccgagggatttcttttccagtcaagaggaggtaccttcgagttgttgtacatagggaaatgactcaaatttttggcatcagaatttttgttttattttcctctgataattttgagtactaaaatcattcccttagtctgagctctttttggttagaagcaaattttagatgctgaatgactcaccctaacttgggcaactgtcaaccatcttgggggatctaataaaagtgtatttgtgggggccggggtagagtggtgtcatgagaactgcaagtgaccaaaattcacaggcagtccccatgtacctcactgagcagcctcacgcatgaaggagccaggtgagcagagtttgctcatgaaggagccaggtgagcagggtttagctttcccccttttccaccctaatcaggtagctcagtagccagaagtgacagagcagggaatgagtgatgccactattgatgtcctgtttttgaaacagaaagaaaaagttcagaacttcttcatttcctaatggtagttcagttaagaacaagcttcttcagatttctttttttttaaggcctgaacatgtcatatttgagaggaattaacttgatcttccaaaactggagcctgtgtggtagaaaagtatattcagttgctaagttgaaaagacagaaaatatttgtgtcccccaaaagtagtggttttctaccctagtgtaaacatggtttataaaggaatcatgtgttcaagctttcttaggttggctggtgacccttggcattgtggtcatgcatcccttttctgtgattcagtattcttcacatcagtctttggcctttcttgaaaaattgtgacaaactttaagtgagataaaattttcaagacactcactctgtttggaaggttctttctaattttttttttaaatttctttctaccttataattgttctttctaaaagtctgtctccatcttgaagaaaagctgaatcaaagtttattcttaggagaaagagggaatgtcttggtcaatatgacggttaaaaatcagaaagcaggccgggcatggtgactgacacctgtaatcccagcactttgggaagccgaggcaggtgggtcacctgaggtcaggaattcgagaccagcatgacccaacatggtgaaaccccacctgtactataaatacaaaaattagctaagcgtggtggtgcatgcctgtaatcccagctattcaggaggctgaaacaggagaatcgcttgaacccaggaggcggaggttgcagtgagctgagattgtgccactgcactccagcctgggtgacagaacaatgttgtttctgtcttaaaaaaaaaaaaaaatatcagcgatgtgaagagtgtagccatcatttattaactcctacatgtcgaatatgggcctaggatctttccctatgctctctcatgtaactttcacatatacccaataggaaggaaggaaggaagggaggaagagagggagggagggagggaaggaggattaagcccattttacagatgagaaaaattagactcagactcttcaggaaccttgattgaaatttaataatgactcattggagctagaagttttcaaaaaaaattaatttgggaggcagcctctatttttcctccacacaatgcaacttctcaggtataatcttttaccaaactcaaaaggttgtagaagcaaaaccatgagccgttggaaacaacattacttaaaagtaaagctcaagcagtcttccattcattcccaactttaacacctctgtgttgggccttggaattttccaactgtaatttctaagttttccgaattaatctttactatctggaaatctctaatctagtgtaaaagggttgaaatgagagaagaggattgggagatttttcttcattcaaatagaaaatgtatgactcaaaagcatttgagtaagctgacgaagctgatgttcctgttccaagatttattcaaatttaaatcatgtgggatgtgcagtccccaggcctttcctcccgcctggcccgggaagcagagcagagctttggaccactttggtatgagctgacagtgagcttcagatcactttcctgatgactgtctgcctctaaatgctatgtgttaagttgtaatttctttaagccatttcctgaacttcactcctttaagcatttctaaacaactaggatatcattttaaaataatagtgtttaattttcagggcagagtacccagaattagggagagttgtgcattcccactaacagttacaggcagaaaataaactcattgtccccagtagtccttttctttccttacccttttccccttagtttgtcctatagcttttcaaattttgtagattttttgtctctcagttctgctaacagattggctttcagatgcttagtgacaccattgcttgaattaagaagccagagggagaatgttggggagagtgtgttattcctgagagttttaaatttagttctgcagccgggcacagtggttcacacctgcaatcccagcaccttgggaggctgaggcgggtggatcgcctgaggtcaggagtttgagaccagccttaacatggtgaaacgtcgtctctactaaaaataaaaaaattagctgggtgtggtggcaggcgcctgtaatcccagctactcgggaggctgaggcaggagaattgcttgaacctgggaggtggaggttgcagtgagccaagatcatgccattgcactccagcctaggcgacaagagtgagtcttcgtctcaagaaataaataaataaataaataaatttagttctgttgaactgaactatggtttgcttcttggaggaatggaacaatatgatttagagtttcatcattccttattggaagaataataataccactttatatttgtctcgatttttagttgttggtaaagcatttagatatctttgatcctttctataagcctaaaactaggtaaatggtattattattgtcattattttattattattattattattattattattattattattattactcctgttaccattttatggatgaagaaacggagacccagtggaagtaaataattttgctcaagatggccaaacaaaaagtggtagagcttttgcacttcttcctagctcccctgactcctggaacattgctggacagcacagtcagccctccatatctgtgggttctgtattcattaatttaaccaaccacagatcaaaaccgaaaaaaaaaaggatagttgtgtctgtactgaacatgtacatgttttcttccttgtcattattccctaaagcatacaggataacagctatttacatagcatttacatggtaaagtaatgtgttataagtaatctagtgatgatttatatacaggaagatgtgtgtaggttgtatacaaataccacactattttatatcagggacttcagcgtctgtggatggatggtgtcttctgcatgtccaggaaccagttcccaatggatactgagggacagctgtacttcttaacctgatactgcaggttaagattcacaacatcgtctccatattatagttgggttttccaatgccagtgttgtctgtgagccttgttagcctctccttccctgcagaatgagtttcagagaacagaggtggagaaaaatgtatctttccctcttagaggcttgttgcactgttcattaaccatgctgctatttttatgaggcatttcagagtcatatatctgagagttcacaaagaaacaatgtatgacaagaataattcttgtagcagtttttgtgaggcggaggatggtagggagaaaatttaagcttatgtcaggacattacattaagtaatttctacagtgttggggatgagggagaatcccccctaagaggaaaaggaaggtacttctagaagcgggtgagagtctggcttttccttggctttcctcatagccacatgatggcatgtcctgcctgacttggaagggaggcctcagcgtgtcctgaagtagtgatgtggaggcgcagttggtccctggatacaggcacaggcatatcacactcacctccagcaggcaagggggaattacagcttcgcttttccttttctattacacaccagtggggaagccctccagtgccattcctaagaacaaggacattttctagttaggcacataaggatgatcaagataagctcaaaaactaggagccacattggagaagtcaggtttaaagtgtgcagagaacatgacagagagtggactgtgcgccatttgtccagtcatgcttgtgctgtcctccccttgcgcttgtactcagtcttgcctctgattggggtgcccttctctgtttctggccagaggctccaagtctgtaaggcccagtccacttgccatgttaagaatgtgatctctccccactgtgagttcccatggccccgtgtgcttccattacagcaggcaccagattttaccttgaattgtaaccatttgtgcacacatctctgatatccgtcaacatttctcacatcaccaattaggtgctgggcgctgtgaaagaatgttagaaaggaagacttagaaaatgttttcttctttttgtgaggatgtggaacaggtaaggcagagaaggagtaagtaatgataatccagaggaaataagtattgcagtggggtctgtgcaaactgcacagttccatgagagaagtgctgtggggccaggggtaagaacacttgattgtgttcctcaaggatgagattggctggagacaaaagatggaatgcaacggtctgtatttatttgcatcccagagtagaccctgtggaggggggccaggattttatctgacaactttttttttttttttgccagtctcccctctagccataaatagttattgtaaggaaaattaaagtgatccaggttgtatccatgtgggctgtcttttatctggcatagcatttttcacatgctgtacattcaatgaatgtgttattgtctagctattttctttttttatggaaacaaacaaacctttttttttttctctttttgagatggagtttcactcttgtcacccaggctggagtgcagtggtgtgatttcagcccactgcaacctctgccgcctaggttcaagtgattctcctgcctcagcctcccaagtagctgggattacaggcacccaccaccatgccaggctaatttttacagttttagtagagatggggtttcgccatgttggccagcttgtctcaaactcttgacctcagctgatccacccacctcggcctcccaaagtgctggcattacaggcgtgagccactgcacttagcccatacaaactttttaaaagtttatttacaagtttccccccaaacatatctgtaagctggtgaatagccaaaatcgtactatagcaatacagacaggaaaaggacattgacttttaggatcctatttcttctcctcccttccccatgcctcaggtctagcacagcactggggcacagcaagcgcttagcagatactgacctggctctcatgaagccaggtgggcactattgattggacccaggcttcgcttaaggtagcaggaagctggtttagaggaaggagaagaaaacctagtcccttttaatctaatgaattaaaataatatttatgggaaatatttgctttattccaggaaaatgtttgaagtaaacatttcctgcaagctgttgaatttatataataaaacattggtttggaaaccttaattgttttcactgaagtgaaaattaagcagaacatgcttcccaaacagccccttgtctcagttttgttgccattgtaatgttcaaagcaggatattgtggccattgaggtaattttctctttattggtaacttggaaatgagcaaggatcatgccaaagttagttataaaagaggaggcactcatggctccttgtagttttatagcaattcaacctttgtagcgtcctcctgttactatttgatcttcacaaacttatgcattaaagagtcaagtttatccccatttgacggataaagaaattgagtcacagtgaaggtaattaacttctggagggtcaaacagggagtttgtggaagaggaccaggctctttacagccccaagctcttttcaaagaccatactgctgctctagaaagcactctttcctccttcaggaattaaagcactttcacgtctgtgagataatttaaccttgcaacatcccagtggggccagcaggttaggtatgattatcatttcccttccagtgatgggaaattaagttacacaggttaaatggttttgccaagaccgtgcagtcagtgttggaaccaggggatggtgcccaggcttcacaaacactgagcccactcttttcctaccacactaagccttctcagaggagagccagaggagcttctgatgccttgaagacagctgtgaaacatcttgcttccaagagggccttgctttcctagcacccacgccagattgtgtgaatgcttggttctatagtctcagcgggtcatgcaaatctccagtcctacgatcactaagaaacaaagcaaaagggggcaaagccagatagattttaccagcctgtttggattttgtgtccagtagaattagcaagtgaaagttgtaggattgctacagaagagttgcttagaaatcaattaacgtgacaaactgaggtgcctcaacaaataaattatatggagagataaaagttgttaggactaaacacaggaagaatttgccacttgtttctctgtaaaaggtaaaaacataacagtgaactgtgtctaacttatgttaaaaaattgaatttggtgagaagcctagttttaataatatttcatatgataatttaaactctctaacttttgcctatttaaccccatcttgtattcttcctaagagatgtgtcaacactaaaacttttcttagttattccagctgaatatggcaaagctacaatagcttttcccagatgcagactcttaacacaatcgctgatattcagtagaaactctttggatagcagatttgggaaagaaccttaaggccagcctttagccctctcaaattataggtagagaaactgagaccctgtaaggttctcaaagctaattagtcacagggctagccctcaaacccaggctttctggctacagatctagtatgattgttgagactgggccggcagcttgtgggcacctgcttggtaggagtgagggggagaaaagtagtagggtgtaagccttgcctactgtatatcttctcagcgttctttattttttatccatttgtgtgtctgtctcccatactatactgagttccatgagtacaagggactaagtcatactcgtcttggtatctttaaccctaagcacttagcctgtgatctaggaagccctcaagggtttgttgcactgaaccagtctgttctgtgtcaaggtcaacttaccggaaggggctgcaggtagtacagctccttaaagcaccttctattactagtccttcagcagaatcttacccagtgagtaaacccatgcaaaacttttgcatctctcctgaaagcagaacaagacctgcccccatgaaaagaaagaaatagggaatccctttataattagatttagtgggcagtggtgagatgtagtagagatgaaactttaatagacacatagtctttgggtgatgccaaaattaatctaactttgtgggttaaaatgaattttaaaatttttctaaatgttcatatgtttttctctgtatgttgttagaattgtcatcgggttctttctaaaggctgtgtgaaagaaaagagcaagccaggtgcggtggcttacacctgtaatcccagcactttgggaggctgaggcgggcggataacctgaggtcgggagttcgagattagcctgactaacttggagaaaccccatctctactaaaaatacaaaattagatgggcatggtggtgcatgcctgtaattccagctacttggaaggctgaggcaggagagtcgcttgaacctggggaggcggaggttgctgtgagcctagattgtgccattgcactccggcctgggcaacaagagcaaaactccgtctcaaaaaaaaaaaaaaagaaaagagcgaaaacatctttagtactggttcttgccctaggacagaagtggctgtttgctgtacctctcagtggacactgaaaatgtggatgtgtccagttgcctgctgtccagcaaccctggaagaacttgtgatggctttgtcttcgttatgagaacactttgatctgaacccctttccttttctgaatcctttcccttttttttttttttttaagacagtctcactggctgaagtgcaatggcaccatcttgtctcactgcaacctctgcttcttgggttcaggcaatcctcccaacccggcctcctgagtagctgggactacgggagcacaccaccacacctggctaaatttttttttctcgtagagatggggtttctctatgttgctcaggctggtctctaactcctgggctgaagtgatcctcctgcctcagcctcccaaagtgctgggattacaggcatgagccactgtgcctggcgtctgagtcctccttctaaagggaacccactgcacagcatctggctgctgccaacaaaatgactgccccaccagtcccacaggtgatgagagtttgcaatggccttcacagcttagtaccttagtaccttttctctcctggtaacttagaatggaagccccatgggggcccacgcatatctgcgagggtgcacaggcatgtggcagaatgagccaggggccaccctcttgttctggaggtgctgagagccggcctggctgggggctgtaactgtcaggctgactcccagccacactgtcctccctggagtaggtgctcgaaacctttgctttttgccttttcgctttaatctggaacgcttggggaaaaaaaaaaaacaaaaaaacaaaaaaacaacaacaaaacagtagaccaaatggtgactgagtcccaacccttcttcaggccagatgaaatcatggtccctgctggcgccattcctccatctcagagccctcacttgggttcagaccctcagtcacacagggagccccgccacagctgaagtgttttgtcagagcaagattgcaaagagttaacacttttgctttttcggaaagttatctgtgaagagtattagttgtttaataaagcgtgcctgccctcccgatgaacccgccagtgactctgcagctggggtcattccaagttcacgcagtggacttttgactgccttctgtgtctgtgaaaacagtcggcagctcctgcggggatcattcattcaggcctgtaacacaaaactattgccaatgggcacctgctggggcagcttcccgggagggctgggaggaagataccaaactcatcaggcatctgtggagataagagcggcaggggatccactgggatcccgctaatcaggcctgcacttagaccccactgcctggccaacaggctggtgtcagaatgtattaggcagccctggccaggataggatgtgagctaattaaaggccttttacaaagaggaggaggtagggggtggggagagagagagagtgagagagagagagagagagtgtgtgtgtgtgtgtgtgtggaggaggaggaggaggaaagaagtttgaagtgcattccccaaatttccagcacattctttattcctctgttttatccctcaaaacagaagaaaacaaattagaggctgagcatttggttatttctaacctgaaattgtcattcattgtgcctgatgccgtattggttttaactgctatttttgtggaattacatatactgtgaaagacatcttttgccgcagtctccctgggaacatcctgttgttgaaatgccgttggtcagctgcttgaattttgcccttttctctgactttgacacatcaaggcaaaaataggtacctatttgtggtgtgttctaggtttctcccttttgcttggaaaatccacttgccagctgtgaagggtgctgctgggaggatgaaatgagtcagtgcacagcgtgtgctcttaaagtttggtggttgaggtggcggtggtagcagcttggctctgtggtttaaaatgccacagcatgcactatcttgaaaatactcagtagtcctagcatacaactgggttttagttacacctacttaaggaagaaagctcatttgaaagtgtttgattttcctgtactttcgtttgtttatttagcctgtgtattccccccacccccagtaagcagcaaactaacttatttataggcctcaggtatgtttaaatctgtggtattttcttaatcagcctgataatgatacatttttgaaagcagttttgttcacacataaacctaagcctttattatattattctgatacattccacataagcttgtctgtgcacaaagaaacatttagattaatcttgtactacatggtaacaatcctaggaaattccaatcaaaagccaacaacctgtttccttcattctggactgttggtgggtttgtttttgtctgtggtctgataaggagtaacaacaatgttaattttgtatttccttggcatttgtctcacataatcttttgtcaaagttgaccagtaggcttgtcaggcttgccatgcagtttatgaaataaatagttacaatggagtagttaacttagccctgcggaatatgttagtgtatccttaccgtaagtgtttaaaatgttaattacatttatctttatttctcagcattgctatacagaaaacatgggatagacactgatactgattgcccagttgaaataagttttgaatttagtaactgaatggatagctttaaaaatggtactaatattttgggagactgaggtgagcagattgcttgaactcaggagttcgagaccagcctgggcaacatgaccaaaaaaaaaaaaagtctaaaaaatacaaaaattagctgggcgtggtggcacccgcctgtagtcacacctacatgggaggctgaggtgggaggatcatccgagcctaggaagttgaggctgcagtgagctgtgtttgcaccatcacattccagcctgggtgacagagcaggaccctgtctgaacaacaacaacaaaaagatactcatatttattgactgcttcactatgtgccaggtactgttctgagtcttcatacaaattgatttgtttaatcctcataacgaccctgtggaatgctagtttgtaaatgaggatactgacgttcagagaaattaactaatttgcccaaggttacaaggagagccaggctaagaaccgagattctctgattcagagcccgtcctcttaataccagtgcaaaagcagcactctatctagtaggcttcattctcgaacctctctgcgatatatttgcagggattaaccatgtaaggctgtattatcaaggggatacagagaatttgagtcacagtttaaagtcatttcctgtgctaccctgtgttgtataattagctcttttgtagatgctgtaccatccaggccaaagtgtgtggccgaaaccaggaaattgttctaaccctgtctgagacacttagtgaaggagttttgactttgctctaactctacacatcgagctgactatagatttatgtgcaaaaagcataacctcatgttaacaggtctatttattgtgtctctagagcaagttcacaactatgtatggacaactagaaatgccaggctctgtgctaggcacaggggacacagacataaacaaaacaaagccctctccccttggggtcaccatccagcaggggaggaggacttgcagtcacacacatgtgggaaagtgttccaggtttgagtttggtgtctgtgggggttcctgtagggggatctcaggaaggggtggactcttctacccaggacaaggaaggtctgtacaggggaaggcacgccggtgcccaatcctgaagtccaaggagatgcttgccatgtggacaagagacaggtggggacaagaagaggcacacagggagcagtcccagcaggagggagcctggggtgtgcagcagcaggactagggaggggtcagtggagcttagcaggtgggcctctggaatgaggagctggcctagtggggaaagactggctcattgtacatccctttgttttcccttgtttcgcccccacccaccacgtgaatttaaaggggaagagacttaactgaatgtttcactttttgagcctagtattgttatttgtcatgatttgaccataatctgcatatatacaatgttaactattattttttgcaagtttttttttgtttgtttttgtttttgagacggaggtttgctcttgttgcccaggctggagtgcaatggcgtgatctcggctcaccgcaacctccgcctcccagattcaagcaattctcctgcctctgcctcccgagtagctgggattacaggcatgcaccgccacgcctggctaattttgtatttttagtagagacagggtttctccatgttggtcaggctggtctcgaactcccgacctcaggtgatccacccacctcagcctcccaaagtgctgggattacacgcgtgagccaccgctcctggcctttgcaagtatttttatgtgggtaaaacagttatacctttcactgagcgggcccaaacaaacaaaaacaacagcctgtcacaccgtgtgtgtgtgtgtggcggcgggaggggggtacccaaaaaccctgactcactttttatataattagagctaaaaccaaaccaagtcatggcttgtttgcagtaggtagattgcagagttaccaaactgttctttctgaccagagtgactcagtctagtgcaaagtcatgaactgcctccagcatttctcattaacctaatatctccatctagagtagaaattcaccctccctaaagcccagaggaaacaaactaagggtccttgtgaaaggaaaaggcctttagaccctaaaacaactgattagaaaggcaggacgaaaggagggaggggggcattctttgtgctttcctgtgcaatttggagctcaacagatgaagtgtttgccattgatccccaaaccacattttgggaaactatctgaccccatttgactggccattcaactgttccaccattttctttacacaaagctaaactagatttgagctaaatttgagagggaagagcacattacatatgggaatgtggttcatggttttctaacccaaccctcccctcccccatccattccaatgagtagatttttctctggaaatccatcctttctttttccattcaaggcaactaacagtatccaatttttgattcgtagttttagttttccatgtatagactaaaagtggatgtttatcttgagacaggaatgactgtttttctgcaattgtttagactaaggctaggtagatttcctgtggacttcttggaacctttgagccctgatgttttccctgcgctcaaaaattacagtgctggatggcatctttccagctgttgggatgggagacaggctgggccctttgactcctaaaattgaacttaggttgagctggttggcaaatgtggcaatgaaagggttccctgagcaaaacctgggaaaatatcagtctggatatactctcctagccctggctttcttagcacaccttgatgtgtgttccgtagctgtcttcccacccccatcccctaaaacttgagcatctgtagctcatcacttatgtcctgaactcagtaaactgagtctctgttataggacttagagaaattttcttatactatggactgaatgtgtccccccagaattcatatgttgaaattctaaccccaaaggtgttggtgtcaagaggtcattgggggtgattagatcaaggaattggtgcccttatcaaagagaccccagagagctagcccacccttctaccgtgtgaggttacagtgaaaagatggccatctaggaagcaggccctcatcagacattgaatcagacaccgaatctgctgtcaccttgatcttggacttcccatcctccagaactgtgagaaacaaatttctgctgtttgtaagccactcagttaacggtattttgttgtagcagcatgaacacactgagacagcacataacacagaatgctgtttctttaaaattttcttgagtttttaccatgtggtttacttgtctttttcattgatccttccctgttcagtggggaaacacagatcagcacccagcccttgccgaccacatgaaacctaagatctcacctcctcctccctggcaaaagaagaattagataatgagaggtgttctggttttgagaggaagttaacaagtgttgggacgcttgcacgttagagctggctgcctgtgctctgagtcagaactgaaattttgacatgtaaagaagaactaatatttgatcctctcctgtgtgccaggcatagcgctagccacttcatagctttttggctattcttctccatctcctttctgccagttgctcaaatactttggagtcatccttggctcctttcggtcatgccgcatgtccagtccctcagcagatcccgaatctgaacatatccctcccgcgcccaccttctagtcctcgttcatctttggcctggtttttattgtagtacacttctccttgcacccttgcttcctactactgacattgaacctcagtacaacaactagagtgatcctgtcaaaacataacagatttggtcacccagcccctccagaggcttcccgtttcactccacatagaaaattccagcttgtgcaacctcacgaagcccacgaggtcagcctcctgcaggccttttctgacctggtgcctcactgtctcaccaccctccacccctcaccagctcctgccacactgttctcgctgcttctcaaccctctgccttcaaacgtccactccaaggtctctgcactcagtgttctcttcctggaatgttctatggccacatggttttcatctacattttctttatccaaatgtcactttctcagggaggcccttcctgacatcccctcccccatctaaaattgcagccccctccagctatacctcttctcctcctcccctcttgtttttctacttttgttactgcttttattttacttctttatactatttattttctgtacagctatgaatacaactgaaatgtgacatgaattttcatacaacatacgaattttggagggacacactcagtccatagtatatgtaaatctcatgagggctgaaagttttgtctgttttgttcactgctacatccccagcccttagaacagtgcctggcaaatagtgctaagtaagtttttattgataggagggaagaaagggaagaaggaaggaacagacagacccttggagttaggcattatctccatttatagatgaagacactgaggctctgagaagtttcccaagatcacgcagccaataagtgaaaccactttgaggtcacacatttgaaccctaatgtgtgaccccagagcttttctgatttctactttactgtgctgttttcctatggatgcctcaccctcatttatgtctgcagtgaatattggctctatgaatttgtatgcacatttgtagtgatatgaacacattcaaatgttttaaagggaatactgcattagaatctcttagctccctagatgctgcctgttggatactccactaagctttctacattgccgcccaagaacaagtgatgcctgggctcctctgagagagagaggcgctgagaaatctgtaagcaaccgttactaaatatgtttgccatatttccagttacatccaggcttttcagtattgagggacatcattttgtgttttgattcctggcatatttgctatcagtatatgctttgggggttttcagtgaatgaaaaataagaggtggtgtcagcaataagtgtagaacactcttaaaagatatggctgtagagggaagagcagggctggagcagcagcttgaatgcgagggaaagctaaaggcaggcttttttaaggttgtgtagattaagaggaagaggctgcaaagattgaagcgatgagaaaagagatgattgacagagcagtagtaatatgcaggacagggtcttacaagagcacagaagaagggtttgaattcttggaagagtcagtctatttatgcaatttaaagtgaaggaaggaggccaggcgcggtggctcacacctgtaatcccagcactttgtggggctgaggtgggtggatcacttgaggccaggagttggagctcagcctggccagcatggcaaaacctcatctctactgaaaatacaaaaattagctggacgtggtggtggacacctgtaatcctggctactcgggaggctgaggcgtgacaatcacttgagtctgggaggcagaggttgcagtgagctgagatcgtgccactgcactccagcctgggcaacagagcgagactctgcctcaaaaaaataaaaaataataaaattaaaaaataaaatgaagggaggaaaagatttttttttttctttcgagatggagtttcactcttgtcacccagggtggagtgcaatggtgcaatctcagctcgctgcaacctccgcctcctgggttcaagcgactctcctgcctcagcctcctgagtagctgggactacaggtatgcgccaccatgcccggctaatttttgtaattttagtagagacggggtttcgccatgttgaccaggctggtctcaaaactcctgacgtgaggtgatctgcccatctcaacctcccaaagtgctgggattacaggtgtgagcaactgtgcccaaccaagatttgtttttcttagtgaagtaaatagaatctgtcatttgtatgaaatggggatggagttgaaaaggaatacaaagcaaatctctattgcactcgaactgtgtttcaggcactgtccggggcgggggacagggtacaaagatgaccagggtggcctcctgtcattaaagcatggacgccagcttttcagcattgtatgcagcaccccaaccagccttgtgaagaaaagagatatgaacaaatggtcacacaacagtcggatacccacactcagaaagccacgtgcagaggcagcacagtgggtagaagcagtggtttgtgtgcatggacaggcattcctgaggaccaggtcgaagttgagaagtcacagatttgaagggttcctgctggtggcaggaacgataaaagtagtagctgatgttggcacgactccataatgagctgtccccccaccttcctgctagatatttccatctggagtcgcaaagatctttcttcttcaatccaaatcaatacctttcatctgttgttttctgtttaagcgatagcagtcatttgcaagatatcattggtcatctaaagtctatgtggaaggaattaactgaaattcattacttgatcagagagtattttttggtcccatctttattttgcttctttttctttttttcttgcttcccaggcaatgcatagtccttataccactttatctccatttgccttttcctatcttttttgctgttattgtcatgtattttagttctacttatattatgcttaaccctcataaaacatgatttttttagcttaaataattgatataatttagatctctacacatatttatcctgtatattggtactttctgagtttaattttaataagctgtgtccttaaactttttagagtcagatctctaaaacaacactatctgatagaaattctcttgtcagattaaaaaagtagaaacaagtgaacttatttttaatgttttgatttaactcattatgtttcaaatattatttcaatatgtaatcaatatgtaaaaattgatttatatttttcccactgtctttgaatttattatatattttatacattgtatagcatatcttaatctgtagtactaatcaccttctaagtgctctgtagtgtgtcaacttattggacagtgtggctgtaaacgaaggtgaaactaaagttacatgaaacaaacttatattgtgtgtttcaacagaagagtttcaagtttctgtggctaacttgtttgaatatacaagttattataattctccattactatttagtcagcttctcaaaacttttgctaagtgattgtttccaagatttcccttactttttttttttttttttccttttctctgtagacagggtctggctttgtcacccaggctggagtgcagtggcatcatcacagctcactgcagcctttacgtctcctgggcttaagccatcctcccacctcagcctcctgagtaactgagactacaggtgcatgccaccacgcccagctaatttttatagagacggaatcttgccatattgtctagattggtcttgaactcttgggttcaagtcatcctcccacctcggcctcccaaagtgctgggattacaggcgtgagccaccatgcccagcctaaggtttatttcttaaattgaattctgcctttggtagcatgcttagaaaacaagttccattacattttttaaattgtagaagagttgatcattagaatattgcgtagtatatgttcagtttaaagaatgatgaaatgaaaacaaggacctagcacttagcttagacagtagaatataccagtacttttcaagccttccaggtgacatcttcttccttcactttataccctgaggtgttcactgtcctgaatattgttttaatcaaatctttctcttctgtttacagttttaccaaacatatatttttaattctgcctgtttttaactcacatataagtcatactgaatatattcttttgtgaccttttgtcacttactgtgacatttttgagattcatgcatgttgatatatgtagctgtagttcattcattgtcactgctgtatagtattccattgcaggaatgtgctacagtttatttattttactattagacatttggactgttccagtgtttttgctggcatgaactgatgttgttacaaatattcttgttcatgtttcctgcaacacatataaaagtctctccattatgggagttacttgattagagagtattttttggtcccatctttattttgcttctttttctttttttcttgcttcccaggcaatgcacagtccttataccagttgacctccatttgccttttcctgtcttttttgctgttattgtcatgtattttagttctacttacattatgtttaaccctcacaaaacatgatttttttttttggcttaaataattgatatccgttagatctctacacatatttatcccgtctgcgtcttttattcttttctttgcctatccatacctccatctgggcccttttccttctgctaaagaacttccttttgtggctcttatggcaatgaattatctcagttttgtttttctttttttttttttcttgagatggtcttgttctgttgtccaggctggagtacagtggcacaatcttggctcactgcaacctccacctcctggattcaaacgattttcccacctcagccccctgagtagctgggattacaggcacccgccatcgtgcccggctaacttgtatatttttttagagacagggtttcaccatgttggccaggctggtcttgaactcctgacctcaggtgatccgcccgcccatcccaaagtgctgggattacaggtgtgagccaccgtgcccagcttcagaaaacatctttctttcacctatatttttgaaagatatttttactatgtttattctttcagtcttttatgatatcatcccattgttgttccatccatttctcttgaaacagctttcagtattattgtttgtccttcaaaggtaatgtgtccttttttttctttgacaacttcaagatttactctttgtttttagtttctattaataatatgcctcgatatgattctcaggcttgggatttgtagaacttcttgaatttgcagtgaagtctttggacgattttgggaaactcttggccagcgtcactttaaatattgtttctgcccccttttttttctttcttttccttctgtgactccagttatgcagaatttggaccttttttactatgtcacttacacctctcatgctcttttctgtattttcacccccttggtttttcttcatgtttcatctggatattttttactacctcattttctagtttgctaattctgtcgactctgctgtttcaccatttactaaaatcttaatgttagttttctggtaaaactgtccatcttatttttcttctgaagatagtaatcatactataccagtgatgaatcttgtattttttttcttagtcttcagtcatttagtcctgttttcttacatatctggaaattttaattgaattcctgacattgtataagaaagattttagaggttctggccaatgttatttttctccagagaggagttaaacttcttctttccttctacctcagatacccagtttttaaattttcccccatgcatacctcccctgcatttttaactttttatttgcggcaaggggtaaatattagcaggagtttcccagagggacttgtatttttgaaaggatcaaagcctgatgcttaaagggaagagtctagaggaaggattctttttcttgggatagacaatagaaagatgaggtcagagacagtgtgtgtgaggtagaaagtaatcagcttcaacccctggagtcacaacagaggacttaaggaaactgagtcctgaagaatccgttctgcttaagcaggaaagttggtgaatcttttttataaacaagggttaattagttctcttctaagtaaaaagtacattgaaccagatctctcattttcctatctttctagtcgttgaaggttttctcttaaaatcaacaaaaggcatcaggataggccgtgtagccacctttggaaagggcagatgttgagttaagtggattctgttctcttccatagtccaggacttttcagacctgaaatcagttaacctggagatgactaattcaggttcaagacaccagatctgctggaagtagatgggtgtgaatttttaatgtcctttcccaggtcaccctttgtggattgagagatagcaaaggttggaatgacgactgaaaggccactgaggaatccaagggacatcctaggcaaatcctaggcaaagaccagaggtttctgaggaactgttgggaagtagctaagctgcaagtttattcctattttagcccatctgaaaaaaaatgggaacatttgagttcatttttaaaagaaccttcttttgacctttcatttgagcctgggatcaagccagttttctaaagaaatgagacaggacttaatttaagtaccttagatttgaactacctcccattcccattctacctcctctgcaaaagacaggttcaacttctttgttctcccagatgctaaagaccagttcccaattggtggtcttacccagatacatgacacttgtgtataaataacttccctggacattgctagaagtgaagtatcagctttgcatgtgtagctttcccaaaatgcaggtctatcctacccaccaccataaaaagttagttgttagaaacaatagcttagtttccactgtgaatggtgtattactcttagatgggtcaggggtattttgaatagcagaagactggcaaagatcagctggacatggtggctcacacctgtaatcccagaactttgggaggccaaggtgggcggatcatgaggtcaggagtttgagaccagcctggccagcatggtgtgaaaccccatctgtactaaaaatacaaaaattagccaggcatggtgtcgcgtgcctgtaatcccagtcactcaggaggctgaggcaggagaattgcttgaccctaggaggctgaggttgcagtgagccaagatcatgccactgcactccagcctgggtgacagatcaagactccctctcaaaaaagaaaaaaaaaaaaaagaacaatggcaaagatcaagaggaatgaagattgaaccaaatgaactttcaaaatcttctttttttaccctaggagcatggttggttttgcctgctttctctctatagtcctctttctctccatagtcctctttctttccatatccccctatatttgtatctccatatatgtccattactggtacatgaaacaggcctttccagagcagtagcttcttttggagttagtttgcttgaccagaccagctctaacttagcaaatgttttagctttggtgttctacgtccttcaggaaatcattctcctataagaagctggggtggaagaggagacctctcctccataggcagcacctcttgaaatcactggtcccaatctccaccccagtctggcctccatctttcttcctagtataaatggtacatactagtaatgtaagctggtgtggtgtgatgtgatccacataacggacatgtaccaagcctcctatttctttgggacctgtttcagattgtcagagtagtagctttgggaaaagaagtagattctaggccacgtggcctccggaaaggtctgggtgatggaagtgggccaggtgtctgagttacggatatggatcaagaaagaacactggagcctgactcctcttccttgtccagatatttgcatgtaatttttcagaaattttttaatatacttttgtcagctgccttcctttgtcagttctgctacttgggagagaaaagagatatgcctgatatctctgtataattttcactggcatttaggaaggaatttttctacgaagacaatagcaaaagtcatggttgggttacctctctaggttacccagtatcacacatagatacttagcagacttttgctggaaatgctcatggtctttccagctttatctgtaaaatgagcataataatactacctcacaggattgttgtgaggattaagctagttaaatatttcattgatgagaggccccaaagacagtggctggcacatgacgaacgttgttggctgatgcttatgattccagaagttccactgtggtcttcagtacttggaagtttgcccttacctactctgccacacactcatctaaaacttaatttatttaaagaaatagttgggaacggatttctttctaaaaacctcaaaaaacttattccaaacccttgaaacctattttacttttgccacaagaagctcagcttatactggtgcccagcatctatgattattctctctgatgtcatcagcctcctttcttctaagcctttggcattaaagtgaatatatttattcatttgaaataaatacaaagtactttgtaagaatggaggtcttgtgactaggaaggagatcatcttgagcttcttttctgttgaggaatgttcggtttcatttctaaagttctgtattttgcgattttaattgacatatttatgctttcctttgttccagaatgggcatgaggtgatttccatagtttaggatgagacatgcaagattcagtgggggagaaagaggagggaaccggagagcactcattggaagaaaggataggatttccagtaataaccctttgatttgtgtttttttccaagtgctttcgtaaccaaggtcgccgtgggtaactccatgggtggtgttctccctgttttgtagatgaagacactgattctaaagagagtgtgtcttttgctcatgttcacccagctgatactaatgacaagagttggcatcaggactctgcttttgagagcctgtgtgttttcttggagttgaaataagttatctgccaaatcaggctttatggtgtgaccgccatagagggaattttttttcctgcattataatctatctcctggttcagtactgaggcacaagctatttatgcaaaaaccttgttagaatggcaaaacaggagctctcatggggtgggaaggcatattccccatggccagtgctaactgtatggaaacctgtcttcaggcttccctctgcatgcttcatggggtttcagcaacagacaagtaggggtctggcattttcaacataagcataccccccttctgccaaaaagtcctacactgggtcctagctgatgaagagctgaaaggcaggacacaattccatccacagctgggcttcaggattcatccttccttcataattctttataatcaatgtagaaaaactatagggaaaataggatttgactaagccccgacttctctatgttgaagatcagttgtcttgattctacctgtgtacatcctgcttatttctgcggtttttactttatagcatactccaccaatcctttttaaggaaaaagcaaaatcctattatgggaatgcttcaaaccactctgagcttccagattaatctgaaacagcatctgagttcacaactgggtcagagttgcagaatagcaagagaaacttgccagttcagcaggcgtgtgtcttgggttagttaagacagcaggacagtcctgaggcctgacttccttgcatgtgtttcaaccttgggtgctgagataattctgggtggctttagataactttgtttcttaactgaaaaaggagtgtctgttgcctgataagtgtttatccgtgaaatagcaacatggtgtgcatcttagggtaggagggcttttagatctccagagaccaggaaaaaaaaaaaagcaaggtcattggcttaggcatattactggaattaggatgtcagtcccaactttaaaatgcctgtattgtttttattcagggtcccctttctggattcctcccctttttttctctttgccttaagggctatacataatccataaccaagtagaactgaaaacagacaaaagcactcctcttctagtggatagaaatctggaatccagaaatgcttccttcttgccaaacctcaacttgttccgtgccttttttttttttttaaatgcctcttcccagcctccccaccctttcgtgatttggctgagtgaggactagctgtttggtttgccttttatcaacaatagatattcactgcttttcaggtcacattttcctttaactcttctctgtttatgagtatcacaaaagggttcttcaacatcaaggcaaaactcacactcagaatactttttaactgtggatattttgacagtatgaaacggaagtcagtggtgaagactttcgttttgaagtgacttaggtcttacatgactcaaagatggttttcctagtagtataccagcagagttgaaaatgactctgaaattgaaagtcccatactacttctaagaaacttgtaaaaagtgttggccaaatgctacaccaaacattttgcattaattattctcttaactcttcaaaacagtcctttgcaggccaggctcggtggcttatgcctgtaatcctagcacctcgtggggccgaggtaggcagatcacatgaagccaggagttcaagaccaacctggccaacacggtgagaccctgtctctactaaaaatacaaaaattagccaggcgtggtggcacacaactgtaatccctgctacgggaggctgaggcatgagaaccgcttgaacccaggaggtggaggttgcagtgagctgtgatcgcaccactgcactccagcctgggtaacagactgagactcagccagcaaaaaaaaagagcaatcccttacagtagaaagtatgtgattttagcagatggataaactgaggttcagagaaattaagcctcttccaccagcatgcgtgtttggtaactgtcagggtaagatttgattcctttgctcctgcttgtttgactacatcgtggcaactcccacaaagttcatggcagccttacttagaggcacaatagatagttgggttttccaaatttatgagttcagacatagcttattgcaggcaatgctgattagaattagagctgtgctggtagctgaggtttgcagctgtacaaccttgtatagtctctgacttgtggtggtttaacttacaattttttgacttgacgatgacgtaaaagctatatgcattcagtagaaactgtacttcagattttgagttttgatcttcctgggctggtgacatgtgatccgattctgtcgcagtgctgggcactagggcagccgcagctcctagttagccacgtgatcatgaagagggaacaaatactctacagtgggccctgctgccagatgacttcgcccagctgtcagctaatgtaagtgttccgggcatgtttagatatgttaggtgtatgaaattcatttttacttaaagccttttcaacttaaaaatgggcttacccggacgtaatcccatcataagtcaaggagcatctgtacttggaagaatataaaacttctccatcacactacggagtcctgccacttctctcttttcctgttgtatttggttaccatcttccctggtgacaaggaagatactgccaccagcaattactcagtgaggcaaagatattaaagaggaaatttccattaggtaaataactgtgaaagaagaacccaagagaagggagagaaattcaagccccagctcctgttacactggccaaatgcctttggcaccccatgcttgctgaagatcataaaagggtcaggtaaactgatcagacagaacagaggaacacagtgtgaattttttcccttgccccattccagtgtctacttgaatttcagttttagaaaatcaacccttcggagccaggccccaaacccaggctaatttgcagtgtctccatttgtgtagacaatgagattattttgggaaggagggtgttgacagagtgtgtgttagctattcagtagaactggcatcttgaagtacttctgagatttttacccccttgctgaaaatattgctttatagaagttaatgactttggactgtggccagaattcacaagtatggcatgtgttgaagtgaaaggaaggggaaaatcattgtctttgtgagtgtaacactagattttctgaaggacattttgttccttggaacctttcattttagctagaacaacatgcacttgaagccttaagtattttgtggacttgagattgctacaaaatgaggtaggcagacttaagtctctgcaaatgctccttctggtgttaaggtattataaccaaagagttacaaattgtctgcagattaccttccagttgctagtcgctttcccagtttagaagcctagcacaccctggtgctgttatgccctgctgcagatagcttccgctttgctggggggatatgccatgccagatgctttacgtgcacactatccctgaatcctcaagacagtcctgcagaatctgattattcccattttgcatataaagaagtcaaagtttagataacataatactatttttattgaatgtctcatatgtatcaggctctgtgctatgtgctttacatgtattacctaatccttacagcatctttgtagggaatatttgtatccccattttgaaaaggaggaaaacagaggcccgcaaaggttacttgtctgtgatctcatagctgttgggtgtcacagtcaaaattcaaactcaggtgtgattatctttctattatgccacatccatacttccctactgaggtcttgaaggcaagagacagaaaccacttctgatttctgattctctgtctctagcctgccgtacaagtagggcttctgcacatgttggattgcttggttgactgggtgtgtagtggatttgtacttgctcatatcgggactcatttttccttcgtctgaataatctggacctctatctccaggctttacttgtcacaagacagtgggaggatgggatcatgaaggatggcctgggccagtcactccctacatgatggtgtagctcttttgggtatctctgccctgttttgatgaccatcttcaaagtcaaggacctgggtaaaatagtgcttccaagcttcagagaagagcaaggccagagggcacccatgatgagcaccactggaattccctccctccacagcccacttgttttctgctgtctttgagggagaaataatggctgggcaggacttaccttcccactgaggtggggaatggggtagaattaaggatgcctaactaaatgcctccatagtaaaaggaggccacatgctttatggtagcctggattcaatcctcagagtgcagtgaactggcccagggccctgcctttaccactgtatccatcatttggctggctttggtttagtttctgtaaaacgtctttcccagtaaaatctgattaactactcatcaatacaggtttggttggatcatagatttcaacatctactcaagttttctgggttctcaaagctgtatttctaggggtgaagacttttgtaatggttgactgttaacaagtggcaaaggacaagtccagttggcttgcataagcaattttttatggacagagaaacaggaattcagacagaagtcctacagtaagttgagataggtgtaggtacctttccatggcaaaggtcttcatcttacggaagaatccagcattagagggaagagtgatctcttaggtcatctcatcccatcctccttgggtcaatacattgtctttgtatagagaacacccaggacccagttggtgctggggagctgaggctgccacagcagacttagttggaaattaagcttttggcataggctcactcatcaactttggatattaattgatgggagtagaagaagagggagtgatattgggtattctgcctagattattctcccatattctcttggtgggggagtattataggatttttaacttcctcctagttagctgccagagataggtaaagagcactttaccctatctgtcttccaagaaagagaatgtaagctcttagaaagaatataagagcttgagagaaacaggaaagacctgaataagaccctgaattggctgcggtgctcctgggtctcttcaggtggagatgtgtcccctggagacacacaggacatgggcacgcgtcacttaactgtggttctcacagcgtctggggcaccagagagacacgtttttgtctggaacctgaagaacgctggcagcctacataattctaaacatagcaggcactcttattgattctttccaaaacaaaggtcacatttcctttctgtgtagtttgtgtcctgggttcctgctgactgttttgtgtatacgattgttaccttctcaaagagactgtcagttcttgagggcagggttcaaggctgctgtttgtttgtgttcttcagcagtacctaaatctgtcctgggctcagaggaagtatttagtaaagacattctaccttgggttgtaggtcacacagtgccagagctggaaaggattttggaaatcgtagagtccaacactctaattttgtaagtggtaccactccaaaaacttacttgggaggctggtgtttatctgctggaaagagaggattttattatgttaaactatagtgcaaatgaccataattctaaacctttgacaggcttccctcaaacgctgcaggcatgttcctccttggactagtagcagagtaataagaacagtaagaatgctaactagataccaggcccccgagccattgtcatgaatgcttccagccacatgacaaagtaggtactctggctattctccagatgcagaggaggctcagaggtaggtgacctcgctcagggtcatgtagttaccagaatggtcgagggaggactgaagtttggtcagatgccccagcttgtggcccttctcctatactgtggtaactctcagatggggtctctgactgaagccactccttagtgattcacggtgctagctttgcagcgtcgtgtggtgtttccagttgtcctaaaggaagttattaattttcattaactttaattctctcattagacaggcagtgatatggaaggcaaggcagaaagcaaacaaataatgataggggttacatctccagaaaggtcaggaatcactgccctaggttgtaaaatatttggactgagtaaaaggcatgagtcttcccatagcttcttccaggaactgttgctttacatggaattgctgctgtgttcactagtccctcttctgtgcccagaactcactgtcacatgtgtcaagaatcctcatgactgaggtttccagggcagatctgatctgtgtaacacgcaccctaacccccttgccaaaggagaatgaaataggcccctagatggccacccagttcctgggccttccaggcaggcagcttgccttgaggctttcccctgagccttgtatctaaggaacattcctgtgagttttctaagaggttagtcctgggtcattggcacttaaaccacttgttttggtagatccttcctgagaaggttaattatatatttgatatccttctctttttatgcctgaatgatgaggataagtactctgtggtttattaactgtcactttaaaccttttcagattgtcttgtgacaaaacagagttttatgtcctttttatcccagctttgatggatgagacagcttttctggttaaagtatgccaggataaataaaatctctgaattgtggaaagggtgggtttgcatttgaaatcatgagttcaagtctgccacctcctatgaacggtgacctaacctgttaatctttccatcgatttcgtttttggcttttgacaaatggagcttggcacctcataggtactcagtaattattgaataaatgaaagacagcattactggagggagtttgatgtctccaaatatttgataccaaaccctaaagcaacaatctgacacatttcctgttttgaattccactaattcttagagcaaagagcctatgttcttaccatgatacagtcctgaagctcacttctccctcaagactattttgttatacctctgattttttcagtaaatttggagtagtattctggaaagtgaatgtcattaaagatttttagtagttgctttgcaaagcctagtgtcctccattgtatgcatcccccaattggtatgtgtccagtccttttgagaaccactcaacctggggcagacagtataggtaactgcatttaaaatatttaaatttatttatatttaaattattggccaggcacagtggctcacgcctgtaatcccagcactttgggaggcctaggtgggcagatcacttgaggtcaggagttcgagactagcctgaccaacatggtgaaaccccatctctgctaaaaatacaaaaattagccaggtgtggtggtacacacctgtagtctcagctactcgggagcctgaggcaggagaatcacttgagcctgggaggcggaggttgtgatgagatgagatcacaccactacagaccagcatgggcttatctaattgtatttaatttaaatttatttaaagtaattcaaatagtaaaaatagtgccaagactttaaaactcttctcctgcttttaactccttctagtttgctggaacattatcagatggcttagggaagacgatggacaatcggcatcagtcagagcgggagtacatcaggtaccatgcagccacaagtggtgaacaccttgtagccggcatccatggcctggctcatggtaagtcatgggtgacatcaggctctgctgctgctggtcctcagaggcgcctttgtatcaatctgattgcagctataaaaaaagaaaggtgggctgggcgcggtggctcatgcttgtaatcccagcattttgggaggcctaggagagtggatcatgaggtcaggagtttgagaccagcctggccaacacagtgaaaccccgcctctactaagaatacaaaaattaggccaggcacagtggctcaatcctgtaatcccagcattttgggaggtcgaggcgggtggatcatttgaggtcaggagtttgagaccagtctggccaacatggtggaaccccatctctatcaaaaatacgaaaattagacaggcgtggtggtacatgcctgtagtcccagctactcgggaggctgaggcaggagaattgctcgaaccctggaggcagaggttgcaatgagctgagatcgtgccactgcactccagcctggcaacagagcaagactccaattcaaaaaaaaaaaaaaaaaaaaaaagaaaaggctgacaacagaggaaatcctgtgttggcgtacctgatagccttccaagctctcttactttatcctccttgcagttgaaatacgacagccggtgagaactcctcattcgctttctgaatgttgtgcacattgcaattccttttcgttctctggcttctgttcccaaagtatcataaggtgtaatcaaccagacctgttcttagaattgtagctgctacttctcttagaattgtaacctctgccttctccttactgatcattccttccaaagaaattgaaatgaggaatttgtggccaggtttgtagcccaggtgttttttagttttacataaatgtgcattcactaaaattataaatttatttgcctaagagatgttggtgatggcatgaatgcatttggtctctgactttgaattcttttaatgctttaattctgagtcatttgccttttgttgcatttttcttaacaatttcttagtacggcatccaaggcccttggaactataaatccagccaattttccaaccaccatccttcagccatgctgcactttggccacacacagctatgtactgcttcccaggtgtgcttccaagtccttgctcacacatggtccttctgctctccctcctctgcctcatttccttgtctatcaaaatcctactcagcctgtaagtcccaactcaatacattttcccagctctattgtccctgttagagttaatgacagagcacagtctgggttgtgtatgtcaccagctgtgtacatctgatagattgagaatgtgaggaggggagaaggaccactttgcattcacctttctccttgtgtacctcacatgacacctggcacatagctcatgcatagtaaggcttagtaaattaaactctttgtaccagatccttaggaaccatccaaagctatcagagtcatatcaagactgatcagtattaattatctgcatttggaagaagaggaaggaatatagacagtaaaatattatatttctatttgtgcttaggacacgtttagaatagagtttttgtttatcagctttcctaatggtgagatttggatcaaaatgcctttgcttttcctaaggctgcccaaccgtaaagggagctgtccctaaggagacgtcaggccagaagtgaaatttggctgaaagtaatttgtttatggattttaaaagttgactgttgggcaatcatttggggttaaggtttaatcattctttctcgtaatggtaatgacagtacattggactcttagaagacttttaaaatgaatataaaatgctttgttatgtgtggtggcctttatctggccagcatccttgtgacgtggagagagcatggctctcctcactttctggatgaacacacaaatgtgctgagaaaatgcatgattggttcaaagttgcaaaatcacctcccatcaagaatcattcctataatatgtacagcctctccaggagccaatggcttcatccaaagaggatccactgagctctgggttatacgaaggcagtatcctagagtgagagtcttcccttaggatgaaaagacctttagaaggtgataagaaccagaatccactcaatccccttgatgtaagaaatgggaattgtgctcagttctctctgcaggccttgctggacccaggttcagtcatgttctgtctctcaggtcccagtctgaattcctgttctgtgtgtgctctgccaaaaactttgttcaaaagtttgggaaagggctgggtgcagtggctcaggacagtaagcccagcactttggaagacctagagggagaatcgcttgagcccaggagtttaaggctgcagcaagcggtaatcatgccactgcactcctgcctgggtgatagacggacaccctgtttctaaaaaaaaaaaaagtttgggaaagagatattgcctcactggagcaaatttacccagaatccaaaagaaatgttgtgaattgttagtacattctcacccaaggagtttcctttaccaatttgtctcactagagctgaagagtctagagagcttcctcacaccccactgtcagagggtaaacatcctgtgagtgtccctggcacaggtcctggagatgctccctagacgggctgcctcttcccttcagtgactgtgacctcttcagcctctgccagcttctggcctcttctaaggtgttttcagccattgctgtcaacttgcaaaatgtttggaatgcctttttgacctggattggtcttttgaactgactccattgagggtcccagccagctttcacagctttttggggtgctcttcatgaaggttttatataatcgccgataccgaatttcatcaaagcatgcagtagcttttaccttatttcaagcatccagtggggttggccagtcacccccatagtgttctttgaaaattgcaaatgtataccatcagctctccatatccacagattcagccaaccatggatggaaaatatttggggggaaaaaagatttcacgaagtgccagaaagcaaaatttgaatttgccacacgtttcaaatactgtattgactccacacaaatgaagtgatatgtgggcatcgtattagctacaataaataatctagaggtgatttaacgtatacaggacggtgtgtgtaggttatatgcaaacacctacagcacattatgtaagggacttgagcatcctaggattttggtatctgcaggggatcctggatcaatcccacatggatactaaggaacaactacatttagttatctctctctgccttagatatctttcttttcttttctttttttttttttttttgagacagtctcgctcggtcgccagactggagtgcaatgctgcgatctcggctcactgcaacctctgcctcctgggttcaagcaattctcctgccttagcctcccgagtagctgggactacaggcacgcatcaccacgcccagctaatttttgtatttttagtaaagatggggtttcaccatgttggccaggatggtctcgatctcttgacctcgtgatctgcccgccgcagcctcccaaagtgctgggattatgggcgtgagccactgcgcccagcctctgccttatatttcataggatgccatcatcttcaaactttccccgaaggcccaattttctagtctcctgttgatttaatcctctatctgtatcctctcctgatcgtccgtaggctgcccaagctctgggatcgaaaaattggccactgttaacctctcagcttttctctgatttttttttttttttttttttgaactggagcacactttacttctgactaacatgtaacatatatcctctgactctggacttaatgggcaaatctgcaggatcctcttctgtgagttggcctgtctgtggcctctctggcacagagattaatagaatggccttaagttatcattccataatcaaggggtttggctttaaatgcttttgcttttgtcctcgtcaggttacaacagcccttgtctttttcactaggtatcattggtggactgaccagtgttataacttcgacagtggaaggtgtgaaaacagaagggggtgtcagcggtttcatatctggccttggaaaagggcttgttggcactgtaaccaagccagtggcaggcgccctggattttgcatcagaaacagcccaggcggtgagagacacagccacactcagcggccccaggtcagtggtgtgggaagaatggcttttgcagtttccagcctaggtctgctgcttctcctaatccatactgatgtgtttaattgtgcactttcttagttatagggtttttaattcaaatacttgtaactgaaatttctgatctgcctaatataaaaagatgaaaatgaggtacagaaacctggcatgaattttttcagataaatatatatatagcatattttatatatgctatatattttatatatgtatgtatatatagcatattatatataagtatgtataactatattatgttatttttctccattagagaggtcagaattaggattaaactgttagaagcttcttctgttcaccaagccaactggatccccacatgcctatgaagaaaactgtcagattgtagtctggttcttactcctacaccccgtgatatagttctagaatccccactgttgttgttcaccatgtgggtctgttccttcttaattttccttccgcttgaaagtatcagccccaaccccataaagaaaagtgccaccccccatccccccagcaggtcagcagttctgctgtgggattgctgtctggccttgataccagctgagactggaaatcagggacagcccatatggttccaaaccccacagaacccaactgctttaacgtagctgtttgcttgaatggcctattttagcctcccttttccagagtgactaattggggattcttatcaacaaagggtataatgaatgttaagggcccagccaagctagactcgacttaagcccagaaggattttgctgctgcttggataatagattttccctgagtgaattagtacgcccttttagaatgcctagggcctggcccacatccacaccctatcactccctcaaataggatgtgaagtgaaattgtccccaattgaagtgaatccatttgtctgtcaccaggaaaacttactgaagacacattactgcagtaggggaaatgctccgattgtggactggggccatgcagtgtgctgtgccagaatgccttccatctggaagcagctgagtaaactctgtatggtttactttagttaagttacattctattctcagatacaaaactaaaacaatccttgagtatattttgaagcatttatgaagttgtggggaggggcaggcagtgaggaggcttcgaaagtatttccagttagtttttccatctctgctcgaagcccaagaagtccacctccagtatttgttaagataataagacttaatgaagtgtaaagctgaagacgcctaagagttcccaaagaagcatgtgtattcttaaaatgtcaaaatagccaagggattggttgattaaaaagggttcaaggtatatgtgataaattttttaaagatgattttgtgctgtgaagttttaataatgttgacgagaaagaaacggcttgaattttatacattgtcagcttgcaagtcttcatgggggtttttcattctttttaggagcacaagtaatgtagccacagtcactgcagaaagaatgtctttgagagggacattcttgtcatttttattagttgttcaacattgccacagaagtttgattttctgtcagccagtacatagctgccatttattcattgcctgtcagtaaatagtgattgaaaatttcctatgaactcagggttgggaatagcagaaaccaaaactgtctctggtctcaaagagcttataatcaagcagggcagcaaacataaaaaattatataaacacttatttgctgaaattgtgacaaatgacatcgaggacacttagagggtgccgtgagactatgatcagagaaggtgatggggagaaggagggtggctaacctagtgatcaggggagttgagacaggcttttctaggaaagtaatctttgaggtgaagcctggagtatgaagtaggagttggccaggtgaagagaagagagaatcaccttccaggtaaaagggaactactgtgtgtgcaacagcaaaaggaaggaacttatctatgtgccaggcattgtctttgtgcctccacgtgtggaatcccatttaatcttcatagttgatttacaaatgaggacaagacagtccagagaagtcatggagcttgtccacagccacacagctggtgggaaatggtagacctagacttagacccagcctatgtcttgaccctgtgcccagcaccactgcattgcaccctgctgcctgggtctgcgaggagggggctcattggatttctcttgtacgtgtttcagagtcagttagtgtcaagatatggcattccacatagtttcttccctgctgactcaagatttactttactattacctgcacactgacatgattcaggtcttgaccaacactgcatttttgtctgtctgtttcctctggcctgccaccttagccttatctggacctcagcagcagagaccatgccctcatgaaggcactggggagccgttcacagtcagcactggccactcctcatctcagcccaatgaagttttacatttccatgtagatgaggcactcgggatatagaaaagttgtgcagcttgactcaaagcagacagtaattgggtagcctaattgaagtttaactgcaagttccaactttgtaggctgcagaaaaaaaggaaaaaaaaaaacaacaacaacaaagtttaactgcaagtttcatgagacagcgatctgcctaaccattcactcctcctagaagcaaaagctaccgtgatcattgaggcacagccggtcttcatatatcctcaaaggagggggattagcttccacatcccttctctattcctggaggtgccagtagtgggagagtcatggcagaagttaccagaggcaagtggggcagaggcaagtagggtatatgtttggatcagtggatcagtgtcctttattgtgcagaaaaagctaaaattacagattcttctgaagggatacatagcagccgtttcaccaatgtccctcagtccatttgtccaggtccagaagtattcatgaggagctatgcgttagaagagagcacttgggctgggcatggtggctcacacctgtaatccagcattttgggaggccaaggtgggaggattgcttgagcccaggagtttgagaccagcctgggcaacacaatgcccccatctcttacaaaaaaaaaaacaaacctggatatggtggcgggtggtgtgcacctctggtccttgctacttgggaggctgaggtgggaagattgctgaagcctggaaggttgaggctgcagtgagctatgattgtgcccctgcactccagcctgggcaacagtgagaccctgtcaaacaaggaaagagaacacttgatctggaaaacaacaggccagagtcccagccaccttacttattagctttgggccctgggtcaagtcaagacatctatgtaagactcagttttagttttttcatctataaagtggggataaatttatctctctgtttattctgcttctcaggggtttgaagcccaaccagagttattttaatgtggaagctataaagaactataaaaatgctgggtgatattattttaaagtcctattaaaggagcgcagagatccttgcaggtggagaaatgtttcagtgccagtttgttctgatgacactgtatctcttaggaacatactggctctaacactatcaccgagggataaatcaccctggtttcttggaagtgagttataaccatctccaaccatcccggttgattgaacaggatccaggggtgttactcagggtttttccccactgtttagacaacagggactaacaaatgatttgaagggattagaagtgagattctgaccgagggttgacctgagcccagggaccaagccaggaatagaacccaagagtccaagagttctgcctctgagcctgcaattggaatgagactttctgcttcctttgtaatatttcatccaagtaaaggcttagatcttagcatctatgttttaaaagacccaaattttaagcagatgataggaaagtaagccataaaactgtgaaagagtactccttccagtaatccatctgaaaagtggccttacaggaaacattggctcttttttgtgtttatttgaacatgattttatttatagggaaccccccctccttatgttcttttagattaaaatacttccaagttcctctccttgttggagtgcgctggcattccaagcgacagccacctaactttcctctgaaatttccaggcaacccaatagttctcaggaaggcaggtgggggtggggagagaagagggcggaggactgcagagcctttggcctcaacatgagtgttgtggaccaatatcccccactgcatttgttcactgtacaagtatgtgtggtttggaactgaaataagaaaccttttccaaggcaacgttctgctggctcaggttgcatcttctggcctacgtgtattgggccacactttgtctgttcccaagtaaagtttatgaaaatggcacagatgcagccacacttgaggtgccactgaagctatgtgaagagcctgctacccttcaaacagaccaggcccaagcaaggtgccaagccatgtgagagtgcccagtccactgtgtaaatgtgacggcctttgatggtagtgtttgaaaagatacttagtagaaagttgcagagacccgggagcagccatttcacaaaagaaggcaaaaatacctttgagaagaaaggaatgtctgcctctgcactatgtatttgcttgtttgtttctccaaataccatctgttgcagactggggtgcatgacattttaggtaagtagcagatgaagatttatgaagctgggccctgaggtttcctctaaaatatttcttcaccttttaagtcaagacccaaaagtggggagagaagtaggagttggcagaacttgaaatatttaaactaatttagcaaagctcaggagtgttggagcttatctcgttatttaagttagataaggaggaaggggaatttgaaggataatgatagatcagtgtttaagaatacagccatcaggactgataatgttctggaatcccgggaccctcggattgtgcacgtagatgtaaattccatttgctctgagaacttttgaaaaagaaagtttttggttgatttcacagaaaagatttatggtgggcatatttgactttttcagtaaaaatagccccaaaacaccacccaaaatctgttaagacacttctcgtgaatgacctcttagatgtgaaatggaaatgggttttcttaaggaaaggccccttttgttaacaatgtttgcatgttacttatgactctccaggataaaaggactaagactcttttgggtcaccagagcctgaatgcagtcaggttggacaggtcagcaaaaagtctgcaaagaggccgggtgtggtggctcacgcctgtaatcccagcactttgggaggccgaggtgggcggatcacgaggtcaagagatcgagaccattctggccaacatgtcgaaaccctgtctctactaaaagtacaaaaattagctgggcgtggtggtgcgcgcctgtactcccagctacttgggaggctgaggcaggagaattgcttgaacccgggaggcggaggttgcagtgagccgagattgcgccactgcactccagcctggcgacagagcgagactccatctaaaaaaaaaaaaaaaatagtctgcaaagagaacttaggaaatgcttccattaactttttcatcctagctgggtaatactgcttttaattactctgctctgagagcagccatttcttatacttggtattacacataggacatcaaacagaattggcttgaattgagcctttagggaacttccaaaggtaaagattgagtaaagattcaaatgtttattaggatataccagtgttcatttttttcccactaatattccattcaaggcaggagactaggctgatatcccatgtatctagagtggatcaagtccaatatttctttcagagttcctgttccttaaaactgtaaatgggttttatattttattccatgtttggcttaataagaaaatatttttaattgctacctggtaaaattaacatttcagaaagatctgatatgttatcctgtggctcctgcctcatacttatctaggaagttccagcacgctccttccagatgagtccggtacgctgtagtagcatccatatagaggcatgtatatggtagaggtgaaaagctggaacttgtacctgtttgaccctaaggctctggttctaatctttgggcatatctgtcttttggcttggtgtaacatctgctgcttgggacagccattgtgttagttaacatgtcagtttcatcacgaaaaaggcattacatttcagtgaaactgaaaaattattgctatatccagctgaagggaagggactgtcaaatatctcctctgttgtccaaacatggcacagtagatatagtgacagtccctttatcttctactcacccttgcgtatatatttgtgaggtgagagccatatattctcacttcctgatcttgccaaaccaggtccttccagagaatgcttgaaggtagatgggtcattttctcattcctccctctacgtgagcaaccccagaagaacactaagacctgtgttgatgacattggatgtctcacttggctctgaaattaagctgatgaaattataggatcggatattttattttattttttttcaagacagagtcttgctctgtcgcccaggctggaatgcagtggcacaacctcggctcactgcatcctccacctcccgggttcaagcagttctcctgcctcagcctccaaagtagctgggatggcaggcgcacgccacctcgcccagctaattcttatatttttagtagagatggggtttcaccatgttggccaggccggtctcgaactcctgacctcatgatctgccgaccttggcctttcaaagtgttgggattacaggcgtgagccaccacacccagtcaggatcagatattttaaagaagcatcttaacagtccttcatgccttataagttaaaattcctctcacaggaacgtaagcagagaaatcttattttctgagacaggcttcttccctctcgctgaactctaaatactgtattcccctttcactcaaaggccccagacgatgccattctcattataacataacttatggaaagctcagatctattgttggaaaaaatgcaaagtgtgtgtgttcatgcacacacgtgtttgagaaaagcctttccatttctgaaatcccaagagtcatttttatgcaagattatctgttaggaaaaaacccacttttttggtcatggtacattataatcatttctagaaaggagagcgtctaatttttgccatttttggcatgcagagatgactgacttcatagaaaccacactatcctgcttccaaaagaaaaaaaaaaaacctactgaatttacatctgaatcaacatctcttcaaagtccagtccttgcatctcaaccagcaggtccttgtgcaaagaaaatgaatgggaagtgtgatttggggttattccatttactttctgatttggggttattccatttaaaaatgaaataatgttgccattatacatctgtagtcccttctgtgttcagtgaatttgtttttaaaactctaacgtgacacctaatattacatacataagataagacatttgagatttttggtttgaacttcaagaaaaaataaaacggtgtctatttctttttgagaaaaaatttgtattttgtgcattagagaaggttgaagagccatttgttatttgtggaactcctctgtaaaggcattggatttacttatttttagattttcatgactatcccatgcctcatgtttttcccttacagaatcatccacctttgcccaagataaaattgaaatctttaacaagaggacccaggtttgagttcagctcccctgctcccagagagctttagactgtaagataattctgagatacacacaggacatttggactagcagggacttaaagactcactgttgtattacagattatggctcggaagcactgagggaaggaaagataggtgtgggtgttataattcacccgtggttttcttgccctgatgtatttatctggtactcttttgccagtctccttctcaaagacattttcttgctaaatttcttactaacttgtcaaatggagggaaaataagattgaattagtaaaacattcttatcacaatatactctaaaagaggctgggcgcggtggctcacgcctgtaatcccaacactttgggaggctggggcgggtagatcatttgagctcacaagctcgagaccagcctgggcaacatagtgaaaccctgtctctataaaaatatacaaaaattacccgggtatggtggcacgcgcctgtggtcccagctactccagaggttgaggcaagaaaatcgcttgagcccaggaggtcaaggctgcagtgagctgagattgcaccactgcactccagcctgggtgatgggagtgaaaccctgtctcaaagaaaaaaaaaaaaacaaaaaacttttgttatattgggcttatataattcaaattaataatgttacttatctatatccttagtggatttactttaatacattgaggaaaccgctttctgattagcagagagaatttgtacatatgggttcttttagaacagagggtctcaaaatacggtctagggaccccctgcggaaccccagatccataacctaaaacctatttgtatatattcatgtacttatatatgaatttatagatataacaatttttataatagtattctctaatgagtatacagtggagttttccagaagctacacaatgtatgatattgtaacagattgactgtagaagcagataggtgaatacagctgttttccagttagcaagacttaagagatttacaaaaatgtgcaggtgccactctcctcaccttctgtgactctgcatacatgccaccagccaacaaacgtacctggttaatttttttgacaagctgctctagttgaaaatacagtgattgataatccatcatcttgctgataagtagcacatatcggcaatgatgggctaattcggactaaaccgtaggagccgctgtaatgcaatgcttccctttggcttcctgccaacagttgtcagccctcctggtttgctcctgacttttactgggtttctagaagtaacaattggaaatattttatcacatatcagaaagacctcttacaataatttacctaatttagttcttcaccttaacctaccatcccaataaattttaatttcggcagggtagtaagtgtagagcagattacttcaaagtgcagaatcttgtccaaaggctgcttggttgtgtttgcactgccctgactcttgcaggtactcgagaaggtgtatctgtttcagaattcacttgccaaaacctcaactttctcccctagcaaagttgctggagtaggataaacccacagtatttggataagctcctttgaactccttgtagaaagcagtttttatgaggcagttgttctgtgttaacaccagagacaattcctagcagatttccccaaacatacttcaaacatcgataatggcaggggtgacccaaactgtatcataaaatcccagggactgcaggagacttcaaaggggagacagagcaaaacctcacttctcgttatgaggagtatgggtcacaggaatcctggctagaatccatggtaacctcgcggagtaatgccaggatggacagaggccagggctcatcagttccctagactttactaattgaccccagcagcacagttagagtggtaataactggcacctgcccacctcctgaggtgttagaggccaaattaccacatgtgaagtgcttttctatcctttagtgagaagatgcaaaccttgaagtgtgtttctatttttgtttgaactatcgagggcccagttaattcagttgagccaattctgaccttgggatattcagatccatcacttagtatgtacaggcaaattgacagtagaaatttattgagtcttgaactcctactatatttcaggcatttaataagtattaaatactgggaatatttaaataattgaggacaaactgctctgaagaatcaccaagctgtttggtttgtgtgttaatattcttaagccactcttacgtgttcattaaagcaagtttccctatagttttcttgaagaactcattttttagtgatttgacttactctttattcttgaaaacaacaaaattgcatttgtgcatatggtatgtgttgaggggggtaattacaggcattttttccctcattaccgggtccgttacagctccttgaaaacaaatagttatagttttactaattgtttataaaattagctaatgatcctttgattttttagtttttttataccttagctgtatttaataaatatttagtatcttctgtgcaattaataagaacaatgggggccaggcatggtggctcaagcctgtaatcccaggactttgggaggctgaagtgggcagatcacctgaggccagagttcaagactagcctggccaacatgatgaaatcctgtctccactaaaaatacagaaatcagctgggcatagtggcacacgcctgtagtcccagctactcaggaggctgagacatgagaatcgcttgaacctaggaggcagaggttgcagtgagccgaaatcatgccactgcactccagcctgggtgacagagtaagactctgtctcaaaaaaagaagaagaacagtgtttaaaaacctgttatttttacctgaattattttgctacgacaaatttatctttcaaattagattttatcaaagtagatatgtattcacttttttaagttgaagtctttctaaatgtctaaaaccaaaacacagtaatctcctgccctacctttccctgattcctgctccctcagaggcaatcactttcaacactttgggctgtttcttcaatgtggaggtatttacctttatatttcataaataaaccaactgctatttcttgacatcatttgacttcatgttgttatacatacatgtttcctttccccatttttcagtacagttatatgatcctttttgaataacttagtattccatttttacgttattatgactgtgtaaatagtattcccagtgaagccccccacccaggtcactttgatgatgtttcctttttaaatgttgtgctttgtttttttctccttggagttagtaactgctctttcagtattgtctgctttgttttctatatgcacattcgtaatttattctcaaatgcttatttagtttccacatttttttaaccctgggcctagtaactcgtttttctttaaaaaagaaaaaaaaaattttatgttcctattgctaatttatccacaaacactcttctgtatgtgtacaaatgcactgagtaatttattggtttctaattaaattctccctcttgatgtcctctgctcccatctgactggttgttgtctagctatttttgtctctaagctatttttctatagtagtactatagcagtactattctgagtttctttcttccatttatttgttttggtctttttctttcatgaatagagacagtccccagagaatctggtgattcttgactatctgttctactcctctttaaagatgaggcactaaaaagccaattgggagctcttggtttgaggctgagggggccttactgtggaatgatcaagtggggacctgctgactctgggctcctgttgagaggagcaaaactgaatggggatgagagaggggacctgaagctctaactgcttcccatgcagccttttaaccaatcttcctgttttcacctcactccaggcctatctgtttctcctttatgctccaggccttcagagctacttgctgcctccatctttctgaaatgcagtggaggccaccatcctaattagctttctgctttgtggcttccactccctcaaggcttacatttcagcgccacgtgtccatctgcttttcagcttctaaaatattgttgacaccttctctttatccttttggatttgtgccatttgtatccctttgctttccctttagaggggtctctggactagatctgtcatgtttaatcagaagtcctataatttagacttttcactaatttgtgtttcctttcttggtgttctttcccctttacccccaactagtggctctgaattagtgtggttttatgaaacccatatccattcagccatggttctatgtattatctcatttaggcatcacagcagcttttgcacagcatctgctcaggcagtctgtggctcttctttccccgaaagattgagaatacatctggtgagaagccgttgccagtcccagcccctgctttgagtctggtattggtctttaatctctcattctgtgtgttgtaaagaaacaggttgtggaaggctcttgtcagatcccaggaacatgaaagaaatagcacaccctacggtagtgacatggccctgtcaccacccctcattgaaccataaaagctattcagaggggccagcagctggggagcgactgtacttagatcctgggtgctgatgggtgttttgtagtttccaagggaagttgctgaaagttttcttatcttgacactccaagggcaagaggtctttcttcaaagagaagcgcttgtttcagaaaaagatgtggaaaggacgtaaaatcacaggttcttccccagttctgaaaaagaaataggaaggggcaacgtggcagtcagtgtgaaaagaaaccacgcatttgcaggaagcaagaaggggttccgcagcactggctgcttccggcatctgcagtgcgagggtaaacaggcctactggggagtcggttggccctgggtttgagtcattgggctgctgcttggctgtgacctggaacaagtttttcccctcttaatctctctgagatgagattcctttgagtcatatgcctacctcggtgggtggttacgtggattaaattatatcatgtatataaagcactcagcctggcatgtggcatgcaggtagggctcaagaaatggtgtcagtgtgaatattctcccctgaatgttggaatgttgtgtgaaggtgaaacagggattgtgtccctagctcttacttaaattcaaccctgtccccgaattcttgctgaccacctgctagagtgtgaggactaggagttcatgtgcttggctgggcttttgtccttcccattctctttcttcacacaaaatgaacagttgaactcaggccaccaaacctggttgagttgctgggtggagggactctcctgggctctgagcctttgtgtgtgggaaccgcactggaaaaggtgtgcagaggccacgaacttgctctgaacccacttgtgaagagcaggtgaccccaaactattgttagtgtctgctgtaaatgatatgcctctgggttcgagcagagttcagccaaaagccccacatgacatggaaatctgtcctggagccaggtttgtcgggtaaaagttatgtagcaaatgtctccaaacattggcatctgttgtctgccgagactaggacaaccgagaatgatggagtgcttaaggaaattaggatggggcatgcgaccctgtaacagctgataaactgtttcaggccaccgtggctcatccagctcttttgataaacagctttaaaagcattacgtggtttggaaagcattcttcaaaaatggttatattttccagacgcatgacagtccactgttcagtattatttaagggttttaaattgtagaatcagattccttttcagtggggctcttggaactgtcgagggctgatctgtctgactcccaccaggacaatctcacaacaatattattatgtaggtcggggtcccctaggtctgttaaaaaaaaaaaagttcagggctaagcgtttaagaggaaaaactatttctttcatttctagctaagtctgatgggccctttcaaacactgctttcatcatgcaccttttatttcacgatttctgcataatgaaaatacaagatcgataactgtggattatcgtaatgccttgagcctttgaaaatgaacattttctagattataaatgttccctttgtaattcatttcaaacttcatcctcccatttgtcctaattcccgaaatttaactgttgccttttgagcctcctaggaaattctgggtatcctttaggcaagggaggtagctcttgggggaatagcattcaggccacaggcaattcatttgcgacttgggctcttcttagaacatatgataagtacaacgcactgtagtgacagattttttaaaaaccctattaaagcccaatatactaatgcagattttttttttttaagttttagagagattcatgggattttattctttttcccaaaggcagtggtggagctgacagagtagcatggagcctcgtcctgatgtattgtgcggaagtggcagcagttcacattcattcagtttgtcagcataggatcagttccttcttgactcaactctctgtgatcaaaataagctattggatgttccctttgggtactggaagcagcttggccccttggcaagagaacaggattgcaaatcacaagagcagagccctgactccagctctgatgctactgtgctttgtgaccttgtgcagacagctttatatccccatctcaggtcattctcccccatacaaagggggagagggtcatccttgccctggtcatgtctgcatggctgaggtgaataactagttgtgtaacttcctggaggagtggcacagaggaagctcccttcctagggctggctctgccatcagggaggaagctggatattagaatgaagaaaaagcccatgcagaatatatggcagcccgataatggattctaaaaataaaaaagcactaggttaatctgcagctgtagtgtacctaaagtattctttggcaggttgtggccctagcctaatccccagctggacttagcaccatttaagtgagttacatctcatccccgcaagggattgagtctgtagccaatttggccttgtcaccacttcagccctccctctgatttcacctttgggaaaactacaaagtggccccagacatacatagcaggcttgatcacatgggtggagtctgtcaggacagcatacatcaaataaaatgtccagggaacctgttgtaaataaaccacttcccgcatgctcagtcatcgtggaggtacttgaatgtttagtttcttttagctgatggccaagaaatcaatgtttaaaaaaaaaaaaacaaaaaacaaaaaaacaccttgacagaggcattttgtacaagaatggtgtgtgggtgtgaaaaagtaaattccaaaacatatttccttttagttcccaaacccatattagatgagtacttcttagccttggccacagtgctagagtaaatagcagtgtcacatagctcgtggaacaggcaaaccacagaatgtacaagagagaagcgtgcacaccagtgagtctgctatggcagctctctttgtcctggtttctacatctcatttgtaagcaacttgtgttcctgcattttcagagtttggccagtttatttacttagaattgcatgttcctggaatattgtcataaaagtgatcctgagatagaaaaagtcaacaggaagcaggggcattgagtttataagttctcagtctgtcttggcccatattaaagtctcattctcaggggtaggtccagctttccaaattttaatatatcagagactcctgatgcatctgggctcatgatgggccaaagtaggccttcaggagtcctcgtgttacacactcaacgcctaatggagactggattcatttacgtgtattaatgtaacctgcgtgatcatgtgagtgcaagtgctttgtagattgtcctgggagatgtggcatattatgactaaagacttaattgaaccctgaacatgtatatgaataactggagacagattgactggattacacatttttcttgaaaatttcctaaatttagcctacctctttgttgccttttatttcccagcttaagtggttctctataacactatattttaaacaaaccagaacaaatagtatacaaaagcatagacaagagggatataacaagagatggttttctgtgatccgtggcacctcctctctaccctgcctccaccaccaaaaggggctttaaattaagattcggaatggcaaattcacttaccagctccaaacacagtagacaaggaaaccttgtgaggaaaatccgagagtatatttacagtttctgttcagaaatacatagcttaacttcgaaggaggaagcgtgacttttcacctgcagatagaactagggtctgatttgaaacagaccactggcttcactgaaccccatcaaagaagtctgcttctgcccggaattggaaagtgccagtgggcatgtagttgctagtatgggatttctgtttttatttttaacaagcttgggcccaactcttagtatcaagatgggtgaagacaaaactgaccagaaaaacacgtatcaagtcagcagtggctcacccctcagaggccatttttcccacctgctcctcttatacctttggtttgtttttggttttggattttttctctatgttcctcctactctttctttctctattttgcttgggccttcgttagaagagttctagtaatcatttcagacttccaaaattcaacccagtagcctcattttacaggtggacccactaatacacaacagctcgatgtgacaaaccatagactcacagttaatcacttggagagcctggattcacctccgcgatgacctgcctttccagccctccagtggcgtcctctgtagtgagttgtaaatgtgccactctagaacattccaggaaagccctcctcttgggctaaactctaaaactaaaatgaagtcctgcccatgtgagctgcttgtttaacactttggatgctaatcagagcattaatgagaacacatggatagattcggcaggtctaatgcttgggaccttctcctatttgattccataagactaaatcccctataaacacttccctcctgtgcacacacacatgcattcacatacagcactcacgtatccctcccttatagccaaagaccgaaaaataaattttttttttctacattaaaaataagaccagctagtaaccagggttggcattcccatctcctgtggaacctggaaggactagcagatagctatagagatctgtctcctttttagtgtggttgtattaagggcaatcttgcctcccatggcaccccagaaaatccaggagttcaagtgggggtgcactgtaggaggactcagcagctgttttatggaaggttcgtcagggatcagactgaagattttgcttttgtgagaacaaagtgaaatgtgacattcaggagcagctcggggcctatatataggggcccagggcctgctgggatggggttttacacttgggctgtccttttgcccttcccctgaactcttttcacttcagtcatgagcaaacagtcagtgcctgaactaacaaccctgtagtcctccgaagcacggctggcttacagtaccgaacaaagggagggagtgccgcgtgggccggcccaggccgaggaatgcggcttcagggttctgctccataaatttaaccagcacgacgaaaaggagataatatgagccttcgtgatgatctgaaagggggaggttctgtgtcccattgattgcggtctggcccaatgccaggcccaagcctgaccgacagttgaaccatatcattaaggcgtgtaatacagctcgagtcttgtactgccgccaatgagtgcatatccacagggcaaaagtttataaagagtcgaggctgtcctgtttaaccctctcacactgcatgtaatagaaccagctgccattcagaacttgcccatctgaggtcataaaggaaagcctgcacgtttcttttcttcaaacagcttttcaggactggggagaggaagaaacgctgtctagagagggtcaaggcacggtgatgtttctctctggagaagcaaagcagtctgcctccctccccccggccagaaacgggacaccttagtgctttcttcagagtagctctctgtttgtggtataatgttgctggaggaaacagggctgacaccacaggaaacctgcctgtctccaaggaggccgcatcggtggcagaggtgggtcagatgccggccgtggagtgctcttgtcaagcttgggatgatgccgttttccttccccatcacctcgaaagctgttaatagccttgctttctggccttccacagctacgcccaggtgctaaaacagagcaggtggaaggccgccccacggagtggcctgtgagcccagagttctcactgtccgaggccggtggccccatgggaactctgtccattcaatagggagggcatgtagaaataggcacattgtcacagcaaggcctggagtggcctgggttcttacagtgggcactgcattgaggaaatgggcagacaaacaaggatttagcataagtatagtcagaaagaaagggctgcctgtgttcaaaggacaaaaggaagaaagtgggcgaaggggtagtttagtcctgtccatcagccagtcacgttctttggccaaactcgggacctgcctgtgctttgtccatggtgtccaggaagaaatctgtgtctgtcacttccagattgctgcttgtctgcaatggacaatgcctcttaggcagacacctgctcgggatgacagtgctgcagaaattgatccaaaacattgactagcttgcatggtatcgctgtcattagtattcagtcttcacaaccaccctatgaggtgggtgctatactttccccattgtacagatgggaaagttgaggcacacaggggatacgtaacttgtctaagatctcagaggtagtaaggaagggtaccagaatgtggaccctggccaactgaacacagagtacatgctcctaatctctgtgctgcttctgggccatctctcggtccctcacatcgaaagacctcatgatttcaatccaaagcatctgaccaagtgttaggtctacttcctttcgattcttggatatgaagggtaggagcttaatatctgcctatagcccagaagatttgtgcaaagaccctggttcacttggagaggaggtactataaaatttggaccccacaatgcgaatgaagggtatgtattgaattccctcagcccaccagcttaacacagagacagtgtgagggatatactatagctgggaagcttggaagggctcatgttcaagggcctctttgggccaaacagcagtgggcctgagcatggagagaccctggccttttagtgccagtgcctagagaagcaggtcactaagctttgtgcccaggagctgtgctgtccctggtccatccctgtgtaccccattccactcctgaaataatgaactactgcagccttccaagttcacagtgtgccagtttgtcacagaatagcagtgacacttctctgctgcaacccatctttgctctgccatgctgccaagaccatcttcaccaggcggtaacctgggaactccagctggtacacagtacaagaagcctccgcagtagactgtcccaggtgcatgtgctcagtatgtcatagccatctccttttggaggccagggagagcttctgtttgggtgccacggatcctggacagaagctttctagaggtaggagaagagactaaatggctggccaacccagagattgttggattgtgttatgattccatggtcaaagtgctttaaaaacctagaaattggctctggtagtgagtcccaggatggagctaacttacgatctggactccattacatgattgctaatcctgaagttcagcaaacgttggtactggctgacttttaatggagtacctgtttgagggttctcctcatcatgtatttaaggttaaattgtataaaggaattctgctgctcttttgaaattttctggttctgtttaaccatacctaaaaatgccatgaggtagccagatgattgactaactgggatttatggaaattcttatctgcaaaaatctcaagacaaagagggcactaactagaaggttcccagtgctttatgtaacatgcagaaggaagtctggtctcagcttcttggatctgagcaatcctttggaaagggagcaatgaagagcagtaactgaagactcatttcctgccttctgtgtgactcactctcctttgtcaacttcaagtttgccctaggcctgcttgcttctctccaccccaaggaacttggtctttggaagacacaggcacctgccctctctgtctgccttttgcccccaggtccagagggagaaacaaaccctcagttggaggaaagtctagagcacaggctttgtgttgctcagagaagcatgacaggaagtggtgctgttgcctctgcattggccgactcctggctgcacctgcttttcccagaggcacggggaggcccaggcaggggcccagggcctgctgctgatcagtttgtcctgcttgcaagtctgcatcccagtacccaacggggccaagtagaaaaggcacatagtgtagtgtgagccgtagctgtcaccagatgggtctttcccctccgtgcccaaccccttccctgacctgaaagggcctagcctctttccccactggcttccaccaagttctaacacattttatatatatcgatttccaggcttgtagaggcaagacctacagtccaggagttcaaatggattcagtgttgttggttcttgtttcctagaaggacaagtgctctgaaggtttggtgtcaactctgacccaaggggtgtatctgatttttatgaaggcacagaaatgcacctgaggtgaccccaagtccttctcttttattttttgatttcccaccacctggatcattaattctgctttcaagggggatggggaaaggagaacatttcaaagcaaagttgatttggtctctgaaccagcttgtcttctaggctgtagttcaccctgatgagaatcagaaaggacagtctgtaaaccccttcactctagtgactctgcagctggggagcctcaaaaccagttccagatgttctctctccctatattggccagaagggaatttcgggcaagcaaggaggcagagagcttttgcccattcattgagtacccctgtctgcaaactgtgtcttgcttcatggcactttagggagagtgctgagcacctgggtccatttgggaccagccagcccttcctgttcctcggttagaggcatgctgctccaagctggctggttactgcaagcaagagaagcccgccttcctgctgttcagggtcagaaagcaagaccgtgctggagaagtaagtcaggcaggctaggaaggagacctgcagatgacccttgggttaacaaagcaactttcacggccctgttcaccaccagctaggatagtacagggctttgcctcccaatcttgggagacgaggcatagatagtaatggtcaactgatggccctttactcttgagaaactccacccagcctccccttatccagaagaaagccattcctgactaagcctggccattctgacgccttctttcttagtctgcacccagcctgtgctgtatgcggtatatgatggtagaaatttgcactcttcatgctttgattttaaatgcatattagacattttggcatttgtgcctgaatgctctctgtatcatcttttttaaaacatagtttgattatgtaagttaaagaatgtacaaatgtaaacttctgaaaatacatacaatatatgatttcttagagtgtatggacactgctccagaggccttgcatgaattatctctttaatccttacaaaacgaatgtgatgggtactattattcccacttcaaagaagaaaataaaaaggacttattctccctgggcattgacaagcaaagagattaataatggtaaccccaccagacatctctatgggtatatatgtgtatatacactagtatacatatatgtatacatagtatacatatatgtatacatagtatacatatatatatactagtatatatatatgatttgacatgaatgggagtacatatgttgatgtctaatctttttcactccacaatggtgctagaacgtctttccattccaaaaatcatttttaacatttacataatattataatacaaatattccataagctacttaactagttccccattgatggatgtttttaatttgttgctgttgtaagcatcctctacatatatcccatcttacttgaataattctctccttaggctaaagtcctaaaactatgattgctggatttaagggtgtgtatattttctgctttgaaacacattgtgaattgccttctagggagttgaaacaatttgtactcccacccacagtgtgtgagaggactgactcctccagccgtgtaccagctctggctattcattcattcagaattcagtcaagaattacatgaagtagctgcagtgtgccagatactgtactcagaaccaggcattgttactcttttaagtctttgccaatctgaaagagtgagtatctgtgttactacttgcatttctttgagaattagaagcgttgaaacatcttttcgtgtttcagttggccatttggatttttcttcttttgtgaattacattgcgtattctttgcttcaatctttttaaacccgttaaggtcagaatttgtctttttagtgtgtggtttttttttaattcttatctagtgttggtctaacccttccaacagttgtcatttagccagtttgtcatccatgtaagtacatatctttcttccagatattaacaaagtttatatcagtctcttggtgaattccgttcctgtaagttagaatctgcatcatgactttataaaagaccatcactgtgcctacagttctttaggaatcgctttggcattaagaatgaggcttcagccaggcacggtggctcacgcctgtaatcccagcactttgggaggccgaggtgggcggatcacgaggtcaggagttcgagaccagcctgaccaacatggtgaaaccccgtctctactaaaaatacaaaaattacctgggtgtggtggcgcacccctgtaatcccagctactcaggaggctgaggcaggagaatcacttgaacccgggatgtggaggttgcagtgagccgagatggtgccactgcactccagctgggcaacagagtgggactccctctcaaaaaaaaaaaaataaaaataagaatgaggcttcagccagatgtttttggattatatgtggcgtggcctattacatggtttttatttttgtttcctcctatttcttagtatttctttccaccagttcctgttgtaaaacgtgaccagttggtactgatgctgtacatccttgtattagtaaaaatcctgctgtgcctggaggcagggacctgcttgggccaggccttcccaggaagcccgtcctaccctctgtagcatatagtgccggaccaccccagcgctcccacttacctccttcactctttcattgttgatacatgggctaggtttcctacagagtcacttcaaggatgtagatcttatcctcccaattggattgtgagtttgttgttattgccttttttggtattcctcaaggatgttcagaatacctcacatagtgatggactcagagtacctattaaagagattttcattaaaatcacaccattcagtaagttgaccaagtacatcaagagagtcagaaagacccaagatctagtttggctttgccaggcatagcttcctcatccataaaatgaaatactagtaagatacttccttatgtgaatcttgggaggctcggagtgtccagtacacattcagcactcagtcagtgcagctgtagagacatagcgtggaccttggtggcccagcagtctcaatcctggtttcttctgacctaagattggtgggaaagtacagataaaagctggttgaggaggtgttgatagcacagagtgtttttacggagtgtcctcggagggttacatgctcctttttgttgaatccgaatctttttttttttctaatatggagcctcataatcattcaaggactcagtgtgatgccacaggtttcaaacttgccagttcgtctcttatgttctgccaattttttaaaagtgggaatatgagtgcatgtgcacgtgtacacacacgtgtgtgtgtgtgtgtctttgtgtatgtaaaatgcttgggataaaaaaagatggatcaaattttgtctggcatggcatagcaactctcacctctagtatcctctaaacatttaaccaaatggactttaactggtttacttcaattctatttttattttcgtagtcatttaaatgtatggggagccaactctttcaaatgagacattttgtcattaaaacatgttatttagtttaaccgcatgggcccggcttcagcaacattgaggactgtgaagagggttctgagcggctgttctctcctgacctgaccgcagcagtgacccaccagcttgcaatgcacgcaaactgaaacaggcaggatggccagcccagggttgtctgcacggtggtcttggcatctgtaccttaggttgccagctcctggccctccttgcctgcatttggtggcccttggccctgccgtgtcatatggcacaagagcccttctggcccgcatcaccctgtgtactgattaggcaggaatcagcaaatccgttgagtgcatgtttaatgtgacacagatgtgggacatactacagatctttctgctttacaaattttcagctttttgcatttcatcagtgttgcttattatttacagaatgtaacttgagacatcagaacagattgtaatttttaaaaaggttgttgggggggtgggcccgcaggggatctgggagaaaaaatccagtagtgtggaatgttgtttgctgtccagaccaaacaaaccagtttgccaagggttgatggactatgacaatcagtccaattcatgttaacactgggggcacttaattaaaaggcagcttgacctccttatcaccaaataaagaataatcttttgttaccaggttgaccgtcgcagcaccaggcagaaatgtaccccttgtagaggcactgaagggtaccaccaagctgccagctcgtgtcctgcctccttcctgtccacagagaaaggcaccattgaacccagtccccactcagacatgtggatattcttgcctcatgcctgctgtggctttacacccaggcgctatggcaagaggcggaaaaaagaaatctcttcctttgcccaaaaatccaagatactcttgagggcattggaatgatgagccaggccagtttgacacaagttcaaggagaaggtaccatctcttgcttctagaggggcacatctggctagaggtggccctggcttctgagaaagctcagccataggttacatttaagggcaaacaatgaaaagcaccagctggtcgggaggaagatgaggaggagtgggtgattggttgcttctttcctgtgtctagttctaaagaacttaaaacttgggtccaaaataatgagagccgtgttgtaaaaatcatttgaagagagttctcctggggaatgtgagctagtgccgtgacctgatcccttggtcagatggttctgagctgtttaagtgctgagtgtcaactgtctacagggagccaggcccctgaggagcggccagggttccaagccccactgttcttttccttcctggaaaagtgcagacggtgcacgttccccggaggccaccaggcagctctccagttgccctctgggtgaacgtgacccaggtcggtaactttctagtgtcccccccacgttggaatgatcagcattcctgtactccaggggttcttgagttcttgagttgttaccaacgccctgcctttctctggctcagattcagaggaggagttccactgcggactgccgcttcttcaccctctgggcttcggaagcagcacctctggctcccctgcacccagtcctcagtcttgtggccctggtctgcccctttatcacatgtcttgagcaccctctcagcacacagcaccgttctgagcgctgaggtgcgaccatgcatagaagagacaagaatccctggttccgcatggcttccctcaacacctacgtttccaggccatggcttgggttcagaagaatcaccctccctggaagagatgagtgactggaaggagagcatgtcactggctcccctgagaccctcccaagagcctcagtttctccctctaccacctgaagtctaactgcagggcctgaaacagattctctttaaaaacccatgagtgtggtgactgcataggttttcattctcctgagttcttaatttccgtgtccctagcactttttgaagcatctgctcctgttgcccctttcttttcctcctcaccctcctccatagtctctgtttgatagtagaaggagatttaaaacctccaggctgagtgaacaggcggtcttgaaaaagcaaacaaatcgggtcaggcacggtggctcacgcctgtaatccccagcactttgggaggccgaggtgggcggatcacaaggtcaggagttcgagaccagcctggccaatatggtgaaaccccgtctctactaaaaatacaaaaaaattagccgggcatggtgccgtatacctgtaatcccagctacttgggaggctgaggcaggagaattgcttgaacccaggaggtggaggttgcagtgagccgagatcacaccactacactgcagcctgggcgacagagcgagattccatctcaaaaaaaaaaaaaaagcaaacaaatcacaaagcaggtcccctctgggggctggagcatcctcatatctgcttggctttggtcactgaaagaggccctgggggagggggcttcagggcttcccaggggagaggtgacagttaggacacacgcctcccccacttcagtcaaggcagcttcattgtcagcggttgtacgtactaagattgtgttacaaacttcatttgcagaaagtgttttacccctgaaatttttttttgaaagcgcctgctgtgagttttattaatggcacttttctaaaacttcattaatttcaattatgagaatttgatatctggtgtaattcattgagctgctagtttgatttgctctagctcgttttaaaaagctctgtcaggcaacaggatatggatgggagtgggtcaggtgagtgaaaacgttttaagcactcctttcttcagaaaacacctctgtacccacatggggtgtgctcctcaggagtcattcagacaggtccaggagaacttgtcccccagggtgctccgtccagatacaattttaaatactgcactttcgcattttggtattttcaatggacttgacacccaataattctgaataaaggtaggaaagagggagatgattaacttttacaagtacctactatgtgccaggcactatgctacacattcttcatattttatctcaacattatcaaccaagtaggtattaagttctcacctattgatgaggaatctgaggctaagaacaatctagtaacttcttcagtgtcacccagctaataagtgactgggatttcagcctgtgtttgtctttttccagtctatgtttgttcctttatactactttgttcttaaatttcatctcttctcttaaaagaggtcaactttgggagaaggtagataatatataaacattgaaagaaaaagattatataatcatttgccagaaataaatctgaaaatattgggctggacacggtggcccacacctgcaatcccagcactttcagaggctaaggcaggaaaatcatttgaaccaaaaaaaaaaaaaaaaaaaaaagtagtgaaaatgtatggtttattaatgtaatcagcttgttattattagcatgcgtacttaatagccacaaaataaagcttaccagagatggtgtatttcggtccttgtgaaatatcttgggattggcattagaggtgacaggttagcaaggaatttgataatggcttgagagattccaataagcactacactctctgactcagaatgttctacttagaacacaaagaaagcttacaattgtaaagcgccttgttcttccatgatgttgaaagttgcaaaccactttataggttgtctactattttgtaaaagcaaagcaaacccagaatgcatgcaaaaattatggcctttaaagaaatccaagccttttaggctccattcttactataacatgatctattttcttggaattctttataaagtaactctgcccctccccacccagccattaacaggtagtctcgcccctgaggcagttgactaagaaaaaaaatctggagtatttttgtcttagagtttaaatcccaataggtgtatctgttggcattagtcctaccagctgtcacagttgcagtgtcatggggtccccaaaacatgtgttaaattatgggaagccttgacccctataaacaagtcaggtgtgaatcccactgatgggagaaaacccagcccaggaaatgtcatccctgctgctggatgtcaaattgctaaaaacttaacaatatcaatataatttctaatgatttcttgaatcaacatctttcttacattttcaatggcaatagtacaacatgggattttatgtgtgttatgcatgtatgacttgagaactctagggagaggtaagtagaatgttaacaagaaagcaaaggggaaaggaaaatacttcagtttgaagcagtgagcctccccagtaggaaaactaagtacaagaggttggatgttacaccctagcccatcttagatcccagacacctcaactagggttcctcgtgtgcacccatggcactctaaataatacactaataaaaagaataggtagcattttatcgagtgcctattatgtgctagactctgttctaagcactgtacatgtattgacttatctactcctcacaacaacccatcattacccccactttatagatgagaaaaccatcgctccaagaagtcacataatttgcctgtggttacagttcgtaagtggtggagctgggattcaaacccactgggcaggctggctccagagccgatcctctcagccattatattatgctgcctactctagtgctccctgtctctcctactgcttccctgctgtgttcttgttgccatttctgttcatctcctccactgaattgctgtaagctccctggatacttaattcatcccagtcttcttcaggacctagtgctggcctctgcatatgatagtttgggaaaggttggttgaataggggactggaggaggcaggcacaaaccatttgcagggctctaagtaggctcgtttttctggctaccctagtttggatccttagtcagtaattccatttaagaaccaatctctactagcatagggtttctttctgcccaacctattttccatgtgtccaaaatccaaattgtcccaacctacggattgaatactatctttgagtgggttctagaaggtgtatttctctttctcttgaaaccttggggaagaatttctcatgtaaacagaggcaaactttagaaattttcatcctctaatagagtcttctctgattacagtttgcactgaaaggagtaaaatctgtttatggagaagaaatgcttttccacttcgtctttagaagtagatgcatgtggccaagaggagggagctacacgtcagaggtagttgcagcctatggcatgatgggagctacaggtccgagatagatgcagcccacagcatggtgggagctacagatctgagatagatgcagcccatggcatggtgggagctacaggtctgagatagatgcagcccacggcctggtgggagctacaggtccaagatagatgaagcccacggcatggtgggagctacaggtccgagatagatgcagcccacggcatggtgggagctacaggtccaagacagatgcagcccatggcatggtgggagctacaggtccaagacagatgcagcccacggcatggtgggcttcttgggcttgcagacattgtactgctgtggataccagagggtttttcaccaattcgtctactctactgcagacagtactatttagacagactgcggggtttctcttagagaaatgacaaatgtttgattaggccatttggtcaagaaccctggtatcttgtagctgttatcagtgaccagtattggaagaggtagtctggattgaccttcgttctcagtctaattgtgcacactcgagcacagtatatatcagtaagatacttgattaaaacaaaagccctggacacatacataaagtgaatgcaagcacaacccatcacacaacccttaaggaagatggcagccatcagttgaataaacattctatgatgctaacgtcacatgtgtgacatacactttctactcacttactgattgtttttgaacatcacttggctgatagacattggccatgacagacttctcaaccaaattaagctgtgtaggggtatgtgtatgtgtgcacagcatctgtcttaactaacagacctatgacatagttactcatcgtataagctacgaataattaatgcctggctaaatgttgactttcaggctgaaaggcaagatcaaccaagtggaattggctggatctccctgtgtcaccttgtttggatttactgttgattttttttttaaaagacatgagttgttactactctgatcattggttttgggcctccggtgtatatcagatagcaatggccagatgcaggcacactctgtattgattgccctcactggaaggatatctgcagtgtatcagccactgtatccacagccccttccctgggggaagagtcctccatgctgtacagcagactccctgacattttcatagagttcaaagctcaagttggtttggtgctgacattctggattagctggttgactggaaggactgcttctttctatacactgtgaaatttgtaaaccgcagcagctgagggcttaacatggccgacaagctccagctggcagcaattaaatataccgcagacctttggccaaacaaaggtttgtggaggcagagttgctgcatgtgcgctgaacagactcctaggttgagtgttggttcataagagatgctgtcgactaaggagaggtgagtgggtggattttggccacctcttgttcggtgatccattgtccccagaattattgtatcaagaccctgcccaagtagcagcaaaggtggtcagaggaaaggaacaaagccaccagggaggccgcaggcctaacagtggtgggcctgagtcgtttagacgttgatctgctgctgtagcaccaatggcaggatctgcagctactccacttttttaaatttattaatttatgtatttattgggtaccactatgctgtaggctataggctgaaaggagaagatgggaatgaaaaaacaataagaagacatttaatatccattcaagcagcaaagattcaagagtctagaccagtgctatccaaaatacaatttaaatttaaaattcagtcctttagttacactggccacatttcacatgctcagtagccacacgtggtcagtagctatgtattggacagtgctgtcctagacaataccaagtgttggatatagatcgctagggccccttaaatgcctcattggcaggaatgtaaaaatggttcagccacttcgaacgcagtttggattatcttgttaagtgaacgtttatatcttgtgagccagcaaattccccctagatagattctcaaagttcaccaggaaacacgtacaggaatgttcataatagcatcatttgtaatagcagaacctggaagaaacccatgtgccatcaacaggaagatggatatatcatgggatagtcatacaatggaatatgaacaaagcagagacatggtgaattaatcatggctacacacaaaagaatacctgaatcttagcaatgtgacagcgacatcctttttcaaaagcccaaaactaaacccaaagaacataacaagaatgtactggagcatcctttgaaatgtggtaaggctacataaaaaagaaaagcacaggaatgagaaacacaagattcagaacagcggctgccttagttaaaggaggaacagggatttggggtggcagaagaccaacttgtggtccacgattgagtgatggagtttttttttttttgctttcacagatgtttatttcaaataaataaagagagcccaatgatgagagtgggccttgaactgaggataataagcccagtcctaaagaccagttattaaaaaaaaaaaaaaaaaaggactggccgggtgcggtggctcacgcctgtaatgccagcactttgggaggccgaggcgggtggatcacgaggtcaggagaccatcgtggctaacacggtgaaaccccgtctctaataaaaatataaaaaaattagctgggcatggtggcgggcgcctctaatcccagctactcgggaggctgaggcaggagaatggcatgaacctgggaggcagagcttgcagtgagccaagattgcaccattgcactccagcctgggtgacagagcgagactccatctcaaaaaaaaaaaaaaaaaaagactagagtcctttccctccaggtgctcataggcttactggaacatacaggaaagtcacttaaaaatggacacactgtcactgagcatgaacaaatgtaggactgctgttacatggtcatactcgtttaaaaggcctacttgaacgtacagtgtcacatcaacagatgaagaaaacagcgtcgtcacacagtggcctgggctgaagaacttcactttaaactttttgctggcttacgaggtttgaaaacactagcttactgttagctttttacattattttagtaattctttaagattggaactaaatttgttcatatgcagtgacttcaaatactctccccctacccacagcctaccaacttggacctgagaaggtaaatttttagttgagttttagagaagaaagaagagtttttcaggcactgacattgatgaggtgatacaggagtggggggaaaattcctttaatccagctttctgcttctaggaagagtatgccttctggaagtccttgtattcataagactgtaacagaagatgtttccttttagggtaaaattgaactcatctgtcttttcttccatgttgatgtgaaaaattagccttgaatgccacagtgagctcccctagtcagcagtgttgagcactgaatccaaccttgcccttgatattatttgatcaaaagtcaagaaccctggaaatgggaagatagtttgtggcctgttgtgaagacagtcaagaaaagaaacataatgatagtcagtgtgtatcctcaggggagccactctgcttttgtattctctgatgttttggtgggtttgcagtttacaggttaaaaaataatgtattgggagtgggggtgaggttggatcactgaaacctgggtaaggctctgagggagtccactgagtcaggaaataactgtttacactagaaagctgtttgatcgtgtgagaagatcaacaaggtgagccctttactcccattctcaactattctggagctgtcatgagattaaatttttaagagctcgggtccagaaacaagccatctttcgttggcttctctggcttcctcggatccaccagaggcatttaggacttcagcaagttttctcctgcctggtagcatgttttccctcagctttgagtactaatgaaaatcctgcttcatgtaagggaaaggcctgtcatcagtgtccgcttcaggacactgccgtcatgtccctttctgtgttttgatcagtggggcagacagagacagccttgtcctttctgtcaggaagatggggttctagctgcttcatattttgcctcaatgttgattttgctttcagggctcaaaatccttagtcttcaaactctccaccaaagcttgcatactggccttcctgtttagctcaattaatggcccttataccgtctgccagccaccaggcactcactcgtttattcggcttatcctgactgctgctctaccataaaccagacactgttctccatcccaggaatgcagtgaatgaaacaaattccccctctcctggagcttccagtccacatgggagccaagcagtaaataacatgtttatccacctgggatggaaagcaaatgtgctttgagcagatgactgacttgatgtaacttaccttttttttttttttttttgagacagagtcttgctctgtcgcccaggctggagtgcagtggcaggatctcggctcactgcaagctccgcctcccaggttcatgccattctcctgcctcagcctcctgaatagctgggactacaggcgcccgccactcccccgcccaccccagctaattttttgtatttttagtagtatttttagtttcaccgtgttagccaggatgatcttgatctcctgaccctgtgatccatccgcctcggcctcccaaagtgctgggattacaggcgtgagccactgcgcccggccgatgtaacatcttttgaaagggccattctcattgccatgaggagagtggacaaggatggaaggaaagagaacaaattatgagactactgtaataatatattacaaatccagggatcctttgttagttatgatcgagatggagaaatagtcagatttgggatatatattgaatttgagcctgcaggcctcccagttgattggggaagatatgttgagacgagtctgaatcaaaccttacgttgaaagtgatgaggaagcagaccctgccatattcctcttggagagcctttgggcttctaccatgtagcctgacagagaggtcagcaggactgccctggggaaaggatactttattagcctgtgtaggcagttattggaatgacagcaagtgctttgctaggcaaggagataagaacagagctctgctacgtggagaggcacgccaagctccttcccccaaccccgctgcctgcagaggttaccagcatcctctcggcagcagtcgtccagcttctctcctgatgggttagcagcggcccctctaccgccctccccactttcgatcgatatttgggctctgagtagccaactgtaagcctgcgtcttgaaggaaaaattgagactggcggggtatgtgagtgtgtgatataaacacaatgggttttttactctttcccttagtgcagatcattgaaacttctataaagtctctgtaatacccttagagagtacaattaatagtactgaagacgtccttataactgaacttttgtaaaattattgctggatttttgtctttccagcacacattaaacctcaccaaggtatggggctgtccttcagatgtcacagcctgatgaactgagtgctgacctggctttgggagcacttttcagttatcccagctgtgcatggcccattgcatggcctgtgacaattttctggggttgtttctgtccatatttccaacctgacttgcccaccagggcactttctgcccttgtaagtaaatctctatgctgcttactgttagttcctgtttctgaagtgctgattcgatgtgtaaggcttctcctctcttttagatctgtctagagaggagtgttttgcttcagtgagctccaggaacaaataataagtacagcaagtacaaggccgaggacagacccagtgcactcttatcagtcatctgaaatatgcacagcctttccaagacaaatgtgcactcctgtttctaggaaaacaccagaaagtacttaccaattaccctgtatatgctgtgtggaaaaagacaacatcagcctaccctgaaagccataacaaagcagattcctccgggccgccgacagctgagtggcccgagttagagcctctgcagaatcccagcctgtggcctgggccaggtccaggtccaggtccaggtccaggtccaggtccaggtccagggggcattcttcccctcgcatgattaccacgtccctcaccctttgcccaaggaactgacctcatcttagaagaagtctcaagggttggtgtgttcttactaagtgcccaggattttcttccagacccatcacaaatccaaagatggctctcctgaagagaggcctaaaaaagagggtgcggcccagggggatctattatagtaataaccgcaggaacgagagccgccgctggtgggcagctcaccatccgccaggagcaggcttggcgggcactgttttatttggtcttcacagcagtcctctaaggtaggtgtcatcgtcctgtttcagagagaaaacggaaactgagggttaaggaaggtaaccaacttatccatgatcacatggccagaaaatggtagaggcaggattcaaagtcaaatgagggtctttaaccgctatttcatggtgtattcacaggcagtactgtaggttaattctgttcactaaatgtaaagtatgtctcgtattacagagtgcttttgtcttagtgagaaaggaaaatcattttaacctgcacacttaacctcttggctttatgtccatttacccatctaggactcaagcacagagggttcggaaaccgcgttgctgcacggggccccaggggctgcttccccgatattctgagagccaggcggaaggacaggagcagctcttcaaactcacagacaacatacaggacgaattgtaagttagagcatgggaaaccagccctgtgggtctactgagttgcctcttcttttgatcctgagaagtctccatctgatctgagttattttcatgactcttggaccttagatctggtcaaagaattccttgccccaaatgttttttagatttagatataactgatgctaaacagccttttactcaaagcagtggttctcaactgtgtgccatagcctggccttagtgttttgtttctagaaaatgacagtctctttctagttagttcaaagagagaagatcatgaataaaatgttctcaattttaaggtttttctcctgtaaaaatttcttaaagtttgatatcccatttttgccgcagaatgctagcaaaacaaaacagaaaaacaaatagcaaacaactaatagttggacattttggaaatgtatttttcgtaagattgcttcgttactctttaaatatggagccttatataccttgtcatatcttcagttagtgatattattcctagttgacacggtagagttaagtatttcactattttaggatattttgcagagatccttgtagcatgaaagtgctctataacctgaataggtgttagaaccaccagcccacagaaagcagttagttgtgtctgggagtagcaaaatactagattaatttcttctgatgcttatttgccatctcctttaaggtaaagcgagcgtgggggattctgagtgctgtgggtgtttttcggtgggtggaggaatgtctgaaatagacgtcaactgtcaggatagtcttcagagtcattgttagggacagtgttaagtagatctcatctcatagtttcatggtagtatttgaatggggatatcaaaagccaactccagaaggtatttgttgcttgccggatagaatggcatcttcctacatgtgccttgtgtgacccctgtggtgttattagaaggtctcttgaagatggagttgtactttcttgtttcgtctacttgggttgccattataaaatatgataggctgggcagcttaagcaacagaaatttgtcttctcacagttctaaaggctgagaggtccaggatcaaggcatcttctgattctgctgctgctgggggttctcttcctggcttgcagatagccctcttctcactgtgtccccacattgcagagagagagggggagctctctggtgtctcttataagggtactaatcctatcagctcagggccccaaccttatgacttaatttaactgtaattactttcttactccaaatggtcacattggggttagggcttccacatatgaattggcggggagggggtaactctgtccacagcaggtgttgctaataggttctgccgtttcagtccagtgcccagagtgcccatcagttcactccagaactgctccagttcattccttggggcagggatttggtaccatgactgctcttgatattgctttgtagatggaacttttagcctttggatggggggtctagagaccccccatccaaatttctcaggtctggcaggatgtggtgcagagtctactacaatggcagccctgtgaggctgggatttttgcctgttccattcaggaaagaatcctcagcacatagaacagtgcctggcatctaataggtacccagtacatatagccagatagctgcagttcagcatttgtgttcacatgcgtccattttccattcatttgggggttttttagtcacaggctaaatgagattataaattattgcatgttttcttttcactttcctccccaactcacctctattcaagtcgaactatctctggtcactgtgaaatttgtttgcaatagaagaaattgcgtggtacagccaacataggactgctcccagtgagatacacacattgaaaaacagagccagagagagctaaaaactggaatcgaaatgaaatcagtaaaatagctttcatgaaactcatgaaattcatatgaactaggaagagatattggcatgaatgaattttgactttaaagatgaaaaccatgtgtctccacccaagttgtgggttaaatcttgccaatgaatgctgaaggaggcacgtgaccacggccttcccaagtgtacaaggaagaagccatcagggagtgtgtcgcatgttcctctgaagtgtcctcagttgtcagcctgggtcttcgcggtggagtgaacattacactcatcactctgcaagaaaggagttttcaggaaaagcccacgagcgccaaattatacctctgacttttatcctagatttgtaattaaaaacatgtttaaagacctaattatttgcgtatttcccttcagagttaacccctttaaaggatctttaataccttgctctactgttctgactaaatgtttccacatttttttccagttaggctcactgtttcacttctggaaaatattgtgtaattatttcccgatggagtgaaaaccccacgaagtccccagtgccttggtgacttcaactttattctcccagatcgagttgcatttaattttgtcattctatttaattaattaatattaaaaagatagttaccaacgtatgatttctggtctggccagctgaaaagtcttcactttcaaattaatcatatattcctctgataagttgcacaattgtcattgcttcccatctttctcagttttggttttgaaacaggatctggattaagatgatgttaaagtaaaatttgtcctatatggtgaaattaatttttctttctaactcatgtctcatttgtagccagaaactcattttcttttttttaaggtacctattttatttctaatactgcatcacctataacggtgcacaccaggctggtgagcagtagggtggctcctgccttttaaaaaatgctcatgagcaacccacatgacctacgaagctgctctaatgtactgctttctggaattaagacaatttaaattgtacttttaaaatatagttttagaaagtaacatttatgggattttttaaatacagaaaagtataaaaaataaaagtaccctatgcatccaccagccagataagttgttcctcttttcaattttttgtagagatgaggtctcgccatgttgcccaggctggtccgaactcctggcctcaagtcatcctcccacctcagcctcccaaagagctatgaggccaaagtgggaggatcgcttgaggccgggagttcaagaccagcctgagcaacatggcaaaaccccatccatacaaaagttagccgggcatggtggcacacacctctatccccagctacttgggaagctgaggtgggaggatggtttgagcctgggaggtcaaggctgcagtgagctgagatcacgccactgcactccagcctgggtgacagagtgagaccctgtctcaaaaagatactcatatgcatggttagcaaatccaagagtatagaagaaaataaaatcaagagtaaaagtctcttttcttatctactttgtaaacatgctgtttacgatttttgtatcttgtctccttgagaaatttcacagagagagagcaatcaggaaaatttttgagcgcaccatataatattgattctaatagcatatcattataaatacaaaccttatagtaacatatgtagtctcaaggactatatatgtttcattccttctgaggaatggaatagaatttattagcttccatttcctaaaccaggaaataatgtactagtaactgttgacacttacagaattggccatttgttgatacacctctgaattaaaacttggatttggcagatggctcagctactctgataaagttaaaggtttgctaaatctttaaaagctaaatcaggagttctaagagaagttttcaactttcctactggtaacatgtgtccagcatccaaagttgcctgtgcactggcaaatttcttgccttaccctaatgccagtgtcattttctgagacagactaacgcatacatttattgaatcctactatgtgccagggtgagtaagaaatttcctctgtcctcagtgcgttcacagtttagcaggggaagcagacactgtattaccaacaacctataacatatattgctgttaaaatagaagtatgagcaacgtattatggaaccacagatgggaagtgattaatttatactggaaagccagggaaggcttcacagagaaggcgctggatgagtcgcctgaccttgcaggaggcggaggaatgtgccaaggagagaaggcgcctgggcagagcacagtgctgggcagatacacgggacagaagagctcacggcaggtctggggaatttggggtcagctttttgtagcagcagcacgtgtggaaagaaggagcagaggctggaagggtgggttcccaggcctgttgctgaaggctgaccttagtggtcatgccgaggagcttgcctctcctgtaggtgggagtgagattgtgaggaagaggatcccactcaaaattcgtcatgaaaaataaaaccttgacagcagcaggtagagagactgaaggcaggaagccagttaggaggcccgtgggatagtccaggtagaaggtggagaggcctgaacacagtggccgtaacgatgactagaagaggacagattggagaggcatttaggaggcagcatcagtggaaccctcaactgctaaattggaatctgagtgaggaggagggttgagagtggcttcgggctccttgcctgtctggttgatgaggctgggggtgctgaagagcaagggttggagaaggagcatctccccagtggacgagctgaggtcccctgaagagggcctggcactcagagcgacactgggcccagacatggagtcagggccataggtggacctggggtgggtaacgcctaggggtagaggagcctgttccaggagctctgagtcaggcttctgattttgaaatgactccagagggagtagaatcaggtatataaatgagttaatatcgaaaaaaaaaaaaaagagcaggaggaaaattaagtagagtggctgaaacagttacttggcagatttctccctgagagaagctggtcatgagtctgttttccatgtggccttctagagagacatctctctccaatctgctgatgagaggatgtgtggggaaaggaggggtcatcccccacaggtttggggtaactgggcacctgttctcaacagaagagctaccattaactgcggatctcttctgtgtggggcacgtagattagctcacaccatcacagtggccctgcagagtagacccatggggttctacacatcaggatggggaagctctgggcaaagtgagaggcggagacgactggcatcagggtggctggctcccctggcgaggctgcagtgtggcttgggaggacgttgtgacctgccccagaggaggcctgaggctgctgttgatgctaccatggctgctgttgttgagaatgccccgtggttcatggtttatggatgacattagtgatggtgcattctactaaggcggcactggctcctggcagattcacccactcttagcacctgtcatcttggaaaagggtgtaagctggtgctgcagccttcccttctctcagaagaaactttctgacactgagccccaagcccagagtatcctctttctctccttaaaggggagttaaaacttttttctttcttcttcttctttttttttttaatagagatggggtctcactatgtggcccaggatggtctcaaactcctgggctccagcgatcctcccacctcagcttcccaaagtgctgggattataggtgggagccaccatgctctgccctaagagttgaaacttttaaccgaggtttaagaatagtataaaaatcctattttttaaatagaatcaattatagtatctacagcaacctaaaatgtgtcaactgaatactgaggtgacttctctaggtctcagattggaaggataaagcttatctgatgctgtgtgtttctggctgcatttttttgctcccctttcctctcagttaatagcagatcagagaacagaaggagtttgctcagggccacctgagaccacggtggccttcttcccttgaggtttttccaacagtcactcattcgtggaccaaaagcaggccttgcgggaagcttgattctaagggcagtgaagacaggagagcctggggttgagactacaaagcagtgtgagcactcaaggaacctcaagtgaggcaaaggaaagcctgggagaactaggccagggaaggggaattacctgtggctttagggaaagggaacggaagaaggtgcagcttggcagaggggagggcggggagcgtgccgcgtttgccaggcttctcttaccaccctgagttttgctgcttctctcacagagtgacaagtttgatatgaggctccattagataaggggtctggtctggagctgtttaattattctttgatgtgtttggcagattttgtaaaaaaaagaaaaagaaaaaattaaaattaataataataacgatgatgatgcaacccaaagccctggccattgtgggatgcaggaaagcctcaggaggatgatggggacagagctgtggccacctggtccctggggtcactgcccagttccagctgtggcctcactctctcccttctccttcttcagccagacccttggctctgatctgcttttgatttgaaaggactttagaacatttcatgcacaatttccagaaatatgttattatcagtagcagcttcggggcatgcacagggtcctggacttacaggacagagatccgtgtggagtgacagcactgccttcctccacttacctttctgtatgaccatgaattccttgacctccgtgctcactttgtgaagaaaactggcagggattaccctctccatcagagagatgaaagagtctgagctaccaagaaagcaacggactcggccagagtcagccagcgggccgggctttcctgccagctcggcctgtgtttccttcgctgtgctctctacttttccggagggcgtcccagctcagagtcacccctcctccagaagtggttctggcctgatggaggacttgaaccatctggggcatcttggaaaagagtctgtttgaaagcctatagaagtgttccaggatggaaagcacactagtcatgtcggccactctggcctgggtgtgagagcatctgcccggatgggaagcccttggctgacatgtaaatgtcagctatgtcaagtgcccagggtggtggcgctgggggctgggggctgggggctgggcaatgaggtggaagtgcctgtgctgtgctcacctagaggaaggaacctcacatctcagttggatttttcatgcacattcctgctgtcatcccaatcatggtggccaactttggagtctccttggagagcctgtgacggcctcagtggctgtgcaccaggcccaccgatgctcaggggtgtaggctgcttccgggtctcatctcagatccccgccagttctggctggcgctgtgtcacctcttctctgtgtcaggatcatttttatccctctctgtctgtctttctgtctttccctgtgccctcctttcttccccggaccagctatttcagattccattcaactctgttcagtgatgctgccgctctcaatgcggttagagcgcaagatgtgagaacgtctgtgctgagtggcctaaacactgaaggctgcgggtctttctaatttcagcattgagactttacaagtccacattcttggcattgccaaccagttagaatagaacaataaatcccagtttttgtcatgggcgtctgtaattaaaatggcaactggaacaaggcagtcacttactgagcgctgatggggtggccaactctgtggggtgctcaggaagacacggggctgtgagatatggactccacttagagggctcacctcgtagtcagcaaagagacttatccaggacatgtggaaagaatgagtttgtgcttggccatgctttgggggccatcacaattaaatgctcaaaagtggaggaggggctggagtatgtgggggatgcttcacagagaagttagaacctgtgatccttgcggggagggggatgggatctagagaagttgggagagcaggtgtgcgtcctgcacggaccccaagtgagcgagggcccggcagcctgctcccctcgacaggcaggccacctcctgcccccaggcttctgcccccttcagaggacctgggaacaacgccgttctggacccaggtttcagaacacttccaggtggagcctggctctgagcaattcagtttgccagcaggagctcgactgccactccgtcgtcagcctttagtattcctgccactgtccatccttgtctgctgtccctggacactgcagccccattgtgaagggctgtcacaagatgcaggggaggcagccaggcccgggagaactgtcacactgttcccaaggttcactgctcttcattcagtggccagagaggtttgatgtgcataaatttccactttgaatgtgtgagctccatgatagaggaattcagttttgttggagtggccctaaagctcctgaagtaacaactagaagtttccaaaaggaagatgacagttttacctaagaaagcgttttctgactctttgagttttctgaacatgaagtggatgggggggtgccctgtccctggaggtgctgagcttagagagggaggaagcggatggggaggtgcaggtgttttaacgccaggctgtctcttcatggcgtgccatttggtgaacctgtttaattctgcttttcccccctcagctttcagcgcccccagctgcgtcttctcgccccttcatgtttccctctcctctgccaggcagtgaactttctcagctgctccttcagtttcacattgaaaggcatcgtgttttctgttttgtccaatagagtattgttacagttttctgtaagctttaagctatccaaaaatgctcacagaaaaacaacaaacacccacaagatagaatttcaggatttagaagtatttcccggcaagggggccgggattcgcactcaggccctggggccacagagcccgcagtgggcctccccctgatgctgggcgaagccccaggtgtcactcctgtgttcccgtctcgctttgcagcttcatcgctgtggagaacattgacagctactgcgtgctcatctcctccaaagctgtttacttcctgaaaagtggagactacgtggatcgagaagccattttcctagaagtcaaatacgatgacctctaccactgccttgtctccaaagaccatgggaaggtgtatgtgcaggtgaccaagaaagccgtgagcacgagcagtggagtgtccatccccggcccctcccaccagaagcccatggtgagtgcctggctgttctcaggctcctgaggggcggggccagggcctcgatgcctctgccctgcttccccgtcctcagcaggaactcatttaggaggttgaggctgggcccttcccaggagtgctgcctctcagtcctgaacatgggaggggcccagggtatgttcacggggcgatgctgccctcccagctggcccatgggtgaccctgggaacattaactgcctcacaacgtttgtgcctcagttacccgtagatgtagtgagggtaacaatacttactctcgttggtgataaggaacagctaacacaacacacagggtttttctgctcccaaaatgggattcttcagtgcaccaaatcgaagaaagcactggagctcacgctggtttctccattgtttctccttaacagtggaaaccgtaacttttgttctagtagcatctagcatgctcaataattatttgtaaataaaagttatactttccctccaaaggggacaaggtattgttatgacaaggcttttaaataataaagctcctgcgaatagctaacgttcctagagggctggctgtcttgtgggttgtctgatcactgtgttgctgtcatcccctcctcactattggtcatagcaggtgattcattcaaggctacacagctgaccttgaggagccggggttcaaatccgagtggcttggcaccagagctggctgcagagcctcttgcggatctgtctctggccagtcggccctggaggcttgccatgacacccaggtgttagtcctgctcattctcacccggcatacccggattttgaagcttgcattcaagaatgatacattaatcaaaagggcctgcccacctctgctctctctatggatcggaaatagcgccagccttattgggcctctctcctccggagtcctttggcctccccctgctcatgaatgcatttgggcctgtttggacttgtgtaaggctcccgtggggtcattggcttaagttagagctggctgatgaagagggcgagcacctcaaagtgtgagtatttctccagatcccttcactgtagcaggtgggcagcctcgcccactatacttctgcccctttcaaagcaggtgggcagagaggtgtttgtggtaagaaagacctagaggcttttgttcgctgattcttcttccttcatcagccatcaccagaccttagatgtgaatcccccattcttgctcttggtcttacctctgcagatcagttatggccgtgggggggagttcccaaatgtcaggtgagtatgggttggctgtacagtcctggggaatgtttaaaaagaccggctgggcgcagtggctcatgcctgtaatcccagcactttgggaggccgaggcgggcggatcacgaggtcaggagttcgagaccatcctggctaacacggtgaaaccccatctctacttaaaaaaaaaaaaaaaaaaaaaaatcgttagctgtgcacatgcctgtagtcccagctactcgggaggctgaggcaggagaatcgcttgaacccgggaggcggaggttgcagtgaaccaagattgcgcctaggcgacagagactccgtctcaaaaaaaaaaaaaaaattgcagggacccaccccagacttgtgagtgcgagtgaagcaggagcagccctggccatcactgtttctttgacgtgtacatcccatcctgagatgcagctgggctgggagccgccacctgggtggatctgattcctggatttccccatcctggggacaggtgacccatcctgttctcctccttaggtccatgtgaaatctgaggtccttgctgtcaagttgtcacaagaaataaactacgcaaagagcctctactatgaacagcagcttatgttaagactcagcgaaaaccgagagcagctggagctggactcctgaagccccgctgctgagatgggcgctcccgacacagcgcagacccaccaggaggaaagaggcccagctctcagctgacgatggaggcagaaccggagtcgggtttggggaagttgtcaaggaatgagggaaagtaaatcctcatgaggaaaagtacaaatggaaatcgtattaatttgtgaggcagggagttattttagattatgggaaataatttttaaaggtattggttaaataacgtttaaaaacatgtactgagatgaatctaatttttagattgccctgtattttgttaacatgtatatatgtacaacagtgtgtttgtaaatatataggaacgtttctgaacagggtctgtgctatgtgtaaaggtttgttaactgtaaagtaatataaagttatattggatcttctattgcactaattctagatgtctaattcaggatactgtctatagaaaggcattcttaaaagttaaagaatgttacgtcttagttttggagactaaagtattcccagtaaagtgggttgaggtgagggctgtggtcctgaaagggacgcctttgacatcgtggctgtccagttgggctgtgagctgtggcacccaggactggcgctggcccttcagaaggatctaggagaggggcttgggagcccacttttaatttctcacccccattttacaaagagtgcttagattcttacaaattatgatgtaagttatccatttggctttttcctaactagtcttaccaaacttagggggaaacctgtgctccattaccacatgggtgcaagtcagcattgtaagttttctcaggttattattattagagaggttggaaacattggtaaactctgttgattgagaaggaaaaaaaaagtcccattgaactgttgcaacaaatcagaaatccacataaaagtgctctcctgcctgggcagcaacaaccaagaacaaagccccgggactgttttctttttaataaagccacaggcaggcatcgtagctccacagcccgaggggacacaggatggaaaccccaggatgagaagggagcagggagagttccagaaagggggatgaaataggagtattaaaaagctgcgttggtaagtttttcatggaaccaagatttgacaaaggcatctcttatccttggttttaaattcctgctgggagcaaggcctggtatgagcgccctgggtcttgtttttggtgtttcgcttttctgtaaggattaagcagatagggagaagggaaaaggggcctcactttagaatgaatgagtcaccttgtgatttttaaatttttattttaataaagctaatcaatttctacaaccttgtcacatgtagctgagtctgggatgactcagtggatcagtggatgcgtggaaggttttggtgtttataactcatgacccaaatccttccaagacacaaatgaagctaatcttcttcccctccctttcctctcccacttcccctctgtgtctgtgtctgtgtgtgtgtgtgtgtgtgtgtgtgtgcgcgcgcgcgcgtgcatgcagagaggaaggaagggagctttagcacaagtagctacatagtgttcaaggatcagctttcttgaactccgaggcttggttgcctttgctgaactccaagttagtggattgcagaatggaaacttggcttttgcggcactgggtgagttttagtttgtgtgtgtcttgctggggggtggtgatgattgtctcagcactcacgcactgcacaagatggcagcaggatacagcactgcacaagatggcagctcctctgcagcttcctcctcagcctccctccttgcacccccacaggtttggcttgtggtttttgtcatcagtaacctactgcctgagatcatgatctcttaaaagatgagactctcggaagggttgattgtatgcgtcagtgagccttctatcaccttctggaacaaagtcacttgaaatctcttgatgagattaaggagtttagtgttactaagaaaatctgctttgggccgcagcagtgctgggtgttctcagacctgactgaggaagttagctgcgggctgccctgtgggctggtgcttcaggaggaatccagagaagtgttcagatgccccccttgggctcctttctaattttaatcagctctttaaatagctgcccatctcctgtgattgcacaaccaagcactttgacatttgcaccttaggagaggcagatgttaaaatggaatccaaagaccacctagggcggggctgggtgggagatgggagggccaactgcgagctgctccacttctcagctctcccctgccctgcagccctgggccagacaaggccagaaggtttcaggggcatttgacatcccctcctggttctcaccaggaaaacatccaaagctttggaggaaacaggccctgcccctggctccttaaatgccccgtctctttgtaaactgatattcagccagcaatgcctaagactttgttaagatcatttctactgcttttctttctgcttcaaacacacagttcgtctctgaggaaagtaaaataaatggaataagagtaaattgggtaaggagatatccaaagctacccagtcccttgacccagcacagttggccgacccgtgtcactccctggctgtcgctgcttctctgtgctcactgaagggtgagccaggccagtgcttccccagcccctgggcctggtcactacacagtggaaaacagacaagcggccccttccccaaatcccaagagtgtcttgctgcttggtgggtgctcatcgcaatgttctgaaggctccagggccactttgtttgtaagtatgatctgggcctcaaaataccatagtagctgcttgataaaattctaaaaatatctggttctctattatgtaaacactattacagtcaccagtgtgtgaagactcttgagtctggttctcatatcagagtcatcatttttcttcctgtggaataaaatgccttgtggacttccc

SEQ ID NO: 37682 - DNA, 338207 bp, Homo sapiens
cgacggcggcggccgtcctcatcccggcgcttgagaggacgcggggctgcgcaaatggcttgtcccgctctcggtctggaagctcttcagcccctgcagcccgagccgccccccgagcccgccttctccgaggcgcagaagtggattgaggtaggtgcgggtggctggcgggcggccttgcactggcgccctgagccacggacccgcgcacgctccgaccgcaggtccagccttgcctccccccaaccgcccccactttcttttgccagctgctccaggtcacccccccgggcctcggcgagccgcgaaaccttagcgctttggcattggaatcccgggcgagggtgggcgtgaaaggggacactgcagtctagctgcgcgcgtgagggcaggaagggatcccctgcgcgtccatccttcctgcccgctggcctcgcaaatctcagctagcgccgcttccaggcgctgccaagggaagcgcagtgctagcaaagcgttgcaaaggcgcaggaagcgcgagcccccagagacttcaccggtgctcgcatttcggggtatcttgcttctggtcccacatttcgccccttgtccccctaccccgcacccttccggagcagagttggcagtgtcttcacggaggcgcatacccaccggagcctcttgctgtattcctggcaccgggtcaggtgtgaggctggcacagtgcgcagggcgggggtagcttgcaagacccacctgcgagcacgcatccgcatagacgctgcccagcctttggcaacccccgcccctctccatcccaaggactgcagggtcggttccgaagtacgggctacccggtctggttggcatatttcacttcttaaataactcgttggcaggccagggaaatcactggagctctcggctctcagtcccggaagcgctcactgggtgatcctgattcacgatgtctatcagtagatgcagcttggtagccccgagctcccgaaatgaactgtctgcggggttcaggacgcttgaagggcatgaaggggaaaggtgaccccctatgattagtgcaaggagcctcagcttcaatgggtggcctttctggaggcttagtggaaggtatgaatttggccttgtttccctcagtgacaagcagccctctttgcctggtagttcagaggaggaagtgtatcgctaaatcatgacccagcaatgttgaagcttccagaattccgcctgtcacttagtgactccccactccgttcagcattgtggttcccaagaagctgctagagtaacaagagctccacgtacagatttaaacctgctgagcttcctgcagaaaccaccctcacttaatgctgctctcctgctccagccagagacctgtaccctacagggttaacctgcttcccgcaagcaagagtgctacttgagtatagaaacatctgtttgaaaatagggttcaagaaacagaacaatgaacatcagggctgtcttgctgaaagccccaggcatgtctcataatttgataactcaccatcagatgagaaaaagaccttggctttttatttttgatatgtggctggaacggtttggcgtgtgacaggtgctctgcctgtgttgcgtacttatgctcccaggatacacaggaagcatttgtagttactggcttattgcagagttggataactatttttcaggttcttgaactctaaaattctcaggagagacttcgagtgtgggtgggggtaaggggaggatctagaagcagaacagtctttactattcttgaaggcaagtgatttattctcaatttccttaactgtatcattgacatattctgctttaaaaatgtattgtggtatgagttacacatgtaaaagtgcacaaatctgaagtgtacacctccatgaattttgacatatgtatattactatagcccccacctaaatcaagatacaaaatgtctcctttggcccagattacagtttgcttttaagtggtagtatatttcaggctattatgcagtgcagaatattagctttaatatcacgtttaagaaaaggaagaagggattccttaagacagtagaacctcattaagccctatagacagtttgggattgttcttgatgctttaccattcataccaatttaagaatgtgaaaaccgtaatggggcatgcgtggctttaggaccaggcagcccaggcgagctgcgtgtgcattattgaagtggcctatctcctttcaattgttgggttcagtttcagggaaaggagagcttccccctcccaggctatataaaaaggtaattgctccaggggaaagatagagacctcccccttccttcccagaggttcttcttgaaatgtaaatgccgagtctgcaaaccacgggaacccagaagttgtaacagatggttttgcatgcagttgccttgtgaacaaagattcctcagctaatacagcaataatgtagtacttaggggcagtgaatccccgggtgggggggcggattggggattggtatctcgagacaattgcaactcctctaggggccccattgtctctggcagcatcctcattggtagggctttgtttttacttttattcagttggtgattaaatttcccataggttttttttctttctttcttctttttgagtagtcaggaatttcaccctttcataaaaatgttcccttgggtggagcaagttaataaacaaactttgctgcttgtctcgcctcgattcttggtcttccttgagtcatggattggcaagaaaacattcattcttaataaaggctcagggaaccagatccaggacgtaacttgttagtgaggaatttctcggcgtgcagccttggctatttgaggaccgtgttactgggcaggaaatgtggcctgggaacgattcccccacttcagcccccttcccctcactccttccttagttggcaaaggtgaaagctctaacggagcactagatggtcacagaccacgtggggacagccctttaacactcctagtgactttttatagctgtaggaacaggttgcacatctaactgtgtttgggaagactcctagaggagacagcaaacttgaagtagtaactgtggctaccagcaggcaggggagtgactaacttctttccatactacttttctagaaggccttactaagcagaacacagtaggtgagaggtcagaccttggagctgggcatcctaggtttgagtccagagtctgttactttgtagctggatgaccctgagcaagctacttttcctttactgtggttccaaatgatttctttggaagatagctctagttgttagcaacaacaaaaatgactaagagttattattgagagcatctgtaaaacaggatactaataacagctcacctatttcataggagtgctgtcaggattaaatcaattaatatatttaaaatgcttagaacagtgcccagtacataggaagtgctgtgtaagtatggttagtagtattattaccattattattaccactgctgttacttttactactactattatcattatgataattattactactactgctattgctattgtttttttctgttgttaataacaactaaggttgattttgaaagaaatgattcagaacaccagatttcccgggtagaaaatatgattcaattgcctactgatttcatcctattatctcactctgttaactctggatacctggagtcgaagttaactagatgctacatgtcactctaatttgcactaaaagtgacttggggatcagagaaaaacctttaatatctactcataaagtgatcttggtagtccatcaaagcttagaaaattattcttcaatattatgctgaatatgtaagtttaatgtataatctttgttaccaaactccaagcagaatgctcaatgcctctcctcttgttcttgtagatgatctaatattaaatcattatacaaataatgggtccaaatattcatctaaatgcagcagaattttattcactgaggttgtgtcaactcctgctaggaataagaagaattcttccattgattttctttccctcttcctcccttttattatttccttctttttttttggtggtatttattgagttacaagagtttattagtaggttagatgactctgattttcctgattccccgcttctcttggcctcaccacccacaacaatatttatctgttctaatctgtggttcttcttttcagtgccaaacactttctgaagaaacagatgtccttcgacttggtttcggttatgatttggaacaggttcccaggcctttagggagggactggaaatttcaacccaactcagccttatttctcaacttgagaagttcctggactcctttaccttcaatcagagtgtgcccatggggcttggtgatgaatacaatcttatttgtgacctaatccatacttcacaagagtgagaactagtgctggaagggatcagtttctcattttggttcattccctgctgcccacatagaattgttttcttattcagctgggacctaattctgaagattaaaaacactgagggtatcatagctctccaagaccaaaagatgcttgtgttgtttggcagtagggaaaatttatgaatagcttttgagataatttagcatttaatggccagtaacatatgacttttgtgatgtaataccataagttatacatgtagtcattctaattctccacctctgtagggactagattcttaacatctttttatcccaacaggtagttaactttgcagatggtcctccagctttgcataagttgccaaggaagaggaagaaaaaacttttctggctagatcaaggaaggagtagtggtctgaatagatatgtaaatgagagcaggcggcatctttctcacaatgacatttaaatagtctagcttgtttgtatacaagagcagctatgacacaatgctgtcacatggtaggaaaacagtgaggtcccacagatttggggaaaggggatgcggaatgggaggtggagctggcacttcttgccccggcatctccctggaaaccagttgcatcaggcgagctccaaagggcagactgagcactggctaccaagaaagggaaggctgagcatgtgttctcagccactgggtctcttggcctccagctctctgctgatggatgacaatagagccatgatgtagacagttggccttgattctgtgagtggcagtcagtgctaggtgggactaggcagctctaggagtactagaaattggcctggcagcttctctttttgctttagaccattctgaagcttaaaagcatcatagttgggggataacatgatgataaaaattatgttaatgatgctgatgttgctgatgataaaaggtactatttattgggtgcttattatgtgcctgctaaagtctatgtacagttggcccctcgaagtggcgcaaaatacattttgtattttgtattttggccttgattttcatgattcaggacagaatcagttaacactggttgatttttgaccaaactgttcttactggaattaggttttccttttaagcccagttcactgttctgagattttttaaaaagtacaatacaattttataatagaacacctcatatgttccttaggatgtgtgtgtgtttacatctgaggcagaagaaaggtatcagatatgatcttttttggaggaagggtagggtagataaaaggatgacttcagtgctattaaatcaggaaaggaagggataatagaactttggttttaagtgattgagaaatataaaaatagcctaaactagagggctaaagataatataggggaaaaatagttcttaaaaaaatgatagaatattggaaagacttctgtctggacataagatgttatatttcaaggaggaatgatgccgtggaattcagttctgctgtgataaaattccatgtttgcaatattgaaaacaacacttccaaagagatgcccatgcatctaaccctgatgggatgtgtattagttcatttacatactgccataaagatacgacctgagactgggtaatttataaagaaaggaggtttaactgacttacagttccacgtggctggggaggcctcaagaaacttataattatgatggaaggcaaaggggaagcaagacaggtctcatatggtggcaggagagagagagcaagcgaagagggaactgccaaatgcttttaaaaccattagctctcatgagaactcactcaccatcatgagaacagcatggggtaaccgcccccgtgatccagtcatctccctgcaggctccctgtcctgacatgtggggattacaacttgagatgagatttgggtggggacacagagccaaaccatatcaggatggctagtgtatctcagggaattacctttggcatcaggaaaaggacagatgatatagtcatataaaatgcacctaagaaataacttggctgataccttttcccactgtcagcaaaactgtgctctatgctgagaccttaagaataaaatattggttaggttgggaaagctccatgtttccactgtcctgcattttgcctgtgagagttactctagtgtggctgttggaggctgcagcttggcctcctggtcagtgtaagttagggactgccccacccattcacccctagatagcccattaggaggccatggaggaatacacctgcacttgcttttaaaatcaaggtcggctaggtgcggtggctcacgcctgtaatcccagcactatgggaggccaaggctggtggatcatgaggtttggagatccagaccattctggctaacacagtgaaaccctgtctctactaaaaatccaaaaaaaaaaaaaaaaaaaaaaggaaagaaaaatcatccgggcgtggtggcaggcacctgtagtcccagctactcggaacgctgaaacaggagaatggtgtgaacctgggaggcggaacttgcagtgagccaaaatcgcgccactgcactccagcctgggcggcagtgcgagactccatcataaaaaaaaaaaaaaaaaaaagaaatcaaggtcaagaacagaaggacttgtagctttttcatttccatgactgaaaactgttaaaaaaaattcctcagccttatttttttgccaagtatgttcaccaaatgggtctgcaccaagtgaggaactgaagttatatttattgcaatgagtacatagctatctttttctcccctcagaagtgtttaaaaaatattttgaacaattattttattttaattgaatatcttattccaattgaaatggaatgaaagcgacaataagctcagtcaaattgttaaaatatgaaaataattatttgggagacttggctatcactcatttgtaagtttgcttcagtataaacagtggcaaaaataagcattaatattttaatgtgtgaaagtgtgctttcaaaaattatttcctgaaaagtgtttactgagctccaacaatgtgcagcatagtgttaggcatggtgttaggtaatgaacaaaataaacatacttcctgccctcatgaaatatacaatgtggcagggggacagagagattaaacaatacatatataattacgatttggaatacatactatgaagacaaagaatggggcaggggggattaagagaaaagcactctttaaaaagacaaggattcttagtgaaaataagatttaagctaagaccacggaagaattctaagcaggagaatttgattgatgatgatttattgagaaaagggcttgcgttggatgctacacatacttttattatgattgtgttttgaaacaaggtagggtagaaacactcttaaatttctctaggtctattgaaggtagatatgtgttggtggtagggcagggggtgaaggtacctgcctcggaagttcttgaatattccttgcaggccactcagagtttgcatgatgatccactgtccattttacatctgaggcacagataagaactcttctaagaaaaatgcggagaggactttgggatttgtgtttgagcctagactctggattaaaattcttggacaaaatagaggctgtagaggctgtactccactcttagcaggaaggggctgcgggaaacctgcttgcttttcagtgagggaagagagccattttgtgtgagacttagggtggtgacccacagatgtcttctcatttgggaacttttcccaaattcttccaaaagagggggctttataaactactaaagccaggtgccctttgggatcctcataaattgtaaaccctggaggtccttgactgagattcctttcaacacttgaactaccattcttagaccccctcccccatcttcccagtctaacatggctgctggagagtcgtgatcacatcacctttccaggaagctggatggaggcaaggaaagtgaagagtgcatccttcccatataaggtggcttctgggaaaccctttctgacatactggctactattttattgcccagaacttcaggaacatggccctttctgtatataggagagactctggagaaggatcttttaccccaggcaggagtaatgctcagataatattcttgagttgtattcctcaggaaaaaggggagaatggctattggggtagccacaacctggaatgccccttctccacttctccagggacaaatcctttcaagatagagcttaaacccgactgcctctgcagcatggtccctgattcctctaagctcattaatccttcccttctttgtacacacctgagcctcagtttttgccttttttttagaaaagttgctgtattttactatcacgaattttttttgtgtgtgtgtgtggtggggggatttgcctcctttggtgaaccccagagccctgtggccaaggactgcgtcttagtcatcaccctgttccctccttgtttcagccaggctgttcctcactagggcctcacagccacatttccccactgcctgagcgctttctcagtgagtctgtgcccagctacggttgcctgattggcacttggacttggctgtggcagagaaaatagactctgttgctgccctgacaggaagcaaagtgtgtgtgtgtgtgtgtgttttgtagtgattaaaaaaagcagtttacccaatagttgcctggagacagtcagtgattggacactcggagggtgatttctctgttggcccttgggtgaagatattctttagggtgctaaccctcccctcaagttagactgggtcagggctcgttggagttcctggctgcaaggcgggagagcagacatctcttttctttaaataaacatgcccccagcattcggccttagggctctcaccttctctttctttccctaagtcaaagcaaacctctctttcacctgttatagaagtctagctaattcccacttcttaggatgagggaaagatagagcacttccaatgatagtgaatctaaaaagaaatggaagaatttttattatagtggtcacctgtatgagttcttattagacaggtatttttaaaggaaaaaaacccaaaataactgactagtagctggtatccatggtatcaataaatggccacggctgtgactgttaattgtcatgacccaatgggagcactgagaaatagcatcccctcttcttttcctatggaaaattaaaaaaaaagttgcctgtggagctgaatgttgtcatcagccaacagatgaggttgccacctttttccctaagggaccatgcaagatgtcataaataggaggggccagtgacaagtagaagcctgattcattatgctgttagagttgacagagtgtgataatagtgataaaaatggctagttcagtgccaaataaaaataacagcaaacacacttctggaacacttaccatgtacaagcggtagtctaggagcttgcttgagtggtagtgtaggtgcttgcatgaggtggtatattgtgtatagaacaaacacccagcacagtgcctgatatataagatacttctcaagcaagcactgtttatggccgttttacagatgggaaaatggaagcacggaaatggtaagtgatatgcttgaagccacacagataatcagtggcagagctgggatttgaacccaggcaaactggttccagagcttggactggtgactgctgtgtcccgctgccttatccttaacagctgctccgtatatatttacttattggaaaaagtacctttgcagagttagtatttgggaccctttagaagtaaaagcgaaacttctaaaaagatcatggtcccaagtaactacctaaccaagcaggtgacctgcctctctccttctctctcttcattcccttaatggttcaatatgctgtttattgagcatcttctatatacatagcaccgttagttgcgaggaaacaatttcatccatatggctcccaagcacattctctgaaactggaaccctttcaatatgttttaaaagataattgtcagtagggtggttaggaccatgatgaaaaatcattacaggagcccaatgaaccatcatcagtgggtggaaccatttttactccctttcacttcacgtctatttccccagtctttttctccttgattggaacctgactcccccactggattcaaatagtccttgatgctgagatccagactggaatgattataaacaaggggaaggaaaatgtggatttagggtgcctccctgccaggcaccgttagttctttgcgtatggtattctgtttagtctttgtgtaacacaggtatctgctgcccccgtcccagtttgaagttctctactgtgcctgtttcaataaatttcacccatgttaagactggcaggcctgatcccacgtagctcctgagtccccacatagtgcccacatgatagttcttcttttggcctcatctggcacctcccaacagcagctccactcttagacctctcatgtggcacaggctctggcattctgaacaaatatagttggctattttataatgtcggtttctgtaatgaggattattacatatgcgattgggaaataagagaagcatgcttggtaaggtgcaagttgcgatggttcatgtgagatttttattaacacttgcgtattttgtaccaccaaatagcagtagttgaaaacaaaataggatagtagaggtgaacacaaccagccagggaggtgaacacccctctttttgctctagactccatttggctttgtgttgattgaaacgtctgcttttcccagatctttctgcattttcctctcatctccataatgcagcagtctcggtctttcctcacacccttccaccatgcgctcttgccccccacctttttgtgtaatcttccgtttgttctgtaataggaaatagaaaacatctttttatgtgtgctggtaatttttagtgttcttgtttttgttactgctctggttacaaagttgagtagggtttgggccttttacatgaactctgtattttccacaagccctgttatttttagtgtgagattttgtaggatacaaggtttttggctggctgtcttagtttgggacattattcatacatttacaggaatatggatactgttttatggtagaaatacatagatattaatagtttgggcagatagtatctctcacacacttacccacacagatgcatacataaaacaataccttgaagattcccagtgctggagcctgggatcttgggtcatatggaaaatgttttctttaggaatttcacatttcctatctgctatcagaagaccttggacaacatttccaggagaagcttctgttgcctttggaggaggtagttgaatattgtctgtgtgtgtgtttttctgatccatttttctttgagattttgtgcctgggtactacataaagcagcactgttttcatccaggaaacctacaggagttacttattgtgagtgagaagcttaagtgagttggaaatgaggaaactgagacttgagggttggcaatttgtctgagggtcagtgacttcttggctgcgattattcctgttctctggagccctttctacaccagtatatgagtattggcaatttgtctccgtttgggacatcattcattcattcatcatatagttattgagcgtgtcctagggactcagtagtatgagagacaaatgtgagatttccattccacctggaaggatggacgctgagcacagaatcacgcgtgtgatgcatgcttggaaagggaagagcaagttggtctggaacacaaaaagggccgggatctcctttggtctaaggggcaatgggacagcctctctgaggaagtgctatgtaagctgagaccccaaggatgagcaggggttggccatgcaaaaatgagcaagaaatcatgttctaggcaaacacttcaggctgtagtgtttgccttaatggaagagctgaagaagaccagtaaggcaggagctttgggagtaggtatgagggaggtgcaggatgaagctagagtgggctgcaggaaagctgcatggtcctggcaccgaagataggaatcctccgtgcttcttggcccggcctgggccatggctggccttgtctgggaggacagcagttggattttctccaaactctctcaaattactatagttcctgacaaaagaatagaaacatagctaacatttatgagagcttatggcctggcaaattctgtcctaagcacctgacttttcaaccatcctatgagctagctacaaactcttattactcccattaaacctagaaatgagtgaatggctaagggttttacggtcattaggtggtagagctgatcttcaaactcatgcagtctggctgctttacctgtgctcctaaccaccatgctatggggtgtgatatggtttggatttatgtccctgcccaaatctcatgttgaattgtaatccccaatgttggaggaggggcctggtgggaggtgactggatcatgggggcaaatttcccccttgctgttcttgagatagtgagggagctctcacgggatctggttgtttaaaagtgtgtagtacctccccctgctctctcttcctcctgttcctaccatgcaggacatgcctacttccccttctgccatgattgtaagtttcctgagtctccccagccatgcttcctgtagagcctgcaggactgtaagccaattaaaccttttttctttataaattacccagcctcaggtagttctatatagcagtgtgagaacagactaatacagggtgcaaatgcaggctgttgaccaagggtgtctgtgagggatattgatgagggggaacagcagtaaagagctgggggcaggagggtagaggtaggggatgcctaaggatgctggaggccagtgttggctttagacatgttttctgtattttaaaagaaactccaaaaataagtcctctcaccttgacagttttgccacctgggaaggagagtgattgtatagaaagagtgctccaggcatctcccaaaccccacattctaatgcatggggactctggttcccaagcagcctgatgaaccctggtattgctctgacatgataggccactcatttttaacttccatcaagagttgtaagtagtatgatatatttaaaaatgtatttcttattttattttaaactctgtgtgtgtgtttaataatttttttcattcaatttttttttttgttttagttagcattcttatggttgcaagcaacagaaatccaaccaaaactggctctaaaaaatagacagttgattgctcattgacgttctggaggtagatccctacttcatacaaaggctgactcagcagctcaatgatatcagtaaggatctggattctctctctctttccaccgtgctgtgcattgtgtggctttatgctctggctttacatagggcctccacacctgccctaccccacttcagaaggtccaggcttttccactaaaggctggctgggaaagagcgactccagtcctcaagttctctttacaccctctgggcagagaaagaggacacattctcattcatgatcaccagggaaatagatgagttgattagcctaagccaatcagacttcaccctggtccgtccctatcaaagatgctggctgctacccaacagagaagcagtgaattccctagaggaaaatctgggtacttttagtagaagaatgggtaaagtggatgccaaagaggctaccaccaattgttactaacattttattaaaaatgtggtaatatacaagaacacacagatgataagggaaggaaggaaataattaaaatgaactattcagaacactgactacttcttggaggtgagtataagattataagctgggagtggttaaaaagaggcattaatagattgttttactcctatttttataagactagaacagtgctatttttagaggtatcactgaatgtcaagtgcccaacccatacctaatgggttctattaggtgtaaaaatgtgattgaatgaactggattgatttttaaactgttgattaaaaaaataaagatgttcatcctgggtacttcaactctcctttcttcccaatatatataaacctttacactgaattactgtaactttaaaaaaatgttataaattaaagtatccaataccagtatctgatttttttcccatttaatttcatatttctcaggtaaagatatctattttttggagcctgaagcctagaaatagcaaaaccatgcagttgctgttcaccggacactccgggtccagggggtgtgcagctctgtgcctgagcagtccccaggcatgtggggcttttctaaaagtggatacagcggctgtcgcccactgatcctctgtgctgagtgacccagattggcacagcgcagctgggtcctacccagggcgagtacgggaaagaggagtaaaaataaaaactggttgggcagcttaggtggagtcaggatacttgaaagctcacaggttactttgctaattcttgggcagatttttccttttttcttttttgaggggatagtgatgattccaatgacagttttctagatttcttggatttgacaaaatagtttcatacagaacagcaaaatgaagtatgtagaaaatatgttttttgagattagaacatttgcccttgacatgagtttcttatttatcctattcaacattcaagtctccaataaagttttccccaaaggtatctcttttatggagttactttctgaatgaagacatttctgtcttttttgttaatagaacgaaatgtacttgccattatagtttctatatagttttctatgttatctaagaaaaatgagtaagagtgtttaggtatggtgtcaagttacccacccagaatagttgttcaatctctgccactgtttggcattttgacatttgtgtttttaaagtgtagtagatttgctaatttttgaagctttggtccttactattagaaattttgaggttttatttttggtgtttgaccaagggatttttttaaaatgcaaaagcagattttatgtaatgttttcctcagttatggatagctttgataaactatatgaaattttttccctcctgaatgctttgtggcttttactgtaataatctttctgtgatctgtagaccaataattaaatctccaaatggcctttaccttgcaatagcaattgaaaataatattaaatatttatacttaaaatatatgggaaatgtggatataacttcttttaaagataaaatgtccttaaaataccctagtagtaggaataccctagggtaagacatatttctgggaaaaagaattttctgcaatgtttacctcatgacactaatttggaactagagttcttctaagaaatttcttacgttttcgttcattaagttatttatttataaaatctattaagagactgctaatagctatgggtttccttttggggtgatggaaatgttctggaattggatagtggtgatggttgcccatatgcagtacttagtgaaaaactaaaatttttttaattataaaagggtgaatttgatggtatctgagttatatcttaacaaaaaatctgctacgagctcttaatgttttaagcatgattttgagctcccaaggtatgtaaacaagcacatgaaattaagactttcagatgtatgtacaatattgcagcataacaaaccacccccaaacccagtggcagatggcaatggtatattttatttttcttgctcacgggttgaagggtcagcttgagcagctctgcttcaagctgtggattggctgcacttggctcaaggctgtgggttacgttcaagtctgtttcatgtgtctcctttcttcttggaccacagactacctgggagatgctctctttatggcaaatgaatgacaggtgcaccagaacccagccaaaaccatgcaacaaatggttttaaagtctccacttgcatcacatctactcacattccactgcaaaaacaagtgatatggccaagtccaaagtcagtggggcaggaaagggcattctgctcacagtgcgaggggagaggagtggatatttttccagtaatactctcatctaccgcaaagtctgttcaggtttccttggtgctgcaaaggaagatgtgaacattctccctgggtattggaatgtttgagagatgggcattgggttccttggtgccttggtttgttttctgttgctataactaaataccacaggctgggtaatgtacaaagaaaataaatttatttgttacaattctggagactgggaagtccaaggttaaggggctgcatatagtgaggggcgttcttgctagtggagacgctgcagaatcccaagatgttgcggggcatcacatggcaagaagggctcactagagacggccaaactggttttggtaagagacccactcttgtgataactgacccactcccttggtaacccattaatccattaattcatgaatgaattaatccaatcatgagggcagaatgctcatgaccaaatcacctcccaaaggttctatttttcaacactgctgcactggggaccaagttttcaacacatgaattctggggtacacacttaagtcatagcacttgggttgagtcttgaaaaattagcaagcattgtcagttggatggggcagtaagggtgaggagaggtgacagcaatggctagacctcgaagggaacatgagcagaggcatggaggtgtgtggtagcagagtgcacttgggaagcagcagagctgggacatagcacatggagagtgctgctggaagaagacacactgggtcacatcagcagaggccttgtgtgccatgcctgagggtttggtgttggaactaaatgggctgggctcagagtcagcctgaatcgcaaacttggctctgccatttactaatgctatgactgtgggggaagttatttggcctctctgtgctttacctcttaatctgtgaaatggtgagggtatttttagcacctaccttgtgaattgtgattaggattaaataaattaatatactcagtgcttgatataaagtcaagtgctcaataagttttggctgctgttagtattttttaatggagtttagattttatctgtaagcaatggggtatgacttaaaagtaagaaagggatgtgattatattttggcaagaagacattggtggtagtgtaggggatgattacgatggccagcatggaagcagggaggccatagggttgttgcaataatagaggtaagaggtgatgatggcaacatcagtgggaatgaatgtgagagatgttaaaggtgtaaaaatgatgagacttagtgactgagtggatgtgtgaggtgagagaaacagagaaatccagggaaaggaggaacaaaagattgtagtaggatttgttttgttctgtatttaaggatgggagagacttggacatattagaaggccttgacgaaggggtagagagggagccatttattatataacaatgagaaggaatgatggataaaacaagttcctgagacattcagagagggagttgagagtaggtgtaaatagtagaagggacactttagatacttgtcaagaaaactgttaaaagttttttgatggtgatttagttattggtgcataatagattagcccaaaacacagtagcttaaaccaacaagtatttattattttatagtttctatgagtcagaaatttgggaatgattagttagatggttctggctcgggtttttcttgaggttgcaaacaagatgttggctgggcaggtgtcatctgaaggcttgactgtggctggaagatctgcttctaagatggctccctcatgtgcctgtatgcaggaggcctcagtactttgctggctgttggcaggaggtattagttcctgtcatctaggcctccctgtggggctgcttgtgtgtccttataacatggcagctgacttcccctaaagtgaatgattcaggagagcaaaaaggaaggcatggtaggacctggcttcagacttcacatgtcaccatatctgccaacttatctgccactgtatcagccaccataacttcctaagaagttagtcattaagtacagcccacacccaagaggagaggaattagactccaccttttgaaaggaggagtatcaaagaatctgtggacatattttaaagccatcataagtggctacacgatcaatatgtaattttaactgtaactggtcatttatcatgttttatatataagggattcaatattagatattctgatactaagtcatttgtctagtccagtctatttagataaatgatgacggtaagatattctctctagatatattttccaaaataggtctagtattttatttatttatttatttttatttttatttttttgagacagagtctcgctgtgttgcccaggctggggtgcagtgacgcgatctcagctcactgcaacctccatctcctgggttcaggcagttctcctgcctcagccccctgagtagctgggattacaggtgtgcactaccacacctggctaattttgtatttttagtagagatggggttttgccatgttggccaggctggtctcaaactccctgacgttaacctcaggtgatccacccgttttggcctcccaaagtgctaggattacaggtgtgagccaccatgcccagccaggtctagtattttaaacaccaccactaccaccaccaccaaacaatataggaataaaaatgcttccactctgaaatcccacctgatataggtaatcactggtaatatgcactatttatattgaaactcatgttactgaaagttttgattagttctggaaacttttatttaaacaaaatcttacagagatttgatatcttcttttcttttctttcttctttcttgtagagatggtatctcactttgttgcctaggctggccttgatctcctcctggcctcaagcaatcctgccctggcctcccaaagtgctgggattacaagcatgagccactgcacccagcctgagatttgatttgatattttcttttctttctttttttttttttagataagcatgtaataataattactgcctccctgctagtggagagctctggctcagcagttctcaactctggctacacattagaattatttgggagcttttgatttaaaatgatctggatcagggcctgagcattgttattttatagacattttcccccaagtgattgcaatgtgcagccagggtggagaacacagcagatgacaaaataagtgagtaagttgcactgggcgatattggcagatctaagatttaaaacttgtttgaatgattatttatgtgggggtgtgtgaagagatgtgcatccagggaatacagttatattctgtctgccaacaacatcattcctagttcacatgatggaataaaataatcagtattttatggcatactataaagagtagtagaatgttctagatacctgagcagatttgaccacagcttctttaggagaatcttcttattttctgcactgaatcataggcattcctgagtgtaaagtcatatcacaatcagttattctttgtacaaatgtcctaatttattcatttattcaataaacagatcttgaacacttactgtgtgccaggtaggtgcatttaatatccaagccactgaatgccaggcactgaatgcccaaggaagaacttaaccttattcttaaactaatatcttaatatagattctagcaccaagtgagtgattctcagtcccatagaggagacaaacaggtgcacaaaagtggaggccaaggtaactaaatttaaataactgtacagcacagcaccaaccaatcagagcagacccagtgacagtagtgcctgccatggtgaataccggctgtctgtcagctccaagtatcggtaatacgaagtgcagtattttaaacacccaaagaggaatgtaaacaagagggagcagagagaagggaaccacttttataattccaaattcatgtttccctcacagagggagctgaattggtgtggttggctataccagttttccatcctgtcctgtgtacataccccttgccaagtgactgccgttcttctccctgaagaggtggagtctgtttcctgactccttggattcgggcaggccctctgacttgctttggccagtagaatgcagcagaagtgatgaggtgcctgttccaagcttaggctgtaagacaccttgggtaattctgcttgttctttctcctctgtcatcgctgtgacaagatgccccagatggcctgctggaggatgagagacctggacaaagccaaattgccccacttgccccagacaaggctatcctagatcagctaatagccagccagcacctacagtgaagtttctcagcagaagcactttgacattaggggttggatcattgtgttttggggagctgttcattttaggatggttagcatcatccctggcctgtactcaccggatcccagtagtacccccactgccaaaggtgtgacaaccaaaaatgtctccagacattgccagatgcccccaaggggcaaaacatcctctgattgagaacttgtgctccagacttatgagtgcgtccagctaagatcagcagtgctacctagtttctgaccgcagatacatgagcagtaaatgcctagtgttgtttaccactgaagtgtgtggatatttgtctcatagcattgttgtggaataggtagctaatacagtgatcaaaaacatggaaacatggaagtgggagatggaactggacaattggaagtagtccagttgggtgggaacttgacaagtagatttgtaggtagagttgggttagtgtgaagtacagacgaggctagaaagctagggtaggctgtatccgtggagaatttaggtgccttggtatgaactggggacacggttattcatgggcgggggagggaggggtgctgtcagaggttttagttatgtatttatagccaaggaaacagggctatgagtttgtactgtaggcagcagtagggagggggaattggaagcaggagggagggctctgcagtagttcagttgatgcatacataaggcctgaattagggaattaggagagtgatcataggtgtggaaaggaggggagggcttccaggcacatttggtgtaaaatggatacaacttggtaacctgtacattgctacctttgcacatttggtttcccctgtctcaaaggctccctcttctcgagtgttgctctactcaaccatcaatactcagctcaacactcagggaagtctttttggtagtcttccacgtctcgtgaaggcagagcttatatggctgtcaccattgtttttttgatacagagtcttgctaccatcacccaggctggagtgcagtggcacaatcttggctcactgcagcctcgacctcctgggccaagcaatcctcccacctcagccacccaagtagctgggactacaggtgcatgccagcacacctggctatcttttggtattttttaagaggtgaggtcttgccacattggccaggctggtcttgagctcctgggctcaatcgattcacctgcttcagcctcccaaagtgttgggattacagacgtgagccactgtgcccagccatgctaatctttttatcattgaattgtccatcttatatttgaactaataatcagttgtaagtctgtctcttccatattattagctgctaattcacttagtaagcaccctttctatgtttggtctggaggtaggtgcttgggacacactggtgagttagagagatatataattgctgatttcttgaagcatgtggtctagtggggagacacacagataaacaggcaattactgtacatgctgtaatgggggaagtaaagaacggtttaggaacatataggacagacagcctggaatgtgtgggtgccagtgaagacctcatgaggagcgaagtgatgaaggggttggatgtggtgtgggaggagttaaagccagggatctgtgggctttgtggctctggattaagagaaaactgcacatctgaggaaaagaagaaaattcaacatcattttaaagggtcttgtaaactatgatcagagctgtgttgggaaaaatctttgattgattttcaatcctggctgcacaacagaaccattgtatggcgcttttaatagtagagggaactgggccccactccaagcttgtttaattactatgaccagagtgtgtggctcagatatatatctatatctatagatctatctatatatatgtctatatgtatgtgtatgtatatatttaaggctccataggtgattctggtgtgtgaccagggttgagagctgtagggctctctctgtgaacactgtgaagaatgacatttaagggatgaatagaaagaggaacctgcagagaaactgagatagggaagtgagaaacgtggacaattaagtgggagaactcctagttgttaaatgttgaagacaactaatagtatcagcagctaaggcaagaggaattttcaagaaggaagggaggaacacaattgtcaaatgctgccaggaaggcaaataatgaactgaaaagtgactgctgaatatggctaaaaaggttgttagagatctaggctggagcatttcagtagaatggtggggcagaagccagactgcagggggctgagcagtgagtgggaggtgagagggattagacagtgaggggtccttcacattacatcctgctttcttttttttttttgagacggagtcttgctctgtcacccaggctggagtgcagtggtgcgatctcggctcactacaagctccgtctcctgggttgacgccattctcctgcctcagcctccctagtaactgggactacaggtgcctgccaccacgccgggctatttttttttttttatttttagtagagacggggtttcaccgtattagccaggatggtctcgatctcctgacctggtgatccacccgcctcggcctcccaaagtgctgggattacaggcgtgagccaccgcgcccggcctacatcgtgctttcttggtcatcacagaatcctcagcagtcaataaactttgaataagtgaaagtgtgggtattgggagagtaaggattaagttgatgcaacatttttagcctgactggttgggcacatggcagtggcatttgctgagatttgaagcaaagccagaagaaagggctgagcttgattttgtgttttaaatatgcaagggagaagatgctaagtgcggttgtagatatattaagtttgatgctctttttctgattattctgtaagtacagcgttgtcttcaaagtccactccaaatactaccaagtattacttggtgttgatcagaagtagggtttcccctcaactttgtatgcttgacaatatgatagaacttgaaaaaaagaggaaatctaggaatttaagaaaaaagtctgaacagcatcattttgggatataagtgaagtagaactgataggaaggggaacacatcctctttgcctgaggaagttggagtagttctacctctgttatggcatttaaaaattgtatatttaatttttcagtgtatttaacttctctttgtcctcttgaagttgggaacattcagttgtactctgaaccagtggatattgtgacctggcgctgtgccacttgggccagcttttgcttccttaatgaatgcacttccttcatctgttagtgataagcaggcaagtgaggaattcttatctgcatctatggattgaacatctgtttctattccactgtgtttcagttttaacttctttgcttagaaattaatgtgagcaagtgagcctcctctttttaaagccattttggattgagagtatttgttttctgagcattttatatgcattaaattgataatttagattttttttctaatgttttgagtgatacagaaatcatcatcatgggtttccttaaatttctgtggcaatgggcttattaaaaatgtaattttgtgcatggtgatttttggagggatatcaaacttatcctatgggtgttcagttttgtcagagagttatgatacattttattctgcatattaaaaatgttccagaaaggaaagcaaaaaaatcaccatggcaactcagtagaatgcccttattttgtttttctgaaaggaaaattctaaatctgagtaagaggtataaaaaagagcagtgcagattgtgtctctggcttccaggaagtgagctcataaaagaatgggtttgatgccctgggtgactctgtgttatttaggaccccatttgttttttctcataaggaagagctataaaaaggtggcgtatatattgacactactaaaacagatctgccaaagagcctgttgaatttttctttgtaatgcaactttttggagccaactgtaagtgtcaaggctaaggatgaatggatagctgcaggggttggtgggggaaggttcttaaggtgtcatcacaccacttttgacacttcaacactgaaggagtgctactagggtgagtttgattagaatgattctagcagagtgtcaaaaaagaaataatacatagtcaatgaattgatacattgattaatagtaaaaagtagaatcaagccatgtaccatttttgtagagagactggtgggcagatcagttgtcaacatggcatccagtagtagcaccaaactggtcgtgtagaactcagtgtctgacctgtaaatggttgctattccagggcttctgttacccttcttggggaagcaccagaggacctacaggaacatcagtattccttagaggagggatgaagtgctcaggcatagatcctgactgacaaggctggaagtagcttgggaaagttacttaacctctccaaacatcagttttcttatctatgaaatggttatggttataacagctatcttatagggttgttttcaggaatacatgagttaatatgtacaaaaaattaaaagaaatgcctgaaacatagtaagcaccaattattagctctaattattgaagaatctacaagtgatgcttttttttggctgtgactttcctatattggatatgtttatgaaatggacaggcaaacaattagtttttgttgttgttctttggtaattactttgtaataagttaaaatgggatgggtataaatggggaggggatatattgaaacccaattttccatgacctggcgtcatgtgggatactgagagatcactgacacatggaacattctggtctgtagcatttagggaaaatatggatatttagcaaagatgtatctaagggacagcctaggtaacttatcagttcaatagtgaggtttctgatgtgcatgacatccaggggtgagatttctgctgttatatggtaggaaaaggaattgtatgctgttttctttactttaattgtttttagccaaagtagctgttatagctatatgctatggtaaaacactgcagcttttggttgttaggaaactgttgggttatctgggctcttctttttcccaagttctgaagatgaagagctgcctatcagaaggcacaaaaagaataaaacagtttgtggcttctgagacaaaaattgttatctatgacaataaataaatactcatgcatactgtattttttaaagttaaacaatatttattttcatttgtcttattagaaatgatgaaaatacagaaaatgagaatgtacagataacatacatgagaacatacattgttcattctttatagaatgtatgtacattccactcataatccttttgcacagaaatctacttacatgaacattttctgggtacatgcacgttgatgtaaatggggctcatatgctttctattttaaagtacattataaatacatttattttacaatgaatatacatttcctatataattgagtaattcataaagcaatcaaaggatagaccaaaaaaattattgaatcattattctttatcaatgtgtagattatttccaatttttatgaacatgttcttaaataacaggactgaacacttgccagccaggcagaacaatgagcctccttcaacctaaagggttatttattttaacagagccaaggcagcagcttctctgtgcatacgcacctctgggaagactgttttctgatgaaggcatggttttattcagcatttgatgacaaatccacaccagtttagtgaaagagatatactcatgttcagtgatgcaccaaggaagggcaggttattaccttggaagtctacatttggcaactatttcacaaattttgccagtcaaaacttgatgtgaagattcttaaaaatttaacttagccgggcatggtggctcaatgcctgtaatcctagcactttgggaggctgaggcgggtggatcacctgagctcaggagtttgagaccagcctgggcaacatggcgaaaccctgcctctactaaaaatacaaaaattagccgggtgtggtggtgcatgcctgtaatcccagctacttgggaggctgaggcaggagaatcacttgaacccaagaagcggaggttgcagtgagctgagatcgtgctacagcactccagcctgggcgaaagagcaagactctcaaaagaaaagttaacttaccacagacccagcaattctacttttaggtagctaccttagagaattgaaaacatatgtgcctacaataacttgctcatgaatgttcctagaagcattattcataatagcccaaaagtggaaacagcccaaatgtctatgaactggtgaaagaataaaggtggtatatccatacaatggaatactctactgtttgacagttaaaaggaatgaactaccaaacctcaaaaacattatgctaagtgaaagaaaccagatgcgaaagactgtacattgtgttattccatttatatgtgatgtccagaaaaggcagatctatagagacagaaaacagagttgcctgggctgcagatgggtgtaaccattaactgctcatgggcaggaggaatctattggggatgttggaaatagtctaaaacgcatttgtagtgatggttgcacaattctataaattcactaaaacttatggaattggacttttacaatgggtgaattttgcagtatgcaggctatgcatccattaagcttttttgtttttgagacagagtttcactcttgtcacccaggctggagtgcaatggcacgatcttggctcactgcaacctccgcctcccgggttcaagtgattcttctgcctcagcttcccgagtagctgggattacaggcacctgccaccacgcccaactaatttttatatttttaatagagatggggttttgccatgttgaccaggctggtctcgaactccagacctcaggtgatccacccgcctcggcctcccaaagtgctgggattacaggcgtgagccactgcacccagcccataaagctgtttttttaaacataatgaatggtatttgattattaaaacattgaaaaggaaattggtaagatatctatagtacttttgtgttttttggctgggaggtggccagagtgcaactttctttggtcatctcatatcctggttcctctgacaccagctgcctctcccataccacctaagtttgaccccagtgagatcaaggtcgtatatctgaggtgaaccagtggcaaaatcagagccacatctacccctggcctctaagatcagccccctgggtctttccccatcaaggttggtgaggacattgctaaggcaaccagtggttggaaatgtctgaggattacagtgaaactgataaggcccaatttgaggtggtaccttatacctctgccctcgtcatcaaagcactcaagaaaccatcaacagatggaaatagaaaaataaactcagtagaaatatcacttttgatgagattgtcagcattgcctgacaaatgtggcactgatctttagccagagaactctctggaatcattacagagatcctggggactgccccgtctgtgggccgcagttgttgatggctaccaccctcatgacttcatagatgacatcaacaatgacatggtggaatgcacagctcgttaagtacagaggaaaatatttcagtgaagatcatttgacaaccaaccaaccaaccaaacaaacaaaaggacatcaacagaagttcccaacctgcctgctcatcagaatcttttgggaaataaaattaaataaaaaaagagtcctgggcctgacctcagccttaggattcctgttttcaatgatcttcctagatcattggctagtcaggttggaaaccactgctttttgtgagccattgctccagatcctgaactattctgaaaaataccaagacagacgtagtcaataggtgcttatttcaccttcccttctggtgtgagctaaatagatgtcaaatcccctggctccccatggtttaccttgaaagcctttcttctcctacttaaagctagacttggtgcttctctgcattcaccttaaggaattgactcactgcagaagcatcagcagcaccattttttttttaactggagagacaagaaagtattagctacagagcacatgacattcctgctctcccaagttctaggtgtcccttcctgtgacccttctgccatcttgctgtcctgtgcctctcactccactactttctgaagcttgggtgaccctgtgtggtccaatcttctgctctacctgcatctctctcagggagagagagagagagagagagagagagagagagagcgagagcgctcctcatgctggggagcctctctgcctccctggaattccggggagtacagttttctttatcttgttgatgagttactgtttgtttcttctgtgtttatgtgttctgcttagttcaactcaactcatcaaatacttctcatgtagtgcgtaaggtctgccatgcgtggtgtgcaatgttaccaagggatgcattattagatggcatcaaggcacctaggctttggcaattagggttgccagatttagcaaagaaaaatacatgatgcccagttagatttgaatttcaaaagaataacaaattttttattgtaaacatatcactttatctgaaattagaatctaacgttgtatcctctatttcattggacattcctaaagtttccatcagacctggttttccttttggcttttccacttgaatagttaggtactcagtaggttacttaacatctctaaactttggtttccttatctgaaaattagggcaaatattacctgtaagtgtgggcttccttccttctcagtggactccaagctcatggggaacagtggttagccctctgtgccaagtttagaacttatgcttacattttattgtctgaaatataatcagatggccacacctagctctaagagtggcttggatatggtccttattctgggcagccacgtgcctaaagtaccaattagggattctcttatgtgggaagaactcgggagcaattaacagtgtttgccacacacttttttttctgtctacaatactgttaaataaatgctattgattaaacacatttaatagaataaaggccactacccagttgcaacaaatcaagaaattgtttggatcactgccaaggatatagagtaggggattattcttggattcaactcactagctgacctgtcctgccatattggaaaaatattttaatccttaagtgctctagtttcttcatttgtgtgaagcctatgttgactggggtcacagacataattacatcatatagctggttgctgatccaattgttggcaatttcaaaacgtgccacctggattttatataccttctattttcttggtgactaagttaaagtagaggtggatttttgcagaaattaggttctaacgtcagcacatagaacaaacattgtgtgtagttaaaattactgaatgtgggctgatatagtgactcatttttaacagacagactaggggaagggaaaaataataactttacagtggagaaatctggcagacaccaccttatcaagtattcaagatgaaccttcccaacaagtcatggtgcttctgaagagcacttcatctctgtggtattcttctcccaaatctatgccccagattaatcatgacatagcatcagacaagcccaaattgagggacattctacaaagtatccaaccaagcacccttcaaaagtgtcaaggtcgtaaaaagcaagcaaagactgagaagctatcacagattgatggagactaaggggtcatgataactaaatacaatatggacattagtggaaaaactggtgaaatccaagtaaattctgtagttaatagtgttgtaccaatgtcaatttcttagttttgataaatgcactatggttagataagatgttaatattagaggaagctggataaagaacatatgagaactctctttgcaacttttcttaaatctaaagttattccaaaataatttttttaaactactcctgaaattctcttgaaaatgccctatgttgtgaatgagaaccatgtgataccttgaaagaagattaacatgtcaggttttcttccagcattagggcagattactgttttcttaataggtatttaacatgaatttttctggtgctggtaatacagcagtgagaaaacagttaaaaaaatctctgccctcctagagcttacattctagtagggatgtaataaaagaaataagcaaaatgtattatctgtaaaatagtattaagtgctatggaaaaaataaagcaggaaagaaagtattggagggttgataaaagtttagaggtctaaagatgtcctccctaagaagatgactttaatgtaaagacatgaaggaagtgagaaaaagagccacatcagacaaactcaatggatattttggagaaaagcattccagatagaggaaatagtgtgtgcaaaggccctgagacagcacttgcctggtataactgaagaacagcaagggatgctgtttgcttacttgaaccacagatagagtagctagttttcatttggagtcatgttgtaggaaaaatgtgtgtctttgaattaaactcagcttggtgagttacttacattatgagaggcatgtgggaactccacctgattgaaggggcagtcttcttccatctcatctagggtcatatgcttatccagtgaaatggaaggctaaactctccacactattgaaaatgttataggccaggcgcagtggcttacccctgtcatcccagcctgtgggaggccgaggcaggtggatcacttgaggtcaggaattcgagaccagcctgggcaacatggtgaaaccccgtctctacaaaaaaatacaaaaattagcctggcatggtggtgcatgcctatagtctcagctacttgggaggctgaggcaggaatcacttgaatctgggaggcggaggttgcagtgagccaagatcgcgccgctgcactccagcctgggtgagagagcaagactctgtctcaaaaaagaaaaaagaaaatgttatatatcttttattttttggtcgagcacatgtaatttatgttgaatttgttaaaggcaaagaaaagatgtttactttatgtgccaactttgtgatatgactacagagcccattcatgatgaagacattgagtgttgctaggaaaggttgacttactccttgttggctgcctgttgtctctggctttcctcgttgaatgtgtactctcctacctgcttgggaggaagtggccaggaggagtgtgctgtgtcttttttccctttggtagacaatgtggctgctgctgctggtggtaaattatgatggttctactctgcccttcatgaatgtcactgtcacggcaataaagtgtgcattagtagagcatgggattgttgcatttggctttagaatgtcctttgataaagaattcctttattatgggtcctaaaaggcaatctctttaaatgtacctttcaaacactgggctagttatatagatgtgtgttccagttactcatgtatagctagttagtcccatgatggagactatatggctgaaagcctgctaggaataaaagaaaatgagagtttcttctacagaatagagcattatagtttcatttggagcttgaatatcttataacaaataccatggctttaaagacatataacagaaggaaaaacacttttatctttaacctataaaaatgtatccctcttttaatcatctagaattgtatatataaatataaactgtaaaattagaaagacctgaagatacttgaataaaaagaaataaaaatttcttttattcaaaatgtatctttatcctctggcttagacttttccatctttaggagatgtataaaatggaaccctttcaattgaattatctcaggaactcgttttactgtgtcattaggaaaaataacaacggtttgggaataacataaaatatccttgtgtctgaagtatctgggtttaagtagaaattttatatcatctgggggcaactttttatttttgggattgagttctttgtctatgtaaacttactttatgtagttttaaagtaactacataaagaattttccttccatttccgtagtgtgctaggccaaaattggttctgttttatgtattattgacagttttgattgagtcctaccatacctttcagggaagattgttgaggtggttgctgtggaacgttaaggaacgaacactttccataggaccctgcttgtggtattctgatagaatcagaagttagattcttgggttacacttaaacccttccaatgaaaaggactttttattatactctgaaatgagaatgaaatattcatttgcttggaacctgttaaattcttaaatttcatataggagttacagaataaagacctattgttgactaaggctaatctgaaaatctctatcatacttctctgcaagctgtaaaagctgtgcagctgtactctggggcttggtatttaaaacctttggatttcctgagattggtagtgggaaggagtgtagaagtgaaaatgccaaggaaattactgctcttcttgatcggggattgtaggtacttctctgacctttaattcaagattccttattatgagtcaccttaatgttcccctggaaatcacatgttttggggaacacctaaatagctctcttcattctgtaattggggaatatgtagggaagggtagattattcatagagcatctttcgtggtggaggaatctgagtgcttggaggccttgcagcaggaagtggcatttacaaatggtgctcagaacaagaacactgcctgtgtccctagccaaaaagaaactaaggacctagcatgagttcccattaaaatctgtgtggactgagtcattaaagctaagttaacggcttcacttttttctttggccaaaaggacaagacatacttcttgatatctgagaaactgaactgcagatgaatttaaagatagtattggggtgcccagtttctcttaaaaagaaaaaggaggggaaagagaacaggcttgtctatgttgtatggttcttcaaatgttaatttaagcaaaataatttgatttgactccttgaagcttaccttggagaactataatttgatagactattttatatttttacaatagattttcttcatcagctagactagtagaagttaattttttttttttttttttttgagatggagtttcgctcttgtcacccagtctggagggcagtggcgcaatctcggctcactgcaacctccacctcccgggttcaagcagttctcctgtctcaccctcccaagtagctgggactacaggtgcccacccctcccacccaccacacctggctaatttttgtatttttagtagaggtggggtttcaccatgttgaccaagctggtctcgaactcccgacctcaagtgatccgcccgccttggcctcccaaagtgctgtgattacaggcatgagccaccgtgtccggccgaatatttttagtgatagtataattgtgtttacttttggcctcatgagagaaaggaaaatatactattctattaaatacttcttggtagctgggtctcaattttcctgctcttaggtctgggcatacttttataaaagtcttgagtgtattttttttctattatggctccatgtcacccccattcattcattcagcaaatacttattgagcatctactatatgtcaggaacttttctagctcctggggagctagctcctgccttctgggaacttaggttctagagggtaaagacaaaaaagaggcaagaatgtatgtcagacagtgataagtgtcatggagaaaaataaagtagggcagtggagatatggattatttggggaagggaatgtgctgtgttttaaggtgatcagggacagtcttactgagaaggtgacagtggggcagagacctgaaaggaatgagggcgaaagccataagaacacctgggagaagagctccccggtaatgggaacaacaaggggagccagggtggggctgtgagtgaggaggagcagtaacagaagtcagagtgtttgtggggccggatctgtaggatctcatagccaagagaaggatttaggatttttttcctgtgtgagttgcatcctaatacgattgttgatatttcttctgcccaacctccttcattttcctataccatttccagttgtttcaacatgtaaactttgttaaggtttcaaaaataaacagatataacccaaataacaatgtattaaatgcaaaagattgaaatctgcatgtctatttctactaaacctctcttctttatatgtgtcatttgctggggaaagcagcatttgctactgacctatttaaatatgctgagctcagagcccttcccagcccaacaagatgcacttaaccctctgtggggatagaaagttgatagattgtttcgtgattgtattgtgcgggtttttttttgttttgttttcttttgtttgtttgtttgtttttgcacctgactttgatatttatctgtgtctgggcattttttagaaagtaagctctgaaggccaggtgcagtggctcatgcctgtaatcccagcgctttgggaggccgaggtgggcagatcacttgaggtcaggagttcgagaccagcctggccaacatggtgaaaccctgtccctactaaaaatacaaaaactagctctgggtgtggtggcaggcacctgtaatcccaactacttgggagggtaaggcaggaatcgcttgaacctgggaggcagaggttgcaatgagccaagtggtgccactgcgcttcagcctgggtgacagagcaagactgtctcaaaaaaaaaaataaataaataaaaagtcagcaagctctgagaagacaggtatgtttggagtataatggttattgtgattgattccctgacacccagtccaccccactatggtcatttcagttgactcccttatgtcaagtccctcctcctaagccactcatggcattcctgtgctccttgctggttatttattagttaaggattgggccattggtttggtcatggctaatgttgagggagcttctatgaaggatttccttgcttctaagaaagacacggagagaaggttgcctttcttcctttggtcattgctgtgtctggttgtgatgcctggaattgctgcagttattttgctacccgcctgagaatgaaattagtatgttctgagctacaggattatctaattctgggtccttctcactttgggctttttatggcatgagatatatatcctcgttgtttgagacaggtttatttgttttgtttacagctgaaagcatcctaactggtaaagatgtattaattcccttcctgaagtttttttttcagaatacgttatatggatttacatgcagtgtttttcagtaatatttagccctatggattccaaacttactgaaatgatttagcagattagagtgggaatgtagtgacattaagttgcccttgttaacatctggagttttgtttcataaaagcagtatgaaaattttgtgtgtttaaagagctgaaaaggaaaaataaaagaagtacagatacagaaaaaaaaaacaaggttattagactgtgttgttcaaatattctgtagctgtactaattttcgttggcatatttgtaattgaatgtgctgtactgaaacctcccattatgatggtgactttgtcaatttctccttacaatcttatcagtctgacatatgtattgacatttatatatttatatttctctagattattttcttagatgcgtagagtttataatggttatgtctttctggtgaattacaatttttatattatgtaaaaaaataaagagctgaaaagaccttttagaccatattaatttattttaatgattgtaccctgctctttaagttagcaacatctgaactatcaatagtagaaaagaaaggtaaattatatgatacaaacccatgtccatgtaccagattcatcacagctattcttgcatgagcccagatactttaaattaaaaaaaaagaaatgttgaagaacttggaattcatccctttatcccattcatttattaagagttttcttttttttttttagtttctattatttttattttattttttattattattatactttaagttttagggtacatgtgcacaatgtgcaggttagttacatatatatacatgtgccatgagaagagttttctcaagcacaggtaatcctagcaaattgagacatcaatatttgagggttttaaggtggccagactgtgggctcatcaatttccgtacttttccgtcatccaactgagttttgtgggtgaataatgttaccattttatttattttaaagcaacatatttggtattttttttctcacatatctctttttgttcttatagaggctaggagtagaactttgctgttcaaatggggagtgagcagtaaaattaaaaaggttggccaagaccctgggaaaatgcgaacagtgcgtgtcttttttgcatctgaactgaaatctgagaggttcctaggttctgcacaaggtagctttgtgcatatttctctgattgctgagcctggagtgagctacctgacaggcctctgataatcaattccaaagcacacactgttctctttcagcatcttgtagggaaaggtggacaaagagtgtgaaataaatattctcttcccaagtctcccatcccaagtgtctctttgaggtgggatactgacgaagacttaaaaatacccatctcgcttgctccctcccacatccctaaatacaacaagcagcaaacaaccccaaatgcctaacaggaagacagttcctttttaattttggcaaaatctaggaactctttgtgttgtggtgtccagaaacataaaaggagaattctatgaaaagatttcagctaattaacatttacagggtgcccattgctgtgccaccatgtgaggtgttatttaagctttgcagaggtaaattaaaatgtgctttttgttgccttgcctgcttaaaggggaaagcagaggcatgggatgttattataaagtaaggaggttgattttcatgtgaggcctagtgcaaatcagcctgttgtttattctgaaaagcatgctgttttctacaattcagacttcattatttatttgcttgtttcttatattaagattgctcagtggcacaaataaggaaaaaaaaacccataagaatagagaggatgaagggggcagagaaaagggagggaactcagaaggtgaagaaatattgtggtttgcctgagggaatctgggaagtaaggagatggaagaagttgggcgatcctttcagttaaaataagtgaagacagttgtgggttaggagaaataagactttctagttatgaagatcttacacatgtaactggtcaaatattttagattctagatggacatttcaagagaagaggtaatataatgtaataaaaattttggctaatgattaatgactgcttaacatgtatgtgttgaaactgatggagaacaggactttatatatattactcagctaactttacttgtaacaatcctatgaggtggatactctttttttttttttttgagatggagtcttgctctttcgccaggctggagcgcagtagcgggatctcggtgtacctcaacctctgcctcctgggttcaagtgattctcctgcttcagcctcccgagtagctgggagtgtgccaccatgcccggctaatttttttttttttttgtatttttagtagagatggggtttcaccatgttggccaggatggtcttgatctcctgacctcgtgattcgcccacctcagcctcccaaagtgctgggattacaggcgtgagccaccgtgcccggccgaggtggatactcttttcatttccatttttttttttttggtctttttttgaggaggaaactgaagcttagagagattacatttcctaaagtctcagctggtaagtaataaaaccaaggtttggaccaagactgtgcccctaacggctatcctatactgtatctgaatacttgaggaaataaaatatacaactgaaattattttgcattttttaaagaaacagtagcaataggggcatagaatcttaaaatttaaaaggtcttagaggtcagattatagagaaaaaaatggaagtccagggagagttcctaaactgtgtcatggggtaccttggaaaattttttacctttgtattcaacttcccaaaaaccataaaatgcataattttctctgtcaatttttttccagttttttgttcattatgaatgtcggggaaggtatctattttaaattggactctgtcataagtaatgcttgaagaattacatgttgtgcttggcaatttgcactgcatgcaaagctggaatgtagggaatttttctgttttgtactctctctcttattatgtgtagggtaaggagaatggagccctaatgcagtttctttaggaagtgtagtacaccaccagtagttaaaatgattattatgcggtaatgccaagggctgtagaatagaatttaaacattacttgatgttttctagatagatcttaaaatagatatcgatataaaacaaactggaaggtacagaaaattaattttagaatgtcaattctggatatattttgatgagaatatgagaaagtagccacaaatcacaccgtgcaccatgaaatttgcaacagaaatttcatagccaaatatatttaagtgttcttggagcccgctttttgttttattaaaaaagacctatccaaatttgtttgagttcattgtagattctggatattagccctttgtcagatgagtaggttgcgaaaattttctcccattttgtaggttgcctgttcactctgacggtagtttcttttgctgtgcagaagctctttagtttaattagatcccatttgtcaattttggcttttgttgccattgcttttggtgttttacacatgaagtccttgcccatgcctatgtcttgaatgctaatgcctaggttttcttctagggtttttatggttttaggtctaacgtttaagtttttaatccaccttgaattaatttttgtataaagtgtaaggaagggatccagtttcagccttctacatatggctagcctgttttcccagcaccatttattaaatagggaatcctttccccactgcttgtttttctcaggtttgtcaaagatcagatagttgtagatatgcggcgttatttctgagggctctgttctgttccattgatctatatctctgttttgataccagtaccatgctgttttggttactgtagccttgtagtatggtttgaagtcaggtagcatgatgcctccagctttgttcttttggcttaggattgacttggtgatgcgggctcttttttggtttcatatgaactttaaagtagttttttccaattctgtgaagaaagtcattggtagcttgatggggatggcattgaatctataaattaccttgggcagtatggccattttcacgatattgattcttcctacccatgagcatggaatgttcttccatttgtttgtatcctcttttatttcattgagcagtggtttgtagttctccttgaagaggtccttcacatcccttgtaagctggattcctaagtattttattctatttgtagcaagtgtgaatgggagttcactcatgatttggctctctgtttgtctgttattggtgtataagaatgcttgtgatttttgcacattgattttgtatcctgagactttgctgaagttgcttatgagcttaaggagattttgggctgagacagtggggttttctagatatacaatcgtgtcgtctgcaaacagggacaatttgacttcctgttttcctaattgaataccctttatttccttcccctgcctaattgccctggccagaacttccaacactaagttgaataggagtggtgagagagggcatccctgtcttgtgccagttttcacaaatttacaagaaaaaaacaaacaaccccatcaaaaagtgggcaaaggatatgaacagacacttctcaaaagaagacatttatgcagccaaaagacacatgaaaaatgctcatcatcactggccatcagagaaatgcaaatcaaaaccacaatgagataccatctcacaccagttagaatggcaatcattaaaaagtcaggaaacaacaggtgctggagaggatgtggagaaataggaacacttttacacggttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcgacactattcccaatagcaaagacttggaaccaacccaaatgtacaacaatgatagactggattaagaaaatgtggcacatatacaccatggaatactatgcagccataaaaaatgatgagttcatgtcctttgtagggacatggatgaaattggaaatcatcattctcagtaaactatcgcaaggacaaaaaaccaaacaccgcatgttctcactcatagatgagaattgaacaatgagaacacatggacacaggaaggggaacatcacactctggggactgttgtggggtggggggaggggggaggaatagcattaggagatatagctaatgctaaatgacaagttaatgggtgcagcacaccagcatggcacatgtatacatatgtaactaacctgcacattgtgcacatgtaccctaaaaggtaaagtataataataaaaaaaaagaaaaaaaaagacctatccaaatgctgaaaatgaaactagtaggaattatataaagatgaaataacttatattgaggattttacatagttatcacaacttagatatttttctattcaaaaaataaaaaagcctagtaccatatctaggaaaacagactaatgctgtaaaagtgcctcagctatccaatagacattttattactaaaatttctcctgggggtggtgggggaagatggaatttcctggttgatttatagcatggtatttaagatgcaaagaactatgttgctttgtttcatgggacccatcacgccgggcacggtggttcacaactgtaatcccagcagtttgggaggctgaggcaagcggatcacttgagctcaggagttcaagaccagcctggtcaacatgatgaaaccctgtctctactgaaaatacaaaaattagccaggggtggtggcgcgtgtctgtaatcccagctattcgggaggctgaggcaggagaatcgcttgaacccaggaggtggaggttgcagtgagctgagattgtgccactgcactccagcctgggtgacacagtgagactcagtctcaagtaaataaataaataaaataaaattaagagacccatcagtgttttgtgtttggttactctccagtaataactttgtaatttccacctagctcctgcattgatcttgcatttttcaatccaatgcattttggttggtctacttatacacttaattcccatagcaagcctcattaatctcattaattccatgccctagtgaactgctgagaagaaaagttgtcattaccatggattctatcacatgaagggatggaatggtggaaaccaccttccgttttctccctctgtctctgttttgctgctgtccaaatatttaacattaaaagagtattataaaaaacaaattgatttcagacatttgagggataacatatttgagatttaatgtatttggggaactgagaagtgtttgatgtgaggtagaggtacaaggaaatgggagtgggttttatatgcataatagtgcatgccagagctaggataggctagaggctagattatgtgtcagttacaaatgacccccaaatctcgttggcttgcaccatagacattttttcttgctcatgctatatatccaatgtggattggtacccagactgacagagacttccttcaccatatctccaactatgaccacccttacagtggggagggaaaggagctttctgttgagacatgattcatgggccaaagcaagtcttacagcaatgcccacctgcaggtggggaggggaagagccatcagactttgtgtctcaacaggaagacccgataccaatgacagccagtactgttccctaacttttcttgagaaagagtgatatcagtaaaggattaaggtgggggcagtgccaaccacttcagtcttgccttgctccttggggagtattttcttttaaaaaaattgattaataggctgggtgcggtggctcacgcttgtaatcctagcactttgggaggctgaggtgggtggatcacttgaggtcagaaatttgagaccagcctgaccaacatgatgaaaccccgtctctactaaaaatacaaaaaattagctgggcgtggtggtgggcgcctgtaatcccagctactggggaggctgaggcaggaaaatcacttgaacctgggaggcaaaggttgcggtgagccaggattgtgccactacgctccagcctgggtgacagagtgagattctgtctcaaaaaacaaataataataattgattaacaatattgcatatggaggcaaggacccaatatgtgattccagggcatgttagttcattctcttcttcattcttttgttccttcactccttcactaaatatttatttaaagatcacatatcaagtacatgatgtgagtgctgatatattttattgattttgcttttgcttgtgtaatctgtagtgattatttctttaacccattttttctgtcttgtcaatttttagttgcactcaggagcagccttttgtttgcatgtttattttgaatctgttatttcttaaattccttcagggtgtgcacctgatctgttttctttaccgtactatccacatgtattattagtaaatatttgataatgagagagaaaccatagtttattggttatatctttttcaatatttctctgaagcagttttgattttaaaaaactatcccagtctattagcattttaatcagcatcttgaaattttatctgtaatacacaggtagaatttttcccttgctgttttacttgtagagtcaaatgactctagtatgtgttgttcaggtgacacaaaaaaacctctgcgtaatgagtaaaattatcccagaggagggagctcttttagacaatgaaacatagtggggtccttgagtgcaactaaaatttcttttctgattaatcaccgtccccttgattcatctttgcttggtcttgtgtatttccattgcatagtctgacttataatgtggttctgcagttgagtctttcttagaactgggtgatcacaggaagttatcttatttatctttgtagtccattacccctcctctcaccctacaggccttactcagtaacttgtgcatagtagctgttcaataaaagcttgttaaatattaaggtgatagatatcacagttaccctgatttgattatatgaatgtatcaaattatcacctatacccctaaaatatgtgcatgtattatgtatcaatgaaacataaaatcttgttaagggatttgattttcaatgatgataggggttgtgcttttgaagtgatgcaaggctaagaacaaaactgtaattgtttaattcagaaagtagttgtggaatggagtctgaagggagacacgacaatatggcctgcacgaaggaagattttgtgtatagaatgttctagcctgtttagattgccttgacttgtgtcaggggagcagtttgtttcactttgcctatataagattaatgtttctgagatgaaaaaaacacacaaaaaaggagctttttgacgtaatcaagcctctatcaatcacttcttgcttcctaataacttttgtatcttcctttcaggagagcagttgaagtgaattcttctgggaccaaatccagtgtttctgccttgaagaaacataattaactgacattttaaaagccactttatagacctgttctgactctggtctaaggacattacttgatttatagtttatgaaaagtctacttttagaatttgggtatgttttatggtagctcttttagttgattgctttcatttttctttgggaaattatctagaatagctgtagtgatgtcatcagaagcttgacttttacctctgtgtacttagagggctgactgacgcacagggaaatatttcaccatgaatggtgaggataagcttatgtgtgtaaggaaaaggtaactgcactgcaagcagcttccccctccctccctctccagggaggggatgatagctattattaattgatttttctcttactatggaaaccaagggtttagatattaatggaaaaaaattattgaaatgtcaaggattttgttttgtggcttgggttccctgaagcctagcttgaagagaccagcagtgaattacagtgtcgcactgtaaagacactgacaagatttttgtcattaaagttaaaaatattgcagcagattgcctgggtaatcagaccttcctttgatgtgtgtggtaagaattcttattcaagggaactgaggcgggatatatattcattattagagactccagcgtggatatgattttaggtttcaatgaaaagctttcttccagaattaccatgcttgaggaaatatgattaagagttgatcacatttgttcaccagccacagacattcttgccagtttgagagcacgggtacgagtgatctctgtgcttctaggcatatgcacctatcattgttgggtcttccaaggatctaatatgtcaatccagatccatgcatctggtggctttcatccctctgcctggagcacagcctcactttcatgataatggatgcccttccaactttctaataaggaggctttgtgttggtcctcgtgtttgttcttgggatataggtaaaagaaaaaaaaaatcctttgaaagtctgtaagtccacactgggtgcttccctgtcatctttttttcttgagacagtgtcttactttgtcacccaggctggagtgcagtggtgcaatcatggctcactgcatcttcgacctgctgggctcaagcgatcctcccacctcagccacctgagtcgctaggactatgggcatttgccaccatgcctggttaatttttaaatttttttgtagagaggaggtctcactatgttggccaggctggtctcaaactcctgggctcaagtgatcctcccgccttggcctcccaaagtgccgggtttacaggcatgagccactgcacctggccccccatcatctttatccttcaagtaaagagtcctggagggactggtccgtgtccataggtgaggagtgtcagtgttgtcacgtggccaatccgtgccctctgcggaaggtgccaggctaagaaaaatatatcgaaacaagataaaaccaaaccaaatagccacaaacttctcctatcccatagcgaccacctgccccttcctgcctgcttctcatcatagtatcccacgttgaggcttggagggttgagccccacgtctagacttgaatacttggaacatgtgaggccaactgctgctactttcccaggttcttgtgatttaaactctgggctactagtgctctggacacttaaaattagtcacttagtggatcaactaagtgcgtattgctggacttagttttgtaggcatcatttaagaaattcctggaaacaaaataggaactatttataaagttattgaccttttgccagcatagttccatatagaatatgaaactggtctcatttcatacctcgcctcattccataccttgtccatagttagtgttcaaaatgtcaggtcgaatgaatgaggaatgagtatcagacagatttatttatggaaggcagcaaagtgaacaagggcaaaggcatgggtagggagacaagcctgggagaactttaaggagtcaaggaaaataacagattttggggaatggtgagatgagagatggttgagtagagatggctgggttagagcaggattcacctaaggagcatcccactcagtgcagtaaaagactcgccctgagaaatactcatgtgaactccctttgtgcagtctgtgtggttggatttctctgactttatgcaaatataacatgactccactgtgaatgtgttggtgctttcaagaagctgcaaaactcttactactatcccattttagatgaggaaatggagactcagaagagtcaagaaatctgcccaaagtctcacagttggagcctctctgcagaccctcaaaatatgcatatgtattcccatgtaaaaatgtcaggttttccaatgttcctcctggacccaactgtatagtgttgatttgccctgagtgaaagtagggaggtgacaagaaataggaactaagtaaggttgtttcttgtgtgattttatggaatcaaaaagggtagttgaatcaacaggttttgcttccacctgaaataacatcttcattttgttctgctctttcttaaacatctgtgatggtttaaacttttgggagttcagttggattgtattgagggtaagcttccaagaggggacaactattggccccaacaaactattgccatagaatcttctagcacttaagttagtcctgatgtttctcataaattctagcgatgatcagcaatttagtcttgaaagtaggccttttaactttagttgtaggaatcaatgacacagaattatttgcagctatatcctgatttgaagtagtttataaaatttgctcatcctgactcgctgtgtacatgggctgtgtatagatcagtgtgggagtgtgtgcttgcttcattttgaggactttttattacataagctgaggaacttaacttgaaattctacgatatgactttttattcctgaagtgttgccagggcttggctgatatttcatgccaaatttaaaaaataatattattatttataagcagttacattttaccatgcacagtctgattgtttggctcattatgactcatgagcagctgaaatgtgtggcttgaattttgagtcagttcattaggaaatattcagccaaaaagcatttattggggctcttctaggcccagaatatcaaggagattaatgccgccagtagtagagatgactattaacactatgacatttcaaatttgaatgatacactattgaggtgagtcagaaaatgtatctagtgataactagtaatagcttgacattgggaaaatattgactgttttattaatcttttaagaaatatggacatctttgctataattaaaaagctgccatttatacctaaatgcatctatgttagggaagagggatggtttgatagctataagctggttgggtctttattcagaaattgtgctgacattgacttagagcggttcctataaatgaggtcccgatacagtaacactgcactcatcatttggaagtcaactcttggctctttttgtttaataatattgccagactttacagctgtaccataatttgaaacagtatgaaaactgccctatttactcattccaagcaaaagggctaatagtgttagttttcttgtcacaagttgattgaattgagtaatagccaacttaattcactcttccctggttctttttatcaaaacgttttcttccttatgcaatcattttgatttaaattctttaaaaacaaaagagaaaaacatgctaacagttactcctttattttttatctgcctcagaatagttaagaaaggttatgttaggaattcctgaaaatggggtcatataagggctttatatcttatgctacccaaatccttttatgtaaactggaaaaaaaaatcagattctgaatgaaagcacagggaaaaaagagtcagggctgattttagcagtagcccaagaggatgaatgtattttcatcgtactgccttccagaaacaagggaggtatgactcaagacccagttgatacctgtgtactttcccaggaggctgtgtttatgattcctagggcctgtagattgcatcttacacaatattggattctgctcatttctgttggttaattcagtcttcacattctccagtatagcttcttttggctcagttaagatttgcactcctctcagtttacttctcctgttccattaaggcttatgtcattggcgtcgtaggaaagaattattttttcctgttcccattactgttgttttcttcaatggtccttctttgctctcccctaaaggatctgccctcaaaccactttacatctcgaccagggtgtgatagctctgcttggatgcacttaaacaaaacatgggggaaaatggaactaactctctgtgctccctgcaagacagcacccctcccctgcattgtcaacactgccagcattctcctctcccgtccatgggatccagtgagaggtatttcggtcccagatgttttagggttaatttgtgtgctgctgtttctgctacatgctggttcattagcccatcttctggctttcctcaagcccatgcctagattggtgaaaccgtttctctgatttttctctacacttgacttccatctcattttgccaggccctgctccctgctgggctgacctggcccttacctaagccccacactcatacctgctagcccatccggataaatgaactccattctattgtcttgctgtttgtagaggttcacacagctcaagacattcttcaccaccatcaggttatttcttctcccttattacgttagactccattgaagactcttagtcttctcaaactcagcacttgaatgattgcctgtgtttgtaaagcatttttacagtgtgtattttcacctagaatgtctcatttacaaatgtttctaaaatgtattcaggctaggatttgaatccaggcagtctggctccagagcctgtgttcttaagttactaagttttatatttgggataatagagagatgagaatttggacaaaaacttttatatataacctgttcctttgcttgcatggcattctatctcatcatggccaacatgatcaaaatttctcagccgaaaattactatgttgctgggttttgtttttgttttttttgtttgtgttttttgagacaaggtctcactatgttgcttaggcttggacttgatcttttgggctcaagcaatcctcctgcctcagcctcctgagtagctgggactataggtgcaggctactgcccagcttgctgtttttctttttatcaggaagttcccttgaagctttaagcaaccaaacctgactttttcctctctcacaaatggctgggattcattgccggattgatcgctccaccactcactcttgtggtccaccatctgccaatggactcagcttttagggaaaaaaaaaaggataggctgggtgtggtggctcacgcctgtaataccagcactttaggaggccggggcgggcagatcatgaggtcaggagttcaagaccagcctggccaaatggtgaaaccttgtttctactaaaaatacaaaaattagcccggcgtggtggcaggtgcctgtaatcccagctactcgggaggttgaggcagaagaattgcttgaacccaggaggtggaagttgcagtgagcgagatctctgcactgcactacagcctaggcgacagagcgagactccatctcaaaaaaaaaaaaaaaaaaaaaaaaaaaaaaggatagccctgacacaggttgaaaacctgttacatggatcacagagaatgtgcatttttaaaaaccagcctcattagcagagattattagctatgtccaactaagttcccttttaaaaaaatgttttcttctgtattaaggctgtgacccatagatctcatcctcacagcggggcattggagttggtgcagctgagcagcaatttattaaaggtacaaattgaagatttcatatggcacttggtcttcctcatgcctcttgtagccaaatatttttaatagtgtctgaaaaaagtgtcaagttgaaaattagaggatactaagacatggaatataattaggtactgaagagatatgatggctgttgttctaggtgctgaattgcatatctcaatctgcatttttctttcacttttcgggtttgaagacttagataatcccagtatctacagaggttacttaaggatactaagtgacatgaggttttatagtcatagggggaaatagaggtaaaatgggaaactaaaacgttaatatttagggcagtatttaaaaaaagaatatagtaattgggtcagtttatatatgtatgcatgtgtatgggaaagtcagtgcattggaaaagagagaaggttttttgcattatattctaataccatcatgtgttagaatcatgctttataggtggggaaatgagcagtagagaggctaaatgagagaccaagagactctggggaagtgaggacagagctgggattgaaacacatccttctggattcaagtacacttgacctttgccttctggctgagtggatggcaagaaggatccaccatgtcaagagaaaaaattaaaagggaagatgttcatctaggggactagtgtgatatcactgactttgcactaaaaaaaatggtttagctcaactctgggggttaccagctttgtaacctaggtaagttgctgaagttggggcctcaaatctggagatcctcatagctaaagggaaaggactttttgaggataagcttatctaccacctttgaagattgagataatgtgcatgacaatatctggaacttgataaatgtcaaattcccttctccttcctttacatattgatctgtaagttgtttaaatttttgctcatgacattgttttctcctgagtcctctttgtcttaaaaaaactaacagagagccatgttattatatgcaacatgtagacataataagttttttttttttttttttaaatatcagttttgtgtgttgtaaggtaacttccaggtaagttaccttatggccaaatggtttgaagtctcatggagccatgaaaatgtatctacaatttgacttttttttgagacaaggtctcattccattgcctagactggactacagtggtgcaatcatagctcactgcagccttgaacccctgggctcaagcgatcctcccacttcagcctcctgagtagctaggattacaggaacatgccaccatgcctggctattttttttttttttgtattttttgtagagatggggtcttgctttgttgcccaggatggtctcaaaatcctggcttcaagtgatcctcctgtctcagcttctcagtgtcctgggataatagatgtgaccctggcctataattaacttttaagaaaatagcaatagtagtataaagaccaagagaaatggcaagatgttaacatcttatgccatttgttctggtggcagtgaatatttatttaacatggctattatgctgtggagtggttaatgtccagatcagttccacataatgtaaagccgacctcaagtaggaggaggataaatgggttaaaggaaaaaagactagcagaggttcctgtggtttataaaaaggaagtggttgagggagaagattaatgactgaggattagtaaaccggggttagctggtgcagttttaacgcagaccttaaaggggggcaggggcctgcctttctccagcctggtagaatgggaaatatcattagagggtaataaatatatttagtttaaacttcaattccttatgtttacatgagaaaagattagattacagatttattataactcattctcccaaatatctgggagtaaataaaacatgatataatcctgtattattcatattaacaggatgggggggcaggaagagtgtgtgtgtggacaacataggacaatgaatagtatgaaaaccactgatcactgacagatccctcttctgttttcttcctgaccttcttggtttgacagcactagacgtagccgagttcttagcatgagagaagggggttgagagggagagacaactcacgtactactgaagttgattatcttaaattaaaaaaccgttatcccgatctacccccttaaaaactgttttcctctcaacttctcacattccatgaaatatacttataagcctctaatgcctgacttgatccttaccgtagtgattagagtcagatgtttagacacgctagactaatctaatgcactttgacttggccgcagctaagactgtaaatccgtatgtcagataccgggcgattgacatttttgttatgaccgtaaattatgctggacctggagcctgatgtaaaattatgcattatgtcactgtgtcaactactcatcatggaagactttgtctaatgttggtcctgagtgtgaaatttcatactcctagaatgccaatttcaaatttagatgtcacccatgatgataaggttttataatttgtgctttaaagcaacttaaatcttacaagtgggtctcaatatataaagaataaaattaatgcttttaaggaatgttgtacacgtattgtggtcacaatatcttgaaaagaaaatgttgataaaatggaaagtaaacacaatagagtggttaggaacacggactctggaatcaaaccttagtttgagtccaggtctttcttgccgcttattagatgtttaatctctcttaacctcatcccccctcctccatatatactacaggaataacaatataatacctgtttcatagagacattgtgatggttaattgaggtgacgcatgtaaaggctttaggctggtaccttgtgagtgctcaataattactagctacagttaacaataataatagaaataaatattaagggtaccacccttaacatctcgaatttgtaaccttcctgaaaatgcagagggattaatttctgttgttgttttgatgttgatattgtagaacatattaacttttgtcctttcgctcctgaaagccatgtggagaatgtcagtagtgtgtcctgaagatgtattattgggaggtgacctgataatggatttttaaaaccatctagataaatagataaaataaaattctttaaactttccatcccctctcttgccccctcccctccttgaagagaaattttatggcaataatatgtatatgatttccatgctggaacaaataatctaaattatttgaggttttgaagcagcatgctgcaggagaaaaaggagaggcccaggagtctgaaacccagccttgcccatacagctgtcgtctgctttaggagacaggttttggaagcatcaccagctctgtgatgcttctgtgaccttggttagctattgtcctttatctatgtgtctggtactgctatttgtgtacatgtccattattatgctgggaacacagcgcggtggctcacgcctgtaatcccagcactttgggaggtcagggcaggcagatcgcgaggtcaggagttagaggccagcctgaccaacacggtgaaaccccgtgtctactaaaaataaaaaaaaatagctgggcatggtggcacgcgcctgtaatcccagctattcaggaggctgaggcaggagaatcgcttgaacccgggaggtggaggttgcagtgagccaagatcacgccattgcactccagcctgggtgagagagtgagactccgtctcgaaaaaaaaaaaaggaataacttgcccaccgattaaactgtgagttctttgagggtattttatgtatagtactcaggctggcgctgagtactgacttagtaaagatttgttgagtgattgtgtgaccagcgtcaaggtgtggctgtaggcttactttgctgggtggttttgggcaatttatttactctgaaacccaatgaacctcacacctgatttgtctcctgcaaatagctaatgtgagctcaaatgaataaatgtaaatagtttctgtaatttcaaaatgccaggcaatagaagattttaaaacctggtcacgataataacaataatattgaaacccaagctataatatttaccctggtatgcttcataatagtgagaactggaaacaactgatattttctgtggctcacgcttgtaatcccagcactttgggaggctgaggtgggtggatcacttgaggtcaggaatttgagaccagcctggccaacatggtgaaacctcatctctactaaaaatacaaaaaaaaaaattagctgggtgtggtagcgggcgcctgtaatcccagctgctcaggaggctgaggcatgagaatctcttgaatctaggaattggaggttgcagtgagtcgagatcatgccactgcactccagcctgggcaacaaactaagattccatctcaaaaacaaaaaaaaaaaaaagaaaattttatcactaggttatttgttaaatcactgatgctacacacacacaatatagtattaggcagctgataatatttactgaatgtttaaattatgtgctgttctactgtgaatgaactggtctaggcaaacctatccccaaaggccaagggagctgacaggccaaagaaagaagctgacaaacctagtttctcagaaagaaatagggacttacaaatagaaccagtgtctccggcagctgagagatggtggatccctgcacttggcctgcaaaaaatatctttacatagcaagcttttagggcaaagacatgtgcaactggtcatttctaagacttttttgtgaaatttgtgacttttggggaggttagatacccatctttatgaggggttatctgtgctataggcattgcttctttgtgaggggttatctatgctataggcattgtttctttgtgaggggttatctatgctataggcattgtttctttgtgaggggttatctatgatatgggaacacattggtcatcacagaggttttgtttcaagatcgagtcactccgggtgaaaacagcctgttttcctgcatgcaccaggccctgttctaagcattgaacaaatatctcatttaatctttacaacacccctttgaaatccagatccagagtcctcagtttacagatgaagtagaaactgtgtgactggcacaggaagaggtgcgctgttttgggcatcaatcagaagcaagctgaagagccatttattaagcataggaaaaacaaccctgataggcgatccatccaagaattagtagtcgttatctctggagactagatttctgagggagtttctttctacagggagtcagtgttgctctgttgcccaggctggagtgcagtggtgtgattttggctcactgcaatctccacctcctgggctcaagtgatcctcccacctcagcctcccaaatagctgggactacaggcacgtgccaccatgcctggctaatacttttgtatttttctgtagagatgtggtttcaccatgttgcccaggctggtcttgaactcctgggttcaatagagccgcccacctcagcctcccaaaatgctgggattacagttgtaagccactgtgcccagcctctagagggtattttaaaatttggtttgaaaaattttttttacaatgagcatgtattattttatatttaatgaaataaagcaataaatgatcattcactttggaactatccattttcttaaaaagaagtagccaagaaatgaaatgttaacataactgaaatgttaatgtaattatttgtcattttggcaatgaaagttgtttaattcgagctaaaatagtgcatttgaaacaaaagagagctgcccctacccactacttttcttgttttctgggtctcagcaattcacttgcatttgactttcatttatcatatttgtgaggataggtgaagttttagcgaataagtcatgtagtattaaatctcagtgactgtaaaaaagactacagctttccagccagaaatgcctctttccataagggaacaaattctctgactttcaaaaatttaatataacaaaagactctattctagattgtatggaagttgtaaattttaattacatctgcgtttttctccattcacctggtgtgaagagggagggactcaacctgggtgagcagctatttaagcatctggcacaggaatcttggtcagccacatgcatgtacaggactataaaaaagtccaggtttgcgttgggagtccatcactaagtgtttatgtgccagtgaagtcaccaggccttcaacacccacagccaagagctgtgccgagagaagcaggctgccgctcctgcagtctggttgacaagcctccgtgcccggcacctgcgccttgttgcctgtgggattccaactctgattgttgcctcagaaactgttgttaccacagaactttctcacactcactggcccagacgtttgcagaattccagggctagtgtgtggttaggcagccaaattccaattttagaatgctgcttgtgaccatgaaactctgttaactcaggcttttaaagggctgacacggtgagagatagagagagagagagagagaaactgtgttggggaggaaacagtatgaagatgaacaaacaagcaattgtttattgttctcaactagagaacaaacatatattttgatctccataggatatgagtgttagcagtgataaaacataggtatttgaaatgtggaatgatgctggaatcttaagtcatccacatttcacaaaggattgtgttaaaattctttcagaaaggtagagggcttatttcacttctgaatttccagtcacttcacaatctgcctcagtaaagtgtctcagaattttacatttctaagtcactacgttttgttttattttattttattttattttattttattttattttatttcattttattttatttaattttattattttgagacggagtctagctctgttgcccaggctggagtgcagtggcacaatctcagctcactgcaaccttcgcctcccgggttccacagattctcctgcctcagcctcccgagtagctgggaacacagatgcccaccaccacatcctgctaatttttgtatttttagtagagacggggtttcactgtgttggccaggctggtctcaaacaggagtttgtgatccgcccacctcggcctcccaaagtgctgggattacaagcgtgagccaccatacccggccaagtcattaagttttttttaatgcctacaataaccctttctccttgtgaagcttatggaagagcctacattttcttcctttcctttccccttccttccttccttccttccttccttccttccttccttccgtccttccttccttccttccttccttccttcctccttcctttcttcctccttccttccttccttccttccttccttcctccttccttccttccttccttccttccttccttccttcctccttcctttcttcctcccctccttcttttcttccttcctgcccttttccctcctctccttcctttcttcctctctgccttcctcctttcttcccttccctcttccctccctctcttcctccctccctcccatgccattctgacaggtattattatcagcattgaggatataacttcgaaccagatggaaaagtttccttgccctcaagaaactgacattttggtgcagataaacagataatacatactaaataagaacttcagaaatattaagtgctatgaataaaactaaacaaggtaatgtgatagaggggctgataaatgtggatgaggggggccttctactcttaattgggtgctctaggcaagcttctctgtggagctggcccttcagctgagacctgaatgttgagaaactatgggaaatactgtcagccagacctgagggcttccattttccgtgtgtcagtggtggcaggtggggcaggatggtaatacctacctcacaggatgattgggattaactgaggtaacatgccaaaatgcccagaatagtgctttggtacttaatagccttgaattataatagtagaacttaaaaaggttcccacccccatttttcatgcctgttgaagtattcatcatatcatctgtataaaaatctgccagatatagaggtcagaataaaagatctatcagagccatgccttggattcagggtgtaggaccagacaagatgatgccagaatatagccctgcctcttgagattaccagtggggttaattatgttcctttatttgccaactttatttcaggagttggctggagcttggttatttgatggatgagttggacataggacttcccaatatgaaccacgccttaggttgacttaacccgattcctcctccccaaggaggtgagatgcagggacctctgaaggcagggccaacgtgctggcctccggaggcccttgagatatgctcacatgcttggcaggtcctccactgaaattctcgagttctgctctgcagagcatggaagagatggctttggcctggaaatttgatggcaggtgttaccttgtggctgccaagagcttgatgatagagattcctcattgcaagaacgctggagaaagcacattttactgtatgtgggccaatttgaatttcttcttactagttggtaattgttgtaggctctgcttcaaaaaggtgcatacaaggcttactcaagtaacacatttgtaactaacgcttgagtttgtatagcgtgtacaccttgacctggatctttgggccttactgcaaccttgggggttgttagggccggccccaagaatcgtatccccaagtagtgtggcatactggttaaggggtattgatattctgaagctagacttccacggggttggatccaggttctaccactagcagtgagatcctggttaacatatttacctactctgtgacttggttccttatggtaaagtggagatcattgtgcccacctcataggagtgctgtgagaagtgagttactctatgtaagctccttagagtcatacctgggtgtgaaccaagacttaaatggcggggagagagagacttaagaggtcagatcgctgattcaggtgagcagatttgcagagttgagactcaaacacaagtctgattctaagtctagtaatcttcctactttttcttatgtttaacagttattggttatgattttaaaacataaactcagaaagaagcataggaagatatttaggatcctagtaatagaatcacacactatttgaagtagtggtactgttatctctcctttacatatggggaaactgaggtatattgcagttgttttgcaatgacctgatgttactttggttgatatttttagtatgccattggtcttttcatttctggatcctaattttataagcaatgtaaaaagcataagactgaaagtgttatttccaatattaaaattaaatgaactgtcctgtgaggcaaaactataaaagaatacgattaaaaagatgaattagcaattcagatatcacaatgagattagaggccaggcatgatagctcacacctgtaatcccagcactttgggagggtgagatgggtggatcacttgagcctaggagtttgagatcagcctggccaacatggtgaaacctcgtctctactaaaaatacagaaattagccaggtgtggtggcatgcacctgtaatcccagctacttgggaggctgaggcatgagaattgcttgaacctggaaggcaaaggttgcagtgagctgggatcacaccactgcactccagcctgggtgacagagcgaggctctgtctcaaaacaagcaaagaaacaaataaacaaacaacagagagtgagagagattagagacttttctcaatggtgctgtcattcgtcaaatatacctgaaacttctctttggaaattaccttaacaatgggtatcaccttattttatttatttatttttttgagataaatgagtgatctcggctcactgcaacctccacctcccaggttcaagcgattcttgtgcctcagcctcccaagtagcttggattataggcgcgcatcaccatgcccagctaatttttgaatttttagtagtgacgaggtttcacggcattgcccaggctggtcttgagcttctgatctgaagtgatctgcctgcctcggcctcccaaagtgctgggattacaggtgtgagccaccgtgccaggccaggtatggtatcaccttattttaaatatgctttaaaggttaatattaatttttttaaaagaaaaaatttacttcagcctcaatttagtaaaaatgtagacattacttgatacctttttccttcttcagatatagaaagcagcttcaaaggtagtgcaagaaaatggtatataatcaatttgggactaaaaagctgtttagcttgtgtggccagattgtggttttcctgtgtggctctagcagatacggacatttcttttttctttctttccttttttattttttctttgataaagggtcttgctctgtcacccaggctgcagggcagtgacacaatcatggctcactgccgccttgacctcctggactcaagtaatcctcctgcttcagcctcctgaggagctgggattgcaggtgtgtgccaccacacccagctaatgttttcaattttctgtagagatggggtttcgctatgttgcttaggctggtcttgatctcctgggttcaagtgatcctccgccttggcctcccaaagtgctggaattacaagtgtgagccaccgtacccagcctggggatttaaaatggagttctgttacccagcagcagccacaatgaaatcaatgaatgcccttctgaggggactactgtgaaggctaacattcatggggtgcttgataaacatcagcgtcagacaccctccgtatgatatggagaagtaaagaaagccgcaaacttatgttctggcttgaagctataacttttctttccaagtaatcttttcagggaaagccttttggctttgactacagctatccacaaatggaaagatttgaatttcatgaagtctgggaaagagttttgggtggtatgcacaccaacatgatcaagaggctgttaaaatgaattttgcaaatgagcaaaaagtaatttgcattaaatacaaatatgttgtcttggggttaaaaaaaaaaaaggaatcctgcagagctctgagactgctagcagatggatttgagagtggaaatgggaggggaggtgagaagctatggtggtggtctattgggagaggcaaagaaatgggtcagttgtgggcttgttttgatacaagcaaacaggtctcaagctcctgccttctccaagcctatagcctgggggagagtgagggtgggaccaaaagtcctctaagcagatacattctatatgttcaaaatacatcaaaatattctggtgtctgtgattatcccaatctgggagaattcttgggtgagggctgagaattgagaagttaaattttcggtgaaagtgctataaaggtgtggagtttgggggaaagtaagtgtttaatatgggaaagattggagtggcttggtggagagaagggaaaggtgggttggggataactgtgaagtagcatagggcatctcagtggtgtttcaggctgccagggccagtcaatgagttactctttgcccatgagtgatgttctgagcatcagaataacaaggataggatactggcataccatcattagtgtgattccctccttcctgccttttctttctctcattttgatatgattgactcagactttttaattaaactttttattttctttttaccatgcgtactagccttatacatgtgacgtagggctccctctttccctctctccctccctccttctctccctctctctttctctccctgtgaacatggaactctgctaatgattcaagcagtgatcatgattctgtcttctgatcttgttttatatatacagcaaaagtaaattgagaccgtttggaaataaacacattagtacatagcccagcaccaagcatatagtgagtgttagaagtcagtggaatgaaaccacctgaattacagttaaaagctgttttcacagattcttattggctgcttaaagtaatcttaccatggattcttacaaacccgtggacccttatctgaaactcttggggccaaacgcctttcatatatcagaattttccagatttaaaaaagtttatacagtgcagatagcatgtattatgtaacttcttcagtagcagcacccatatccaaacatatcatttttttttgttttgtaatgaaacttatgaatgttcacattgaataaataaagacaatgcagctgcaagtcagttcaggtcaggttttgtcactaattgagttttcaccaagcttgcatacttttgggtttcagaacttggggttttggaattgtagaccatagtggctttttggaactatttcctgcttatgttgctgttagctgttgcccagtctgccttaaaaatattggattcccctgggccagacagcagctattggtatcattcatcttctgtttcctgcaggaaacctgtacttcttttaggctctgcagcaaagagaaaatcagaaggaaaatcgtctttggtcttccttctgggtgtctgttttagatcctgattagccttgtctctcaattgtaaaaatattcctctcggccaccagattcctcagtcacttccctggtccatctcctcctttatcagtgcttgaagagtgtgacatcgttcattgcttttaacaacctggggtttggcctgatacaaattggttcttaaactaagaagggcatatctgttttccttctgaacgtttaaaaagattttaaacatggaacagatgtaaaaagtaatttgcttgttttaatacagagagagaatgacttctaatggcttcatgtctgggaagggtcttgatcccatgaactgatcctgtctcatctatttcttccttaatcctcttctcttggtcttggtttccacccttgcttttcagtattctcaggcagtttttcttttttaaagacggagtctcactctgttgcccaggctggaatgcagtggcatgatctctgcccactgcaacccccgcctcccgggttcaagcgattctcccacctcagcctcccaggtagctgagactacaggtgtgcaccaccacacctggctaatttttgtattttcagtagagacagggtttcgccatgttggccaggctggtctcgaactcctgacctcgggttatctgctggcctcagcctccctaagttctgggattacaggtgtgagccaccacacccacctggcctgggtggtctctttcttaccaccccatctcttttcttttgcctgctgcctctgctacctgcttctttttaatcaattgtgttcacttttagttgtttacaatcagttgccaatctctgaaaacagtttcctgacaaacacatttcttccctcttcctgttggaggcttttctgtttgggattctgcccacatatgcagacacttaaacttctagtttcatggctgtcttagaggacttgggttgctgggcagctgagagttggatgtctgaggtgctgctgttttaaggaacatttatatgcatgtgagtggttttgatttgaaactaaggatgctaactatgaaatctgagagagtgaaaagattcttttttttttttttttttttttgagacggagtctcgctctgtcgcccaggctggagtgcagtggcgggatctcggctcactgcaagttccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccactgcgcccggcccgtgaaaagattcttgtaagattccaggtgattcttagttcttttcatggtctgtatatgagaagtgtttttctacatctttctttatgatagtaatagatgtttgtaacagtatagacatttcacaggagactttagttaaatttaggaatcatgactttatcctggcaattttactttagaaatattatatgcttagagtaattcagataactcagtcctttgaaggttctctacatattactgcctttcatatttgaagatagatttggaaatgattgtcctctgggtgtaaagagtccaatatatactgctgttgtttccacacagcattgtcatttcctaccagggactctcccttttaaacttaagagttggcacggaaacattattgctcaaaagagccacccattcccgagtgtgtttgacaggtctttgtaaacaaacttcttcagccttgctgaaattagtggaaaaatctaggctctcatgtttacagttgacgtgggttttcctttcacctaaaataaccattacaagtaagatactaagtaaaaaacatactcatttctacttggtatatgaaaataatatatgtttgatgtattcagtgaaattccagttaactcataactctttgaggccatggatggagaggtggcattattagtctctacctccagtgcctcacacaattcctgggcacagaaagagacatacaattcatgttgggtcaatcaaagaatgattgatcattggcacctcctgattctatttggtggtcagagaaagtggcaggacttaagttattttacatataaacatttcttgcaaaatttggagaggatgttttgatggcttgagatcttttaatttctttgagttactttcattgtccttcccaccccttccctctctccactctgaactgcatagggcctgcctgcagtgaactactcacttcttctgactccaaggaaggccatatcatgtgttttaagtaccccataaaatttatcttcaaagtaaagcttcctttgccaagctcacaaatgatggatttttgttttccttcggcctgagggtcaaaagaatgggcacttttgtatgtacagtcttcggggccatttcctccctcctatcctactgccctctccctgtcttaggcaagaaatcacttggttccgagcagtgacctccgctgggccagacagttctgaaagcctttgtgtgttcatttccttaaagaagtggaaggtaacatgtttgaaagccggacagctgtggcctgttccaaaacatcaatgttgattgtttgtttttctggattttaacaaaggagcttttgccaggagacctttgcactcttgcttattcaaaccccaaattacaaaaatacataacaaaaataaaacagaagccagacttaaggttatcttaccaaaacaggacgtcttccttctttagattgtacaaacacatgagttccctagttaaattcaatcaatcattcctgacggattcagctaaagttttgctttaactcataccacattgtctagtccttagagcttagttctatttcctcaccttgtttacctacaaaatggtgcatctatttggaaaaaaaaaaaaaaagaagaagaatttactggttcctttttacctctgtgtattcagcaataaaaaaaaaattctctgaaatgtgtgctggagaataataagcagttttccttgggtggtcttaacagcttaacagattgctctgaaattgaaatcctcaaagatgatctgttcaaaggaggggtgtcgactttctcatcttttggagagagagagggatgcagcattagctagagacagtatgaggtcgtggtaaagaacatgaactctgaggccagttggtttggtttcaaatcatctgcctcttactagctgtggaccttggttatatcacttaacctcactgtccctcatctgtataatggtaataatagtagtacctcctccgtgctatcatgattaaataagttaatatctctaaagcactacataataagtgctgtgcaagtgtttttaaaacacatgaaaaggaaatagagatgagataatgtcagaagagattagtgttaagcccttgaagggagggggcaatttcaaatgagaagagctgatagggagtggcagagaaagcaagtaaattggggattaaatgatagactatgcatttggccatttggagttcttaagtaacttctaactattcagaatgtggctttaagcaagccaatttatctccctatcggtaaaaggtgacacttggctggctcgatattctgttatgtgtcccagccccagaaatgcacagactggtttccatttttagtggagtgctgtgagcagaagccagactgagatttcaggttggattgaggaaagatgaaagagctgacacttggtatctaagtcatttcctggcagtgagtgagaagagagagcatcgctaatggcaaagccagggctgagaggcatggggttgagttgctgtgtgaagacagtcgctcactgctgcctgaagtcttccatggtttcttctgtgatttcttcctttcccatctcaagcatttgattccccttcttactttttttctgactgttactctttcgaagttgcctgtgaaagggcctccttgtttgaaatctcttcttgggaaggaagaaagtggcatgcagcaacgtaaatagcaggtgcaaatcctccagatgagttccagccgagggagagtggtgcttgagtggctgtgctgaattcctcctcccaacttgatagcagatttttgatattacagtccatctgtgcaccattttttaatgcgtatgtttttgttttttggtttgctttattctcattttttcccttgggctctttaagtagtcttattctacaaagcagcattttttttctttttcttatttgtgcttctagtgctctgacccatgggtttttttaaatataaattcacttgcgtttagccatagccaccgagtgaagggtactcatttctgaggaacatacttattattctggcataagctatgtgaacagactgttctctacagatttgagtatctttgagaggtgctggcgacaacaatggcatttggcagcatgatgctctgttcaaacaaatattcaacttggtttatattagcgtttgtatcaggctgtggtaagcacagtattctcagatttgaacctataaagaattatggaaaaaggatggtgaggtccgcagaagtggtcatggcacttatatttttccagtttgcctttcttgatttttcttcattaaattttcattcagtgtttttatcagacaggatgtgttagatgatgctgcagtaacaaatgatacccaagtctcagttgcttaaagaaacaccattttctttattggctatgctacatatccatggagggctggccttcatgtaggccttcatgtagatgcacgttgatagatatccccctgtcaccagttacaagggaaggaaaggaaacatggtgaatcatgcacactgtcttgtgggatttggcttagaagtaatattacttctgctcatattcattggccagtcaatgaaaggcaagtcaaatggccatgcctaacttcacatggatgggcagggaaacacaatcctataatgttcttggaggaaggagaattggaaatatttggtgaacagcactaaattcctaatacagtatagacgttacgtaagtcaaataccataatagagtctaggggcacaaagatgaatggagtgtattctaattctagagaaattatattttttgggggaaatagctttatataggaatttcaaaatgatggtgatgaagctaagatgtttttaaaaccatttctgtattttattatatttatctatttattttttgagacagagtcttgctctgttgcccaagctggagtgcagtggtgcgatcttggctcaccacaatctctgcctccagaggttcaagcgattctcttgcctcagccttccgagtagctgggactacaggcacgtgccactacgcccggctaattttcgtatttttagttgagatggagtttcaccacgttggctaggatggtctcgatctcctgacctcaagatctgtctgcctcggcctcccaaagtgctgggattacaggcttgagccatcgggcaccctgcccccatctctgtattttaaaagattaggaatgtttcctttgttgtttcatttctccagtttttgtaagtatgttccaaaagttacaaatagctactaaataatcttcagaacttaaatatgatgaagaaaaattggctttacttaattttacataatgtttgggtcctttcttgaatctttatatgtgaaagacatcatttttgtggttttgccatgctttagcagtctaaaaattgaatgtgcctaaggagaataacttttttattacatgctggcttaaatctcagacagaattccattgaaagccagttggttttctgttttgttttttttttctatgtgtctttcagtgctgaaattggaaataaaccagcattatggcttcatgacggaaagtgtagcaattctgcacaatgcacaagcaagtttgtcatttaaaatagcagacatctgtcagaagttggtgctgaccttctaaactgcaactgaatgttcagactgttatttctccatcctcctcagatgcatttccagtgttgggctcacagccccatgcttcttgtctgcttcctagtgggttatgggttgtgtcctagagtctagacatgaaatgaaaaatgattatgtaatctgtttcccttcttctctgcaaaattcagaggaagggtcaaagctttgagacataccacctccccctgcttggtggaaagagcagattttgaggatctatagacatagagttggaatcttggccagccccttcttacctgtagaactttgggcagattgctttatctctttaattctcagcttccttcccagtcatatgaagagcataagaactgtttcagtggcttgttgtgagggttaagtatatggtttatataaaatgccaacagtgtctgacatgtaacaagcacccaataaatattccctattggcacagtgcttactggtttttaaagaacttcattacattttatctcatgggactacatcaaggaggtaaaaggcatctagctgaattagttttccattaactttccaagaaaataaatacagactgcattctcttggagtcacagttgacttcgcaaagatcttattttattatgatatgtgtatgttttcttctctactcacattttccctcacccatcatctgttacattacatatagactgaatcctctacactttttaagttataaatcttttcttgtgctattatgagttttgggtgattacttcagccagcaatggatgattaagggctgaggggattggtgttcatactataggagaagaaaacaaaaactttgataattttaataataatgactaacaccaattgaataatgattctgtgcctagttcctaattgaagttttcttttttctatgaaatcataattaatcttctctccactctgtaaggcagctatgactattacttgcacattgcaggtgaagaaatttaggctaggatgttaaataatttgtccaaggcagtatacttagtaagattagcactggaatttaaatccgtgattgtttgatttcaaaattgctgtttttccccactcagctctatagtacagataaatttgggtttaaaatagggaggttatattgctggctgatgcgtgttgtgtgaacactgtctgagtggattaattgtggcagctaaaaataacagggtgtattgttgactttttgtacagtctaaacttcttttctggatgactttaaaatatgagtgtgttgctgctcttgattcctaacagagaactttagagacctggaagcctgtcctttgtgtaactctttacgtataacgtcagattctgtggacaggtggcccctgatctgcatccctaacaggagggttagtactgagaagtaagggtaaagatagaagctagaaaaacaaataggctgtaccttcctgtctgaattattctctcatttttctcatccctgacaactttctcaataaattgtcctagcaagtaaatccatgggtctctatccttgttgggaatagcatcatttgggcaaagctttgccatcaatttttcatttaaaaacatttcctaaggtaaacattaaggcctgaatgacagctatagtttgagatttttactttgaattatgaggcttacttggctggacaccatttttcaatggcaacgatccttcctgttttaaaacctgattgttaaaatacaggacatatgggagatcttaaaaagatcaagttccaagtataattctttttcaagtaggcagtggagtctggtgcataatgttccaatctagtttcacggtccttttgatcaacccaaaataaaactgaacaagacagcatctctcaaagggttaataccctggaatttcacacttaacaatcggcattatgttctttgcattcttgaggaattttctcactgatgtcaaaagactttggtttgttatgcaagacagtggtccagtgactttgcatatcacattctcttaacatgagggaaatccttgcatgctaattggagaaggaaaaaagtagtgcaagtggttctttggctacagatgaattaaatgagggagggcatttagtgaaaaaacaaagcacaacaaaacccttgcaaatgagcgggcattcttttgaaatggctgcttactctagtcgttttgcgtctgtcttactgctgtgctgtgtcactgtgattccagttttgggggggaaacacttgaatgtatatatggtttgttttttatttttctgattgctttaattacctattgctgtataagaaatgactccaaacttagtggcttaaaataacaacaatttattgtttcttaagattccatgagttgactagttcaattctgttccatggggtgttggctggtccctgtgttcagttggtgccggggctgggctggaaggtccaagacatcttttctcacatgtctggtacctcagtgcttctccacgtggcctttctacctggcaggtttgggcgccctcatagcatggtggtttcagggtagttggacttcctcaggtagctggccttcaaggaaaagaaagcagaagctgttagtcttcttttttttttttttttaaacttttaaattataaagctgtcagtcttcttaaggccaagcttgaaagtggcagcatgttacttccaccatatcctgttggtcaaaggaagccctagagtcagtccagatttgagggaagtcggggaaatagaccccatttctggaagggtggagtggcatgtccctataggaggaaacgaattgatggcccaaattgtacaagtagagggaggactgagggcagaggggctcgtcttagctggtgggaacaccaagggcggaggagagttttgtcccactttctttttagggttctggacagacactgctatgtgagtaacttcatgccagcttaaaaggggtacacttccaagtgacataagaggacaaaatggtgaggtcaggtggaaggggccccagggcactcaccaaggctctctcagctcctgtgtgatggcagaaggagccagatgttctggaattcttccaagggaggtctcagaaggcagctgagttaagaggcagtgggcttaggctaggaactgggtggagaatggacccagagctggctgtggcaccactggaggccagccagtggcactctaaggccctggccaccagctgtagacatcagctacagatgtccatggaatatctagggttgtagagctagccggtttcactcccatggtcaccaggccaggcagcaacccagactagctgctttgcagcagagggcagctaggatgtagaggacaacatgtgatttgcattctccatctctcacatcaccataatggagacactcttccctctccccatacacctggttacagttggtttttggggtatttttttcctgagacagtcttgctttgtcacccaggctggagtgcaggggtgtgatcttggctcactgccacctccacctcccaagttcaggagattctcctgcctcagcctcctgagtagctgggattacaggtgcccacccccatgcccggctaacttttgtatttttagtagagccagggttttgctatgttggccaggctggtcttggactcctgacctcagatgatccgccagtcttggcctcccaaagtgctgggattacaggcgtgagccaccatacccagccctggatactgtcttgatgaacagaaatctgagtgactgagcatggtgtctaaaaagactgaacctaaaggaactgtttaatttattgcataggagtaaatatttgccagacttttctacagttgggtctccctttttccaatagtctgaataaagtcttcctatggatgttaatatcttaatccttagagcctctggctatattatcttatatggaaaatgagactttgcagatatggttaaatcaaggatcctgagatggggagattatcctaggttatctcagtggaccctatgttatcacaaaagtcctcataagagggggactggacatcagaagcagaaaaagaggagattatccaatgttatcccagtggaccctatgttaccacagaagtccttataagagggagactggatatcagaaacagaaaacggagagatgatgatggaaccaggtattggagtgatgcatttcgacgatgaagaagggaccatgagcaaaggaaaacaggtggcctctagaagctggaaagggcatggaaagcctcctgttccccgtgccgaagcctccagaaggaaggcagccctgccaacatctggacattaaatttcctacccctagaactgtaagagtcaatttgtatggttttaagccactaaacttaatgtggtaacttgttagagcagccacaggaaactaatacacccttcttgtcctaaaccagtcacttagaaacattgaagctacaatttctttgctcatttgagtgcagaataaagctaatagagttctattttattttttctcccattcattttcctagtaagatattatttctgactatttgatgagcaagaacattgaggggtaaggagtgaagttcagtaactttgcccaggttgaatggttaatgattgagcaggattaatctaagctgcagagacactgtctgggaacatcatgcaagatcagggtctcatataaaaatgtattaagtagaagtttatatacagagtaagctttcggtatctcaaaaatcttatttctgaagtcctatattgtagcaacttattgacatgatgattcctataatagaaataataaaacagttgccactacgtgactcaaattgtcccctccttattttgaagacttcactcagcttctcaagaaataaccagtgtaccatatttgttccactttcaatgatacaggcacttttcaattcatttattacttttgtaaagtttagttctaataaagctcatagagccataagaaaatctctttaaaccttgtttttctattaaaaaaatacattctgggttgtaaattaggaggccaggaattcttgttccctctttggaggtgattgtggtggtggtttgagctgtctccttgcctagatctaggtacctggactccacaactattcactgttcgcacttctccgcctgtgtagagatggcatgacatttgtctgaacatgagtatacctccagtttacctctccttgagcttttctgacttagaaaagtgagcagttgcccccaccgaagggtctggggttgcagacttacttagggtctgctcatgggtctggggcattaaaaaataatgtccatatgttggggacagcttgtattaagaataatctttgtgagccagttaatgctgtgagagattttttcctgacattgtcattgtgctatttgcagcacaagttccaacaaaacaacttttccattttatcatcgggattgtagaagcagcatgtaaagtgattaaaataatggcaccagggcaatctgtgtgacagatgctgtcaggactggagacagaatgcagaaatttccaaatttctgtgtgtactctttggtccttcccaaggagccttcgtgtgtgtttcagtccttgtggaggatgggaaactaggattttgtcagcgtctgggtatatattggaagtatggagctggttgaaaaaaaaaatttgcgaaggagatataaagcagaaaattagggtaaaaacacatggtttttgtctggtcttttgcatttcctgtgtgaaaggtgaatccttgaatctgaaaatgaaagccatctccaatgtctcctaggtaatatgtcaaatactgtcacggacctcagatccctttcattgcactctttgttatttctgaatgtgagcttgacacacaaatcttcttttaagaaggctttccagaaggcctactgtagctgtgtgcatgctttaaaataaaagtaaatccctttctcacttaaacaaaacaaaacaaaacaccaacctatttgtgtccatgaaaaatatctttgcatgtctagacagtagtgctgatcggctgccttttgtaaggaagggatacagaaaaactattattctccccagaaaccttgtaaggtcctacgtgacccaagtgacctctcactcaactagtgaaacaggagccagaagtgtgcaaggagcctgagctggagcttgatgctgatgttataaatcagccttggcattactgggctttcctgtttttagccagcagtccttggggactgttgctgattgagagtgagaaagatttctgaaccattgtaagtggtgacactgacatatcattaggcttccacccagatggcatttgtaacagatagaaaggaaactgtagtggaattaacttaaagaggaaagaattaaagcacaattttacaggcatacgtagcatgggaaggatccaaagggaacttttatttgctgtctgcttttgctagatactgtgcttggtgtgttgtaggtggacttcaaaataatgagaaaaggtttttgtttttcatttacagagtggccaggagggccctatgcctgctagttgaagttatctgtgtttacctctctgtttcatgtaaattcaattttttccctcttcttctcctgggcatcttcttttttgttttttttcttttggtttgtttatgactgtaagtcattaaagcagttcccaaaaactgttcttaggtctttagctgttgttggatgcagttgagaattttttgctttcacaatggcccaaagtaaattgtcacatgtggtttaagtctggaccctgcagtgaccactggattatcatatccatatccattccatgatgcactgaatttgttactaaaatatcttctacctggaatatgagaaagtgctgggggcattcattgttttattgcaggatagctgttttccccaatcagctacctttttttttctacatagctgtggaacaaaccacatccaaagcatattcaagtgtgtgattgaccctcatattgaacagatattaaaattgcccatttcatggcatgaggaagctgctcattgaacagagatgtaccctccatcatccatatctgcaaagatgagagaatggaggttcagagaagtaaaggaacttgttcaggccacatcgtcaggtgagtagtggagcaaagactcatacctggtcctgtctgattacagtgcttgtgccttttaatttttcttttcttttctttttttttttttgagacagagtcttgctctgttgcccaggctggacataatctcggctcactgcagcctccatttcccaggttcaagcaattctcctgcctcagcctcccgccacgacacctggctaatttttgtatttttagtagagacagggtttcactgtgttggccaggctgatcttgaactcctggcctcaagcgatctacccgcctcggcctcccaaagtgctgggattaccagcgtgagccactgcgcctggctggcttgtgcctttttattacagagcttttcaaacttctgcagtgaaggactattttttttttttgttttgcttttgttttttaaatttccaatccgctgtaatacagggctgactgcacaggatcagcatgctgcttgcatcacatgcacctcgcccaggccagttggccaacacctaaacagatttacatcttgctcagcaagatgagtcctgccatcacatggcttggatgtggtggcgatggccagactgctgtaaatgtggattatcaatcctgtaatgtacaatgccatggaccagcagtgatcaattcacagatcatgcttgaaataatgctgctttggtttaagggtgaggggagcatctgtcagggaaaagccagactcctttgactaaagagaagcattgggagtgcagttgggaggctaggaatagaatatgtggaagatgtacccttcagcgtgcagatggtgtggttttcttattctctccaggacaaacttgaattccagcaagtcatgttctgattcagtacatgcagatttttgttctgaagtcagatggggacataattgcagtgtccactataggaaaaacaccaagtgatttctaatacctacaacaagcacaatttgcctggtagaaaggggctcaaaaaggggagggcaggccagcgccgtggctcatgcctgtaatcccactttggaaggccaaggtgcatggatcgcttgagcccaggagtttgagaccagcctgggcaacatggtgaaacccccatctctataaaaaatacaggaattagctgggtgtggtggtgtgtgcctgttgtcccagctcaggaagctgaagttggaggattgtgtgagccctggaggtcaaggctgcagtgagttgtgattgtgccattgcactgcagcctggatgacagagcaagaccctgtctcattaaaaaaaaaagaattaaaaaatttcttaaaaaagtgggctgggtgcagtgtgtcacgcttggaatcccagcactttgggaggctgaggtgggcagatcacgaggtcaggagttagagaacagcctggccaacatggtgaaacccagtctctactaaagatacaaaaaatgaggcgggcatggtaatgtgcccctatcatccctgctgctctggaggctgaggcaggagaatcacttgaacccgggaggcagaggttgcagtgagccgagatcatgccattgtagtccagcctgggcgacagggcaaaactccatctcaaaaaaaagaaaaaacaaaaaggaggagggcaacatccttgcatgagtttctccagaaaactttattaattcacttggtgatttgttctgcttccttactgaacatctcctgtacactaggcattttgcttgatgcttcatgattaaggtagtattcctatactgtgtaatttacagctgctggaggaaaggaagaagtaacaagaagacattttaaaaattattaaataaacttgagcattaattttattagtttcccctctataattaacaagtttaacaaaaatactgtttaatgcttagttatatcttttctaggtgattaaatagggtctttgtagtaattttatttttaagggctttaatcaggaaactagtatctaactaaaacaatgtttctatgagaaaatcacattctacagaaatatttttgacttcaatgctttcctcaagaataaaacctgtcagaagtgtgaatactgcctgtacttagcagagcaatttgttatgtgaaccagtattggtaaatgtccccaaatggtaccattgggtttctttggcctgagatattataataagctggaattttatgttctataaaatacagaaaaaataccatggtctattatttatttatttctttgtttgagacagagtctcactctggctcccaggctggagtgcagtggcgcaatcttggcttactgcaacctccacctcccaggtttaagtgattctcctgcctcagcctcccaagtaaccaggactacaggtgcacaccaccgcgcccggctaatttttgtatttttagtagaggtggggttttgccatgttggccaacctggtctcgaactcctgacctcaggtgatccacctgcctctgcctctccaaagtgctgggattataggtataagccaccgcacctggcccatagtctactattgataatatagcagacctatttctatggtgactaaatataacagaaattaatgatgttctcaaaagcttttaaaatgatactgaatatgaatatgtggcagaataagaagtttggtcttaagtctttgattctgattgttcacagattcttttccttcatgtttgattttacttctgtttcatggtatggagatctctttcccttggtattgcatgtgtaggtatgaatgacatgaacccctcttcccaacactttgctgtgacaagtcaaaaatgccatgtattgctagggatttttaattcagcttctgtcttgagtagaaatgaatttactagaagaagatgtagaaatcttagttttatagtaatcaatgaaaaatgaaatttgcttatatttcaatgaaaaatgaaaaccaaacagcttctttataatttaaatctattagcaatgttttaagcaaagatctaattaatgtatttttaaaattattgctatttgtcttagttcccttggccaatcctctttcttattgtcccatttctgagtttctgtaaagaaaggcttaaaaacttagggcattctctctcttgagtcggtcatttttttttcactttggtaaagacaccattgtgccttggttttaatatgaggaaaaatgaaggtgggagtggaatttgcattaaatatttggaatttttcttcctccccaccctcaacgtctaaaatatgcatgggatttggaaaacaaattagaaacaggatctttcacagatattttaaaaatgcatttctaaatggtggggagttgtgatttctgaatagtgccatttcatttaggagcttaggttacaaagttgtgtctaatactctttttctttttcttggtttttattttaacttcttaaagattgaaagtctttttaagaagttaatatgaaatatctactttgctaatataaagtagtttgctagtataaactaataatggtataagcaatattaattttataggtttttgctgtcgtcgtttgtttttgatgtgggatatctgctaaggaaatagagagtaattagactcagaaatgattttgcttctttgtctctctctgtccctaaactcttgggttagtgggaacatggagaccacaaaagctgtgattctttctcttagacattaattttaaaatagcctgggtgtggtagctcatgcctgtaatcccagcaatttgggaggccgaggtgggcagatcaagaccagtctgggcaacatggcgaaactgcatctctacagaaaatacaaaaattagccaggtgtggtggtatgcacctgtagtttcagctacttgggaggctgatgcgagaggatcacttgagcctgggaggttgaggctgcagtgagccatgattatgttactgccttccagcctgggcaacagagccagaccctgtctcaaaaatacataaataaaaataaaaataaaaataaataaaaaaggacagatagactggaacaaaccatcaaagatgcattttacgaaaaacacaagtttggccacttagcatcagtgtctattcttgcccacttttgtatacatgctttgcatattcccaagcacacacatggctcaaatatgtattcatggagcaaatggatgaaggaattaattgggtgtataaccaactagttaaccaactagctgatttcatgatagttgagaactcatctgtgtgggttaccattgtgggttgaaatcacctgcatttttcaaacaggtactctctctccattttggttgactgtgttgacaaagaaaaagactctgtaacactcagaaatctaaatatagcttcacacagatgcacacttgttataatgatgcagtatggaaattaactatggattgaattttaattatttaaactgcacacatctcctaccccttcctccctctattgtatcacatgtaattacattattatacatcagtcatttaaccagggtaaacaataattgctggaaaactaagatttttaatatgaagaaaggaattgctaagtaaatgaaagggaaacatacaaatgtactgtgtgattcttttgtgtagctgtttgtttagcaattcaggaagtgacttaaactttgcctgccaatattagatgctagatttttatcaaaggaaaggtcctatcatttttcatgtgtgtttagttagagatttgtttaaatggaaacataagctagcaagcaacagtttcacttttggggaatgatttccctcataaaagcttcatgtcttatgctccaaggtaaagagaaaaaaaaatcatattggatgttttttttctttttttttttttttttttttttttttttgagacggagtctcgctctgtcgcccaggccggactgcggactgcagtggcgcaatctggatgttttttttctttctgctctgggaagtgcatcaaatgtaaccaacacagtgaattcagaccacctgtgagattccaaattgcttttcctgaatcgttgttgaattaaataacaacatttgattatggtacttaaagcaaatcaaggaatattcagatgaatcagtggataaacacatttaatagtagtatggactttgctcttattgcagatggattattatccaatgaaaccattcttctttcatgctgtaaagctttccagatttcaggaagccagggcagctgtatttttttaaaccttcacatgtgatccaaaagtaccatttcctaggagaaacgaagatctgttaatttacagtatttgtaagcaatggctaaactcttttctgtaaacatcagaaatacacctggtgaaggaaagctcttctgccagataaaatggaatgttctcagttaaccaagggagcagctcggatgagagaggcccatggaacaagtgctgctgagcatctgattccagcctgtgaaggatgtgagggagtttgccttccctcagggctagagaactattcatataagcaactcagcaatttctgtctatattgctgactttgtcttgatgtcttgaagaatatgctcacttaaaactcgtagactcaaggaaaggcaagctggctagatttaaataaaactgaatcatagaagaggctacatctgtcagagaaaactctgtaatcatggacagtgcagatattcctatctggataggtattgtccgtgggactgaagatagctgaaatgtgtgcaagagatggctcagagattgaagagtgcttccaatttctgtgagtctgaatagttctaaagatgtagagactcatttggtttgagtttatgttctggcaggtattctttgtataaaaattctgtttttactactcctaaacgactttttggtgacttttcagtcatattacatatgactgaaatatatgtatgtgtatgtgtgtgagtgtgtgtgtatatatatacacacacacacacacacacacacacacacacacacacacatatatagagtgcagggcatagcataagtttattaatgtttcattgagaaggtaagactgaaatacaattacagaatattgaggaaaatctatattaatatatgagtttgaccttaagggtaggtcagtggaccttgaactatttggttggcgtcaggccgtgcctgtggtgtctcttcattggccaacacaatggcgtctttgtctgggaatctctacctctcattagggtggtcaacatatcacagtggtctttcccttcccaaataactgtgagaacaaaagtgccaatacaagcataagcccttgccaagtacaacaacatgaggttccatcagccctaaagaggggcaacctaagttggtcatcacagcaatgggattttcagtcttgctcaacattggggatttgaatagctcttaggataatctcttctctagtggttaaggatatagtccccataaaagaaatctgcttatgggcaatattttgccgaaatctgaccatccactgtctgatgtgatggccaggctaccagactgaggttaaagagctgagttatttactgacaaagtcaccaacttcttctagctcagcatcttgctcaataaccactgtgtgcttttgtaggcacatgaagagaatattcaacaacattttcccattctttttttttttttttttttgagacacccaggctggagtgcagtggcgcaatcttggctcactgcaacctccacctcccaggttcaagcaattctcctgcctcagcctcccgagtagctggaactacaggtgcacaccgccacgcctggctaatttttatatttttagtagaaacagagtttcaccatgttggccaggatggtcttgatctcctgacctcgtgatccacctgcctcagcctcccaaagtgctgggattacaggcgtgagccacagtgcacggcccccattctttattaaacgtgtaggaagcctatttatatctcaaacctctgattgacagcagttgattgattgtccatgaaaggtggacttttaccattctatgttcccaagctttacttaggcagaaagccattgccatcttctgagacgaacccctgtaatgtaaccataaagcaagaaggatcataggcacctgtggaattgtcctcaaattttttggcaatgaaaattgcaactgaagcactgctaatattttcaagaaaaacagtaaaatggattgttacaattagttcctccaattaggtattcaagaaaagcatagaagtatgtgaaggtttccttatctgtttatccagtgacctgtatctttccacgatactttcaaatggaatttatttagcctaaaaatagaaattaattttgcactgatggcctgagattagagtttctttgcattctggagatgagggtagctactgacctttctatcttgctttattatctgttggtcttggcagtacctttctcttccaggatgcattcccagaatggttcagtgaaacaaatgctctttggaggactttggctctttgtggctgagataaatatatatcaacttaaagtgggttttattttcctctgtgaatgagttcctagagaattgaaattgtggaaagaactaaaagctcaaatataacagaacgaagtttccctaaaggattacggtctgaagcctcagtacattgggtaattttgttaaaataggttcttcttgtcaaagggtttgagggttgctgtcagtctattttcaaaactgaagatgaggaggatgattgtcaactgcaggttcaattggaacatcgtggggagaaaaatctctattctgctagtcgttggtttttgaagcacagatggggcctgtgagatttgggtggcatgatgaggggaggggagtaaggggcaatgcagcagggtataggggatttagactcaccttcctagtcctgttgcagttttgaaacctctgagtctattagtgtccgacaaaagtgtttgttaaaatagatcaaagactagatttctaaccattagggaagggaaagacattctcagagattcacaaatatacgtagttaatggaaccataacttttagaagtcagtgttcacaggacagatgggaatagctggaatgaagtgagctttgaatgctgattgctttattttatactagctaatgagtgaatgtgccacacatcctctaacctttctggaatggtgaacaaatggatagatgtgctgagtaagtgttggaagacaactacatgaacccttaggcaactaggaggaatttaaagaaataaaccatgtgtttacaattaaactaggaaaagcctgtatataaatccaattggtaacacattatataaagataaatgataaaagtccttaatatttttcatgatctttcaaagtttctttaaaagtggcaagtggcctcagaaatttgaattatcatgaaaggaaaaggaagaatgacttaaggatgtgtatgtgtgtgattctgagttaaagattctggtatagatcagtgtcgtggagacattagagacaaatttgaaggttaaatttattcaatgggccaggtgtggtggctcatgcctgtctgtaactcctgcactttgggaggctgaggcaggcagatcacttgagcccaggagtttgagaccaacccgggcaacatggtgaaaccctgtctctactaaaaatataaaaaattagctgggcatggtggcatgtgcctgtagtcctagttactcaggaggctgacgtgggaaaatcgcctgagcccaggagcttgaggctgcagtgagctgagatggccactaactgtaccactccagcctgagtgatagagcgagaccctgtctcaacaacaaacaaacagcgctcccaaaacccaacaacaaataaatttattcattgcatttcaagaggagcgagtgttttgagaaaagacaaggacttttggtaagttgggttaaatactgatatctgcttctttaacaggatcactgttcttgtctatatctggaaagaagacaaaccttgggcagcaaaatgctgtttttattattaatgcagtgatgtcaatccaaactagatgactgtgattcatggaatcttcaaggaaaaccaaatattcttttttaataaagtaatggagctgggaattgcacatctgctcttaaaaatctgtttttcgtaatacagaacatatgttaatcgtcacatcttttattaaactgaaggaaaattcttgttgagtagattaattctggatcctgaaaatgcgggaccatggagacgagaatatcgagacaaatgtctgtctgtcttaccaacttacctctagaacagtgattttcacactgctggatgtgaccttcacgagggtaatgaaatcaagctagtgggttgggagtagcatttttttttcgtttttgagacagggtctccctctgtctcccagtctggagtgcagtggcgcgatttccgctgactgcaacctctgcctcctgggttcaagtgattctcctgcatcagcctgcctagtagctgggattacaggcatgcaccaccacgcctggctaatttttgtgtttttagtagaaacatggttttgccatgttggccaggctggtctcaaactcctgacctcaggtgatctgcctgccttggcctcccaaagtgctgggattataggagtgagccaccatgcccagcctgggagtaacactttaaaaaaatgaaatggagtagaaaatgcagagtagaatgtaggagcttttgggagcttttgcattattgctctctcttgtgtgtctacacagaggtgtctgcagtcatgatgtaggaggtaactttcctgtatttctcctagagcttcagctttaggttcgctttaggttggtgggaccagcaaaatcccaccccaaattggagaggtctggctgactggttgaggctagggtgatgtctgattgagaaggctcgaagactcaaccacagcttttgagtctctgattctgcagttacattatacctgcaggttcagggcctgagcttgtctgtttcctcacagatatttatcacagtgctctctccttggcctgcactgacccaagaatcagaagcagtatgtcagtgcgtaaggaagcacaattcattaattttttttttttaaagatttttttggtaacagttttattgagaaataattcatataacacacattttatcaatttaaaatatgcaaatcatgcttttcagtatattcacagagctgtgcaagcatcacccatatcaattttggattatttttatgactttgaaaggagaccttgtaccctttagttatcatttcccaacctttcctttcttgggctgaggctgtagcgtcagcggacacctcgagagaaaagatgaactttggcatctgtaggctgatacggtggtctccaaactttctttatttattaaatattcagtaaaaaagcttttgagcatgtacccccaatttacgtagatggaaatacatttgttgacttctatttcaggctttaaaaaaagaaaataaaacatttgtaaatgatgtatgccactgtactgatacagtattacattatcaaacacacacagagttcagcacttagtaaaaaaaaaaagctggtattttctccacacgcccctgtgactcagcctctgtgggcctccctcccgttttgatggccttcagttagcgtatacaggcccagtttggtctgggctcagctgacccctggacctctctctctcatcccctggcacccttccaacccactccttgctctctggccttgcagaactccaggcagtgctcccagatgctggcttttctctcccgatgacaccccactatcttgactttccctccacgtggaatgttctccctgtccccgtctttctggcgaacttggtctaattcacacagcatatgcccaggtttacctcttctgctagttttccttactctctgaagcccagctagatgggcctacctccttttccccttaacagctatacctgtttattgtaacaatatatttatttgtttgtttcccattttaggccccagggattggacttgtaccttgcttacattttctccccaccttctctctctcttactttcttattacagcagtgttgataagtatattctcccttatacatgaatctttgcactttcccgcatgtcttcctagggatagattcctagaatgtcgatgccactttttggtcatagttaaaaaaatccagaaaaatggattgagaccagattgtgaagtaacttgaacctcagatctccaaacattaaagcttattgattgggcactaatcatatgagtttgctagagctgctgtaacaaactaccaccaagtgggtggctggaacaacaggatttatcatctcagcagttctggaggctggaagtccaaaagcagagtgttggcagggttgatgtcttctgagggctgtggggaaggatctgtgccaggcttcttggccttcttcaggttcacctgacattctccccatatgcctgcctgtgtacccagattccccctttatgatggcaccagtcacattggattagaggcccaccttattccagtgtgacctcattgtagcttaacaaattacatctgtaatgaccccatttccagataaggtcacattctgaaggtactgggggttacgacttcatatgagtttgcagagtggcgcacaattcagtccataacatttgattgacacacaattaaagttatatattattagggagatttgatacacttataatgtcaaatcttcctagttaggaacaagatatatttctctttttatttaagatttatttatatttatttcatcaagtcaattttatagatttattgggtttggggccttagaaagttagaatatttgtaaaatgggatcagacctggaagaatatgggtaaatcacattagggaaggtaagagaatggagtggggtcactggcatatagttggcacttcatgagcgtctgtggagtaaatttgctgcatgagtagagggaatcaaagttaaagaacatttaatttagcaacgtaaaagttgtaggggatgatggccaggtgtggtggctcacacctgtaatcccagcactttgggaggctgaggcgggcggatcacttgaggtcaggagttcgcctggtcaatgtggtgaaatcccgtctctactgaaaatacaaaaattagctgggcatggtggcgagcaactgtagtcccagctactcaggaggctgaggcaggagaattgtttgaacccggtaggcagaggttgcagtgagctgagatcacaccacttcactctaacctgggccatagagcaagactctctctctctcaaaaaaaaaaaaaaaaaaaaaaaaagttgtaggggatgttgctgtacagtttgggtacttacatacttgaatttgtctaagattgtcctttatcaggacagattgagttctcaatttgataattccctttgtgtatatgggtcatcatagaggaagtgtagaagctgaaatactattatgagaaaagactgcataaaataaactcattaccaccaaggtctccttttccttctttagtctttagaaatacagatgattgaaaatttacattacatggaaaaaataagaaacaccctaaaagggtaattattttatttttatttatttattttttgagatggagtttcactcttggtgcccaggctggagtgcaatggcacgatcttggctcaccgcaacctccgcctcccgggttcaagctattctcctgcctcagcctcccgagtagctgagattacagggatgtgccaccacgcctggctaatttttttttttttttgtatttttggtagagacaggttttctccatgttggtcaggctgatctcaaactcctgacctcaggtaatctgcctgcctcggcctcccaaagtgctgggattacaggcatgagccaccgtgcccggcccgaaagggtaattattttaaaacacttttatttttatggtcgaaagaaggctcacagatcccccgtcctgctatattctgttgcatttccaactcttgagagtctttcccacccccgggacctctcctctctcccttctcccccatggagtgctggttcaggaatatttgaggattggcctattgtgcaaacactcaacattgcgtctttcatctcaaatcctacagctgaaagcagaaacattttaaatttgaaagaatgggaaacctttgcaattcacagatttgcagttcctggtttcaaacacttgccttgatgtttgttactttagttctcagttaaaacctctaccttcggggtagcactgtatgttcaattattgcattctttcctttcctttcgtcttttttattctgcacaaaatttcatccctttagctaagctcccacctgccccatcttcttaccttttttccagatgtctccatgctgggaagcctctgccagttggacttgtttctcaggggaggcttcattcaccactttgcctcctcataagccctaggcacgctttctggataaactctttcttcttttcttctcaggatcaaacaacttagtccccgcttggctcttcccctaggctccagctctagtctgtagagcctctccccactgccctccagtatcatattgaaagaactgacaaaaaggcaaaagcatgtttttgctactatggcaaccatgcccagccacatcttctctcctttttgaagttccttccttattttatttatgtaaatttatcaaataaagctgagcttcatgtttttaactgtttccagccctcatttgaagacttggccttatttcctttcataagccttcattatagctgtttggtacatggatttcttcatcacggatacctagaatattttccctgccaatggcccctagagcacttcattgtctctggatgtacaagtccctgtgtgagaggtggtcagtcgcttttcaaagtgattatgccaacttatccttctaccagtgctatatttcagtttcagttccctgcatcctcatcaacactgggctttgttgtattttttgataattgcctttatgatattctcctagctccctgaactttgtcttctcatcatacttgtttaatgcccttgccagtctgtagactctaagaggcagggatagtgcctgtttgttcaccattccactctcaggagttcctgaaatccaacacctccttccttcttctgcaccgcaaggccagtttcacatgccaaatcttctgcaaagccttcctcaatccctcaaaatcagatggctcttccttttttggggtcctctgttgttaatagcagtttttgtgcctttttaatattcaccatgtcttatatctaaatgtgtacttttctgttgccctcaatagattagctggttcttgagggtggagaagatcttcctcatctttgcagcacccacggtaccggtgccatgtatgttttaggtgcttgataaatatttgagtgaatacttcagtgcctgctgtgttctgggaaatcattcacacccttcttacttgatgatactcagtgctgttgctgacacaaaggatatgtacctaacgtaggttgtttatcggtggccaggtggtgctctagaaggactgcagcaaacaagaggacttttcaccccacacctgccccagtgctgggattgtccaacctcttcatctttgtcagtgggttagggaaaaaatggtaattatgagataccgtatatatagatacacacacacatatacagttggcccttgaacaatgcagggattatgggcactgaaccccacctagtcaaaaatctgtgtataactgttgactctgctcaaacttaactgctaatagcccactattgaccagaagccttactgataacatagtcagttaacatatattttgtatgttatgtgtattatatactgtattcttacaataaagtaagctaaagaaaagaaaatgttctttagaaaatcataaggaagaggaaatatatttactatccattaagtggaagtggatcatcataaagtctttatcctcattgccttcactttcagcaggctgaggaggaagaggaggagttggtcttgttgtttcagggatggcagaggcggaagaaaattgacatgtagctggactcgtgaagttcaaacctgtgttattcaagggtcaactgcatgtatgtattgattttgtgagatttctgtttatatcctttgctcttttctcttttgggatatttgtcttgcttgtataacctcttcctacattaaaggtattaatactctctcatgtcactcacttatttgttatctaaagcttgtttcttaggatgaatctccagcctgagtgcctccatttatctcatttctctgaagggaacagtctttctttttccacgcttctgttcgttttccatctgcctcccctcttctacccttctctccttgccccgcctcctccaacactcttactctggtcaacaccaagtcatccttcctatctaagtttaaatatcactgctttggagaagcctatctggtcctcccctcctacttcatgtcaatcaatctccctgtgccctgttattctctttcaatgccccccaccctcaccacattctctcccgtaagtgccttcatgctcccttcatgaccctcaccatcattagcagttacatgcacatgtaatgtttttatccactgctacaatgtaaatctcttccaggactgggataaaatctggtaaataagggaatgcgtaaattaaacagccaagtgattctctttgatcactgttttattaaactaaaatgatttctgtttcattagttggtaaagaaattgtttaaagacttccacttgcactctgaaaaaaattttatgtttgctaatggaaattaataaaaatggagtgtttttcaaatgggtggatgatgagggggagagagagagagagagagagagggagagagagagaatgtgcatctgggagctaaactactgcatatttgagagtaggtgtggccagctgttcgttctgtgctggaggatgccgcacccctcctggtgtgtttccccaagctctgggagaaatctgtagcattcaaacagtcccctgagtatgtgtcaaagtagtgtatctagtggcagtgcacatttcacagctattgctaaaagataaagcagagacgcaagctatgcagggcacgtcaacattcacagcaagctattttctagaaagcacttgtgaatctgatctgattattaggctgttttcaatgcatggtaggtatggtttaagggcaatccaatgctcagtggtgagaagatgagagatcgaaatcctgaccttctctgattctgcattaaatgctttgatggcacagaaaatgtatacctgagagttttatagctgtgcttgtatgcgtacatgtgtgtgtgtgtgtgtgtgtgtgtgtgtgtgtgtgtgtttgtgtggtcaaatttcatgaagacatgcttctttgactgattagttggggttattgacatgaataccatagatacagtcataaaatgtactgtatttctctatgggtttgagtattataaatatttatgtgtagttgattctctagaatgcaacttttccagattaaaaggaaaacaatagcagatcattctgaaatgaagaaagggaggctgctatcaattatagtgtttaaaagtatggctttagataaaaggatgatttgttatttaatgtatcaaacaatattgtgagcaaattctggttgaccacatctgggtgtgttccccttaactctaaaaggagaggggtgagccaggagtgattagtttggaaacagtccaggggcagagagggtggggctggattgtatggagtggggagaaacactgctcagctgggtttttacaagtcagaatgggtatttgaagaggacgctgctttcatcctgctgggtgcaaggtcagctgcagatgctctttcattgtttctttctaatcagcttctaagaatgtggcttaaacgctcagctatttccaggtggttggcatcatttattgagttgtctgctagagttatttcatacgctgcctaaaatgactcaaaaaacaaaaaaacaaaaaacaaaaaaacccaaataaaacagctgtatggcaaacatgctgatgaggacctctgcatttagttgcttcgactcagcgcacaagttaatttaatgttttgagtttggtgacttattcaaatcctaaattgttactgctgtagttagtctgtaatgtcaagagtcttgttaatcatggtagttacattaacctgttgttaaagaaagactcttcgacctcagacaagatatccaatggtggtaccttctgacttgatactaacacataagaaatctcttgttcctttaaaatgactagtaaaattacttacctggttagtgaatttgcatttcaacattcttttatttccaattttatttaactcctggatgtgagacacacttttttttgtttgtttgttttgtttgtttgtttttgcctgcatgagttcttgtaataccagtgaaacagctggatcagtatctttgatggcaatagtgagtttgtcagtgagacgatttggcctactgaggttgtaaaacttacgactccatagctgcatgagctttaatggccattttccagaaacatggctaggtttatatttctcacacagcttaaattttaggtttatgtcaatttttgtttttggcctcaccctggatagttttatttgcatctttgatgcaaattttctcatttttcttattatgtttgattgttttgggtgtgtgcgtgtgcatgtgtgtgatgttttcatgcccaaaagagcaattgcaaattccctgggtacaccaagtaatatgccttgtcttaagcaactaatcagacaaaattgcttttttatcagactcatctagattgaaaacaatactgtatgcccttgaccatcttctttgaccagtgttgcagttttgacagagacgctaaggcagagggagggaggagatgctgcctttatcaatgggctgctgctttataacaaaccatctgctctagttattaggttggtgcaaaataattgtgctttttagcattactttcaatggcaaaacagtggctgaaaacaatgacagcatttgtttcactcacagaccagcaatttggtcagagttctgcagggctagcttgtctgttccactcactgtcagctgggtcagctcagaggtttggggctggaatcatctgaagcttgtttgctcacatgtctggtggtcgatgctacaggtcagctgagactttagcgagactgtcaaccaccataccgacatgtggcctctccatgtggcccgggctccctcacagtatgggggctgagtttcaaggtgtgaagacaatattctcttcctatgtaagagcagcagtctctgtcacagaggctaagaccatcagagcttgagggcacaaagggaaattctacttggaacctggcatatcaaacctgaaaattcagaacttatactttggttagatacagagaaaatgcacgtgtgctctctacagtagatgtaacaaatctcttgagtttattagatacatagctctcaatttagacaagttttctgaaatatataccttaatttctcaattggcaattaatttcatcttgctttcacagtcttactgacattattctgcttgtaataaatttgattatcttgttgaataggtatagacagtttattttctggaggcctctagaaagagaccttgaggagaattatggattgatatttttatataacgtagggaaattatgtggattttaactgggtccattataccattggcttgagaggtgatgtgatattaataagaactaacattttttgagcattttttctgtcctaggcactgttgtaagtactttacataaattgctcatttaatcctcccaatagtactgaagcaagtagttttattatttttattttataagtgaaaaaacagtggcccagggaggctaagtagcttagcccaaatcatagagtcactcagtgctggggctgagttagaacgtaggcagtgtgcagtttggctctggaggccacatccctaacgaaggtgaaggtagactttggacaaagccatggcctttgactttcatttcttttaagaaatcacatgatgctgcatttgtgaacagttatgcaaatccattcagaaaacatttgcaaatcatctgactggagatttaaaaaaaatccttgaaatagcatctttgccttcaaagactttgttatttagtaaaggtattaaaataagaacataactagactataaggcaaataatggataaatagatgaggaactacgaaatgggaaacctcagggaagggcaagaaagagaaagatattttgaaaataggaggcaattaataagtatgttgataagatgactaaaacagtataattggattgtttgtaacacaaagaaaggataaatgcttgagatgatggaccccatttaccctgatgtaattattatgcatcgtatgcttgtatcaaaacttcttatgtacctcatacacctgctatgtacccacaaaatttttaaaaaaatggatgcatagtatctcactcgatgaaaggaagaacttgtaacaagccaatctccttctttttgcacattaatcttgcttccaatttatttgctactacaaaatgattaaaatgagtgacttgtaaaaaaaccaaataaatatgttgaaattaaatcaaagtttgaacagatcttgagaggtacctagtaattgaataggggtggaataatactaatcacatatgtgcaggaaacagcacatagttcagtttgggtttgggcaaggagagagtaggagccaaggctggaaaggtgagttaaagatggattgtgggccaggcgtggtggctcatgcctgtaatgccagcactttgggaggcagaggcggccaatcacgaggtcaagagatcaagaccatcctggccaacatggtgaaaccccgtctctactaaaaatacaaaaattagctgggcgtggtggcatgcacctgtaatcccagctactcaggaggctgaggcaggagaatggcgtgaacctggggggcggaggttgcagtaagctgagattgtgccactgcactccagcctggtgacagaatgagactctgtcaccaaaaaaaaaaaaaaaaaaaaaatagattgtgagtcctttcttgaatatcaggctaaggaagctgaactctttcctgagacaatgggaaggaactgacagtgtttaaatagtgtacttgagtggaatgactttgcatgaacttatatgaacttttgaggcatcctgagtcatttagttgctgttcaacctgctgaagttgctctctaagcctcattatattcagttataaaatgggaaaaataatattgatttcatagagttcttataaggaactaggatatgcaaaactgccaataacatgcttggcactgtacaagttatgatttctgagatacttttgtatcatttactatttggaagatgaacatgctgattatggctgagtttcatggcagtaattacaaggataaagagcttaaagaggaaaatttagttaggatggtgtattagtgttcagtaaggaaaagaaaaatcattttaggtatttctttgcctccctccttccttccttccctccctccctctgtcccttccttccttcttttttgacagggtcttgctctgtcacccaggctggagtacagcagcttcaacatggctcattgcagcctcgacctcctgggcttaagtaattctcccacctcagcctcccaagtagctgagaccacaggtgtgtgccaatgcatccaaataatatttttaattttctgtaaagacgaggtctcaccctgttgccccagctggtcttgaacttctgggctcaagcagtcctcctgcctcagcctcccaaagggttgggattataggtgtgagccactgtgcacagcccattttaggtattttaatggagggaatttaacagagggaattaggtatgtggatggtataagggctaagaactaaacaggaggcagggaagcaacccagagattaacaatagcaagaagctaccactaactactcctagggctgaagggacttagggaggatatttttacctcagcccagagacaggggctgctaagtgggagctagaaccatgacgaagcttgcagtaagagctgcaatgtggaggaaggtgctgaccagggaaagctagagcatggaggagaaatgaccattgctagagatgccacctgaggcgaagatagggaagggaagatttcctgccttttccacacctcctgccccagtcttcgcccaagtctctcactgatggatgaatatcagtgagactttcttacctggaagccgactgtcaagggagcctgggaaatttaagttccctttgatataaagcagagagggggtgtgggcagtaggatatggatcttagagtcaacagacagaggatcggcacagatagaattctaattgactataaaaatctgcacagtcaatatggtagccactagtcaggtgtgactatttaactttaaattgaaatagttgaattaaaaattcagtttctcagtgcactagctgtattacaaatactcaatattcacatgtgactagtggctaccatattgcatagcgcagatgtagaatattttgatcgttgatcatgacatgctacgtgagccccaggtttgctggaacatccttcacctatattacacgttggccttggtctgtagaatgaggtgatgcataggtaaatttgttccactatagtaatcatctatatatatatatatatatatcttataatatcatgttatagatcttaaatatacacaaaaagattttttttaagttgtttgtcagttttaagtagagatttaggtgtgttggttatacgattgattctcagtgcttttcagtatttttctaattactcaaagtaaaaatataaataatttttaaaggcataaaagcccgaaagagccacctgctttaatcatgagttcctctgctaaccgtcagccctctcttggttcatttggtgccattatgagtggttgagtagctgtgtccctttggcttttcctcttatagaaaagccttttatttcagtgggtgtagttgacggatgttcagagccagagcgccatgcatgctggcaaggaaatgcctgctctgatgagcttcctgctgtcctcagttcccctgactgtggcaggtgctgcacattggcccattggaaattgcagttgtttttaatatttttttaaaacaaatgatctccgactggctctgttgctcctaatttcctttatttgttgaacactcaagatgcaataatctggtttgtttatagttttgtggaaataggaataatgaacatttatgtagtggttatcctatgctagtccttcttctaaacaccagcacttcctaagcacctattaatttgttgaatcttcagagaaacattctgaggtagatactgttgttaccttcaatttcaaatgagcaaacggaggcagagagtgttttagtatgacttgctcatggctaggaggcagctgaacagggtttcataggctgcagtctggctgcagaatccatgccgttggccatgcttctctcactcgagtcctagaatgctggatgcagtttgtttgggcttatttcttcgattgcttaaaaacgactaaagaggttttgcctcatttgatggatgttctattgtgagttgcacactttctattgtcttttactttaaaaaagaagaagataaaaaacataaaattatagatggtttttgagaagctgagggtccgtggtcccactgggctgtttgatacctaattttggcctcaaatctctagagcacgagtacagtgttagcttactgataactcccttaggacatctgtgacaaactgccacaaaaataataaaaaagaagcagggtttactggggttgtgttgagggccagtgcctgatttctgttaggttcttgaaagcttggcagtttcctgatggctagaaggccttaaaatttttttgaggatttagaattgtgaaggccatcagcaaaacatgaatccaagtggcatttctccctcacatgttgtccctttgctttgcatggaaatcattaccttagtttaaaaacataaaagagaaaaatgctcagacctaagtaagagcgtaatgaaatgagcatgtgcatcccacagcccttcatcagggcctcacccatgattgattgttctgcaggactatctaaatcagtagcatgtttttggacagcttgcagaagaccaacctatttagcattttggccagtgttgccaaaggggctgctgcttgaagtctgcaaagttctctttgtatgataaataattataaagggaacggtctacttgaacatctggctgatggaaagactgacttgaaatcaagtgctgaactttgagtgcatccagccccagcatctggtgtggggatacgatggatttgggagggggcagtatgtttgacatctgtgtattggtcctagaatgttcttttcaagttgtttgtgctggtcccagttgacttgtatcctgtaggaagtaaaaaggcaactgcaaaaaggattaattagattccatctctctgggagaaaaatctttattggtaacttacagtttgagatgagagttttcattggtaatgtaacttcttatgggtttgatttcctccttgaatagattacaatccaggagatatctcaagaagaaaaaagttctaacatcatgaaggttaaatgatagaagaagagaggaaaagaatcccacaggaatcatgagagcacttggcatagaaaagcagaagtaattcaaacataaacttaaaaaaatgctttgaatcacatagaaaagcatacgtaagtcatcagttggtgctagatgtatcttgaaattttgaacttttatacataacataaactgaaaagagcacaagttttataccaatgacccaaaaccacaaagcaatttacttttattaacattggagtaaataccagtgtttgctggcttgtggcttggatatgaaacataaaagaggaaaagtctgtttggctttttttcccccaaaagtaacacagctggcaaaaggcaggcattttacctcacttataattgtctggaaatttaaaatagaccttttatttttttttaagtttatattgaaattccatctttacatgaaatcagcgagcataggtttaatagcacacattggtctctcatgtgtagtttgtattatgtgaaagaccagagcaattttgatcaccagcatggcacagctcttaattatcttggggtgaggttgcttgggtagctccaggatcacccgaatatttaaccaattgtcttctgtgctactatgaccattcacctcctggaaggtcccagagggagttacacacgtagagaataagttgagaaaaattcattaaaaaaaaaaactctgaagttctttttaaggtcctgaagaacttgggcagggtgacttgggtatcagctgctgaagatctagacatgattggcttcctaggagtcactttttctttttatagtacacccactttatgtagcagccattgctagcagagactatattatctgtgtttagggctcagaacagaaaaaaatgagaaaggtttaatgcttttcccattggtagtaaatctgtgataaatgtctagaatccaggacctggattgaaattaaattggtggaaagctatgactcctagtcaattgtgacatggcttccagttagaaatctatcatgaaagcatccaagtagtttctgtatctgctccctacccctcacttctcccaatccttttttttttttttaacttttattttttgagacaggggtctcactctgtcgcccaggctgttgtgcagagtcatgatctcggctcactgcagcccccatttcctcagctcaggcgatgcttccacctcagcaccccccgagcagctggcactacaggtgcgcgctaccatgtgtggctaattttttgtgtttttagtagacatggggtttcaccatgttggccaggctggtcctgaactcctgacctaaagtaattcacctgactcagcctcccaaagtgctaggattacaagcatgagccactgtgcccggtcacattttaaacatttttttgtagggatgaggtctcactctatttgcccagtctgatctcaaactccagggctccagctatctttccagcttagcctcacaaagtgctgggattacggccatccccatccttttttctttacagtggcatctttttgaaacccaaatcttattttgtcacccccttcccaagtctgcttaaaatcattccatggcatcccattgttcctgggttcagctgatgtttcttcaatgccttggtccttgtcccacccacatctctagccagttatctctgcttgccgttgttctctgagctcctgctccagtatccttcttcctgtccctcacacttgccctgtactcttcctccactgggctgtgtgcatgccatctcctcccctggaaggctcttccctctttacttccttacctcctactcattcttcggatttccactctggagccattttctttttccttttctttttttcttttttttttttttctgagatggagtcttgctttgttgcccaggctggagtgcattgatgtgatctctgatcacttgctcactgcaatctccgcctcccaggttcaagcgattctcctgcctcagcctcctgagtagctggcattacaggtgcgtgcccccaccctggctaatttttgtgtttttagtagagacagggtttcaccatgttggttgggctggtctcaaactcctgacctcgtgatctgcccccctcagcctcccaaagtgctggggttacaggcgtgaactaccaggcctgcccgagccattttcttaagtaggtcaagtctgttcattctaacctccccagcattgtctgtttttttctgtctgaaatttaaaacaattgcagttttacatttgtgtgtgattatttaacgactgtcttctcccctccacaagcttcctcaaaccttgcgcttcttgtgtggagcacagagtctttcctgttacagtaggtgcatgcaaatatttgttgaatcagtgaattatctctgagggtgaatctactccctcatcacagtggaagactggaacttaaccctctactactgaatttagaaacttgcaatggtcgtgcctctcatctctttgtctttcctgcctaccttttttgggtgcacattctgtatgttttaaacatcaaacttgcaaacttttcttttggactgctgcattcctaggagcccagaactaaactgagcggggagggaattctccaagttgcatttccagcagtctttctcctgctggcgtctattttttcattctcagcagagcccccaactttcttccccctgtgctgccatttgttgcctcctttttggaactccaaagtccataagccagtcttgtgggggctggttcccacctgcccccgcatttgttcctgtctgagaaatctgcttgatgagtctctgaactcatcaagtggtgatgagtctcaagtcccgctgccagcacaccagtgaggtccaaaatgtcttggccaaatgatcttcaaaggcttgccaggccttgagttaaaatctccactctggcatgacctcctgctacctcttctcctccagtgtggatcacaattcctgttctcctggtgctccctgcccattttcctccattggtttcttctcccttgtaaagaagttcgtatgcagcacgggttacagcccacttctttggttgctgttcccatctgtcacatggagggctggatcagcaggttttcctcctccagtttttgtttttaactccaaagctagtgttttatattgatacttctcctctctgagtttgagattatccttctaaagcccaagtaataattttctatacatgtagaaaatgtgaaggcttccttccctatagaatagatgtaagccaactgtggccccactgcctgattttacaaataaagttctattggagcaaagccatacccattcgttgtatctattgcctatgcctgttttcacactacagtggcagttgaatagttgtgacagtgtctcttgtaaagcctaagagatttactgtttggctcttttttttttttttttttttttgagtcagagtctcgctctgtctcccacactggagtgcagtggcacgatctgggctcactgcaacctccgcctgctggattcaagtgattctcccgtttcagcctcctgagtagctgggactacaggcgcacaccaccatgcctggctaatttttgtatttttagtagagacggggtttcaccatgttggccaggatggtctggatctcctgaccttgtgatccgcctgccttggcctcccaaagtgctgggattacaggcgtgagccactgcgcccatccagtctggctcttcttagaatacctttgctgacctctactctagatcagtagttctccaccccgaggacacattaaattaactgggaagcttccttaaaaaatggcaatgcccaggccccacttcacaacaattaaattagactctctggctggggccatatttccaggtaattatgtgcaatcagattgagaagcactgttaataggtttcccttcatttcttgattaattgatgaattctacttcctgggccttccaaatttatgactaccaaggcttagaaacagttcggttcctcagcctcagctgagagatggagagattacaataaacctcatgcttcactttatctcaaaagtccctagtctgccctaaagctatctctaaatagccagaatgatagatttcctgtgtcatttttcaggttgttcagtacatattttcggaatataccttcttttactattaaattccttcattattattattatgttttaatcatggtaaaatgtacataacataacatttaccatttaaactatttttaagtgtgtagttcagtgacgtgaagtgcattcacatttttctgcagccatcaccaccatccatccacagaactctttttgtcttgtaaaaccgaaactctgtacccattaagcagtaactcctcattctcttgccctccagcttttggaaaccaccatgctaccttttttctctatgaatcggaatactctaggtacctcgcataggtggaatcacacagtatctgtcctttgtgactggctgacttcacctaacatgatgtcctcatgccttcatccatgttatagtgtggatcagaattgccttctttttaaaagctgagtaatattcccatatatatatgtgtatgtatatatacacacacacacacacacacacacacacacacacacacacacacacattttatttatccatgcatccatcaagggacatttgggttgtttccatcttttggctattgtgaataatgctgctttgaacattagtgtgcaagtatctctttgagtctattaaatgttttttaaccagtgtattagttcgttctcatgctgttaataaagtcatacctgagactgggtgatttatgaaggaaagaggtttaacgaattcacagttccacatggctgggaggcctcacaatcatggcagaaggtgaatgaggatcaaagtcacatcttaaaggcaagagggcatgtgcaggggaactcccctttataaaaccatcagatctcgtgagactcattcactgtcaggagaacagcataggaaaaacccacccccatgatccaattacttcccaccgggtccctcccatggggattattacaattcaaggtgagatttgggtggggacacagagccaaatcatatccactgagtatctttgattttgtcctaaggagaattcagatctggcacatggtccttattattttcacacaaaagatgatgttctgggaaggtcagaggccagtaagcattgcacatcttgcagttctaccagaaaacagaatagtcaacattgtgcttgtaggtacccctgaactcagaggctagataatgctcaacagtgttcctcactgtacattggaagcattgacacgtgcgggacgccattcatacagcgtcacatatcagaattcaaaagacggtgcttgcctgatgcttgtcaacattttgataatctccacttttttcatttgcttttcatatggtaaaaatgacagctctttggaagcctgagagttcagtatagcaagcccacagagcaaagcttacatgtttgcttttatttttacaggtcttcaattatttgagcacaaatacaaaatccaaaaagctttgagaagtggaagttttatttttcttttaagtttagtctttttgttctcaactggccggcctgcctttattccctccctcccctcccctctctccctccctcccctccctcctttcttccttctgccctgcctgacttgccttccctgccctgcctgccctgccctgccctgccttccctgctcccctcccctcccctcctcctcctccctccctccctccccctcctctctccctccctccctcccttcctcccttccttccttccttctttccttctttccttccttctatcttcctttggtaaattcatttagcaaaatcttgacctgatctgaaatgacattaggttattctttatcttaatgtattaaacttaatgtgaacattcatacattttaccacagaaatattgtgtttgattacagagtgcttccccagatcttttagaggtgttacatagtagacagtacatatcttaccattctaaaatgtaacacattaccaattagcttcaagagttttgggtaaggcatgtagtcctgcattataaggtatctcgttttctgtcattcaggtaagatcaaaggtggtgatcacactttggccacctttgagagtcttactttcgtacacacctagtgtctctttcccagtgtagctggtgggtggcagctcggatttctaactctgggcttttgtgtgttgggaatgtttgtaaagctttcttatggagagaccgttattttttaagaggttgaaaaactgtcaccttaccctgggaaacacaggcaaagtgtttatcctgataattttcaaacccttcttcccaaaagactcatcagaggacttgttgtcatgagttcactccaacgtagtcaaacaggcagctttcaccgtgatatttgtaatgatgttgcaggtgtttagggccaagagtcatctgtgcatccactgggactgaggatgataattccttttatgaggtgggaattagtaatctgggcctcctggtagccggacactgatgtttttaaagcctacctcccacaacagttgaaataaagccaagcacatttgagtgactgacactcctcctcttctgttgatcttgctccttcttcaggggaaacagatctgttacgttcttctagcatatacaagtatggttacaactcagaaatcatactatgctggtctatttgctgcctccctctttcaatcagtaataggtttccaaagtctttgaagtcttgcttctctagaatgtcctcctgtggcatcaatgactcccctgtacttgtcaaagtgagagaggaaggtgactctcagtgcgggccatgcttgcagccataggcattcttcatagtgtccaaggcatggccagcagcacacattccaaaaaagctttccttttagttagttaggtagtttatttatttatttgaatcccaacaggaaataatttctttttagttttaacaaccttttttaggattatgtcatagcttgttttgagatttatttatttatttatttatttatttatttttgagatggaatctctctctgtcgcccaggctggactgcagtggcacaatctcggctcactgcaacctctgcctcccgggttcaagcaattctcctgcctcagcctcccgagtagctgggactacaggtgcctgccaccaggctcagctaatttttgtgtttttagtagagacagagtttcaccatattggccaggctggtttcaaactcctgatctcgtgatctgcctgcctctgcctcccaaggtgctgggattacaggtgtgagccaccatgcctggccaagattttgtttttgttttaaagcagtcaggctcatctttgagcataattatgggattttgtgttcatggataataactgcagtggccaaggttcttgaaggaggcagaaggaggaaaggaacatccaatgggcaccccttacttacccactacccatgtatcagttcaccatcctcactcttcacctttttctttcctcaaacctccaacaccattcttcttttagctttgtcaacggatcacttctaaaagcaacctgaagagaactgctcatttctcaccaaatttactatctgccctgcatctgtacccatttactctgtcttcattcctttgcaatggatgatctctccctgctcgtgtgtaaggctagaccttacccttgtgatctacatcctttcacccattcagagatttgctctttgttcctgcaattgtcatttctctctttcctatgtgagggacttctctttctctactgggtcattcctttagtatgtgccctctctacacacccatctccagctacttcttttctactcattcagagagttgactatgctattcctcctttatccactccagtgtacacttctcctcaccattctgtagaaattgctcatgtcaaggttacctgtgtcttctattgccccagatccaacagacaattcccagttctcatcttacacaaccccttaacaatttggactattaaccacgcctcttctcttcaaacatcttttctccatcttttctgacttaatggttggctggccctaggattcagtccttggacctcttctcttgcacactccatgcgtgatttcatctagtggcctctgaccgcatatttcgttctctctcttatttctgtctctattgtctagggcctgggttgaaaggacttacttgaaaagaaagagaggcgattcttatggagaggttaaaaaaggaactacaaaggttagggaagttactggtagctcccaggattttgaagcataattgtttttgtgtctgaggatgccagtctttccaaactaagacttttttttttttttttttaacatagatggaagactaatcatgtctagaggttggagttttgaattgttagtagaaatcttaaaatagtcatgtgaaaaataacagaaattgtagaatagcaacagttagatctcaactcagattaacaaatacattttgagctatcgtgttagctttaacttactaacaagaaaatatttttgtattaaaaattatcgtgctagtcacattgtggtgaagttcaactactatgcattatgagtgtgggggcacagcagagctttgctttagaagctgactcaccttgaactgattttaataaaagcttgaggatggtggaaagagctgggtggaacaatgcttaatatttcaaagcaaggacttgaaaatctatttctgcttcttagtaataggatctctgaggttccagaattatttttgaactggttcactggctcttggaggccctgctgccccacgtccatggcaccgatgaggctcttgccgtaattgcttttccacctggcatttgatgaaaattggggaattacttggtcatatagctaagaagtatccagcgtttatcctcctagagattggatttaatggccaaatggctggatttggccgtgtccatgtctcagagctgcttaattgttaaaattcctgactgctgtgttcctcaattcagtttcaaattaaaaagtcaagtgtgtgtgttttgtatctgtattgtgaggcaggctgtgatctacctttttgacttactcattccagccatgtatgtttgttcctggaacttcctttagctctgcacacactcttttcttcctgcccatctgagctcagcacgcctttttggaagccttccctctttaataccctactctcaccggacttgtttcacttctcttgaacatctacacacaagtgcacttgttacttttctttccttaacttttctgtaaactgggtgccttatatggtgtgcaattttaattcctttatggtttaaaagattctgcacagggcaagcacatctgtaggtagtgttgtgtgggtagtattgccctgtaagtccacgttttctttctttcaagagaagccataaagaaaccatttgttgtttttgcttaaatattagctcttcaaatttttaaattttggtggcttatgcacatttttttaaagtaccatgtgtgccagtacagcaaaggccaaacgacacatgtaggcgcctgtttggcgcctgaagccatgattttgccaactctgcagaaagccagttccttccctccctccctccctccctgcctccctccctgcccctcccttcctccctctctttccttccttccttcattcctctctctctctctttccttcctactttcttctttttctttctttctgacagggtctcactctgtcaccctggctcgagtgcagtggtgccatcacggctcactgcaacctttgcctcttgggcccaagtgatcctcccatctcagtctcccaagtagctgggactataggtgcatgccaccacacctggctaatttttgtattttttgtagagatgggtgttgccatgttgcccaggctggtctcaaactcctgggctaaagcgatcgcccaccttggcctcccagaaacccagtttcctaaggcaagttccacagaacactgaccccacccattggataattttcctgcaaggtagtcttggttagacagattgggaaacagtattttatccccctctggagaatctcattagcatattgttggcactgagaagttcaaagttaaaaaacaaaacaaaactttttttaaaacgcaggattccccaagcttacttgaccatggacccttctttccacatcacatctcttaacatcccatggagctaggattctgcagaaaacactttgggaaatgctgctgtaagcctttttttttttttctcctcggtaggccagagaataaatgcgaaggccaatctccacgaaataataatgtaattccattcaagacaagaggtgaagaacagatattgcctctgcattttaactcctcccagtgccataaaatgacaacttggtaaatgttgatgtgagtgtgaatcttttaaggacctgccaataccgagagtgagaagaggaaaggtgtgtgctgtttactgcatgttctttgagatgttagttctgtttctttgactttgctcaggtttgtcattttgtgcaatggtacatcctggtcccatcactaccaacgtgttgcataatggatgaggctgaagagacccaggcagcaggcagcaatttaacaaaacagagaaagaacagagctgttgatggttggaaaatgcattagtcttttctctcttttacaaacaacagatccctgtgtcaatcagtagtaaaatagcaactggtctgttttgctggttctactgatcacctcccttgcagtgtaatcaagagtctagttcagggcctttatctcaccctgatacaagaatcaactgaaaatggattaaagacttaaatgcaaaacctgaaagtacaaaactactaaaagaaaacataggggaaaactccatgacattggtctgggcagtgatttcttggatatgaccccaaagcacaggcagcaaaagcaaaaatagacaaatgagattgcatcaaacttaaaagcttctgcacagcgaaggaaacagttaacagtataaaaagacagcctacagattgggagaaaatatttgcaaatcatacatcagataaggggccaatgtccaaaatatagaaggaactgtaatgactaattaacaagaaaacacataaccttattttaaaaatgggcaaatggcaggcacagtggtttacgcctgtaatctcagcactttgggaggctgaggcaggggcatcacctgaggtcaggattttgagaccagcctggccaacatggaacaaccctgtctctactaaaaataaaaaaattaacaaggcacggtggtgcgcccctgtaatcccagctactcgggaggttgagacatgataattgcttgaacgcatgaaggggagattgcagtaagtcaaggttgcaccactgcactccagcctgggcaacagagtgagactctgcatctcaaaataaaaataaaaacaaaaatgggtggtcaggcgcggtggctcacgcctgtaatcccagcactttgggaggctgaggcaggtggatcacaagggcaggagttcaagaccagcctggccaatgtggtgaaaccctgtctctactaaaaatacaaaaattagctgggtgtggtggcaggcacctgtagtcccagctactcagtaggctgaggcagcagaatcgcttgaacccaggaggtggaggttgcagtgagccaagatcgcaccactgctgtccagcctgggcgacagagtgagactctgtgtctcaaaataaaaataaaaatgggcaaaggacctggatagactattctcaaaagaagacacacaaatggccaacagatatatgaaaatatgctcaacacctctaatcactagaaaaatgcaaaataaaaccacaatgagatatcacctcacacctgttagattggctattatcaaaaagacaatagataacaaacattggtgaggatctggagaacgggaaccctcatacactgttggtggtattgtaaattagtatagccattttggaaaacaatagggaggttcctcaaacaactaaaaaataaaattatcatatgctccagcatcccaccaatgggcatatacccaaaggaattgaaatcagtgtgtcgaagagatgtctgtgttcccgtgttgactgcagcactattcaccatagccaagatatggaaacaacagagtgttcacaacagattaaaatgtggtatatatacacaaaggagtattattcagccttaaaaaaaaaagccaggaaattctgtcatttggacaatatgagcgaacctagaggacattgtgctaaatgaaataaaccaggcaccaagagacaattttcaggagtttagtggagacctttgcttttgttttctattgcctacctgtatccaggaaatcagaaacagccatctgaaaggacgctagtttacattattcaagtacttgtgtctttctataagatgttgactgtttataaataagagtatatgcaagtttagaagtatctgaatgtttatatagttacatgctttgttttcaatcattatttgataaaattctccaatttcatgaatattcagaaattataatacagttggagcactgcaattggattaactcttagtcctataatgtatgtcatacagactgtgagtttgcagtaggggtctggagccagttcatatgactggggagaagggattgtgtctgtttcttccccactttgcattcagtgatatcaggttgagcatgaattcagctaaggtgggaatgttgaaaccacagaagctggcaaatgctgtacattaggaatctccctattcccatgagaactggttgttaaacaaacattttagaacacccttagtcctaggtcatttctcaggatgacttgattataaagaatgtgggagttgaacagtgaggacacatggacacagggaggggaacatcacaccctggggcctgttggagggtggggggcaaggggagggagagcattaggacaaatacctagtgcatgcggagcttaaaaactagatgactggttgataggtgcagcaaaccaccatggcacgtgtatacctatgtaacaaacctgcacattcagcacatgtatcccagaacttaaagtaaaataatacaaaaaaagacattaaaaagatttttaaaaatacaatcaaggaccttttagaacacagtgagtgttttaacaataacacaattgcctcttatttatttatttttagagacaaggtcttgctctgtcgcccaggctggagggcagtggcatgattatagctcactgtaaccttgaactcctgggctcaagtgatcctcctgcctcagcctttcaaagtgctgggattccagacatgagctctcacacctggccctcacaattgccttttatatctttattcctttcttcatttccccagtcttttggttaatggtgtttaagctgatgtgtggccacaaggtcccattgtttgttggttggttggttaaacatgattctcacctattagtttcataaagaataaccttgctttttttcctgtaatttcaagaggatagtccagttttgcattgtttccttagagttcttggtaataccctggagacagcacttgttcttcattgctgtgggcgttgttcgtggaggtggaggtaaggagagccaaatacagagcctgagcaaggttcactcctgtgcaggccaagatggctgctgctgcctctggcggggcaacaccacactctgcatcagcaatgctcagtgatgaatggcattttagtgggctgggttaccacctgctgtctgtatcacaaaccagccaaaagaacagatttcctgccataatacattatttataagtctaaggaaccaaaggaagataagtagggaaatattttgttccaaaaatgcctgatggtattaaatgaggcatcttgtcttccttccttctgttcccctccaccctcccttaatggatatgtattttcattccataggggactgagttgtatataggattatttcaagctggattctttgggtacttgtgatgattttttaaaaacaaagataaaaatccagggacctgacaaagattgttattatttcacccctttggtgttgagtgaattgacaataaatgcacagatgtgttgatgtttttctggatttgggggtttattttcttattacacattttgaggaaaaggcgcattgaagagagcagaaggtgtcataggcagtggaagtctgatctttctttgcaactcaactgataatagggggaaatcagcaacatatttagacaacatggcacactggctaggagggcaggtcaggagccagactgcccagcttagaatcctgggtctgccacctgctagctataggaaattgggcaaattacttaatggtctgtacttttgtttcttcatctggagaccagggataataataatgcttatatccaggctcctgatagcccactgagcacttttgtgtaaattagaaaaggcagctccccagggtggactctatgggcttgggtacagacagtagctttatgtgaattaggaaaacaggactcttccttcagaggagtttgcgtggtttagcaaagagagctcaggctgggtgttccccccaccatgacaacctgtgtaagcagctgtggtagctctgactaccacaccgggtgctgaggagtaaacgagttgatgaagattcaataaaagatgctgttattatcatcatcattattttgaggtgacaagctagagtagaagagggttcagaagagcctgtagtttcgtgcagagtaatcttagaaaatgaagcaatttgctgaaagcccttggttattagcaaaactgtggctagaacacagttgtcttgacttttggtttttgccaatcctgactaggcgttgctacacaactatgtgattcaaacaaaaggaccattgatagaggataggggtgaggggcactgcggtcagtcccagccccaggtgccactgagagccattcaaataacaaactcttagaagatgatgggttttcctcctaaaaccaaacagtatatatgttcctttgtccaggatttaagtgttcatttaaaaatataccatgaagtaggcatgtggggatcacagctaccaccttaatggtggacttgaggaatattagtagatgaagatgtatttctgtaatatttgaactaaacagctcttaaaagtagcatttctcgccacagtgttttctgagtacaactaagtggaaaaaaatacctttgtttcttataagagggaaaaacaagggagttgagctactgtgcaagttaagctacatttttccagttccctgtaaaacctatttcattataaaatgtaacacaagtacagagaattacatgaaacaaatacatagcttagctaattattgaaggtgaacagtcttgtaatgactactcaaatcaaaaattagtattttaccaccctggaagcacatttgttgctatccctcaatgatcactccttccctccttcctaaaatcctcttctcattttccgttgatcacttccttgcttttctttatagttgtgttgcccaagtcaagcccttttaaaggataggctgattgaactgtgatcattctgtctttatgctgagcatttcaccatgttttattttcatttggtaatctaataacttgtttgggtgaattctattagtttcctaacttgagtttgatgcctttttaaatgccaagaattggtgacatacaacagttttgtggttactttggattcttacctaaaaattatccagttattagaatatcaaatagtgaaatcgatcacttcatcagacagctctacaactgttacaggactgtgtgttcttggcagagcctctagttctagttctttgcctgaactcaggaagccaaggggctcaaccccttcttccttcccatcctcattggtaacgtcatgtcgatttgatggctagtatgtgccatttctatgtagtaagcagatgaagagtgagttgaacataaatgtagtgaccaatagtgaactggcaaatgagtgtcattagtgaaaataaatatgaaaaactcctagaaattaatgaggtggcactggacaggttgttgacctgagtattttccctgggctgttgaactactttcagccctagcccccaaacattttattgtgaatgtgttgaaacattcaaaagaaagaaaaagaaagggaagggaaggggaggggagggagattggttcaaagagacccatatacccaccacctagtttcaacaattgttagaattttctttatttgcttcctacacacacattccactctactattttttcggtcatttcaaaataaattatagatgtcaaaaccctttccatttattttagtatgcatctccaaagtgcaagaccattcctttatataaccaccatgccattatcactctttttgtttgttcaaaatagtatttcacttggtcctccaggctagagcacagtgctgtgatcacagctcactgcagcctccaactcttggctcaagctgtcctcttgcctcagcctcccaagtagctgggtctacatgcatgtaccaccacacccggccaaatttttttgtttttttatagaggtggggtctcactgtgttgcccaggctcgtcgaattcttggcctcaagcaattctttcacttcagcctttcaaaatgctgggattacaggcgtgagccaccgcgcccagcatcactcttaataaggtgaacagtgatgccctaatatcatcaaatgaccagtatatatttagctttccccaaatgtgcccaaaacattaattataaatattcttttaaactaggatctcattaaggagtatacattgcaattggtcattatgtctcataaatctcttatctagaatagcaacccctccacttttcttcatgacatcaactttttgaagtccagttctcttatacaatgtgtcattttttggatttgcataactgtttcttcatagtctcatttaacccagataatgtgtataggaggttatcacatgggcttccccgtgtgattttgtgctcagcacttaccaacccaaatccatcgttgaagtggcaaatttgcctcaactagattttctctccgctgggcagcttttctgaacaaaaattgcaaccacctgatttagacactccagttatggattttcttctccttaaatatgaagcttgaaaaaaaaatagaactaccatttttgcacactcagtaagtactaagtgtcctattagatggttcctacccatgatttccaacctacaggttggactgttgtcaatcagacttccataaccatcttttaaaggaagcaggctcagagatgtgaagccatttgtccagttcccaagtgccagacctggaattggaatgtagatctgcctaattcacaggttttatacttcattatgctgaaggctagctgacagatggactgatttgccaaaattaggcaagaactggccgggtgcagtggctcactcctgtaatcccagcactttgggaggccgaggtggatggatcaggaggtcgagagatcgagaccaccctggccaacatggtgaaaccccggctccactaaaaatacaaaaattagctgggtgtggtggcatgcatctgtagtcccagctactcgggaggctgaggcaggagaatctcttgaacctgggaggcggaggttgcagtgagctgagattgcgcctctgcactccagcctggagacagagtgagattccgtcaaaaaaaagccaacaactaaaatgtttattcaagcagcaacatgatacccaggtaacaataacactgtggtcaaagcacatctctgctcctggaaatggaggcaacccatgtagcctacgagctctccactagtccattttctttctagactcttccttctctctgctctcaagtcagttactaaggctttatgctgtggtaaagctcattttgagtgttgtctgtctttctgtgcagcttctgttcttcctttttgcaaggcaagggcagcttaaggatgtgcaaacacagttttgctaaagccactcgcatgtctccggactgacccattttctgcatctagatcatacaagggctcgatcagaggatttaatgctcccaggatgcttttgagcatcggctgtattcttaattagatttttttttttttgtagactctgtcagtctgtgtctataaacagtaccttctggttttctgatgacatgatgaaaatataaatggattctgcagattgcattttattttcctcaatattaagcactcagagctggtgctggagggaattatggtcggataatgttgattaaataacctcagggctggacttctgtgctgtttctttgccaacacaaactgaatagatatagggaactattgttattaaagaaagtgtagcagtgtaactgccacaggaagaagagttgggcttcagaatgcagcatggtggggcggtgaagccctgggctgggtgaaaggagaactgagtctggactcatccttgctgctagctagttatatgaccttgagcaagtcacctgatttccaggacattattttcctcatctgtaaaatataggggttgtgcgtataacctgaactttagcataaagaaaggacatagatggatctctagaaagatccctggatgctgtgtgggaggtggcctgtggaatggctggagtggaagcagagagatccctcaggtggcaactgcagttgtctggctgagagatgatggagcctacactagtgtcatagcgtagagacagagagaaaaggacagacctgaaatatattttggggggagaatgttattcttcttggtggtttgaatgtatctctgtgttactcggggagggagatggtagtgctgttcattgatatggaggagaccagaggtggaacaggtcggagtagggaacagatgttaagactttggtattgatcttagtgtgaaatagttgttttttttttttttcttttgagactgagtctctctctgtcacccaggctggagtgcagtggtgcaatctcagctcactgcaacctcggtctcttgggttcaagcgattcttctgcctcagcctcctgaatagctgggattacaggtgtgtaccaccatggctggctaatttttgtatttttagtagagatggggtttcgccatgttggccaggctggtctccagcttctggcctaaagcaatctgcctgcctatgcgatctgcctgccttggcctcccaaagtgctgggattacaggtgtgagccactgtgcctggcctgaaatagttcttaggtacccaagtagagatgttgactaagaaattggatacttgattctggaccagaggtcagtactacatgtaaaaatgtgagttatcatcatctgtgagctgtagagagccataggattggatgcgactacccggggaaggaggtaggggtggtacagagagaagaaaagagatgcgaagagaggagaaaaacgcctgcaattacagctaggaagagaatgacatagaagtccctaaggctgtggaggaaggagtatttatggagaaaggagaaggaaatcaggaatgtctgctggtggggaagactgggagaggcaagggatccaaaatggagggagagggtgactgtcatgcttctgcgatgttacaatcaaatgagaaaaatgtcttttgggttagacagtatgacaatattagaatataagaggagagccaggaaagcgtggccttatttaagatcagggaggaagctgaaaaaaggactggaaagggagaaaccaagaatgagatccatggcaattttattattgctgccaataatgataatggaatgtcctgagctcttacaatggagcaggtaatataatctgggttttagagacattaatttatttattcttcatgcaaacctttggagtaggttccattagcatgtcttaattaggaaagctgagggttggtacaagttcattaattgcctaagatgatttagcttatgctggggggctgagaatataaggattttcagtgagttaaatgaggacagcttgcagatggctgagctatgatgatagggtaatgggtataggatactcatataggaagtttgggctgtgatgggaaggagaagaacaggatagtgattagagggctggatcgaatgagggtttttagggaaagaggaaactgccatgctatcactagagaaatgatggatgctgtgggtagaggggtaaggttgacatacaaaggcaggacctagggatgagaagggatagggcccagagccttaatggaggaacccagttcaggaaggagagaatgtatttctgccttttgagctggcaggataaaatgaaaagataggtgtggatatggcatgtttttggtggggggtgtggggccagggatggtggttctaaaggaaagtcttccccaatggtctctgtctcattgcaattccaaccatgagatcattggctatacataggagtgggagagtccacggagagataattaggagcaacaagcaaaatgtcattctggaagaatctctttagaggtaggaaattggtgggaaatagggaaattgattaccaaagaactcctccccttgctcccatcttctgggttgtctcttttgttctgggttcaggtgtaacccatagtgctggcacacaaggcccttccccatctcgaccatgcctactctggcacctcatcacctaccacccttctcatccccacctgccgggaaccctgtgctcaggtctttgaaagcttttggtctttgttcaaataaacctttgtacaggtctttgtatctgcctggagcgccctacttcatctccttccttgggaaattccttcttatctcaggaccaactcaaatgtcagccgctcaagggccttccctgactgtcttaggagagagagtttattcttcagccctcccataatattttgctcaaatgctgcaccaaagggtgcttaactgtgacatcaactctgtaggcacattccctgggttaaatccaggctctgttttttactagttttgagcccttgggcaagttacttaacctttctgtgcctggatttctttggctttaaaatagaagcaataatcaaacaccataaagttgttatgaggtttaaataaattaatgtgacaagcatttagaacagagagggcatattgtagttgtgatatgaatgtgagctcttatcattcagctatttcttcagttatgcaatttgtgttcattgcttcttccatgctcttgtaactctcttccattaatttattgaaaaccacacatcttttccatcaatctattgttttctaatgttttattttttccctggactgtgatttctacagggttgggaccagatcttgtcattttggtcttacaccttttacactgactgacataaaacaggaatttggtaaatgatcgattggttgatttctaattatggcttacatgagtgtgatccatcaatgtttacaaagcacttctgtagaattttgatttgattgtttctagcaatcccacaaagggtttattcctcagaaaatgtcaaaagtagataaattttgttctgctttatttcacaatttaggtataaaaatatgcagagatgttcttcttgtgaattaagtcaaatataaatcagaagagagtaagcataatgagctacagattatcttcagtgaactaatgaggtgtttgtaggaggaaatcacggtcttctgaaaagtgtgcctgcttttgtacaatttagggaatatattcatgtctttcaaaagttgccaaaatctgttaaatctagtattttgttccagttgcttgaatctaggcaccattatttcatcagccaacagaatctcctcttaagatcattataatagggtttgtcaacatttgtttaaactcttcttcagacagtttgtgagtggactgtagtttgtctaccagattgctttcaaaaaacaaccaaagattaatgaaaatatttctaaaataccttttataaaaatgggaacgatcaggctgcgagactgattcttggcagcctttgactttttatggcaattacataataacaatggttacaaagaaattagcagagtggagcatactcatatacagtgttttatatcacattgtaaacacactgtgaaaatgttgccataaagttgtgtggttttctttattagactgttttttttaaagtcccccatgtttcttatttggatggttcagagcagtgccattgacatagacaaacttagaaacataattaccttttagtcctgtggaaaggaaataggatacagatgagcttcctcaataattacttccataaaatagtgtgatgacacattaaaatctcctcttgcttctgcttttggtgtaactgctaaagcagatgaacacttttcttttcctttaaaatcatcaagattttggtgaattatccattcatggatagtgttaatcttcgtgtccctccaagaaatattttggttagtgaattaatcctaaagcacaaagcaagaaaactatgctattgggctttcttgaaaggcacacagggcatagttggtgacataattgccaccgtaagtacttctgagggtcccctttaatggagatatatatggaagtttattatgcccacctttaagacagtagtgtccaatagtttttgtccgtgcatgcccattagtttgtgtgtttctatgtttactcctttggttttatgttgctcaccattagggaactatgagaactttcacttaaccttgagtgagatggggagctatgggagtgggagcgagggtctgagtggaatggtagcatgatttaattttacaggattaccctggctgctggcttgagaatagatggaagggaggcaagggtagaagcagcaagaccagttaggagacccttgacctatgtaggtgtaagatgacagtggcttggaaaaagacaatagaatgcaggcagtgagaagcaatgattctggctaagttctgaagggagaatcaacaggatttgttgataggtgtggttaggtgtggaaagatagaggtcaagcataactcttaagattttggctaaacagctgcaaagatagagctgtaaggattaagtgatcaatgggcaaggatcaagaggatgagagagcaggatttgggggactgatgaagtgctcctgacattgcatgcagcttttcccctactggcccctgaatgcttctgaacctgggctctctcttcatcacttccatctcgggctctttttaagagctctgctaagcttcccgttctcctaagcttcccatcctgcccttgtgtctttggagagtgatcatgagctgatggtttgcccagtgccttgtctggaaagttactgagagtccttcgtcagtcaggatccaggtggcacagtaataagggaaggcagtcactttttatgtaccctgcaaatggactgttggtactggtggttgattcttggcagctgttttgctgtttatagcaatggcttatgctgtcatgaggggaacaggaattagcagtctttatagttagtatatagaatgtgtgatattgtaaacatattataaagatgttgctgagaggggtagttgagacaggccatcccaaatcctgactccagtggaaggtcttccctctgtggttctgaactgctggcttagtttagtatacgaggtgagggctttgtgaaatgtactgtgcataggaatcacatggggatctttttaagatgccagttatgatttagtagttcttagaggggatgggagcactaagaatctatgtctctttctttctttttttcttttttattttgagacagagacagagttttgctctgttgcccaggctggagtgcagtggtgtgatctcggctcactgcaacccctgcctcctgggttcaagtgattctcctccctcagcttcccaagtagctgggattacagatgcatgctaccacgcccagctgatatatatatatacacacacacacatacatacacacacacacacacacacacacatatatatatacacacgtacatatatatattgtatttttagtagagatggggtttcaccatgttggccaggctggtcttgaactcttgacctcgtgatccacccgcctcggactcccaaagtgctgggattacaggtgtgagccaccacgcccggccgagaatctgtgtttctaacatgaattgcaggtgaagatgctgctgctactggtctaagggccaaattttcagtggcttggtccttattgaatttctgcagtctgtacagctgttgatcctcctaacaaagatccaagtgcatctatcctaaatagatggaatggatggcatttgaatcggtggagagcagtgtgaagaccgtgctcggtcctaatgggcatgggagagggacaacagagagcagaggaggaggaacagaggtggaaactagcatcttcctgcaaacacatggtgcctattcccagaattgggtctaagaaattgaatttgatcagactacatcttgggggacttttgattagcagactgacttttagattattgtatcaacctctacttgaaaattttcagtggctatgcattacatactaagataattttaagtggtacatgaacaatttaggttgtatgtggggcaccaatttttttatattctttttttttttttttttttttttgagacggagtctcgctctgtcgcccaggctggagtgcagtggtgtgatctcggctcactgcaagctccacctcctgggttcacgccattctcctgcctccctagtagctgggactacaggcacctgccaccacgcccggctaattttttgtatttttagtagagacggggtttcaccgtgttagccaggatggtctcaatctcctgacctcctgatctgcccgccttggcctcccaaagtgctttttttttttttctatagattcttaatagttatgttatcttgtatttatcataagagtttagattgcttttctcagcaatcggtgagcttcctgcacacagtggccacagttcatctgtggttctgtctctagatactgctcatcatcattgctcaatacatggagaaaggcctaggtaaactgaaccagagattctgaaataaatgtagctaaactttgttgggctgtcaatgttggcactgttttcactagaacataatgcttttgacaaaaatgtaaagacgtatgaaaaaatgttttagaacctttccaatcacttcttggtgaacaaagttagtattatagagaggcttagtgatgtttccaaaatgtaaatcattctgacagatgacacatcagtggcagaaaaatcatggacagattctgggaaaaaaatgccaatatgtttaaagtctatgtttaaaatattagctttttaaatgggatctttcttaatttctttattttgggaaaactcgatattcataaactgttaagaatgactttttaaaattcattttcttaccctccctcaaataagaatgagaggatactaacaaaataattgtttgtaacattacatagtgggagtggttaatgagcatgttttatgatagaatttaaactttggtttataaggaaaaattgagaccatttagtttctttagattttttttgtaacaaaaagtcttgtttgatttttctgatggttaaagtaatatatattgtagaaagttttaggaaaatattgaaaaatttaaaaagtaaagtaaaagtcatatatgattccattgtgaagaaataccattttggcatattttctgtgtatgtgtcttataatatctgtctggtttcgatatcagggtaatactaacctattaaaatgaattgggaactattctttccttttcaattatctggaagagtttgtgtagaattgccttatttcttccttaaatatttgatatgtttattaggtaagccttctgggcctgacattttctttgtgagaagggtatctttctatgtctttgttgagtgaactatggctgttcgtgtcaagggatttatcaagttcatctaagttgacaaagttattggtacaaatttatttataatttttcttgttatccttttagtatctatagtatctgtaataatgtcattgctgtcattcttgatatcagtaatttctgccttctttcttttttgactaaaaacaaaagggttactaattttattggccaagagtttactaatgtagccaaaggtttctaaattttattgatctcacaaaaccccccaccagcttttggtttctttgatttttccctattgtttttcagttttgtatctgattgatttcactcctgagttttctccctttcttcacttaatttggccttattttgatgagataaagcacaattcattgatttgagatgatcttttctgatatgggcattttgggcatttctttaccctaaatattgccttagtgtctttccatacattttgatattgtcatattctttcactacaaaatacattgtaatttctttttgatttcttctttgatcagtgggttattaagaattatgttatttagtttaaaaatatttggggattttccagtgatatttctgttattagcttagaatttaattccattgcaatcagataacatattttgtatgaattcttttttttatttttttattttttaaatttatgtagttcattttatttccaagactatgagttatctagtgagagttacatgggcacttgaaaaaatatatatatagttgacccttgaacaatgcaaggttcagagcatcaactccccattcagtagaaaattcacgtgaaattttgagtccacaaaaactttactagcagtctactgttgatcagaagccttatcaataacatagtcaattaacaaatattgtatatgtcatatatattatatactgtactcttttaataaagtaagctagagaaaaaatgttattaaaaatcataagggacagaaaatctacttactattcattaaggggaagtggattatcataaaggtattcatcctcatcttcatatggggtagactgaggaggaggaggggttggtctcgctgtctcaggggtggcagagacagaagagatggagcaaatagaaagagaggcaggaaaggcaagcacactcagtgtcacttttaatccatgcgtaagtggacccacacagttcaaacctgtgttgttggagagtcagctgtaggctctgctgctatttttttttctttctttctccctttcttttttttttttttttaatttattgatcattcttgggtgtttctcagagagggggatgtggcagggtcataggataatagtggagagaaggtcagcagataaacatgagaacaaaggtctctggttttcctaggcagaggaccctgcagccttcggccctgtttgtgtccctgggtgcttgaggttagggagtggtgatgactcttaaggagcatgctgtcttcaagcatctgtttaacaaagcacatcttgcactgcccttaaaccatttaaccctgagttgacacagcacatgtttcagagagcacggggttgggggtaaggttatagattaacagcatcccaaggcagaataatttttcttggtacagaacaaaatggagtctcctatgtctacttcttcctacacagacacagtaacaatctgatctctctttcttttccccacatttcccccttttctttttgacaaaaccgccatcgttatcacggcccgttctcgatgatcgctgtctcttcggagctgttgggtacacttcccagatggggtggcctggcagaggcgctcctcacttcccagacagggcggccgggcagaggcacttctcacttcccagacggggcggccaggcagaggcgctcctcacttcccagacggggcggccgggcagaggcactcctcacttcccagacggggcggccgggcagaggtgctcctcacttcccagacggggcggctgggcagaggtgcacctcacttcccagacggggcggctgggcagaggtgcacctcacttcccagacagggtggtggccggacagaggcgctcctcacctcccagatggggcggctgggcagaggcgctccccacctcccagacggggcggccgggcagaggtgctccccacatcccagacgaagagtggccaggcagaggcgcccccaacttcccagatggggcggccgggcagaggcgctcctcacctcctagatgatgggtggctgggcagaggcgctccccacctcccagacggggcagccaggcagaggtgctcctcacctcccagacggggcagccgggcagaggtgcccacttccccgacagggcagccgggcagaggcgctccccacctcccagatgaagggcggccgggcagaggtgcccctcacttcctagatggggtggcgaccgggcagaggcgctcctcacttcccagacagagtggccaggcagaggggctcctcacatcccatactgggcggccgggtagaggcgctcctcacatcccagacgatgagcggtcaggcagagacgctcctcacttcctagatggggtggcgattgggcagaggtgctcctcacttcccagacggggcggccaggcagagacgctcctcacttcctagatggggtggcgattgggcagaggtgctcctcacttcccagatgggggcggccaggcagaggcgctcctcacttcccattcggggcagccgggcagaggcgctcctcacttcctcccagacggggcggccaggcagaagcgctcctcacttcccattcggggcagccgggcagaggcgctcctcacttcctcccagatggggcagccgggcagaggcactcctcacgtcccagacggggcggccgggcagaggggctcctcacatcccagacgatgggcggccaggcagagatgctgctcacttcctagacggggtggcgggcaggcagaggctgtaatcttagcactttgggaggccaaggcaggcggctgggaggtggaggttgtagccagccgagatcacgccactgcactccagcctgggcaacattgagcattgagtgagcgagactccgtctgcaatcctagcacctcaggaggccgaggcgggcagatcacccgaggccaggagctggagaccagtccggtcaacatggcgaaaccccgtctccaccaaaaatacaaaaaccagtcaggagtggcggtgtgtgcctggaatcccaggcactgggcaggccgaggcaggagaatcaccggagcccgaggcagggaggttgcagcgagccgagatcatggcagtacagtccaggctccgcaagagagggagaccgtagaaagagggagaggctccacaagagagggagcccagagggagaaggggagggggagggggagggggactttctccctttctttttggctcccatgaattcttttaagtgtattgagatttgcattctgactcagaatttggactgtcttcataaatgctcactgtgaacttaaaaaaatgtacattctgcagttttagggtggaatattctagaaatgtcatttaggtctatttggtagatagtgttggtcaagtcttctatagcgttattgatttttctctctacttgtcctgtcaattattgaagagagatatataaatctctgaatctatttgtggatatgtccatttctctgtatagttctatctgttttggcttgcatattttgaagctttttaattaggtgtatgaatgtttaggattcttgcatcttcctgattagtgaacctctttatcattatcaaatgattttatttctgttgttatttttcttctgaaagtttctttgtctgatatatagttatatcagactttcctggaaaaaaattatttcctaaacaatacagtgtaacaatgatttacatataaccatatatatatggttaatccagctttcttttgattagtgttatcatggtatatcttattttattcttttatttaacttttttgtgtctttatatttaaagtgcatttctgtagacagtacatagttgttggatcctgcttttttagccattctgacaatctctgtcttttaattggggatgtttaaaccatttatatttaaggtaagtattgacatggtcaggtttaagtctataatatattgtttttctatttgctccttctgttctttgttcccctctcccttttttgttgctttttaaattgttagtattttttatgatcaattttatctcctttcttggtttgttagctataactttattttgctattttagaggttgctttagggtttatagtcaagtcaggcttccgtatccatgagttctacatttgtgggttcaactaactgtggaccaaaaatattaaaaaaaaaaaaagcatctgtttttgttgtcattatttcctaaacaatacagtgtaacaactgtttatatagcatttatattatattatgcagtgtaatctggagatgattctatgtgtactggaagatgtgcataggttatatgcaaatactacacattttttatcagagacttgagcattcacagattttggtagccgagatgggttttgaaaccattcccccatggatattgagggatgcctgtatacttacctggtatattttaggtgctcaatacatatttcctgaatgaacacatgaacaaatgtctccctggtgcctaggccacagggctgctgagagccagaggcaccaagagtggctatcaatcctgtgctgtcagacaattattctttcccagcttttaattttttctcttttatgccatattattaatggatattggctttaatcttcccatcttgatgttagtcccttgagattagacatccatatcctcttctccctcagtccctggaggtttcagtaaataaggactttatcctcaggtgtgctttccccaggcttttttgaaagtgtgcatggggtggatcctctggatgaaagagactgtggccttgacttattgtgcccaaacccccaaaagtaagaaattcttgtcaggaagggtagatattgtttaaggtagtaaatagaaaaaaaggcttcaaagaaatggtctaaatttaactttagctgatctaggcaaagctacacatgggaaggaaattcaggcctaacagattttccccattcttggaatgccacccgtttttttcaagattattgaaaaaaaattatatatatataattatatatatacacacatacatatatatacacatacatatatatacatacgtacacatacacatacatatatacacatacatacatatacgtacatacacataaacatacatatatacacatacatagttatatatatgtacacacacatacacacacacatatatatatgattggacttcttgattaaaaaagaaaaacttatgtgctctttttcttttcttttttgcagcaagtaactggcagaagttttggtgataaagattttcggacaggtttagaaaatggaatcctcctctgcgagtaagtatagcctatattcagttggttttattcaaaaaacatcattaatactatccagtttggctgtaagacttctagtgttttgttttgaatttattcacagtttgaatctgaaactcaaaaaatccctgggctagacaagaaacacaagtcggtgtgggagccttggtgtgccagtagggagtggtggggactgtggcaattgcaaacaagacagagaaagagcatctggtagctgctgttcagctccaataatctttcactgtgcatcaatttgagcccatgtaattgtaagggtggacctaattgtggtaaaagtaaaacttttctccccttttaaatcccaaacaaaagcagcttgtgccaaaataaaacagtgcttctatatacttacaacatcttaaaacatgccgggtaatgctcctcactttgcctgtttcactggtgtatttcaaatatgtttaatctgtgctgttggcaaaatttaaatgtgaacaataactacagtgtttaatttttgtgttttaaagaattcagggctcctgtgaagtagctctagctacaaaataagcagagccttcgtacttataaagacatatatttcaagatttatggatagacgtaaatttcaagatttcaaaatttgcatttatttaacaggttttgtgatttcaatactgatttttgttttattgaggtgaaatgtacatacaatgaaacacacagctcctaactgtacaatctaatgggtattgaaagatgtgtacatgtatgtaacctaatcaagatatgaaacaaaaagtttcctcatgccccttctcactcaatctcaagcccctggagacaagcactgttctgatctctgtcacagtagcatctattttgccttctcttatacttgatttcagtggaatcacatagaataaactcctgtttttggcaactttcagaatattgcttgggatccaatgatgacacggaaggaatgtgggtttggagcctgtggactagagattgatgttcttactttacccctaaatcatttaatcaccccaagtctcatttttttctaaaatcataataaaaaatgtataactctattttgtaggctttttatgagcttcaaaaggatagagtgagtgaggcactttcaaagattatgcagcactgtacaaatgttgactattttgttgaacctctcaacacagctcctgtcagcatttttttctgcctccccactgctcttctttcttcaaagaaaaatgtgtatcttctatttgatgtttccatattctctttcctacgaagtctctccaccctactcgtgtatccctcaccacctcttttctcattattacatttaaatcagagcttaactcttaggtaagctgcagttacttcagtggatgcaagctcagtggatgcaagccagtcaggctctgaactctttctctctgttctaccacttgcttttcccatgattctgggcttagccctctcctgatattaacagactagccaaaatctgatctaattcatgcagaccatgttggttcaattgaagtgggtctttggtccaatttttgtttacctaacatttgctccagagattcttgtaggcatccacttctccactatattctcatgcccaggtaggtaggatgaaattgtctaagtcctctaatcacaggggattagacccactggtgtatttgaaggagcacgagctttggagtctgaggactagggatcaagctctcgtttccccagtgggactctagctagcaggcccagcaaagagtttgctaaagtggaatgaaccacataggaggccagaggcaaggaaagccagtagcgtgaacctctgctaggtccttcaagagaaagctgggtcaggagccagagaaaccaaatgcacacaaatttctaggcatggaacttgcagagcaatgagaaccaaaaccatgacccaggagctgcatgcaatggtgactggggacaggggaggaagagttttcttcctcacccttatggctaggttttgtgtaagttgagactattaggctgctacagactgagattagcaggtgtattttctgggacttgtatcccaaggccaatctagcaaaaagggggacttgctctgttgaaaatgtgggatcgtttgatggtgggggccaaaagctggaacactcagcatggaggattttagaagttgaaggctcccagacagtggagccacacaggtgtcaaacacctgtctttggagattagattagaatgcctaagactgtaccactctctagaactggagagagtttagtggatgccagtgattaggagtctaattcatagctaccccacaccacagaaacattaagaaatatgaggactctctacaatttcaaattttgaaaactaagcagtttggctcttcttagaattgggctttttatagtatataggctttaaaaaattatttgatgctttccagttttgtgttattcaaaatagaagcccagttggtatcttggaacagtgttatcccagttggcaaatacatgagcagcattgttgaattctttcttttgttcaacaaatgctcatctttttgtctgagttgaatccactctaaatgttagtagcaactgtgtagagacaccagcatctttgttcactaaaaatttcctgagttgttgtaggagtctaaagaaaaaaaaaaaagcttcatcattttcatcaaacagaaggataccttctggtcctggggtctggtttcccctgaccagcctggtttcaaacttagctgtggtctctaaggaatattattatacctattttacagagaaagtaactgaggtacaaaggattaaataacttggctaagatcatacagataaaaagtatttaagtttggccgggcacggtggctcacgcctgtaatcccagcactttgggaggcaggggcagatgggtcacctgaggtcaggagttcaagaccagcctggtcaacatggtgaaatcccatctgtactaaaaatacaaaaaattagctgggcttggtggcggatgcctgtaatcccagctactcgggaggctgaagcaggagaattgcttgaacctgggaggcggaggttgcagtgagctgggatcgtgctactgtactccagcctgggcaacaagagcgaaacttcgtctcaaaaaaaaaaaaaattaagtttaggaggtctgatcccttagctcttgctcttaatcactgccctgttctagaattgggattttaatgggagagaaaagaaagagattggcaggtggagagaggagagggcattagtgcctgcagacctaagtttggggaaggtggcagtgcagagggtgaaccactgagtctcagctgggcagaggacaaagaaggactgcatgtggttggtggtcttagaaaaatgtaagcatcaagggcctggtggttccacttgggctaagaaggcagcgtcaataaaagtgagggcaagagagctgaaagggtcggaggctgtggtcagtggaggatgtaggagtttcagtttttgatagagcagtcaagaccagatggagacaaacgagaatagtggacctggattaaagactacagagacaggagagagaaaagacgagcacctacatacagcatgtacgatggaaatggaataccctcaaaatcaccctgggacatctcttactccatatggctttgaatatgcaactcctatgccggaatactaatacataaatgtataacttagagtaatagcaagtataaaatagagtgcctgtgcccagtggaatggcagtagatgtgtttttgccatactcatgtctctcttcctctgttgtttttgccaagtgtgtgtgtagttgaagtttcagaggttaaatgcttaaatggtgtgaaccctcttctgagtatttaataagaggctggggtcaaagtgtgacagagccacaaatatgtgacaaatgttatgctgttagaaatatcaatcatatacggcacagtgtccttgatgacttacgagtcaaaaaggagggctgcagagagttagtctttaaagaagctactcccaggttggagtcattagcagatgatattctctacttccctgcacatacaccggcctgttttgaaataactccagaaaagaaactttctgacttgtgttcctgactctgattttattatttagataagagtctataggatcaggggctggcaaattatggcccttggcctttttttttttttaactggccttcttgctaagaatgtgttttatgtttttaaaggattgtaaaccaaactaaattaaacaagagtctatatgtggctcacaaagcctaaagtgtttactatctggtcctttacagagaaactttgccagttctaaaggactgtggaattaattttagatgtaaattgtttatccttgtaaagttaagaaattgagtttgggcagtgcaaaatgctatttgggtaaattaaataacattttacaaaaggttttcccaggagtctctttacaagttttctcccccacctttttattttggacaatttcaaatttatagaaaagttacaagaataatataataaatatccatataccctgcacctcactatactaattattatcattttgccatatttgctttatctcttcatgtgtatatatgcctctttttccctgaaccatttgaatgtaagatgcaaacatcatgaaacttgactcctaaatgttgcagggtggatcttgtaaatataggaacattatcctccgtaaccattcaaggcatttagcaataatatagtaacgtttaaagcatagtccagaattaaatgttgctagtatccccagtaatatcctttatactgattttttaaaaatctaggatctggccgggagcgatggctcacgcctataattctagcactttggaagggcaaggtggggggatcatgaggtcaagagatcgagtccatcctggccaacatggcaaaaccctgtctctactaaaaatacaaaaattagctgggcgtggtggcgcatgcctctagtcccagctactcgggaggctgaggcaggagaatctcttgaacccgggaggcggagattgcagtgagctgagattgtgccactgcactctagcctggcaacagaacaagactccatctcaaaaaagaaaaaaaaaatctaagatctaatcaaaggtcacacattgcatttggttaccatgcctctttagcttccctaaacctagaacaatccatctagtcttttgtgtctttcatgacattaacatgtttgaagattccagaccagctattttgtagaatatatctcacatttggatttttctaatttcttcctcatggttaaatccaggttagacagttatagcaagaccacgtgggtgatgttcttggcatgggacatagtagggtttgtcccattgctggtaatgttatgagtgataattggtcaaggtgatgtccccaagatttatgcattgttaatatgccttttctattttgtcatctgtgaaagatactcaagttgtggaaataacttgatatccccagatctttcatccaatggctttagtatctattgatgatactttcctgaatcagtcattacactgagagttgcacaatggtgactttctaattctgttctttctacatttgttagctgtcattcttgtgtctttttgaagaaaagagcttttctccctcctctttttgagtatcaccaatccattggcatccatacttttacattacccttaatcgctaaaaaattctctatagataacgaatgaggtaagtgataatagcaggcctgttttacaaatacaaccagaatatagaacatctaagattttaaagtcagtccactgaaaaaagattttagagcttttgtgttcatataggtagatggttcatatttctgtttgcttttatattattttccaattcttgctttatcttagtgttcacctttggcaaggtcagatgtcctgccctggccaatgttcggacagaatcaccaatatgactatgttgggcacacctgcccaaggaaggagcttccagtgaagacttaagagacagacaggcactagaagagtataaccatcaagggcctggtagtcccacttgggttaagaaggcaggttcaatacaagtgagggcatgagagagctgaaaggttaggaggctggggtcagtggaggatggaggggtttcagttttcgatagagtggttgagaccagatggagacaaatgagagaggtggacctggactaaagactacagaggcagaagagagaaaaaactagcatctacaggcagcatgaatgatggaaactgaggatcatcaaaatcaccccgggagatgacatatttcagcatgggggctccgggtgaggtcactggggagttcaggtaagaactctgcacaagaaagaccattaatggccactgtgattttctttaacccctgagaaaagtacagaccacacatgagttagttctacagggaaccttcaatatttttaagttagttatagtaaagattatttctttgaaagcatagatatatgtggatgagaaagagcctgctagtggcttaccattttctatctgatctgaagcattcactgcaagaaccttaaggaaatgaattcttaagtgttttagaatctcatgtcttttgaccagagctgtatgaaagacatatttctatttgtgaacatgaagtggtgtaattggcttagaaggccgaaaagattccctcactttttggtattgcttgatgctgaaatcaagaattgataagccttgtagagataagtcatctagtcgccacatcaaaaggagacagaggtattccagcccttcttttgtttcttctgctctcatgttgcctgtttagggataattctatgaaatatttcagtttttttggtggggtcattctagagaagggacaggcttccttatattttgtctctaaagtataaatgaaagtaactggaaaatacccttttcctggtgatgaggcacaattactgaattatagaaaacaatagaagacaaattaattcccttgtccactgtattaaatctttagtgggaatcttaatttagaatcaggaaggcgggtttaaaatcaatggcattttcactctcatctcccggtgtagaatcctttttttttttttttttttttttttttttaaaaaaaaccttcaatttttattttaagttccagggtacgtgtgcaggatatgcaggtttgttacataggtaaatgtgtgccatggtggtttgctgcatagatcaacccatcacccaggtattaagcccagcatccatgagctattcttcctgatgctctccctcccccaatgacttccccctgccacactgacaggccccagtgtgtgttgttccccctattgtccatgtggtctcatcattcagctcccccttataagtgagaagatgtggtgtttggttttctgttcttgagttagtttgttgaggattatggcttccagctccatccatgtctctgcaaaggatataatttcattcctttttatggctgcatagtattccatggtgtatctgtaccacattttctttatccagtctatcactgatgggcatttggattgattccattcttcgctattgtgaatagtgctgcaatgaacatatgcgtgcctgtatctttataatagaatgatttatattcctttgggtatatacccagtaatgggatcgctgggtcaaatgatatttctgcttctagatctctgaggaatcgccacactatctaccacagtagttgaactaatctacgttcccaccaacagtgtaaagcattcctttttctctgcaacctcaccagcatctattgtttgactttttaataatcactattctgactggcgtgagacgatatctcattgtggttttgatttgcatttctctaatcatccgtgatgttgagctttttttcatactggtatagaattcttttttcactttcctcatttcctacttgtagagatgtgtcaaaatgagttaggtctacatttaaagatgaggtttttttggtggtcgggttgggggttgagttgaagtttgctagtgagaatttttgttgttgtcagtgatagaaatgcaactgaaaccagtttaaacaaaaatgggatgtgattggtttatgtgaataagcacggaggtaaatcacacacacacacacacacacacacacacaccccaggtacagacataactatataaccatgcttgaattgtgttatctgactggtctgtctgtccatccatccatccatccatccatccatccatccatccatccatccatctcttgcctctgctttcttctttattgactttgtctttgggtaagttttcccatatggtgacaaagttggctactattagcttttagcttatattttactagctttgcaatcccagcaggaaaaaagagatacttttttggagtaattccagtagaagtcctggtgcctgccctttattgacgtgaattgggcctggtgctcatctcggaattaaccgaatggccaggtctggatttgcccttgcttggagccaggacgtagcatgggcgctctccacagtctgccctaccctacaactgccctactattcctggagagttggggaggaaagttgctcaagtggaaattaagaagctgttatcaaagaagaaggaatgactattagaccaacaaaaccaatacaggcccgctgagggactcttccatccaaccaggacagacagcctttggaacttctagtggagaaaaggtgagcttaagagtggtgtgaaaggtttattaggtctctttgaggccttggttagacttacataggggtgtgttcagagaaggatgctttggagggacttacgttttcagacctgtcctgtcaggagtccattcctttatccctatcctctctaaactatggagtgagttaccttggtgaggtaaaactgaggccaccaaaatctatagatcactccttccttgggagtgttgccggagaaaagcctctctcctgagaagcaggctttgtcctctaccagtcggttccctcagccctcaagtgataactgcccttgctctgagcttcctcccagcctttttacctccctctctaggggtttgggctgatgcttccaggagctgccatttttctgatgtggctgccacgtttcccaactcttctgcctccgagcacttggagttgcgagagagacctctctcccaatgacagctctttgagcaaatcttagacaggtgatcctctgagtagtctgtactttctccttttaatttatagtaccccctactgaataacttggcaccaattctctgagagtggacaggagaccttggagctatccagttcagtttctcctcacaaccatttgctgtctcctagaataaggcccctccattttcagctctgtccaacctcagggtctgtctctgcatacttcagacctttctttccaggggttggggttaatgtttgcttccctggcattagtcctgatatctcttcattctgagtttcctagtgtttctttaaccatttcttccaggaggtctaggggagccccagtcaatgggatccctgtggagctgttcaaacatcctaggtaggttttgaaattgatgagctcctgtgtctccacagggatgctattgatgtcatcagaacaattcctttttgcatctgagcagttccactcattgcagataattcacctcctctgccctgctcacttcaagccagtggtgcttcccactcgtgggagcaaccccatactcaccttcagattcccaaatgctccctggcaatggcagtatgcagatactcttcatggctatttgtagcttgcgcatagagaaatgcaaagccaagtttcagtgagtgtatgactgtgtttattttcttaccttgattcttactgatatgctctcccttattctctggtttgcttatcattttccccactcctttcttccatttttgttactatctaaggacatatatttaacaaaagccagttcaaacccttttatgagagagtatagtggaaagtgaatggattttggaattccttcattaaatcctatgaaattgtgtcaatagaccaaaaaatagtcagataatgtgatttcctagggttcaacctagtagatggagcagatcctagatttgcctcctgtgtatccttaggctagtaacctaacctctttgagtcccccagtttacttttatctataaaaacagatcataattgtaaaaatccatataggattgttctgaggataaaatgaattgaaaatatgtataaaattctttgttcagtgtttggaacatagcaggcacttaaatgttaactttcccccgttcgtctatgtaacagagaaattactacttcttgaggtttctaggagattccagtgagagaatacagtcaagcactcagcatagcatctggcacttgcttggcaccctgtaccactggctgttcttattattgtttttggaaatagtccaaaagtcaattatgaatatgacatagtcattgcaactctgtgtcactgtgcacccagtggctcgctcccttgggctgccagcaagccacgggatgaaggcatttggattatactttctagcttctctcatctagcttgtgatcaaaaactgggcaagaaaatttgggtcccttacaaacttgatcatgtgtgaataatgaactttggctggcagagcttggggactagagtgattgttttgaaaacaataaccctgacctctgtggtgatgtcattttctcccatccatccagtctgttgtggttttcttctctgggaagctgttccagaaccttctaggcagtgttaataggttcttgtctggctgctaagtacccatacacaactccactttagtgctattatagagctctacctctttgtcccatctttgtaccggattgagagctttcttgaagaccctttgtctttgtatttcactcattggacactggtgtagcaaataatccatctatagaaacacttggtgaatagattgagaccaagttataagatttctacctaggccacctgatcatcaatgactgcctttaactttctcccagtcttagtcagtattattctctctctctgtgtttctgacacacacacacacacacacacacacacacacacacacacacactttgtataaacaacagacccatccctaaagactgggagaccaaaggatggatgtatttgctttcttcaagtgtaagattctctattacaaattccatcttcctaggagtcatagaactgaacttaaaagttttgttttgcaaacgtattgtcatgaaatgaaagtgtgagtatgttaatctacaaataagtgaccaataaagaatgtcttagtggatttttgtctcagttcctgtgttgctgaaatgattttccaaagataagaaatctgttggcaaacacttattctatcatcactgataaatgagctgcttgtcagaaggaggtctggccttagattcttgtcatgatttcagcatgagatgtggtgtgtcacggatgtgtcctagtcttgtaggacaggttgagggttgatggtgtaactttgtgtggagacattttatcacatggaggaattgttggctatcgaccatgtgctgcatagcaccaaattaggcaccaagaggcataaaaacagaatgtaagacatgatcttcaaaagttttatgatgtgcttggggactggacccacacacacagagcagttaagttacagtgtaaaccagtgtacgagtaaatgtaaaaccaacaaagatttaatctccaagatttaataagaggttaaatgaggatactgttatgacttgggagacagttaattggggagatataatattaattgactattaagaataggttgagggaaagggaaaatcatctttatagagaaaaacaagtagttttttctttctttatactttcataacactctggtcacaaaaatgtgtggtttttatccctcataatgaccaattctccaataccagctggttatcttaaagtttaacttaatctcgacactaactggagataatacagactacacaggttaagggctcagtcccacaagactgcccccacccctcatttagatgccagttgcaaataacaggtcctcaggtgatccacaacttctgtccacttggctacaaattggaggctctcatggcctccttcttgggtttgaatatttatcagaatggctcacagaactccggggtacatccgtgtatttatggatttattctaaaggatctgataaagggtacacatgaacagccaaatggaagatgcagaggggaaggcgtggggccaagggaatagggttttcatccctttcttgttggtccatcctcccagcacctccacacgcccagcaacccagtatatcttcagactcttgaaacagagggattgaaaccgggatttttatggaggctttgtcacttaggcatgattggttgttaattccatttccagcctctctccccttcctggaggatgggagtggggctagaagttccaagcttctaatcgtagcttggtctttctggtaaccagcctccatctaggagcctaccaagagtcacctcattagagcaaaagacactcctatcacccaggaaattccaagggattaggagttctgcgtcagcaactggggtcagagactaaatatcagagtaaaaaaatgcacctagcattcctattgctcaggaaattacaaggattttagggactctgtgccaggagctggggatgaagaccaaaatatggatttcttaatataattcacagtatcacagcatcctacacagggacaaaggcaggagggaaggtttggagtcaggaatgagtaggctgtgtttggcacatatagaggataggtgcctgaaagggcaaggacatctcttcctttatccaactgacctttataggaacccacttatgagtgtggtaagttactgtaaagatgaatgcattatgcaatcaaatcatgtaatggtggtggtgggaggggggcgggcagctgatttgagatctaaatcctgactgtgtgggatataaatctcagattcccttcaagaagcacatttaggtggagacctgaacgaagaggagaaattattctcttctaccaggaaagaggaaagggaaatgaaagttgagaagaaacatactctagggctgaaagaataacatgattgaaaactctacgactggaacaagctctgtgtcttggaggaattgcaggtagacttgtttggccaaaaggtagaaaaccagtggggcaatggtatgagatcagtgtggatggagagaagtagtgggggcaagattgtgcagggccttgcaagccatataaggatttggtggtttgattcccaagagcaatggaaatgaagaggattttgaagaaatcagcagcacctggtagagtatagtgatgaatgaaagaaaagacaaaaaataattttggtgtttcagttgagtggggtcctgatacaagccagaaaggctcctctgtttgttggagaggtcatggttttagtttgggcaggatgagttcgggatatggacaagccacccaggaccagagtcctgtaggctgttggggatgagggcctggctcttagaggtgagacgatgcattcaacttgctcaagttggatttgtgagccattgtcggacatcagggttaagctatgagatatggaagcctctctgagggaaaggccacattaggaaagagccgcagaaggaggtctcagtttgaggaagtgtctcccctgggtcatgggtgggagaaagagaagctcacaaaagagctatcagagagatgagaggaaacccaggagactgtgaggtcatggaaaccaagagggctaagaagacttttaagaaggtggaggtgacttgtattgtatgtccccagtagatatcagtttgagcaaaacctcagaaaaggcctgccttgcttgcagaaggaaggactggagacttttaacaattaatatgtatctctgggaactgccagtcaactgatcatgattccacctaactgttttaggtctagctcatgtttgtgtatcattccaacagctattgttagagaccttgtgtaatataaagtacacatgcaatcattttctgaaacattggtaaagagatgagattagtatgacccaatggctgattagtagagcaacaatacaacctgtcattcaaactgagacactgttcagagcgaaagggggtattaaccagatgagatgctggaacaagtggaagctgggactgacctcagctaactgggatatatggtcaccccagttattgatgactttagactggtccctactggtcaccattgctttgttcagtattcacaaaccaatcccttatttagtcctcagagcaaccccagtgaacctagatcttccaacccctcttctgtagatgattagatggagacccgaggtggtagggcacaatgtgtctttgcactctttgtctagagctctctctctaacccagatgctcgctccaatctcagcaaacttgggtcctttttccattactgattttggccttagcagactgggaagaatttgatagactttctatgtagggttctcccttgtccttctgccaaatcacaattggccacgctgacttggcctgtctccagctgtttggcaccaagactcattaagcctttaagttcaagtgaggacatttcaacccgctccttttctgaaaaagatctccagtgaaaaagctgctttttgtttgaagattggcctggcttaggtgggggcttaggcaagaattgagtatccccaacaggcttctgttagaaagatgaaaacagatggagaacatggaaggtgaatatgcaggactcatggtgagcagaatgagcccccagtgttgcctctttttttgaatcctcaccaaataaatagcccttggctcctactcaaaagagggactcagcacagtaggggtactgtctccattcaaactgttctttggacatcaattacaaagtctactctgggagctcttgtgtgcacttgagcatcttgcctttggaatattctcaagctcatccatctttgtaaatattctgttcattaaaaattatacgatccttgtcacttcctttctcctaatacatagtcttatatgacccagacccagtagggcatttacagagtttgttttgaagcttcctagaaatgtgtttgaaacttattttagcagaattgtcacttggaaccacttccctcaacatgtggcaattccctcatcctattaatctgctccttaataaatattaaaattctcctgacttgaatctcaggctaatctttctcctcctgaacaaatttttgacagatttttaagaatgatcaattaatttaagaaaatataacaactggtttaaatgtggactgctcatgtggtagatgagaaactggcctagcccattgcctgcctgtggggttacatgctggattaggctttgcttagatttaagaggatttagtagctctaattgtatttccttaataatccattttttgattgtctctaatgggctgtcaggcttggtgggctggcttcccatgatgaagtgtgcaaaatctctgcctcacctgttctgaatgttccctttggttactcgaaggagtggactttttcttaaatagcctactaaggacccagtttataaatgattttttttttttgagatggagtttcattcttgtcgcctaggctggagtgcactggcacgatctcggcttgctgcaacctctgcctcccgggttcaagtgattctgctgcctcagcctcccgagtagctgggattacaggcgtctgccaccatgcctggctaatttttgtatttttagtagagacggagtttcgccatgttgggcaggctggtctcgaactcctgccctcaggtgatccgcccacctcggcctcccaaagtgctgggattaaaggtgtgagccaccgcacccgaccaaatgatttctttaaaaagttaactatgaagaaatagacttccttcttggtatcaagaggaagaaagagtgaataaaaagaaaaagtgaagactgtatatctgagtgattagctctagtgcttgcccttccttaagccactgtagactctgctgggaggctaacattcccaaacatggcttcatcgtgactggtggcctcttcccagaagacggggtgtgattcaagttcctttgcctagaacgtggtgtccctctgtctgggtgcaatgattctattcaactcatcagccctgtccatttgcactggtcacagaggttgatctattattgttcctacaattctctttgtgcttccctgctttgtatctttcttgcatttgcttctagctacctgcagtgctgtattccctgtccatttccatcttcttaaatcccaaacaaacgcaatgggcacctttccctccaccacaacatccccagtgctgcaacctgaattcagtcctctgagcacccatcgctgtgacagccatacatcccgaagtggagatgacaaccctgatttcaactgctgtctccctcatttcttgtttgaaggagaaattttggctgtgcctagagcaagtcatttgtctcacacatggcactactcatgaagttggatattttaactttctattagatgataaattccttgaagtactgacagcgactcacccatctttgtatgcctaatggtgcttgcacatggcaggcatgtagtaagcttttgaagggaggacgggaagaagaaagattattttaaaattaatacttttgaaattattgatatgtttataactaaccagtaaatttgtgtagtaaaatgctacaattttaactcagaatggatcatagacataaatgtaagtgctaaacctacaaaactcttagaataaaacatggcagtaaatctttgtgaccttggattaggcaatcattttttatatataacatcaaaaatacaagtgacaagaaaaaataaataaactggactatatcaaaattaaaaacttttgtcctgcaaatgatatcatctctcaacccacagaatgggaaaaaatatttgcaaatcatatatctgataagaggcttgtatccaaaatatataaagagctcttataactcaataataaaaagataacccaatttaaaaatggacaaaatatcggaatagacacttctccaaagaagctacaaaaatgactagtaagtacataaaaaagatgttcaacgttgttagtcttgagagaaatgcaaatcaaatccacaatgaaataccacttcacacctactaggatggctataataaaaaaggaagacagtaagaagtgtggcatgatgtggagaaatgagaactttcatgcattacttgcagggttgcaaaatgacacagccattttggaaaacagtttggcagttcctcaaaaggttaaacattaagttaccatatgacccagctgttatactcctaagtacatacccaagagaaatgaaaacacacatccacacaaaatcttgtactcaaatgttcatagcagcattattcataatagccaaaaggtggaaacacccaaatgtccacagagtgatgaatggatagatcaaatgtggtatatccttgcaatgcaatattatttggctataaaaaggaataaagcattgatgcatgctacaacatggatgaaccttaaaagcatgttaaatgaaagaaaccagtcataaaagactacacattatataatttcatttatataaatgttctgaataggcaaatctatagagacagaaggcaaattagtggttgtttggggctgggggttgtgggtgagtaagaggggaagtgaaaactaatggatttggggcttctgctagtggaagggaaactaaaattagtttgtagtgatggttgcataatcctgtgaatgtacaaaaatattgaattctacattttcagtgggtaaactatgtgaattgtatctcaagtcattaaaacacaaacacatacacacacaatgggatttaaatttttggcttcaagatgtttaaaaagtcatctagaaatctcattccaaatatcatttagttcatttctgatgtgctagtatcatattgtaaagtgctgctcatattttagaacatcattgaagagaatgtttcatagattgatatttatattgtctacttcaaaagagatataaagaaaattacaaaaataaaactaaaaaaggcacattcattaagatcagaaatagtaacatcagacaaagaaaggccatggaatggaagaatgagaagatgttattacttaaatactacatggcttttgcatcacttaaaactcttcttctgccacagatgaaaaggcgttgcttgctgtttgatgattttcctgccagagcctctggcctcaagaatgtattccccagtcctctgaataaagctgcattttgtatttctgctgcacgcccagtaaaggagaataatgtgtgttgcccaaggggagatggccatattgttttctccttgccccatttgtgtatccggtggtacataaaaaaagaaggacccagagattttactgcttcctttggagccaactcctaactcttctttagagaggaacagggggactccactcattcccatcccctctttcacaaaccaacaggaacttcatgcagtaatgactggcaggaaggaactaaaagcctgtccgatgatcctttccctggtgtggttgcttgaatccaactttagtcttggtcctgagagaatgattcatatatgattaatgggccaggcatggtgcctcatgcctgtaatcccagcactttgggaggccaaggcgggcggatcacctgaagtcaggagttcaagaccagcctggtcaacatggcaaaaccccatttctactaaaaaatatgaaaagtagccaggtgtggtggtgcatgcctgtaatcccagctacttgggagactgaggcagaagaatcgcttgtacttgggaggtggaggttccggtgagcggagatcgtgccactgtactccagcctgggtgatagagagagactccgtcttaaaaaaaaaaaaaaaaaaaaaaaaaaaaaaaaaaaaaaaaaattattaacgacaacaaaagttgtaaatcgttagcaggtctaaagtccgtgatagttccaaaactgatgttttgagtccttcccaatactttataatgttgctcatttcattaacaattcactcaacaaacaaaaattgaggccctaacaaggactggcccttacactagagctagagttacagagaggactaaccctttgcctgatgaagaagccagatagtttctgtgatgtgtgataaatagggaagccaaagagtgttgggacccagaggtggaaggtacagtctctacttaaatggttcggtgaggaggtaacatttaaactgggttttgaaggatgagtaggagtttgttaggccacaaaggagtgagaggaggcctgtgggaaaggcagttcaggggaggaagcagtaagcatgtgaaagtgcctagctatatgaagagactttgtatgctcagggacaaaggctaggacaagtgcaaggtggggcagactagaggtgagaggtaggtatcaagtcagtttgtgaacaatcttgaatagcatggtaaggactttaaacagcatccagtgagcaataggcagccagcacagtctctatacagaagagcaatgggtttgctttttaggcaattacctctggtggcaatggagacttttgattgctttctgctgtgccccaaatacaaataggtgaataaaacaccacgcctcccaaggagcagcagaaatccttactgcacctatcttgctatgcctgtccttagtttacatccttactatgcacatgtacgtctcagaggttctcttccaagttacttgtttagaacttggaagttatttccctatagaagcagttcgcttcacaaagtcttatgtaacccaaaccacatctgagattgtgtcagccccactgttgaacccggcttcttgagtgtgtctgggcttagctggtgtggggtaaacttttgatgacaagatgtggaatgaataggaagtagattcagaattctcatggccacattaggagcagactcccctttctctgtagctgttggcttgtcctcgtcatcctcaggacggcaagtgaggctggggagatgggagccttgaaaagagttaaagcccaattttggcagaaagcagggctggagccagctgtggctgcggtgatcacgcagccgggtctgtctttagagcttctttctgcctttcctttgtcggcatcctcccttccttcctccgcgtccccagcttttctattgccttccgcctgtccagagactacgcctatggaggcctgtccttcagaaggattggcattgtctcgttccctcactgctgttctttcattgcttctaacctagccttagccacaggcaggattctcaggaggagaagtgagccagtgatcaacacagccaattttcaccagtgggagggctgcattgaaatctgcttggagaagatggtaataatgccggccattgatgaagtgtatattgtacaccgggcctgtgccaagtgcattacatgcattgttttacttattccacatcctcaagctatgactagcaggtatttttgtcaccatttgaaagaggaggaaactgaggctcgtggatgtcaaatgcgtaaataacttgtctagtgagttacagggctatgatttgaacccaggtctttctgtctctggagcttcctgctgctcttggaattttatggatcccaatcctggaactctttgttctgagaacttcttgctaaagaagagttgggagctggctgtgtattccaccccaagactggatacagaaatcttcagagctgcatcacagcaatttcaccctctgagttttctctccacgctcttgatagcaaacccagcaataactgggttttagctgcgcaaaggaaatactaattacaatcatttaaacataattactacatagcacaatgatgattgcatgtatcactccctgtgtcagagtaactttagtctccattttatgtagttatactaagttcttttcgtgtgttggcagctttcacggttcattgatcatatgtttcatcctaagcttgtagcttataaaagcagggagagtcttgagtgggaaaggcaatttgggggtgattgggcttgattaccaggtgaaggcatttggagggcatcctgtggcacttgggagcctggaagtccttggaagagggaaggatcccggccagagccaggttttagcagtggtcagttggagtgcagtttgggtgcagtgggcctgtggattaggatggcagagactggtggctggagattatctgtagaaatgcaaaaagtgaagcatcatagaaaagcactctcttcagatttagaaacccaagtttataatcccaaatctaccgcttaggagctctgacctcagacatgtgccttcacctcccggggacagttcctttactccttatctagattatttgatttgatttttatgccttttctagtttccaaagtccataatttccagacagcaggaatagttatgcaaagaacagactgtaaaagatattggaaatggatcaaagcactctgaacatattcaaataattgctgtctgttccttcccatgcttacagtatagatgattttattagtgttagtgttttagtattaagagggatgtgataggcaagaagaggttttatttttccccctagaaaatgtgggaaaataaaaattggtccatttgtttacagtatcccaaatgttagctcttcttccttctgctgccatcccagcaagatccggagggaagtatgtgcccaggtgttaaacttcacattctggaacaggattttcttgggtacagtttgcctgggtattggagaaaggcctcctgcagagatataacagtcaagatagtgctaggtgctgtaagtaataaacccctaaatctcagtggtgtaacactgtggaaatgtatttccactcttgtatggcctaatgttggcaacagggaaggatggagacaactctgctttaggcagttatttagggacaccagctaatagagactccatcttcaacatacaacttccgaggacttccgggtgtcaacatctaactagtaaatgtggaggagagagaatggagaattgtttgagagggtttttagggccaggcctgcatgtgatagaataacttctgcctgtgcttcattggccagcactctattatatagccacagcaaattgcaaaggaggctgggcaataaagtccagtgtgtgcccgagacagcaggaagataagaatggtaagcagtctctgccacaggtgctgtattacagtactgatagcactgctgagccctagaaatacacggggtcaggctcaacttcttggaattccaaatctacaaaaaccttctaaagctcctatgatctcttcttaggtgtgctccaggcaagtggcttaagtgtgacctatatttcacacattctgaaccgtgcatagcatcccacaagcatttggtagatattgatggcagcttgcgttccaacactcttgttcatttgaaactcctctgtttcacatttcacttttccctatattttagtcgatttttcttgatctcagaggatttgttaattttcctggttttgcctgggcaagaaagaaatcttttaaaatgacatctgtaacagatttttggtcaaggttaaattgatctcatgcttaggttcaaaaacagatgccatgttatgttaaatgaaagtgcatatactttcatccagggtacatagtcaaacccagaaagtgatcaaggaaaccacatagaaaaacactattgagccaaattaaaagggacacaaagtgggtaattttgtgatcatagttgcctattgcagctgtacaaaccaagctaatgagatgatgatgtaatctcttgttgcaaagaataaagtgatttcctatgagattaagcatgaactttccaaccttgtgtttaagatttagatagctcttctgttcttcccgaaactctaggataattactagaattgaatttctgagctaaatgacttatagagtaagctcaatcctttttaaatttgcaatcctttaagaattttacctttaatgttcacattacagtccgataacatataagctgcccattgctataattcctaacgtctagatggtctcataaggtaccattttgtagcactattcttagtgctgtgctccttgaagaactactatatgggctgttggaagagtctgtctgaaacagaacctctctcttccagagtagggctttgaggtttttgtttgtttgtttgttttttaagttgcagatagaaaaaaagtcttcactttgtatttcataatcattaaatgatgattgagagactaccacatgctggatattaggggtgcaaagagttattaaatgcagtctgtggttgaattggaacattagcatcattcctgggtgtctcaacaattgtttcttttttgttgttaatttgctttaagttctgagatacatgtgcagaacgtgcaggtttgttacataggtatacgtgtgccatggtggtttgctgcacctattaacctgtcatctaggttttaagccccacatgcattaggtatttgtcctaatgttctgcctcttcttgccccccacccccgataggccctggtgtgtggtgttcccctccctgtgtccatgtgttctcattgttcaactcccacttataagtgagaatatgcggtgtttggttttctcttcctaggttagtttggtgaggatgatggtttccagcttcatccatgtccctgcaaaggacatgaacacatttttttttacggctgcatagtattccatggtgtatatgtgccacattttctttatccagtctgtcattgatgggcatttgggttggttccaagtctttgctattgtaaatagtactacaataaacatacatgtggagcattccatttgaaaaattgtttcttaatcttttaagaactgtgttctatagaatgtgtgcaaagcatatctttaattcaccttctcaaaaattaagatggccgtgaattaggatgtatgacagcgagacacgtatgtgcaccattctggtcttcctgtgggtttttaatccactagtgagcataccccacgaggaggagacctggggtcttccgtgcctttcttcatatccccagaacccagcttcagtccagacatcatgcatacgcaataaatgcttgttgagtacatgaaagaacatatggcataggcttacttgaaatgggttgcagtgtgtttcagatttagaatgtaaaagtttagtagacaccatttcatttgtatcataaaattaacatttatttttgattactctcagtgccattaacttgtttcataattaaggattatccaagatcatagcttttcttcctgtttctagttgtttctcacctggtgtttgctaggcaagctatagacatttgttgacctgattcatttatgtgagatttttatctaaaggtggccagagaaagagaacaagcaaaacttattttggtttttgcaactggctaataggaatattgaaactaaaatagcttgcagttacctagctaaaagggaaatgctcagtatagtaaatgaatgaatttgcaagtttccatttatcaaatgctagcaacacccatcaccccactggattctcactctaatcctgaataggaggcaaagctaattttaaatccccattttatggaagggaaaactgagaccctgattaagaaacctttcagtaactcatagctaatatgtataggattcaactttaaaacctaggctactgactccaaattcactgcctcttcctcttcatcaagctgaatgttgtaagttattggtgatgttttatctatgctctctgatacctatgatttttaataagcagaaattttctatatgcatgtagttgtaactttattttttaccgatttgcaaacagtgatgttttaaaaatataaatcagattatctcagtctctgttttacgaatcttcttatgcttcacattgaacttaagataaaaaatctagaagtcttacctgggcctggattttgcttacaccttggccatcttgtcccagacctcttccttctactcactctcctcagctacattggccttctggttgttccttgaatataccaagtccactcctacctcaaagcctttctgctgactgttcaatctgcctggaacgcttgtcctccagtctctcgttggctaaagtctcttgttcctttgtatcattcaacttttttctcaaatatgacctccctagcagccttcagaccatacaattagagtactactgcgtggcctacttgtgtgctatctgaaattttcttcttatttatttacctgttttctgttccctccactgccccatccactcactgtaccaagattacaaattccaaagaacaagaactttgcttgtcttgttcactgttgcccttcctgtgcctagaatagtggacaacacatagcaggcacttgatcaagaatattggataaacagtaaatatctgaaaatagttccttctcattggctcttacatttttgacattttaaaattttctttatttttatttgtagttgtgggtatatttagcacagaagacatgggatggtacaaatgcctagtagttttgttgtgtaggattatgctaattttccagaaaattcatcttttgatgaatacgaagatgatctcctaccagagagcagactacctgttaaggcctttagctgtatgttttgggaaccacaggcaggaagttggcatagggttctgctgagtggagatattcctccaagtggatgacagcctcctttcctctggatgaggttgcagatcatctgtaggtggaacttggatcctatgtgtcttatacttcaccaacagacactctcttccattttccttttattcccacctggtgttgatattatctcattgtatttaggtcgtatttgtttgggtttttgatttttgtgttttgtctcgaattatgctttgatgacacatactgaggttggactttctaaagcaccaaactgtgaaataaaatggcctaagaggtgaaaactgtcccagctgtgcttcagattagctgtgcatgtctctgggaaatcttcatatctgtttggggttcattttttcttctacaaaaatggtgggacacatacatgacctatctctacagggcaggacttttgggaaataatgcacctcagaagttatataaatataacatatcatcagcataatcacttcaaagcatgtcatcaataagtatttactgaaaatatttatatcttaacttatataggatggcatagtggtttttaataaaattgcaagtgaatatccttgactcttactcaaaaaatctctcacacaaaaaatgtccttgatttaacacaaaatacaagataagcaggtgttgggcatttcaacaatgtgaattcaatgttatcttttattgttgagtattataaacagaacactggattggagcagtgtttacctgaaaaaaaatacagctgtcttagtcttgaaagtgaacattatggctttttattttttaatttatggtaaaacattgtgagagaaatcatagtttctgctacttttaagtaaggcctagtgttatatgtcagttgattgatagattgattttttccaatcttccctttatgtgatagggaagattctgccatataagtgtaatttttacaaaggatgaataccatgaaatattaaaaacagcttaaaaatctcaatatatataaaagaggagttttgaggccgtgattgctaaaaatattaatatagttcttagatatagaggacaaaaagcatacctctttaaaagataattttaaaataatgaattttggggtaggacattttgttattttttctactttgcctaattaacaacaaagctcagatctcagtctgtctggtagcaatggtatttcatcttattagaaaaatctaaaactattagacagagtggttgatctgtcagctctgcagtcatcagtggtccacagctattgaaaagggcatagctccatatgtatggatgaggggtctccaaggtaaattgttcaacctccaaaatatattgttaagtgaaaaaacaaggtgtaggacagtgtgtactatatgctacacatatatatttttaaattctatatattttttataaattctcctctggaaagtctttcaggttgccttcagagagtaggctggagtcctgtggtacaaaggtgacagtgagatattttactgtatatccttttgatgcttttgagttgtcaacaactgtacaaaaatattatcttaaaattcagtttaaaatgacactgttaaaaactactaagaaaagtaatgtatctgagaaaagcaaaagtagcgagaaaaagaattttgtacatttaaaaatgtggctttggagatatcatatctatctgtgtattttaaaccagaagatttgggatatttacaccacctgagagaatgcattgatctaagaaatttgggttctgggcctgagtgtgctactaaccagctctggggaagtcactcagacttcaattcagacttcaccaggcctcaattttctgaactataaaatgagaagagtgaataaattgccttccaactggtaaaaccaataagtccaaaataagttataaagaagcatttttaaaaggttaaatttatggttaaaaaataagtgcattcatgaaaagagcagccagcttggctctccgtgggcaaaacagcacttgtgcactctgagtaccgcctcttggtagcagcatgttggaattgcagtgaaaattaccgagaacagccaattaatcttgcatgcaaaaatggaatatcctgtctgtcacaatcactgtagggacatttctcaacatatgaatatatggtggtatcaaagtcaaagatagtctaaattcaagactattaaaccatttgaaaaatttttgttactgatctgtagaaatctggcaagcacaggttctttataatttgttataaccttggattgcatgaattttaacagaggtcagcaaactttttccataaagcatcaaatagtaaagattttatgctttgtggcccctcaggtctccattgtaactactcaactctgcagttgtagcacaaaagtagccatagacaatatgtaaatgaatgaggatggttatattcctgttccagtaagactttatttataagtacaggtgttggaccagatttggctcatggattgtagtttgttgacctctcaattatgatacactcctaccctaagtttctctttgcacagtattctaagttacctaattgcctgattcccgaacgtggaaataacattctacattctacagccccttaccttcaatcacttatttatgaataacctactttgcaaatactacactttacccaattaccccgatgctaaccatattttaattttataagttgctttccttgtttctcttcactctgggtttttatgtcctgaaaacaggcaatgatagttgtttctcttgcattcccttgcttgtgtaaccattgttatataatttcaatctttagctgaaaatcttttgctcaaatatcttttgtacctagggactcttggttagccttgtttaaaatcttcagaatatgattggctaacctcttattaaacacattcttccctttttaaagtgaaactcaaccacattgaaaaagccactcttctcaaagagcaagtagggtctgacttagaatgtgtcttggcgaatcatttgtaaagatagaaactggtctttgaatttagtgcatccctggagagatccatgtcttagccaggaaaattggcaacaagccttacctgagttgtaatacctggttccagttccagataattccctcacaacctcaatccagctctcccccttgtccttttccttgaagccctcctcagtctctaccttttctcatctctcaacatttctaaattctaaaacttcacctgccgtggaccaacttgatgttggcaaagctcttcacttatatgcatgaaggctgatagattattgagatttactatatgctttaaattcactgcttttcctatccagcaatttagctgtagccccggataaaggtgatttgtgtgatccatcttgctttatgtctcacttgacattctgcctttttcatgacaggttgctgaatgctataaagccaggacttgttaaaaagatcaatagattgcctacccccattgcaggactggtgagtacgtggaattgagatttattttccaatattcctttgctctaacctaggggtcatgacagcaccatttattacagttctctcctgcaatatatattccacttgaatgagaacgcattgaatccattaaacgaagaggtcacttaaaatgaaagattgcagtcatgcctaaatggcatgttaatctttgtttgtgttttttccatgagtgataaggaccttcattctcaaagagctaaatttgttttggtgtgagaggctgataattaggttgacccttgggggaggaatgtgattttaattacgttttctcatttcagttcatcactgcattcccctagaatggagggtaggggaggtagagagaaagagaattttaagagaaaacagtcgttttataataaattgctgctttcaatattataatctacttgggttgaaataccacaattgtaggccaactatcctgaagacatactggggcactaaggtggtctaacgtcatctggagaactgtttaagcagaatccttgcccttctgaacctatccacataaaatctaaaacttacatgttcatatgtggttagaagcagaatatttttttcatgcgttgatatgtcttataattcttggcaactaattttttaattgcttcatcgatgttgcctttgtgtagaaaaaggaaagaagtagaagatgaggaagacaatcaaatcttagttttggaaggaattggcatatgtgtgtgtgcgtgcacacgcgcgcgcacacacacacacagagcagaggaagtatgtagctcggtaatgactcactgattgtttccattgtgatcgccttctgcgcatgtagttttgcagaaagcaatgagaagaatgtcaagaatttaagcaggatcctacgtagaccttactgattgttgttaaaaagcttcttagccatatcacgatgactaattgaaattagatgtgacaaaaaaccaattgtgtttgagaattgtggggggtccttgtgggaaggtacatggtttcagcaagttgaatgaaatagatgttttctttaagaactgctatttctgtggatgcattttattccccatattggttggtagtgagctggtgattagtcgttaaaaatctttctaattttgttcttcagaatcatgtaaccaaataagttagttaatatcgagatagatacatatatttggaaggaatatatttgaatagttctataaaataaataatatataagtattatatatcagtgtatacatatatcaattattttaaaacatttagtaaattcacctcttccaaatgttaaagccaaggtcttaatgatcctgatgaacatctgtttgtccctaagcctatggcaactctggaccctggagctctggggtttaatgttatagaagcaaaatttgcagcataaaactaaggaaggccccaggaaaatccagatgaggagaaacaagtcactcccagtccagtagctaaagagaaaaggctttcaaaacctcaatttaaaatggaaatcataaataattttagtaaaattaactgttaggggcacatgcatttgtctttatattatttcctatcatggatcaaatgttgtttctcacatattgcctctgtcttggagcatttgggcaacttgatacaagaagacaaggtgacctcatcttctttccttctatttatgttcttgactagtattcctctactttcttttttcatttggatttccttttcactttgtccttgctatcgctttttttttttttttgcccctttcaatgaacacctcccctgcttaccgtcaccctgtatcatttatattttcttaactaatttatcatctttagtccaaaaaaatactttcttaagtaaagtcacctactaacccattcactagtgactcctgaatctacaaacctggtcaaactcttttcctttgctccagttgccttgagatcaacatttccacaaaaaccagagcacttgtggccctggtgggaaacagatcgccatcccgcaaccccctgttatgttcatgtacttccacggttctcgcgtcatgcctgtgcctccctctctatgctcatattcttgactgtgtccatgacttcagctctccatgatattgacccaaagcagcatttctcatcaagtactctctcctgaactccagacctcgtgttctgtctattggacagtttcatctcggtatcctactggcacctcaaacttaacatattcaaatgggacttgcatcaccagtcctgtgcacctatttcccaatgtaagtgaaggcatcatagacatgcagttgcaccagttcagctatcaaagaattttcccatttgtctacttgtctgcatttccttggccactgccccagagcaggccatcctcatctcttgcctggactataatagttgactcacagttctgcaaacactcttcactcccatgaatggtgccttttcttgtgatatgtgttattcattgaatactttcctcctgctcttcttgacaaaattatatttgtccatcaagatctaacacagactaacacatcttttaagttaaaaaataaaataaattaaataaaactaaagatctaatgcaaaacagcctcctttgtgaaacctttagtatttatagtccattatgatcttttattatagaatacagagaatatcccctggtataggagaaaatgagttaatactcgagagagataaaagtagctctgttctgaaatatattttggaaagtaagattttgaataactatggttaacagtttgaaattaaaggcctgcaagtggtttcgtattcatgtcaagacactatgtctttaagtagttggccatgatcaaacttaccgatatctataatgggtccaaatgatgttagatgtcctggtgatgcactaagaaatcacagcagttctcaggaaacaatacgacaaatccacattaagggacatactgcaaaacagctggcctgtcctcttcaccactgtcagcgtcattaaaaatactgccccgtcctcggccgggcgtggtggtggctcacgcctgtaatcccagcactttgggaggccgaggcgggcggatcacgatgtcaggagattgcgaccacggtaaaactccgtctctactaaaaatacaaaaaattagccaggcgcggtggtgggcgcctgtagtcccagctactcaggaggctgaggcaggagaatggcgtgaacccgggaggcggagcttgcagtgagccaagattgcgccactgcactccagcctgggcgacagagcgagactccgtctcaaaaaaaaaaaaaaaaaaaaaaaaaaactgccccatccccaaaaggctggaaaactgtcgtagattaaagatgactaaggaaatatgacagcctcatacagtgcatgatccttagttgggaaaacgcaactataatagacattattgagacaattagggaaatttgaatataaattgagtattagataatagtattctctcagtgttggatttcctgtatgcgatagctatctttgtgtatataggagaatactattgatcttagatggcaaatatatatgctggagtattttgaaatgaaatgtcatgtatacaaccaatcctcaatatgtttagcaaaaaagtctgggtacataatatataatttcatatacacatagagataagaaggaaggaaaggaaggaaggaagggagagaggaagaaagggaggaagggtggaaatgtggcaaaatactgtctctagataaagggcgtacgggggtcatggtactattcttgcaaccttttggtaggtttgaaatttttcaatataaaaagttgaggattaaaatacattaattctcttattttcaggggagacataggaaacctcaaataattaatgggtttgaagatggcagagatcatcttgttagtagagatgcagcctttgtgtgagggtatttttcaaacaatattttcttcttccaaatattcatgacagtcaggaaagggcagatagaaaaatccctgaaatacttctgaatacatcaggttggttttttcactttgtcaggggttgacaggccactgaccgtctgttgatcaagaagtccatagtagcaggggccatagagatctgagaagtgtggccagagggttttctatgcctggaagccatgcccgtgtgtcttaatgggctagtgttgagaagccaatccattaagatggcccagctgcttgacttgaagataaataaaaaagtgtgttttcacatagcaatatcaaattataaacatatgtagatttacaaaggcatgaataggtgtattttagcccctgagttaagctgtggttacaaagaattcaggggtgaaggtgttaaaacaaagtagttgaaaatcatttcctggcaagaatgcaaagaccctgaatccgggtctgcatttcttctgcaacgattgctgacatatgaagccgtgtggtgactgcctgcagatgcttgcattctcttttaggtgttagtgatactgtttgctgctgccagagagaaagtcctcaaatttaggtcttggcataccaaaggtttttttttaaaatgctgcacttcagtctgctagctcatcagtattgtactatcgagccacatcttgaaactcaatttagtggtcatcagagatcatgctaaatgttgtttcatcccaggagctttaggttttgtgcaaaagccatgaatgtatgaaatctttgcttatgataggagtttggggattaagccttttcttgcacagatttgaattgtgacagccgtcgtgtgtgcacatatgcacatgtgaagtataattggaaataggtgatatttgcggattctgcccctgagtgctgaaccttcttagagttgtcatgaaatactgtttgatttttccatgggtctgtaaggataaaagtgatctgaggaaaagacaattttacgtcttagatgtatcttagaaggacatcttagatgtgtttgttttgcagatgaggacatgtgggtccataaagggaaattatttgccccacattagacaaacagtaaaagatgagatggatcccgagccctggccacccctctccttggttattacatatacactgttcccagttgaagatgggacacattttaatgacattttattttaccttttttgaaaaagagaggaaggcaaaaactcattttttaagttcatctcttttttttctttctgtcggccaatacctacaaaatatctttctgagctctgtgaaaggccttacttcatgtatcacttcttagcctgatgaacgatggaaatttgacgctagctgaaggtcagaagcagaagcaggaatgtgactggtcagatgatcctaccattcagtaaccctaacccactcagaaacgcattttggggaaaaggatgtacttttctctaatcaaagataagatttcaaatatggttagagcttcctgccatggaaaaaaatgtaagtttccataagttctttagactttaggaagctttcaaaagttatctgctttagtttatgaaaactgacatcagaacagttgccatttcatcgagtgagatcagagtaggggaagtgatgaaagagctgtagtgatttccacattatgagaagattaaaaatattgttttggacaaaactagacatacaaggctgttaacctgagtagtatgagtgaaaagcctttatgcagacttcatctttttaggaggataacaatgcaataaattggggtcctcactgctttgggtgtctagctgtcaagaaaaggtttcctgcacatccttcctaagaattagctctggtgtgcctcaactcatcctgatcaatgtcttctcttctagaactttaccttccctccagtggtttatcttatagattaccttagaaaaaactggttaaagttctgttctccgggctcggtctctcctccagttaaaattgttgttttttggccaggcatggtggctcatgcctgtaatcccagcactttgggaggccaaggcatgcagatcacctgaggtcaggagttcgagattagcctggccaacatggtgaaaccctgtctctactaaaagtacaaaaattagcctggcatggtggtgtgtgcccgtaatcccagctacttgggaggctaaggcaggagaattgcttgaacccaggcagtgagccgagattgtgccattgcactccagccggggctacaagagcgaaaccccgcctaaaaaaaaaaaaaaaaaaaaaaaaatttttttttttttttttttttggccaggaagcaggcaaggcagggaagagggaggttagaggtgaaagttaccacagtgataaccatcacgtatcacattcctaccctgccccaggtgcagtgctagatcatccttcctaatctttacaacacacctgtgatgttgttattgctgtatctttactctaaagttcaaagaaatgtcaccagctttccaactaataagaggcagagttggtacttgaacctgggtttgcccaactctacatctgtgccttttctactgtgttatactctctccattagaccctaggatatagaattgaatctcaacactttccgaacatttgtttggagacatcaacctctaaggagacctaagttgttagaaatcagactctctcatttaaaatttattaattcaaccaaattgaggaagtggcctttttgaaaaaggcactgctacatgtaatgtttctaccatggccactatcaaatcaggcttcatgtggccatacctaacaagtgatcataggaaagcattagaattctttactggagtcttaaaaaaaaagtcagagtgattttattcataatatgcagcagaattacctaaaatgccctcctctctttctcttctacagtctttctctgtcacacacacacacacacacacacacacacacacacacacacatacacaccttatacttgccaactctcccaaacctctctatgcccagtgacctcaaatctttgagcctcacactgtgctagttcttgccttccttgcttcttacccttttgtctgctatgactaatggttagctctttccagtgcaaatcaatccagctagactcggctccttttgcccctgattctgattctggacaacaaagactcagagacaggaagacagaattctccttcatgggtaggggagaaggaagggcttggaataaaaaccctcatgtgtttttcctgctactctgtgttctctgtagtagttgcatggtacgatccggagtctccaggggtcgtcctccccttctttaggggaacaagtaaaaactggtagccaagcgatgttctgtgtgaagaaggcatattcactgagggaaatgaatagacattgtgaggtttctcagccaaaatggaatttaatgacacactttcctttatcctcatccctggcacagtatgagaaacctcggttgcgttcccacaccacacacagagggaatgctcaatttgctgctctcaagtttgatgccaaagccaagccaacataggagtgatggttagcattttagtaggtctagccatgaaagactacacaccgcagggaaaaacaacaaaacacacgaggtctttggtgcattccacctgcattcaattgaaaggtggaatatgaacttggggattctaagtttatttactgcctcccaggttgatatggcttgtgtgctgctgtttgaaacagcctttacagttagcttgtaaaaaatgtacaggtcatctcgtgtccctcatcttctcataattttatatggctccctactgaatgtggaataaaatccaaacacttcagaaacgtatttaaggctcttcctgagtgaaagtaacattcgagtaacattcaaaagtaacatttatctctcactttgtacatcacactcggaaaccagggcaacagatggttcatgacctacaccaaaaggcttgaccacatcgtgaatacagtgataaaagtgtgtcagatggcaagagccattctccactgtaggttggaccgggtgaaggggagttctgatgcccactggagcaggctggcttttggttgttcactgatgtgcttggatcagaccaataagttagtccccttgcgcatcttttgtgggtatttgggaagacttaataagaattttttgtcccttcactcatcttgtgattattatgtcctttctggttttcttttatttggtgagagttttagttattaattgctctataacaaattaccccagaacttagtggcttaaaacaacaacatttatcatctcattgttctcatgggtcaggaatatgagcaaggcttagctgggtctctggttcagggtccctcacaaggctgcattcaaggtgttggtcagtatcatttccaggccagagtagggagcttagaacttccgtttctaagcttactcgtggatattggcaggattcagttcctcacaggctgttggccaaagccatccttgtgtacttgccatgtgggtctttctatagaacagcttacagggttgcagcttgcatcatcagagtgagcaagcaggaagggcctgagaaagaaagaaagagaaagggagggagacaacaagtgagatggaagtcacagtcctttataacctaatctctgaagtgatgttttgtcagttctgccttattctattaattaaaagcaagttgctaggcccagcccacattcaaggggaggaggtcccacaagggtctgaatgccaggaggaagggatctctgggagctcttcagaagctgcttgtcccgatgaatgaaatggttgtatccgtctattgagcagccagggcatagatctctcattctcctgaacaccggctccttgtgcttataggactttaaagataacacagttttccttggttaacctttcttgcatgacatccaaggacttttttctaattttcttctgcacatatataccaaatagagatgatgtgttctctctcttgccttccaagtaaaaatccacttcaagacataattcctgccttttaggagactactttctagaagacaaatatagaagaaaggtcaaatgtaaggtagactgtgaaatgttaatgaagtataatatgcaagaaagaccaaggaagaaattttgatttgtgattaagaactttggaaggggtgggatttgaacagggcgtctacaaatagtgaagatcatggagttagaggaagaacaactagcttcagggcatggaatgagaaaggctctgagtcagaaggacctgggtcttatctggaagtggctatcatttgcattatttgcactgggtccagtggctgcagctggacgcagagtccctgagaaaatccatgcttggaaactagaccaggaatagtaagctgagaccagaaatgccatctgggggtgtttggactcattttgtgtgcagtaaaagccactgaaaacaagggaatctcgtgttccagataactgaggtggccgtatagaaagctgattatggcaagataccagcaataaaagtcaagtaggagataagtagtccaaatgagagaggatggacacttaaaccttagtagaagcagtgggattagagatgaggagacaggatttacttttcactaaatgtaatatgccatcaatgatgacacacaccatttttaaaaattatagctcatttaaaaaagctgccaattcaatgatgacacaatgctaagacactggcaatgaaaaaaatgcatctttatttcagaggttaaaaaaggtgtacatcttagaactgatgaaatacaacagataattttaggaagatgacatttgcattttggacttgagcagtgtggagggtactgatgccattaataggaatcatgggaacatgggaatgagaaatgagctccaaaagaaaagatgcattctcttttggacatattgagttggctatctctaaaagatattcatgtgcagatgtctggcagactattagaaatgctggtttggaactcaaggaaaaagttacaaaaaattggactaggttaatggatggactattttgaagttaaatcctatgcttcagtataaatgaagacatattttttttttctataaccactatgaagttcccctccccctccaaattatagtattgtctttggagtgtttgatccacattggcagggactgggatatggagaaaggagtgaaaaaaggagtttgagactacaggaaaagtcattagcaattgcacttagaattgaaaatcatgacagaaagaccggtgcagtggctcatgcctataatcccagaactttgggagcctaaggcaggtgatcgcttgagcccaggagttcaagaccagcctaggcaacatggcaaaatcttgtctttactaaaaatacaaaaaattagccaggcatggttgtgcatgcctgtagtcccagctacttaggaggctgaggtaggagaatcacctgggcctgggaagtcaagcctgcagtgagctttgaatgtgccactggactccagcctgggtgatgggagtcggaccctgtcacaaaaaaaaaaaaaaaaaaaaaagaaaagaaaagaaagatcttcatataattgacaattcattgagatatcatatccatccaatcttgtgccctgcagcctctcttatacccctgatatttcattcttagtactagatgagtatattaatttgctctgatggccataacaaagtaccacagattggatggcttaaataatagaaatttattttgtcaattctgtaggttagaagtctgagatcaaggtgtgatcagagtgggtttgttctaaggcctgtctccttggctcccagatggctgcctttccctgcatcttcacgtggtctttcccctgtatgtatctgtgtccatattttgcctttttataaggacactgtcgtattggattagggccccctcagatgacctcatataacttaattaccttcttacagtcactacagtcacattctgagttagaacgggttaggagttcaagatacgaattgggggagggaggaggagacaatttagctcgtaacagtgggttagccagctaagcccttaaattcttattcacgtgtgttttgaatgcctagacttgctagctgaagtctaatatcctctttctgcaccaccacaaactatttttccaaatttgtttccataattattctgtgtctctgcagaggtggaaggttatatatagcagtgctgtaaagcttttttttccccaacttcatttttttttccctttcctgttcccgaaaaaacaaaaaatgccattctttgaagaaagaaaccacttgttctcccttatctttcgttgaacagcgtttagcagaatttgtgacattacatcagttcctcacttttttcccttaggaatagaccttcaattacaaactgtgagcaaaaaatatataatagcaggaaatacatatttcagctgacgtctgactcctttttttccatagttatagcttacctagaggataactttctgtggaactaattcttagcatgtattccaaacccaggtttatagggatttggttgtttgacaacaggaaaaaaataccaccaaatgtatgaagtatgagaccatgctaggctgaaacagcacttctcttaaaacgtgccttcctctggattgtttttgtaggaagtttgtcttggcaagcatttcaaaagaactcgctagacgcctctcttgtaattagctggctttctgctagaatgttaggtctaccttcatctcaaatggtacaaaaattaattcctctctgtcgctctgtccacagtataaaatactagatttctgagtagtttgatatctaatttttcctttctaaaatttaactatattcagtttaagtttttgatttaacttaaacataacattaaaaataggatgattgatataatgttatataggaatggtacttttcctcttttccctcagtgttaaaagaatggtactttttcctcacaaaaacctatatccccagccatggaaagaatatcagacaaacctaaatggaaggatattctacaaaatacccgaccagtattcttcaaaactgtcaaggccatcaaaagcaaggcatatctgagaaacaaggaaagtccagaaaaagttaaggagacataatgattaaatattatatggcattatagatgggatcttaaaacagaaagagcatattagggaaaaactaatgaaatccaaataaaacatggatttagttaatagtagtgtaccagtgtttatttcttaactgtgataaatgtagatgtaccataggaatgtaagatgtaagacatgagttatactgaaactctgcatattatctttgtagctttctataaatctaaaaactattctaaaataaaaagttcacttaaagtaggatgaatgacaataaagataaaagagcataatgcaaggaaactatgaaataggtaaggaaatacagaagttattaataaatattaaatgtcagcctaccacttgatgtatttgtgtcaataaatggcaggataccagtgagtccattggcatattaatccaataaacttttataaatgatgaattggttgtaaacattgtgttttatagcatttgaaaattccaaatggtaactccgcacacgatgcttctgctcacatatttcagcatcctgcttttagaatctgcagaaagaaatagttcatgtcctttagggaggtttaataaaaagcaacaggtggaaaatggattttgcagtagcatgaacagccataaccataaatactagtacctcagaattataccagcagaggactgtaaacacattaatctcccagcagtgcagaaattccattctcagatgtcatctcaatttcaggcacaaagattgaatgcctccatttaaattcaaaacactgaaggaatatgatgatccttttttttcatggggattcatggagtgagtttgccagtttcctcatctataagatggggttgataaatcccatctcagcattgtgggattaaatgagatgatatacataaaatacctaatatgatggatggtacacaggatgttttcaataaatggtagtttactttttattatgctcatgaacattaggatggtcttagaatcccagaactagaagccacttagagatttactttttgaaacattgttattttacaaataaggaaactgagaccagaaggcagtgacttgcctggagtcaggcagcaactttgttccagagttgggactggagtgagtctttgttcctcgggtcccacttgggtgctttttctagatccagatttcctgacagtactgcaaacctactgtgtgctagtggctgacacaaagctctctgcacaattccaatcctggcatctctacttctgaagatgccattccttttcctcagagggaatgggcttctccgcctccctctccaataggtgtggcaatcagctgtcttccagttccctttcactgcatcagcatttcagccgcagcagcctgcttgtggacagagcaggggttggcagtggtgacgactgttttgggaaaggaaatgtaagggcatttcggctgctgtgctggggctgacgaggagcacacaggagagatgcccctcccatctcccagagtgggttggctggagttcattgcggagcatgaggacgtgtgggggtaagtaaaattcattataaaagaaatacatgcttaggggtatccatgatggaaagaaggaagctatttagactttaatacttggtttaaaaaaaagtgactttttattcacttattagtatggcgaaaataatatgaaaattactttcctgtggattcatcttgtcctttgataactgttagcacctgttgcttttaattaagcttttttttttttttaattccctaaggaaagcattgttttttattttccggtatgtggtacaagacacataactccattagtttagtcaaaataaaaaggatttttgagaattttgagaatgagaagcaacttggctgcatttttaagatgtggtccagcagcacatggtgttgtgggggagatgtggctgcattcatggtggggctgcttcacctgagcccctgtcacattctgctcctgactccacagccccctttgctttttaaaaacttccatttcttaaaatgaggaggaaaagaagcaaggaagacattggggaggcagggaggagtctggagggaagggctgcatctccagccttgcccacttagtccttgtccttcatagtcactatttactgcaggccgggaaaggaatgggggttatttctggacaattgtctcataaaatcccgtcagacccgtctgaatgctaaacgttccatggcactggttatctaggggaagaaaattttccttagccaaatttatgaggctgggttgaaaatcaggttgaaacagagcctggcgaatccctatggcaaaatgattcatctttgtggagtcgggaaatctatttttatcacctttattcagccagctcctgattgtgattctctcactgagctacagccgttttcttcatggtgctgaatagaccaaatgtctcaggagtctgaaacttctctcctgccactcccagagtggctgattcagcagtcccgggagaaggggtttgtcctgtgctgcgcgggtgggttccgcacaaggtgaaggtcaaataaaaccgagaggctgcaagtgtcagcagccagcctttgactcaggaatcctgcctgagggtatgtgccactctgctctcctgctctctctgtaaggtgactagaaggtgactgggcagccataactcctccaattttgaagaccttcccaagggaagaaggggcaagaataagccaccctccttacagctgccaatacatctcctcaatctaatcatcgggcagagagggacttcctaacaccgttgtattcattttcccatttccatttagttctgtaactatgcattccaggctgatacatagtcctagctggttcttgctggagtcccaactaatgctgagaggagtggcaattgttctctataataaagtttaaaggataaagatatggaagaagaactcactcttgagtttccttttctaatggattcagcatgcttactctctgggagctataacaaatggcaattaggaaagcaacaggaatgttgactagacaggaacagtgaccatggctgttgggggtattccctgcacctggtatatagtagacactcaataacaatttgggaaatgaatgaccaggatactgttccccataggcttcagttggccttcttaagagctctccttcaggacatagtatgcagggcagctaggagctgacattctagagtgagatggcctgagttcaaatcctggatttgcagcttctcagttgtgtgctgatctttggcaggcaacacaatcgtttgtttcctcgtctgtaaaaatggacataatatagtaactaccttatgtggttttcatgaagagtaaattaattaatataggtaaagagtctagatttttttttcttgtcatgtggttcaagatatgaagaagaagaaaaacaggagtaggaaaagaaggagaaagaggaggaggaggaactttggctgttgggataaatttgggaccctttgagattttggccctgccttttaggttgaatatttccctaaaatcatgattcagtgatttttaaaccttctcttgtcctgtagagagaataatttgagaataaaagaataaaacgggccagatgcagtggcttacgcctgtaatcctagcactttgggaggctgaggcaggtggatcacctgagatcaggcgttcgagaccagcctggccaacgtggcgaaactctatctctactaaaaatacaaaagttagccgggtgtggtgatgggcacctgtaatcccagctattcaggaggctgaggcaggagaatcgcttgaacccgggaggtggaggttacagtgagctgagatcgcaccactgcactctagcctgaaaagaaaaaaaaagaataataaaatggatttcagggggaaaatgatgacgaattattgccaagagttattgaactcctgctccttgccaggtactaaccatattcagtgttgaaacaaactgtcagtccttgccctgatggacgctgcagttgactttcaagggctgctgggcagtgtgaattcaatggctcagcgaacacagctgctacgttccttgttctctaccttttaaaaaggaatgttgagtagatctagaaggatgaagctttaaacttagctcccaacaggaaatgaggagtgaggaagtagggagagatttgtgtgtgtgtggagtagcagatgaagtctaactgtacagcagtataaaggcagtgaaagaaatgtagacgtgggcattggattgaaccatgaaactgaagggaaatccaaagcagtaatgtatcatcaacctgtgaaatgtaaagaagcacaggtaagtagtgaaagaatgaaggaaccaaagcagttgttgtaatgatataaaataagagccatagcttattagacccttagagtcccaaagcccagccttgagagtgtagattcgggaaggctggattcctttggcatcctctcttttcagctctgggtactgccgcagcaggtgagcttgtgtttggtccctttcagagtctggagtctcccatctcttggaaatacaaggatatgtatgagctaccaactcccatctggctttactggtctgtgaaacattctattttaatttggtgaatccttttttgactctagagatcttcagcagtacctgcccttcacaccgtttcctcacctttgccagatctgcttttgagtagcagttttatccctagatgtcttatagcccagacctggtaaatcaccaatgtgaattatagaacaggatcatttttcatcctgctttcatcccagtggctggattaatttttggatctctgctttctgtaagcagtcatttcttccacagcagccatctgtgaagaaacagagcttacgaaatgactggggcatgttttacatggctgtgctcagttccttctgtttgattcccatgtaagctttggcagtgatttccacaagcgtttctgtgggaggtgctggagaatgactttggtaaacagccccttggctattgttggccctttccctgcaaataccataaaggacacaacttgaaaagtcgctctggtttctgagcccctcctagggcccaccccaggtccgacatctgaaaagccgaactcagccatgcttgtggtagagcagcgatgtggactgcgtctgtgtttgcctgacttctgctgggccactctgggctggatgggagctctgaccatagagcttactcccctcccctcattacacatcctgggattttcacactagccctcaatctgttggagtctttttaggtagaatctcatttcatcttcctcgtttccgtttcaggttttcattccaagaatggaatggctggttccattgagaaccagccttaggagttctcagtgtattgattttatttacactgctagtgttacattttgcttttaggaatatggaaaagcttagggaatttttggacatgtgtttttctctctttctttcttttctttttttttttcctgatggccagaggtttctgctctcaaattactcagtcagggtaattaaggactaaaaaaatgtgaatgtgtgaatttaacagtaaaaacttaaaggaaggaaaaaataccttccttataggaagaagagaaaaatgcatataaataaacttgttagaaagagaaaactgatttaccagcaactgaactcccttttgtttcttgatttttttgcctttaaataggctgtgctatttcctgaagttgacccattttccttgcttctgccaacactcccttaagataagtatttataaagtttattccacgttgatatttcaattgtttccagaaatccatcccatcatagcagcttccctactgccagggaacctgacctcagtatttcctgaagtcagaggatggtcttatatgtatgtaagtgcaggtatctacagtaagagagaacaacttgctatatagggctcatatgagtcaacgccaataaattgaaaataagaactgaaaaaattgtaacattgtcctcacattatttttaaagcattatctgtttcgatgctggcaaaactgattatcttatataatggccaaaggaactgttcactttcaagaaataagcaactagcctgtctttgttttcatcagcatgttttttggtgactaatatgttgatttgatgaaagctaattgcacaaacatgcggtttgtggggaagaaggtaacgcatggaactatgtctaagagatgtgggtgttcattccattggtggatccagcactttcttcctcaataaagagtatttgttcctaaaataactggtgtccttcaaggcacagaatgtctaactcagctgaaggtatttaatttatattataaatgtacatatatattttatgaattttaatagaaatatattaatttacatttataagtttaaacataaaaacataaaatacatgaaatatgtttgagtgtattgttagggacatctctgagctcctgtggagatagtgttttttccctaacataacttacatttaagaaaattggatttttcatgaaatttactcaagtaagactgtaggctgagtttaatatatatgacaactaaactttcggcccatattgcaccaaattaaagctttcttctttgtctttgagcacaagaatgaaagctggcatactgtccggtagactgaaatgtgtcctcatggtcattttgaccaccttatgagcatgattaattgacaacatgttgttactatcttaattctttggtctgagtctcagctcccgtgtcagacctctgagtcccaaacatagcgccacagtctgggtcttcacatcttggccaggtttctgttaaaaaaacaaaggcgcctctgtgttatacttttatggagcacatgtggtgtgtatttattttgtgataggtttttatcacttggtagaaagatgttactgtatcttaagtgaacgattgtttcaccctgttgctccacagaccctagttgtttctttaaaatgggcgatggatttttaggggcgtattcacaaacctgccatgaaagtctttcttctccagatgtttacttctatatttttatgtgaaattcaactttttcacctatggacatgcttccctgcagcaaataacatgacaaactctttgcctttatattgtctttatatttcagatacccccccacccccaccaagccttctcaattccaaacctgtgattatgctggatgctttacgtgttatgctccggcttgtaatgggccaactgaaagataaactgctattaaataaatctatgactcttttgagaacaaatagagctgttgaaagagtttaaaaacatagtgactcctcgaaagactgtgaacattcttgaaccctttgaatcaaagtgaattttcttcactctctgtgtgtgggtatacactgaaacttataagaaagaacctcagtagcaagatatttgaaggcttttgtgttcttaaccctgcaaggtttttcttggcaagacttgaagaaaatgtagctgtcgtctattttctgctcctgtcgaggggagcagttgagtctgggaggcctctaatgtgtcagagagaagcctgcagagtagagaagagcccagaagcctccaggtgcccagtggttccctaattattccattacctagttacctggttttctattacctagttacctagttattccattccattccacctcctctccaagcaaggctgggtggttcttctattttgatctcttctcatgtgtctctgttgctgtggagctgcaacatcaaagcctaccccagaccacacgtgtcttctgttgccaccacgtttccctctggacactggatcagccttactgccattaggatgcttatgcttcctagaaagcctcatttatctgtgctggggcagctgctgaggactacacaagattcactgtcatgggtttagctttcagggactccccaacttgcctaagttacctcttgggtccttgattgaaactccagttgccaagtaatgaagatacagaattttgcattgatctctcttcccttttccatctttcctgtttccattctgaaaggaactgctctgaactggcaaatgcctacagggacttcagtgtcataggacaggctactttgactcctttgtataacctcaaagtcactgccaatacaagggtaaaacagattctgttctttgtactcaaattcagtgtgatgtgagttggaatgctaagaaaaacttaagagatatttttagcaaaaatgaaatattttgatgcctatcgctcacctgaaaattttcccagatttgccatttctagatttttagcagcttcacaaaggggtattgtgtttgagtcggaagagaaaaatgtttttatttcctgtccttgacgtttagtggaattgataaaaagcatcaaggatctttgagttctggatctcctgcaaaaaaacacattatgtaagaaaggacttgagtgtttttttcctgttcgtcagtacgaggggagagttactgtggaaagtgaagggcagtgatcatcaggaatggaaaacaaagagctttgctagaaaatcacagcaagggtgatcaagcagttaccctattatctggctctaaacttaatgttgacctcgacaacgacttttacatcctccccccaaacaggctcctttactcattcctgaaaggacactgttgcaacttgagttatagggttgttggagctacctgatgttttattaaatggttatttaatcaataaatgagtgagtgatcatctcttatggttgatcagaaagtattcatttaaaaagtcataggtttaacttttttaaaagtcaagtcagcacagagcttatgtatttaagcagttggaagtcaaaatattaatatgttcagtcaagaatatccatttcgtttcatacttacttggcagtttaatttttttttggccatagtttacatggtccaactgttaggttgcttaaatttgccaatatgaaatattaacattggggtgaatgctttatgaaaacaagaaattgtttctgcttggtctacctgtttattcattcatcaagatttcccaggctctgtcaacagatttctaagcagatatttgatgatatattgttataggaataaaaaatatgttatagaaatagaaaactaccttccatgtagagtagaaagaagccttcattggtctgttttttttgtttttttgagatggagtctcactctgtcacccaggctggagtgcagtggtgtgatctcagctcactgcaacctccacctccctggttcaagcaattctcctgcctcaccctcccaagtagctgggagtacaggtgtgcgccaccatgcccaactaatttttgtaattttcatagagatggggtttcaccatgttggccaggctggtctcgaattcctgagctcaagtgatctgcctctctcagcctcccaaagtgctgggattataggcatgagccaccatgcccagcctgtattttttttttttaataaaaataatccttgggcagctgtttatgttgttctgttatgcttgcctatctatagaatgaaatcaatgtggttttttttctcaactttcttcttttttattcttttttagccccatcattcagtctctttgttcctaagtctttcagatgctttaaccacactattttcttacctgattttctgttccacttagcatgttattccaggcaatgaatgtgttgcttcccctgtgatagattatggcactaaaatagtaatgagctttagtacaatcagagcaaaaattactctcctaggtaagccccattcttcccctagctcaattcagtgttccattagccacagaaatgccaaggattccacatacctacatatatatatggagagagagagagacaagcgagagagagaaagagagagagaggttgagaccgagattgagacagagagagctagttccctgtcaggtctttactactggaagagtcaaagatttgcaaatggagatttttctttgcatcttcttcttcctattatccttttttgtaaacaatgtttattttatttttaattgacaagtaataattatatatatttctgggatacaaggtgatgaggtgatgttatgatgtctatacaatgtggaatgatcaaatcaggctaattaactgtcagcttgctgacttatttctttgtggtgagaacatttaaaatctactcttcacacaattttgacatatacattattatcagctatagtcgctgtgctgtctaatagatcactggaacatactcctcctgtctaactggaatttcgtgtgctttgactaacatgtcacctttcttcacccacctgttacctcctccttagcctccggtaacccccattctactctctacctctatgagtttggcttttttagattccaagtataagtgagatcatgtggtatctgtcttcctgtgctttttattcttaaagatattaactgcagaggcccagcttcatcccctgtcttagccacttcccagcccaaggtgaccttgggctaataatttaagtttcgcattttttcatctgtaaaatgatgattaactatagtattgaccttataagaccatagtaaggattaaatgagctaatatataataaaatatacagatattataaatatatacatatataatatatacagatataaatatatacatatataatatatgtatgttatatatacatatataatagtatacacatatatacatatataatatatacataaataatatataaaaatataaaaatataaacatacatataatatacatatattataaataaatacaatataatatacattataaatacatataatgttttatgatatataatttgtgtgtgtgtatatatatatatatatatatatatatatatataaacagtgagtacattacctagtgcatggtatgtgctcagaaaaagatgactatagtaatggtgctggcaggtgttaatgtcattcatatttttccctaaacctctattttcccatctattaaatagcatagtaatagtacctaactcattaatttgtgaggaataaaggcatatggatcaacgtagcatgttgcctggcaccttataagatctcagtgaatgatgatgtatacttctgcaatgatacagatcattgcacttctcctgtttatctctaccctttgtttaaggcttacactttaatctataatcttaccatgaggccctgaaattacactagccaagtcagtttgagccagtgatttgctttcttcatttctgtttctcatttgtaaaatgcgagtgttgaactgagtactctgaatagtttcttcctctaaagtattttcacaaccattttatctcactcaactcattttaagaaatacctgataatgagaaactcatccaagagagcctctttgcccccgctccaccaaaaaccttactaaactaatctctttagttgttcagtcaattttctcttattcaaaaagctgggctgttttgtttgattaatgacaccatcaactggccctatcccagagtgtaattgatcagtccataattccccaagtcattcttatttcctatgattatatttttaatttataaacccttggccagtttcaccaaaaattaaatcctgatgccttccagatatatgttccaaatattgaggaacagtattcaattttgtctctttgccagtggctgctctcaccttgttccaactcccaaatccccatctcgttttttcctttttggagaagagtcgtgaaaaactggtttccattataattccatcacccctagaggcaggaggactaagtatgcagtgtggtttcaggccaagaacattggactggaggtgtaaagagctgggttgcagtgctggctctgcctccagagctgaggggctttgggcagggtagtttctgttgctttagtccttagttgtctcatttgtggagtgaaagataaaactgaatgattgctgagacctttctacctgtgaaaactcatggtttctattctttcccattttgtcccctactgttaatttttttttttaaagacacttggtctcactatgttgcctgggctggtctcaaactcccagactccagcaaccatcctgccttggcctcccaaagtgctgggattacaggcatacgggccactgtgctgggcctgttaatattaactaccatttatttagtacctacaatatgccagatattaatctaataatagttaacatttagtatgtgctcaccatgtgctaagcgctttatttctattctttactcttcacagtaacccaaaaaagtagatgcaactagtgttcttcttttacagatgaggagactgagacacagggatgtgaagtccgtgctcatgggtatgcactcggtgagggatagagccagaagctgaacccaggaggctgatgccttgcccttgcccttagtcattttattatataacattcttaaggacttcatttttttctttttctctctactatagcactaggaacaatataatagtaccctcacttaaaaaatgaagaaaccaagtgcaatgaagctaaacaatttggccaaaataacccagctagcgtatgacagagctggggatcaaacctaagtctggctcctaaccaccgtgttccaagagcagagtggatttcttacttctgtcacatgtatcttgtgggttagtgataagcaaagtatagtacattttaaaaagaaggatacttttgctttctgttcattaaattttttaagcatataagatagaaattttgctagatttacttgaagaaacagatagaaatcattctgtaatcaacacgatttatatgtggatagattctttttattgagtaagattattacagtttaatctagtttctgtcggatttgtcttctatttcaaagaatgctgtctgaattattaggttggtacaaaagtagttgtggtttttgccattaaaaataatggcaaaataaaaagtaatggcgaaaaccacaattacttttgtaccaacctaataataaaacttggccatgtacccaaattgtaagagacggcaggcttcacccccagtatcctcagtgtggctgccatttcttatgcccactgtccctcatgctgctatttaaaaactgattatcctgtttacaaggtgagactcaaaatttgatatagaatctaattggttaattttatattgtgtgtatgtatttttcctattgattcagtcaacaggtattaatttagcacatgtggcaggtgatcaattaatacctgttgactgaatcaataggaaaaataatttgatacctttagctcattttattctcctaggtatttaaaaaatgagccttctactttcaaaatgctctggagtaaatggctcaaggccatctcatttcaccatctctaggtgcctcaagttggaatcaatcatacaccacttggcctgaaattcagataagagttgacaggaagtgggcaggaactgtttccttgttttttattgtttgtataaatgttaagtgccatggcaacaaaaaactaacagccagatgaagaacagaaacatatggagaagtgaaagacaaccttgaaaagagatatttgaaagaaattattcatttggctcatcttgatatgagtgagtgtattgctaacatgattgattgtgttcctgagtagaaatgcaagcttactaagattagagaattaatgaattaattggtactccttcttattctacaaaggactggaaacataaaaatattaagttatagttgggggaaaaagtaaaagctttgactgtggaaaatatcagtgtaaccaaaagataatataacttttataatcggggcacacactttactctgagtttccgggcagccacagcaaaaaggaaaatatgattaattacaaagcttttagcttccatcagacttagttaatttctcatgaggaagaaagttattcttaacatctaggtttaaaagaaattcctttcataggtattcatattggagactaactctttgattccaaaaattcagaatgtttcttctatctttcttcctccatgataggaaattgatcccattcaagatgagaagtaagtttctaaagtcattgtcaaggcagctgtctaattaggtaagaatacagatggactgtgaggggaaatatgtctttgatccttccagcaatatctacagagttcatgagtttagttgaactttcataattatggatatttataacagccttgccttctattgctaggctcagagatccttccaaacaagtgcatgattcttaaaattttccaaaggagttgctcaggacaaaataacactggtaagacttgcttttctttatatagttgtatcatgaagttagcacttacttttatcaaattcaaatggtcaatactgggcatcttccaggggtaggctgtattgctggcattgggcactccaaggatacaaatacgagatgaaattagagtgtttggatgaagccgaggtcaaggaactataccctgcaggccaaaaccagcctgcttccttttgttcatggcctgtgggataagaatagtttttatatctttaaatggttggaaaaaaataaaagaagaatatttcataatacatggaaattaagtgaatttctaatttcagtgtctataaacatagttttattggaatacagccatgttcactcatttatgtagtatccatggctactttcataccacagtggcagagtagatacaacagaaaacatatggaccacagagcctgaaatgtgtactatttggccctttcagaaaaagtttaccaattcctgttatagtggagaaagtgctttctatgtgtattagtctgttctcgtgctgctaataaagacatacccaagactggataatttataaaggaaagaggtttaatggacgaacagttccgcatggctggggaggcctcacaatcatggcagaagagcaagggacgtcttacatggcagcaggcaagagagagcgtgtgcaggggaactccactttgtaaaaccatcagatcttgttatgagacttattcactatcaggagaacagcatgggaaagacctgcccccattattcagttacctcccactgactccctcccacaacttgtggggattgtgggagctacaattgaagatgagatttgggtggagacacagccaaaccatatcactatgtgttcatgagctgtgtgaagagtctgtaaaaagaagaaccgtcttctcttgtagacagggccctctatctgtgtggtgcatcctttatatctccatatactgatctttaaaacatggcatgtgccacgcctgcatcaggatccatctgagaggaagaacactccagaaggctcgaatcatgagctcagggccaatataaatgccatcgcgttactttggaggctttccctacaggctcttgttctcttggaatcagtgccttttcctgtctcttgcttcttgttctcctaggctgctgctcaccaatccataaaaattataaacatggatatttaaaaattttgtgacacaaagtattcaaattaccctgccactacctcttctagacacttggtctgttctttattaatgctgtccttttttcaggagcttggataaaatagcttttaaaaatatttgctgaaatctgtttgcctttctgctaggctctgcattttatgtccttattactatttgattatgataattttaaagcattatataatcagaagtaagacagactttaagaattatgagctgaaagttcagtttcatggctcatggaagtaatatatatagttatctccttaggaattttaattatttgaggtgagctgtttaaaaaaataaaagtgcaaagtgcttatgtgtttaattcctattccaatccccaaaaatctgaatggagatttataaaatcatgtaattatggggttaacgtgaccctaggtgccactggtataatcagccttccaggcgctacaagaatctcttctctcccttctggagtgatggccagttggtctctgcgagatctctcgcagtgatgggcagctgtctgactcctgatttagttctgttatcatgtgactgtctactgtgccagccactgtgcattcggggttacaaccatgaatggcatggtctccacctttgaggaactatttagtaggggaggcagacaatttcagtttagcatggtaggtgataagatggatatattcacaaagtgctgtgggaacatagaggagggccttaattgagtctacttgggaatttggagaaatcttcctaaaagacttacaggaggtgagtcttgaaggataactgagttcaccaggcagaaagaaaaaggtggtatgtatgttcccagcagatagaacagcatgagcaaagtgtgcaagataccactagaccagtggatgaggtagggtgtggtgggggatgaggagggcagggagatatggactaagtcttgagaatccctgtgtacctggtaaaggacgtgggatccctcttcatggtgattaaaagaaagtggtaactctgaatgatagcaatgaaagaacggaggaagggagcctgatttcaaggggatgttggtgtcagtggatcagacttcatggtgcgctggtggtgacctctgatgaaagattcttgagccagtttcagccatcttccctcttggatccagggactggaggccagttttggcatcctccattcatttttggtttacctactatgtattgcatacctactatgcaccagatcctgcactgttatctcaatgtatagtgacgtaaaaacaaaacagataatatccttgacctaagtgaattctcaagctcagtagtattaggccagagcaagtcaggttcaggagaagctgtggtgtggtggccagctttgttggtttccaagctcaaattcactgaagcctgttcttttcatggttggcttcaatccttataaaactacaattttctgaatccaaagttttcttcctgagagccatttgaatcggtttttccattcccttcttctaaggaaaaggaactattttgcttccacttgtatttaatagatcttccactgtttctctttttgtcatttatctattattgcaattgaactaggcaacaatcacaaaacctcaggagtgtaaaacaagtgttcattgctcatgcatctgagatggctgaattggtggctctgctgaggttggccaaggtgatgggatgtgggactgctccacatacctctcttactctggttggcaatgccaggcatgtgctcatgcttcccaattccttctgctgtcacctatgagatgttgtttctggactattcattttgtcagtatttcttcctaaaatgtgcactcagacctgtacaaccttcctctaggtgtggtctaaccagtaaaaactgcaggggaaccattatttcctatcctctggacacactgcttctattagttattaatttaggctgagatggcattagcttacttagcagatgaattgcacagttggccctcttctcacattaagcttgagaaaaataaaacttctcagatttttgtccatatatactgctgccaagtctcatccatcctgtgaaaaaaaatttttgtctttcatgcctagtccttgaaccgtgtcaattgggttttgtaaagggtctttgaagtatgtcttgaattaactaagttcattcattcattccataaatatttatcatgtccctattaggtgtcgagcactgtgcagggaacaagacatgaacatagtccttggtcttgtagaatttgtgctctacttgcagaagggtagggtggatgttgaagattcagtagtcaggattaaaaggcattatccactttgtgacatgtttgttgccatggagtcttctccattctttttgagaactcctgtagttgattaaaattccagtcattgccatttgattgatatttggggttttgctgagatgttgacacatctgctcgaacaaggcatgaatagttagcggatgtgaaaactgttcacaaattgcaaaaagcaggtttctgttgaacgttatgaacttgattgacatcacactcagggtggtgttgatttagcaagcgtgtcctactgttttcatggaaagttcaaacatctttcccctgtgccacttgatgggcataaatgtgaaggattttaggcaaaagagcatgcggtgaatactgaagcctatcaaagctttctgtcactcacaactacatggtatgcctatgttagagctagttgaccgccttccattggttctaaggacacttggttagcagtgtactgggtgttgccctgactctaaagctggggtgtgagtactgggaggaagcatcacccctttttgactaatccagcattcaaaatgcaaaacaaatctaagtgaagttctttcattcattcaacaaatatcagaaaatcaccaggtactggaaattgatcagcaggcaaaatgcccttgaggagcttatcttctaatgagaaaacagataataatggtaaaacaaacaagaatttttttttcttatatggttagaaagcaagttctataaacaagggtgtaaagtgctgaggtgaaagactgtagagtgttattttattttattttatttttgagacggtctcattctgttgcccaggctgcagtgcagcggcgtgatcacagctcacaacctcgacctcccaggttcagtgaatcctcctaatctgttttctgagtagctggcaccacaggcatttgctactgtgtctggttaatttttcttgtactttttgtagagacagggtttcactgtattgcccaggttggtcttgaactcctgggctcagggggtctgcctgcctcagtctctgaaggtgttgggattacaggtgtgagccaccacacctggccagtaattttaaatagagtggttggcagagtcctcattgaaaggtagtatgtagagcagaaatctggaaaatgatctgaaaaaagaagttagccaaatcccagcactttgggaggccgaggcgggtggatcacctgaggtcaggagttcaagaccagcctgaccaacatggcaaaaccctgtctctactaaaaatacaaaaattagctgggcatggtggtgcacatctgtaatcccagccatttgagaggctgaggtaggagaattgcttgaacctgggaggcagaggttgcagcaagctgatatcatcccattgcattccagcctgggcaacaagggcaaaactctatctcaaaaaaaaaaaaaaaaaaggaaagaaaaagaaaatatcataacatgcagagatgactgccagtgtcaaggtccctggttctacctttttgatcattaactctgctattaaattagctacaagtttttgagtgccctgatgtgcccagacactgggcagtttacatctattgcttggaccctgcctaggaagtacattatattacgcctccccatctacagtggaggaaactgagacttagatgaattaagtcaagccccatatcttaagcagcagctgagatgggatttgaatccatctgactttgaattcctggaagcctgagcatttcctcctgtcttgtggcttctttcagtatagacataatcttgataaaaacaaactgggaaattaccctttgaaccaagcaatttgaggagtgtttttgaaactaagagactgggtttctaagagataaaatcatataactgctgttctttaaaattcaccacaggatctactttttccaagaaatctcccctgaataagggaaggtatttggcatacagcatccagctaggttaatagagctctttatatagcctatctgctattaaagcagccattcgacacagaattctgtttattttaactatcattaatggccattccaggaatctatctctatttctttgggatacaaaaccagttctgtatcgattgcttgacaatcttgacacataataaatgcagaccttccttgtgttctaatgttgcaaattgtatcatcctgtgggccgttgtaaaatggttctcatctttccatagcatcaataccaggatggaggagttgcctccatttataaggactaggcatcaagtggtcatcatgaccaacaatgtcataaatgcaaagataaatgtaaaattacctttgaagcttcgtaaaaagggttatacaagggagcctcatgtactagtgtgcataaaacacactaaaaatatacctaactccactctctcatacatttagagtttacaagaatcgatggaagagatgatttttaaaaaggtatccagggaagtttaaactgatgctttttcttgcaataaatagatctaaatcaagcaaagatgttaaaatgtgtgtgttttaaaaatctttattgcctctgtgtgtgtgtgtgtgtgtgtgtgtgtgtaattagaatgatgaggagaattcttaataaaggtggcctggtgagcagacccagcacaatttttatcagtgaggtgttaaaacaccactagaaatttaaggtgatgagggaaacttgatttaccagaaacctctcccgacactgcatggaaggaatccttacctaagccacatagggtgaaggtgttctggagggttggaagtgccaagggcggttctaaactacactctagtgaaggtggctacaatcagtgtgggcttttgtgggggctttaattgtgaggttaggatctgaataagaatcctggagagctgactttgacaccaatacacacttttttttttctcttatcctcatgctcaactcaatctcctctgaaacttgatgtccaacagctaggttttaagggttgcagattatctaccttatcacagtggccacacgtgtcagcctggtgatgatggtgtttcacgttcctcaaggacccctcacggtgcctggatgtcagtttgcataaagctttaaataaagctgctccgtatacatcagcccaagtagcagccacccataaacggtgtgtgctgtgcttttatgtcactttgacactttggtgacaactcttggaccatttcactcttctctaaagagtcataaaaactgataccaacattgaaaaaaaaaacttcaaagtttgtctcttagagttgtaaaggcaggaatgagatgcctgccttagatcttatgggaatttcaccaaaaaggggcggtgtataggagggtatcgtttaagccactggctaaatgaatggtttaaaacaaattaggcagtaatgtctgattatgcttctttccagttcaaaatctttgttggttctattccccagcatgttacaatccatattcctttccacagtctgcccagcctcatatcctgtccctcatttctatttcctccacctcccaatgccattaccgtcccagcccttccctcatcagagaagaggcaaacctgaagtcagccttggagacccagctcacatcacctcactgaagccctgttaggtgcttctgagtgggttcctgtgcccatggtacagtttcctacgatgatgtcaaccatattgtatttatgaaagatgcatttgtgtatttccaccttggtacagtaaattttttgaaatttagagaccattttctatgaaccccttcagcatgtggcataattctagctcatgaatgattggattgatgctataaagaggagggttcctgtatataatctcagtgcaagcagagcttctttctttgttaaaactgttggattttgaatctcagcagacatgtcttcaccatctgagattatgataaatgtttgacttactaatgcagaaatttagctttgagaaacacctacagatttttgtttggttttgtattatccaaaagagcattgtcttcgtggctgaaaaaaaatattttatctggtttggcagattaatttggcaggatagagctgggctggggattatgacaatatatgtggaaggcaatttatgttgtcttttaaatacagtactctaagaattgtagatttttaaataaaatatccttgctgtttttgccccctaaaacataataaagataaatcaaaagtccagcttcaagttatcttacaggagcaccttcaatttcctcttctgtcttagatgttccatgtaacctgtgtcctgttctctttcccaaagttgtaaaggaagaagggtgcctcctccctgtcttgatcctacttccttcaagaatcttctgaaccaagccccactattatagtccatctctctcacattttcaacccctcatcttaccatcagctgctacccttcagtctacaaacctactaagccctcttttactcttaaatccccctttcctgaacctggctgcatcctccgactcccgttttcttcatcctcttcttcaggtgcaactcgttgcaaaaatagtctccatttacatcatcatccctcatcatctcacatcttaagctcgtaccagcctgacttccactgcttcatgggattaaacctactctcagggtcactaacccccatcagctacctcctatgtgtttgataccattggtcagtcactacctgaaattagctttcttgttggctgttgccacaccacagcttctagctctcctacatttcctttatatgcaccctacccctacccaacgcagatatttcttctggttctgtctttgattcttgtgcacctctgtctatcatttttctcttgacaactctgcttgctcttttcttttaaaccactgtctacatgctaaggaaccccaagtccatatgccaaaaattcccaagtctctattgatagtcccgatctctttccagggcttatttccaagtactacctagacttcttttcctgtgttcctgacaatttctccactttattctgtccaaactgtccaaagtgtaatgaatcaaacaacccgttcctccatctgcattccttatttcccttaacaccttatgtcctttattggcagcacaattcttatagccagcatcctggaagtgttcccagcactcacccctccatctagttgttccaaagttctgtagattctaagtccacactctctcacacacacatctaccttttcctttctattcctcctggcctttgtcaaagctcatgtgtcaaagcacagtggggattctgtgactctcctgccctttcactgcagcaatgaaagacttcaaattcctgcagaaggctttcagggccacacaagtctgactgtcatttaccttatataagcataagggcacagtggaaagcagcactctgttaatggtgaaaatctaggcttctgaagtacatagacatgaatgaaaacctcagtcttcccctccctcaaatgtgcttgcttctctctaagcttcatccttgtgtactcccctctctattgtcttttttgggctttggttaaaaactcttctgaggctgggcatgatggctcacgcctataatcccagcactttgggaggctgaggcaggaggattacttgagcccaggaatttgagaccagcctgggcaacatagtgagaccctgtctctacaaaaaaaataaatcggtcaggcatggtggcatgttcctgtagtcccagcactttgggagaccaaggtagatgggtcacttgagcttaggagttcaagaatagcctgggcaacatggtgaaaccctggatctacagaaatacaaacatcagccaggtgtggtgcgcttccccatagtcccaactactctggagtctgaggcaggaggatcactttagtccaggaggtcaaggctgccgtgagccatgattacagcactgcactccagcctgggcaacagagtgagaccgtgtctcaaaaaaacaaacaaaccaaacaaaccaaaaaaacaactattctgattctttcccacctcaggatgtttctgacccatgagaagccccaaatgctgacttggatctgtagaagctgccaggctctttctgaccttgtgttgtttaatccaacctaaatatgaaaggaaaagaaacaatactgtgctcacacacatttaaatgttttaaacattattctcccttcctttctctccagtttagaaatgctgcacataaatttagtcttgcttccttggctgtatttttttccccctccagaactgcatggatttttctgtaggtgttagaaaatctagattccaattaactttgctgctgattactttgtaaatcttggtgagtcagggcttgttcgtaaatgatgatgaacattttaaagttctttgagcatggcgatgtgtgagcagaatacagatgaactaattagaatgtatagtcgctgctcttgtgtgataggttttgagaaggctgtaaataaacatggggctttcaagtcttgtttatggttttcaagggggaagtttgtgtgccttatctcatatgaaaaaacagtttacaaaatttctttaagtctctcttgctcttcagttcatattcttgggcactaaaatgtggacaagtaccatgggaaagaaaaagaagtggatattctgcaaaaattccactgatgttgaagaactaaattcctactgggaatttgatcaaaaagagactaggggaacagcagaatgggaaaagtaaccaacaattctattctttatgcctcctaattacaccgtgaagaaatagacggatgtcacaagagcatgcacttcagtaaacatttgcttgaaaatggtatttaagaatcctctgaaatctccccaaaggcctctaaaaagccttctctctagagagaattctgattataaaacattttctgcacgtctcaccctctttcataggcagtatcattattgcttgtgggtttggggctttattttgcttctgcctctgttacgagcctctgagcagtgttcagaagtagccaaggtaccctttttcaggtgttcctggtgccagggccagatatgggcatgaaagagtcacagtcctgtcctacttcttttgaaaaagaggcccatcaacctctctccactttgcatgttcagtttccagttacaactttctgtcatcctttttgcttccttttaaaaattttatttcaccattagtagagtgattggggtgtacgagttttccttactttcccctttctagtgtggtgaggatgagtcaggctttctgagtggtattttaactttcccttgtctcctgtaacatttgaagaagtctgagagaatgtcaattagctaagttcctatccagaaataaaaggaaaagtgtcaataagtattggtagtaggataacaattttggtgcaatgctgagacaaaaaggaaattgtttttgacctgtcatgagaattagcatgggtccagtcattctgtcccaaaataaattaatttagactttaaaaattgtgctgattagatagcaaaatctgtagcaaaattcaaaattgttacccctagtatctggatggctacatagtccactgtggcaatgattattggtacggaaatgtttaaaataggaaagttcaggctggagtctggaaataagtattgatccctgtatctcccttctgtagggctaaggatttgacagaattattaaataggtatttgggtatctgcaccaaggagaaaaatattgctctttctgggtcatgggggaggggtgatttttgctttcccttttgtcagaactgataaatgtttgatagaaaagatctttggaatgacacaatcagtgagagtacactgggcagaatgttatgaaaggatttgattccccaattatagctttttaactagattaaatcaagcagcatcaattctgaagatgggtctattttcctctcccagtggaacactgcaaaggattgtcctgtaaacttcaaacactgtgcttaagttgggaagattcatcttctgttattaatagttgaaggttcatagcataaaccgtggcctatatagaccttggcccacatctctgtgccatcaccgaccagctctgtgatagtgtacatgtcacagagcctctcccatactcagtttctttgatctgtcaaacttgatggtaatatattcaagagattatggataaaaggggatatatatgggggcctgcagtgtatgcacacacagtaaatgctcagtaagtgctacctgttaatgtctttatcctgacatccatactctaggtatgttattctcttccagggatgtatctggagcatagataatcagaaccccgcaaacagcttgtaaaatgaagcaagtatctctcaaaattaagtaagcagcccagatacttgcaaatggattttagtatttttcctacacaaaagagtagaattgagtcatttatagtgatagatgctaaaaagtagagcaaatttctttcctccattgtcctgaatttgtagtttactgagaaattctgggaaacccaatataccaatggcatgaaaagcaactgtgctttggagaacagcacctccctctacccatcctgcaaaaaatgaacaagtattgcttgtgaatgctttgcatgacaatgccctctcatttttccctacaaatcacccgccttttcctcttagccaggtattatcagattttatcactaaagtcctaatatatctctattagagatgaaaacaggagactataacattttgcctacttcttcattcttggaccagctatcagaaaatttaccatcagggatctcctgtcaaatttaagtcaggagtgttggacttcttagcagtcctcttctctccatcctagagcaggaggatccgtggaactgtgttccccctctctgttttacacttcaggaaattatagaacagcatggttaagtgacttaccctaggctcatcagccagcagataatacaatacctaatatttacttagtgctcattataggctcaaagctctccttatgtactttgtatgttatttcaattacttctcataacaagtgtaagaagtatagataatatgattgttcccattttacagatgaggaaaggagcatgggaggtgagtaacttgcccaaggtggtagacctggaattagaattcagatagctaaatccagaggcttctctcacccatttgctctggcggcagaagagaattcacattgaggctatttcaggttttcctggttcccgtgaaagcattattgcttgaggttattataatgaaaaataaaagacacacttgcctgctatttgggaacatttatttagtaaatacttattgagtacatagtatggttaagggtctgtgcttggttctgtgggggaatacaaaagtaggcatgattaatgcagcatacattaaacccgatatttctatacagaaaaaagtggatatgatccctgttttgtcctcagtgaaattaatgtatcctattccagaaacttcccagggacttccatagagttagcatgactgatgtcagttctcactataagccgttgagtctaggaaatccaaattacctgaaggataatttgtccctacaatatggtttggctctgtatccccacccaaatctcaccctgaattgtaatatccccacatgtcaagggcaggatcaggtggagataattgaatcgtggaggaggttttccctgtgttgttctcgtgatggtgagtgagttgtcacgagatcttatggttttataaggggcttccgcctttactcagcactcatttctctctcctactgccctgtgaggagtttgccttctgccatgattgtaagtttcctgaggcctccccagacagccctacagaactgtaagtcaattaaacctctttcctttataaattacccagtctcaggcagttctttatagcagtgtgagaacagactgatacacccaattaaaaacaaataagagaacaaactatgaataagcagtgtcctcaaattagaccttggtaggttgtgaaagtgatgggacactgctgttttgccagtgcctagaagctcgtgggatattggagtggttttcttttctagttgtcactgttctgttttaagcaaggatcagtcatccaagccaagatctccttgctttatgcatagtgattcgagggctctctgtcatgggttggcatcttaggaaagatagttagaagttagctatttcggatacacacacacacacacacacacacacacacacacacatacacacacacacagacacacacacacacacatatatatgataaattaaataaatatatgataaatatatatatgagataaatatatatatatatttcaaactagtgtttgttgtctgttttcattgttctggatagagtcttatgattttttagaatttcctttgtctcctggtaaaaataacacttagcttttgtatctttctctaagaagaattccaagatgtttaacaatggtccaggtacttcttaccacaagtatgcttggactggtgaactattaggtccccaaattttaggggatctgatggttgagagagggaaaggtgggcattttgactgtctcagccttggcactggagttgtgatgtatgtggttggagcttaggaatctgttgctgctccacctgtgccaccctgagtctggaccagggtaggtatcccatcccaatttgtgccccacactctgacagtgtctaagatgatgctgataataaccactacaagcaactaacatttggggatacagactgtgtactaggcatggcactaagctcttgggaatttcttatttaaccctgacaacttatactgtagatattcttattcctgtttcacagataaggaaacttgtccacgatcacaaaattagtaagacagagccagagttcaaaccaaagtctgtctcattcatccctgaactcttaaccactaaagtaggcatccctagtggtgaagacactaaggtaggagtcaggccatatgggtggtcatgtcacattgagcccctccacatcatctatgaggactggaatcaacttattccagactcttgttaatgttgatattttgagcctcccccaagaatcacaaatggtcttaatggcatctagcatgatgaatcctttccagaaggtcttcaatttgctttgcccagatccatcagaggaatcactatctatggcagctatagccttacaaatatatttcttagataataggacttgaaaattgaaattactccttgatccatgggctgcagagctttgagtgaggttttgaatgtgggaaaggctttgaatgtggggaagagataggcctgggggagacatgatgaaatatcagaatactgaaggacagttgggtgaaagagagcctcagcatgatgtaggcagtttcctggaagtatacttagaaccaatgaggagaagtcactaggagcatcaacatgttgatacaatgtaagaatgagttttctatgataactatgtgaagtgatatgctaatcattctacacaaaatcattatacaaaaattgtataaatttaaaatgtagaatgtgatgttttgataaacatctcatcatacactttatacaatttttatttgttaattataccccattaaagctgggaataaacttaaaaaaagaagagttttctatcacatacagagttatccgaagatgggctgaaatgcatcagaaattgaccacttccttgttactgaagtctttcaagcctagactgggcagcttcatcatgaggactgaatcattgtcaatcctataattctttgatcccaatcagcagtgctcttataagtgcccatcagaatacttgcaaaacctacctgctcaaactcctctattcttaaagctgttcttcctttcaccaagttctgagaactagcaagggctctgcccagtggtgtgtcatagcacagtacaaaactgatgggtctgcataagaaggcagaataaaggatgctgaggttaagggggggacctgcttggatttgaaccctgtctcgtcacttgctgtgcatacatgctgaagttactctacctctctgtgccttggtttcctcatatattatgctgtacatgggataatattaaaatgaaagtgtttttaagattaatgagataatacatttaaagccctcagaacaatgcctggcatgtttgagatattcagtaagtgtttttgttggctttataagcacgtcagcaaaactttttttaacttttgacttgctctcagccaaataagtaaagtatttatgcaaaaataatcatgacaaggtcaatagtagcagcaatagtagtaatatatgactgaggcagaattaaattccagagcccatacttttaactacctacttagggttaggtactgagttaggtgctatacttgaattatctcctttattccctaggaaaacctggtaggtaagtgttactgcattttatagatgaggaacctggggcttagacagattatgtagtttgcccagtattaccaataagtgcacagaaaggcatgattagaatccaggtctttttgtgtttatctttggaagtattgctacacttgtttggtagtaataaatagctctttttttagaaatcttgtgcttaagtggcatcagaaaagatgataagttcatttcacctcccaggtaatgtccttaaaattggcagctataggccgggcgtggtggctcatgcctgtaatcccagcactctgggatgccaagacaggcggaccacgaggtcaggagttcgagaccagcttggcccacatagtgaaaccccggctctactaaaaatacaaaaattagccaggcatggtgaaacccacctgtaatcccagctatttaggagcctgaggcaggagaatctcttgaacccaggagacagatgttgtagtgagccgagattgcaccactgcacttcagcctaggcgacagagcgagactccttctcaaaaaagaaaaaagcagctatgacggttacttaaatgggcagtaaaatggcatttgaggaataaatggtcaataggatccagtatttacaaccataattgatagtgaaattacagactcatcactaagaaagctttcctatcactttacaataaattgtgtaatctgaaaataattttaaaacaaaaagttatcaaggtccagcttcaggagagccaacgtgacagctgacctgatgcaccggagttacaacacaagaactgttgcattcccttgcaatggtgtgtcatgggtttgatccacatgcacacagagtatatgtattgaaaacagtggtgacataatgttctacttatttttggatctagatttcttcaaaaactaatgcgagaaaaatactctaaaatggatgatttcttctggctatccttcagaaagactgaatgagaaaaatatgatgctgctaaaataggccaaaatgttgatgaaatgtctgtggatattggaggatatactcaaatgtaaattgtctcctttgtcataaaataaggcgaggctataggtcgaggtattggcagttactatgaatagtaaataaccattgaaagattgcttgactttgaaattgattgcagagataaacatttaaaagttttctctcaaatttctagacatgttatttacctctctattcaggttatgtggcccatctttgtgcattggcagtcttattacattttttcttctctttttttctctttgtgtttttagtctgtcattctcttgatcttctacatatggtgtaatgaaaatatgcacagaatgtaatcaagaaatgtctcatataattaaaaaaaacaatttagtgcttcttaacattgtactaaatagaaattaccaactgagggaaactgataagaattgactgtgtaaatgcctacacccgaaccagcatagatattgtttaataattggttttgtttctcatgataaataatgctgcgtgacctgttaccccacttgagagatgcaggagttagagatcaaaatgctcgctttcttaatgagaagagctcaattgaagacttcggtctgtggcaagggtgcctgctgcccttttagcctgaacgaagccagacttacccactcagccaccaggaagagcccaccatgcagttctctcctgtaggggcagctcccgtaaaacctgtagtatggagtggaagagaaagtgcacattttgcccgaagttggaggaagaggcttggctaaacatgctcagttccttcatcactcagataccccatgagcaagagggcagaaaaatgcccaggggttatgctaagggagcttcctctacttggaaacgcgaagtaaaagaataggagggtcggccctcaacagtcaattaggagatgaggcacagctgaaatctaggacctgttttaaatctggctgaacacattagctatatagtacctgtggtttccaaatactatagtaaatatattgtatgtactcggattactggagatgcattgtcaaagtagtcaagtcaaggaccatattcaatattgaagtgggtttcaaagataatgaaacataataaggactccaaaaatgccactaaaagcagattctcaatattagctgtgcatcaaattcactttagttcactgaaaaataacctgttgattaaaattctgttcctcgtcatcatcaggaaaggatttatgctttaaagttcctatgctatttaatctattttgcatttctctggccattgtgactgaatttctctttcatgagtaaatagataagactaaatgacagccatttatagcatcattgctgaggacacagctgagggtctgcccagcatgaaccacatgtttgcagaatggttggtggacagcaggtcccagcgtgggatattaggtatgagtgtcaccatgtgtctcagtaacacagaacggtatccttggcaatgtactctgtgacctccacaaaacattagatatgctgcatcagcttgactgctgaaaatagtaagcctgcctggcacgcataattctgtggccattctgtgctttaaccagtagtcttacagcgaagctctgacctgaggcattctgcttatagcactaacaaaactttgctttccaaggggttaaagaaatactttcaaaacatgtggcctcacttccacttaattgctgtagggactctctggtttcaacaggagcctttgaatctgaagtttaagccttgcttttgttctatcagccctcttttccttcagtgatatgttttgcattagcgttgcagtggagtagacactagcctgtattgattttggtttgcatgcttatgctaaggcagaggtgttaattttgaggaagaatgaatcctggtttggacctgtgcacttgaggaaaggaggaaattataatttccaccatctgtaacagtggccctgctccgaacattttgtggcaaagaaatgtttagtaggtagctctgggcggacaagagggattcaagaatcaataacatttaggcaaaggttaaagacagaaggatgaatggcaccgcccaacaaaaatagactgatgagagttattggccatggggtgtgacttggagaaactgtcgtttaaggattgggggagaaaaagggactcaggaagaggactgagaaaaagaaacagagaaacagtggaaagtggagcattctagcatccatttgaaggagagtgcagaaataggaggtaatgaactgtgtcaaatgcaggtagagatttagcacattgcaagaactgaaaagtgtcccttggattagcaagtaaggaatgattgttgaccgtaagaggatttgtaccagatggtgagaattgaagtcagattgtgagggggatcaaacaggaggagagaaataaagactgtgattatgatcaactcttgtgggcaggagagctgagaaagaagaggagagaatgtgtggctcagggagccacacagtccttggaggactgttcgttagggtagaaatgttttttgtcttgtttataggacaaggagaagactggtgagaaaaagatgaagacagagacagagaagagaggggaaaataagtgtgaagtcttggaagttaggaagggatgactttgacaaggaaggagagacttcttttgtcctcggagcaggggaaaggagacggaacacaggagtgtataaaaaaggaatggagtattgacagtgccgtttctggaggccttgactttctcagggcagcagcaggcaaggatgtctgagagtaagtgggaggggtgtcacagagagaatatgaagagagaagcaggaggttggatttgttgttgaggggaatgggataaaattatggcctcagtgaggactcagctgaatttggaaacaatgaatttataagggagccaacatgttccactgggtgatcaacaggttaaaagtttggtgtgaggtccaagaactagtgcattttgagggtgagcaagagcctgatggataatgtgttcggccatggaatatgatactggattatctacagtatcactgcaggtaatgacaagattcaaagtgggtctccagagtggtgtggtgcctggcctcaaaggaaggggaagtagatggcttttatagggtttgatgtcaaggatgtcgaaaaccattgccacctcagaaacctttattcttattaggtatttaccagagcctgaaattccttgaggggtgccttatagcaagcagcctttcatttatagtaaactggaaatatatttgagactggggatattttaatctccaatgatttctacctaagcgtgaatgaaacatgaaaggagcagttctaagaaataattattggttggtttgttgataggggtgggagcaaatggagaggctgagatgggcactgagtatgagaaaaagaaacgttagctgctgagctgaattctgctttgtcaaacttttctaaacactgctccatctggaaatgtaacacaattaacaacatcttcacagatgcaagacaatgatcttgcaagtgccccactcaaattattattataagttgtatagagatacacacagttcgggggtttagaaaccacagagaaacaaaatttgacgattggcaatacattggatttaggggaattaccattggatttggttttatattacattttagtgtccaagattgcatattttacaatactagttttttttacttaaggaaagaaaatatgagacatcttaataccaaaaggaaaattaagagtggaatttgagtgatgtggaatttgacagtgaagtaaataaaaagaaggacctctgagataagattttctggcagaaaaaagcaaggctcttagtagcaaattttaaatgagtaatggtcaaggaaaataacgtgaaacagattctctcataagcttggatgagaaaacacagaaaggaataatgcaaggtcaggctgaaatgaactgtaattagagtctgtgaaatcgcacaaccagagtattgtcacatggtgtttgtgttttgatttcagtatcttggcagttagataggacctagtcagtaattcttaggtgggttaagaactttctagacataaggcaacgggaatgaggaaactgaaagaggagtcagacgagtgttcagaggaggcaggcacttcccaaaggctactgctattcagtgacatcacggaagtacctaatttagaggttcttagatcctcaaaccaagatatggttatctacaggaatgggacagtttctgcattaggggttatgtagataaggaaaatctccaagtaatgttagccagtgtaggactttcagatcttctccaaaccaatgtatggcaatcagcctctcctaccaaaacgatggctttgaagtttactgtcgtgtctcctctttctatgcaccagtggtgatgccaataagcagtgaattttcagacaacagaaggcaagagaaaaatagtccatgtctaattggcttggctgtcactggaaaaaaccaatagctgagaaagtcaacagcatcaacaatcaatttagaaaatcttttttaaaaaatcattgccatctttttctagatttaactatgatatgtaatcactatgtaaaaataaaaattaaaaaatatataaaggggcaaataaaatcatgcatagcagtccactcagagactgttagcatttggttgacattcctctagtaatttctctgtatgttgatatgtatgtaaatgacatggttgaggttacactgtgcatcacttttccagccttcattttccctggaccttgatcatgaggacttccgtatattgttaagtattcttcgcaaatgctattttgatggctgtatacccttttcccacatcaatgtgcaataaattgcttaactgcattcctgttgctgggcatttgggtggttgctatttttaagctactataaatcaacttgtgatgagcaatactgcacataaaccttctttttttcctgatcattttttaggacaaattcccagcagtaaagttgctagatcaaagaaaacccacatttttaaggtttttgagacgtgttgtcaggtcctcctcataaaggttgtaatacacactttgcatgtgtaaagtattataagggacccaaggggagatactggattataaaagccaatggctattaggtcattagcttaaagagctatttttaaagttctgtgtcctggacctttgccataagctcccgtctataatacaattaggaagacaaatctctcttatatgccatctgtgagggaatttgtgctaaattattcaaacaaaactctttcctataatgcaaactcaggcggcaggaaatatcatgggttttgttgaactaggtttattccaggcagagcttaagtacagaatcaggtgggatctggcaggggtcatcaagtaaaagtctcagaaagataaaatgtgttgaaggtgtgaagaggaccatcttgattttgacttatatccttgaagatcccctcccctcccctcccctcccctcccctcccctcccctcccctcccctcccctcccctcccctcccctctccttttttgagacagaaccttgctgtgtcgaccaggctggagtgcagtggcacaatctcagctcactgcaagctccacctcccgggttcaagtgattctccagcctcagcctcctaagtagctgggattactgccaccacacctggctaatttttttgtatttttcatggagatgaggttttaccatgttggccaggctggtttcaaactcttgacctcaggtgatccacctgcctcagtctcccaaagtgctgggactacaggcatgagccactgtgcccatctcttttcatattttaggatccagactcatccctgggagacaagcacaggctacaaacctatcagcttaaccatcatccctgtcattgttttaatgtgttgaatgtaagctattaagacttcaaatgtggctcgagtattctattacgctgtttgctttttgctttctggaaaacatttatgagactgtgtaagggagcgaaataggttgggcacttgggggtaggtttaaatcccatctctaccacttgctggccgtatgaccttggagaaatcattttaccactctgagctttaggttttaatttcctcatctgtcagttaggaaccactgaattcatcttggagggctgttgtgagaatgaaaagaataatgtctgtgaaatactcagcacaatttcatttctatggctttttaaatcctactgatgcactcccaattatgtgaaatcacacacccacacacacacacacaatttattgaggcatattttgaagtagcaaatgattggaaacaacctgtaacctctaaatatctattggtagaagactaatgtaattattctgactagtagctgttgttaccatgttaagtatgaagacactgaccagatagcatttttttaaaagcatcgctgatttttaaaggcattgtgattgagaaagtgctgttttacctgttagctctgtattatttcatcaggtatggtttgaatgggtaaatatctgcctcaccgcaaatgcaatcattcagtaaatatttattatgtgccagcatggtgctatagtttcacaaacccattacaagtttgaatttttttaaactggattcattcaggggtgtattcttttggaaataattttcaaacactgtttcatcatgcggatatgacattctttagaaagtgctcatagaaatcttctgtcatgtttgagaacactctgtacttagtttgtaactacttggcatacaaatttatatgattgtatataaagctcatatcaggcgcatcttgtgagtagtaggaagatgtttaaggttagggcctaaatatatgagatttttaaaacacattttggcaagtgtgggttttattttttatatgtgaaaggagctgtgtctttttttcctggagcttaaatacatgaagcaggaatgtatctggtggtagtagatatttgcctcttgcaatgttgagatcgcacaattctagcagatactcccagcctgttgatcttataggagattcccctatactttgggcttcaggtccatcagctgtaatggccacagttggtactacaatagctgcctctaagtagaagaataacctttttggaactatttgttctccaagaagaaaaaaggcaggtttctatcagccatttgttgtcatttattgacttcaaatgaaaactaacttgcctagttggacaaaaagaagaatgtgtaagatataaaaaggggatgggatgctcacagtgacattaataagcaatacatttacaaagtgtttgttagttcaccgtctgcataacctgttgatttgtgcatatttcttgtgaggtttatgtttgtttttgaacttctatttgtccaaatacatttgactttaattatttccagtcttgtgtttctgtatgtgtttatgatcaagaatgctttaaacttgctcaatatacattttttcagactttttttaaatttcaaaagtaacttattgttttatcttattataaaggcaatacttgcttatgtcagaaaaaatgaaaatggtgacaacctttagggaggacaatttggaaatacctatcaaattttaaaaatacagatatcctttgactaagcaacttctcttctaagtgttataatttacagatacactcccatttatgtgaaatgacatgcataaagaggttttcattgcagcatttttgtggtagcatgtgattaaaaataacctaagtgtccatcaacagagaaatggtaaaattagttgtggtcatttatggttaggatgatcattcatccaggtttggcggggacagtctttgtttatgtctgttctgcagtagttaggaatagcatgctcttccctttcaaaagtatcttgatttggccagtaaattttgtgtttagcctaatttgagtgtagtcttactatggaatgccatataataatttttttaaatgatggcattctttatcttatctttgactaattaaaaaaaaagcaagatgtacctacattgggttttaaaatattaaaatatggaggaggatgtggaatacatataaggagattcataagcagaattgactgttgataatacactgatatgcagattttcttcagtaggcccactgcatctgagcgttctgcatgtgcaaccaaatgcagataaaaaaatacagcattcccaggatgttaagccctcacgtatggagggccgacttttcctataggtgagctccacagggctcactgtgggacttgagtacacatggattttaatatacttaggggtcctggaaccaattccctgcatgtaccgagggatgactgtacaccaaatacttctggaaatacgtataaaaaactgaaaatattagttgttttagggcttggaatcttggtggctggagaccagaactaaaagggaaactttacagtatacccgtttctgtacttttttaaccatgtgaataaactacctattaggaaagcccagaattttagaaagggaggaaaaattatatatctatatagaaaaacaactttaaaattatacatcctagtgttaacagtgcttattccgaatagttcagttgcaagtgatttatttatttatttactttttgagacaaggtcttgctctctcacccaggctgaagtgtagtggcatgatcacaactcactgcagcctcaaccctttaggcccaagtgatcctcctatctcagcttcctgaataaccgagactacaggtatgtgccaccacacccggctagttttaaaattttttgtagagatggggtcaccctatgttgctcaggctgtcttgaactcctgggctcaagcaatcctctagactcggcctcccaaagcactgagattacaagtgtgagctaccacgccttgccacaagtgattttttttatacacatctttttgaatattggcatcatttggacttcaggattaaacttcttcaaattattttaatgcctaacataagcatataccaacgtaagtatataccataataatttccaacataagtgtataccataattctatttaagcgatctcttgttgttgaacattcatgttgttccagtttttcattttaaacaatgttgcaatgggcattctttcataaaaagctttgtgaatgtccatttgtatttctttaggatagattcctcaaaaaagtgtatctgaatccaacaaatgccaaatcctaaggcttttggcacccatttctataccagccctacaatgcttactgaattattttcatgtatatcattttaagatgactgggtaatttataaggaggtttaattgactcacagttctgcatgctgaggaagcctcaggaaacttacaatcatggcgtagaatgaagaggaagcaaagcacatcttacatggcagcaggagagagagaagggggaagcaccagacacttatcaaacaaccagatctcgtgagaactctctcattatcatgagaacagcgtagaggaaactgcccccatgagccgatcacctctcacctggaccctcccttgacatgtgacgattacaattcaaattacaattccagatgagatatgggtggggacatagtcaaaccatatcaatttctaaatcactcttctaaaatatagtatagaaccaatttacacccttgatagctgaatctgagactgtcaacttctttatatcttcccaacactggatcttataattcttattcatcttggccaatttgatgggtaaaactctttctctgctgttgttttaattagcattaaaatgtttttggggagtaggccaaatttccccccacacatttattgaccattagtatttcttcttttcttttcttcttttcccccttcccttccactcccctcccctcccctcctttgatagggtctcacttggttgcccaggctagagtgaaatgaagtcatagctccctgtagccttgaactattgggctcaagtgacccagtagctaggattacaggcatgcaaacccacacctggctaatttttaaatttttttatagagacagggtctcactatgttttccaggctggtctcaaactcctggcctcaagggattctcctgcctcagcctcccaaagcgctgagcttacaaatgtgaaccactgcacccagctctatttatatttcttatgaataaaactaacagaagaaaaatgtgtgatttttttttttttttaatgggaccaaaaccttaaaagaaggttctgggagaatggagtagcacatatcttggctttcttctttttgccagtcaaggtgctcagaataagagctgttatagaaatgtcaagtgtaaaatgattatgtaagtctacaggccagctgctaggttatatctgactttgtacctctcaatatcagggctgtttaccacctcctgttccgtaagagtctggcctagtcattgaaattgatcgggcataatgtcaccacttctgatccttacgcagtggcatttactgaggcaggaaaggtcttaaaagttaattgcaattttctgaattattttaactcacaatagcttgttgcacccttaaacatgagatgggggaatcatttgtgttaggatggttttaccttaatctgcttttcaaatggcacactgtgtcagatgtctcttgacatagttgtgcagtccatctggcgtacagacggtcatcgttaatgtaacagtgatccgcatcatgtatatgtgtctaaacatcaaacaaatcaaactcttttgatgtccttttcaatcagtctttagtttcaaaaatattctttacactgctgagtgtaacagcaaaattgctttaagtcttttctctcctcccccactgtacactcagtgttttaaggaatttaaaacacttaactgcttcagaggatgcatgataggggatgattgcctttctctggtatcctcttggcatgtgtaacatacatgtagcggtctgtttgtttctcaatgcttcatggtctgtggtgcctgacaagacccagtctccatttgaaggcttttctgttgcttaccagggctgcagaggagctgctttttaagggcagtatttcaatagttaactgggactttggggaggcacagccttcggggagggcaccaccaggctcatttaattttcactagtaatgtggtaaggcaggcaggtacaatttacatttgacacacagggtaactgagttccaggcctatgcatggaggagacaggattttaaaattccaaatctcatgggttttctcaccacatcatgtgaggtgtcctatagaacaatccttaagtgaatgcgtttcgtgtccgttttcaaagatcatggtcagtgtataaaaatagacagttaaatgtccatggaacgtgtactgtccctctccttcccctgaatcatggccacaaagaaatccttcaaaagatcaaagaaaatggagatattgaacaggtcacactctgtgatcatgatgcaatgggtatagaaataataacaagaaggcaatttaaaaaattttacccacttgcaaattatgaaacacactcactgataaccctggaatcaaaaagaaaaccaaagaaaatattgacatcatcacttccattttcattggaagtgaaagttatcagagaagaaagaaaaaagaatattttattatcaaaacttctaagcacagtgaaagaggaaattttctattccttactaaagaataaagaaaaaataggacaagtcattactcagcttaagaaataaagagaaacaaaataaacctaaaaaaacaggaagaaggaattaataaagataaaagctgaaattaaagggatagaataatggataaataaatccgaaagctgtttctttggaaagaccagtaaaatatataaatctgttgaaagcccacttaagggaaaataagatagcaaaagagtacaaactaaagacaaagaaaataaatggcaaaccaataaatagaagataagttaaaatcattttgagacttgtataaacaaactcatggtaagaggtttgaaaaccagcagaaaaggatgatttttcagcaaaatataaatgatcaaaattgatcccagaagtagaaaccttgactataccaattactgtagaagatactggaaaggtaaagagttatcattcaaaaggattccagagccagacggttacagagataacctttaaagaaggaaaactgtctgtctgtctgtccattcatctgtctgtctgtctatctatctatctatctatctatctatctatcatctaatcaatcatctgttttctagctttattgagggatagttgtcaaataaaatttgtatgtatttaaggtgtgcaacatcatgatttggtatatgtatacaccgtgaaatgaccaccacaactgagctaattaacacatccatcactgcaaatgcagtgagaacacttaagatctactctcctagcaaatttcaagtatacaatacagtgttattaactatagtcaccatcctgcacgttatgtcctcagaatttatacatcttattactgattatgcccttttgaccaacatttccctatttcccacagcccctggcaaccccaattctactctctgcttctgtgagttcagtgactttaaattccacaagtgacagccgggcgcagtggctcacacctgtaatcccagcactttgggaggccaaggcgggtggatcccgaggtcaagagatcaagaccatcctggccaacatggtgaaaccctgtctctactaaaaagtacaaaaattagctgggcatggtggcatgcacctgtagtcccagctacttgggaggttgaggcaggagaatcgtttgaacctgggaggcagaggttgcagtgagccgagatcgcgccactgcactccagcctgggcaacagagcaagactctgtctcaaaaaaaaaaaaaaaaaaaaaaaaacaacagcaaaactccacaagtgagatcatacagaatttatctttgagtctggcctatttcacttggcataatgtcctccagagttcatccacgttctcacaaataacaggatttccttccttttatggctaatattccattgtgaatatatatgtcagattttctttatccgttcatccattgaaggacacataggttgttcccatattttggctattgctaataatactgcaatgaacatgttatttaaactcttccaactgaatttaaaaaaatacttgcttaaaatgtgtagtgtgctagccatagtgctagtcctaaaatagttggtacatacatgagtgtgaattcctgcatggtaactcatggaataatggaaaacgaagccacaggctttaaccgtaacccagagctgcatgtgtatgttgttcctaccaccgtggatcaggtggtgccaaggaatcatgatccacaggcacacatggaaaactagatggaagatggtactgaagctggtctttggaatatactcctgagagactaggtggcaactcacttttattagcccatgtaaacattatttataacctattgacatgcttggtttgggcatcattttcaggctagtgaggtttatgtctttatatgctatgtgcctaaatttatagacctggaggcaacgcagtgtagtggtaaggggtaggggttctggagtcagatggccaggatttgattcaaccatttatgttggttcaaccatttacgtgtgtgccattaagcacgttacattatgtctctgtagttcactttctcatctggaaaatggggataataatagtatctacctcatagggttgacatgaagctttagtatgtaaatatacataaattgcttagaacagtgtcttacacatagaatgccctcaataagtcagtaatgatgatgatcatgatgttgatatttataattatcattatcatcatcttcagcagtatttttataagttggagggaaagactatgtatggcttttaaatcagactggcatacctgttagctttgtcgtgggtgtattgtgtgcccttggaactttactgaactttattttattgtggtaaaatatacataacaaactttaccatttaatcattttaagtggacagttcaatggtgttaatacgtttgcattgctgtgcaagcatcaccaccatccttccctgtaacttttcatcatctcaaactgaaactctgttcctatcaaacaataactctatggaacttattttaaacatctttctctacatctgtgagggtaggcacacttagggctaggttgtgagaactaaatgtgggagaaattgcaaagccccacacaccttatagggccttagtacttcttgtccttaggaaaccctgtctatatcttcccaaacctgagtgcttaggaaagggtcctctgcagtcacactggtggctctcaacattccttatgttcacccttctcctctcttcccccctccatggtgacctttttctcagatatcttgttttgtgaacaggaacagcatatgcaatgtgttaactcgttttagttgccaagaatgtgctaggtgctatttgggagagataacttcccccattagatttactgtataaattaggtcaaacactaagttggaaagaagaagccagtatccatggaaaatttattattttgaatatacttttttttcaacattccttgacgatgaaatgtggtttccacttgtgcatgattacaacgttgagaatctagagttatatgaagacaagcttttctccacaccttttttgaattacatagaaaaaaattggaatagtaaaggcagccccatcttgggttaggcacctgataaacttgaaaacataaaaggagtggtggtgatatttccacccaatttctctctctctctcttttttttttttgctttgaattcgtaccctacatatctcttcttccttttcatacacattttaatatcagcagaatatttcaagaggacttttccccagctgaaatttccgaataccgaaattacttcaggtttgttttgggtttttttttattttgtggtgtttcctttctggctgactttttagccttctcagtagagaggttgtgatctgtaaatatgatagggataatggtttttagatctattgacatggctctttgcactcacactcatatgacctctatacgcctgtttcttttcctaatgtcatccacatgcctgacctggactatgaaatactttgttcctggggtcacccctaactagtaaatcattgtcttaacctgcagccctatagagacaagtgtggaatatatcctttgttgcaaagattgaagtatgcagagatgaatcagaccttgatgtttgactcctatttgtctcacatgtcttgggggttggttggcattgccagtgtagaaatggattgaaagttgggttttagatgatgagccacaaccagagtgtgatgactatttgactcctatttgaatatgatgtgaaaatacaaactgtgtttcagtagttcatctggctcagcatttcttaaactgtgctttatgagctgtgaaaaggtgtatgatggaaaaagggattctgaagtccaataagtttaggaaaagctgagttaaaattaagagtctcttagtaagaatttctcagaactgttagtctaaacattatgaactctcaagtggggagtattttatgtagcattttccaaactttatttgatccagaatctcctgggacatatctctaggactctgtgatgtgtttattgctgttttttttgtttgtttgtttgttttgcatttttatacctaacaaaattgaccattttaaccatttttaggtgtacagtttagtaagttatattcacaatgttatgcaattgtcatctctatccatttgtcttagtttgttcaggctgctataagaaaatactatagactaggtggcttataaacaacaggactttatttctcacagttctggaggctgggaagtccaagatcaaggcactggcagatttggcatctggtgaggacctgtttcctggttcatagatgaccatcttctttctttgtccttccatggtagaaagggcaaggatgctctctggggtctcttttaaaagggcactaatcccatttatgagggctcaccctcatgacttaatcacttcttaacactccacttccaaataccatcacattgatcggcacaaacattcagtctatagcactattttgagaactttttcatcatcacaaactaaaactttttacttattaaacaacaactacccattatcccctacccttacctcagaccctggtaacctttgttttaccttctgtctctatgaatttgactactctaagtacctcatgtataagtggaatcctgcaatatctgttcttttgtgtctgacttatttcacttagcatactatcttccggatttatttacattgtagcatatgtcagaaagtcatctctttataacgctaaatactattccattgtatgtatagaccacattttgtttatctgttcatctgctgatgaacatttgggttgtttccacattttggccattataaactttagtgtgcaagtgtctatttgagtttctgctttcagttattttgggcatatacctaaaagtgggattgctggatcatattgtaatcctgtgtttaactttttgaggaaacatcaaactgttttccatagcagttacaccattttacattctcaccagcaatgcacagtggttctagtttctctgtattctcatcaacacttgttattttctgtctttttaaaaacaggcattctaatgagtgtgaagcgatatctcattgtgtttgatttgcctgttattattgttgttgtttaacttccaactcatctcagactgatacgtgattctactaccattggttacacagttcagcacaatatatgactcatgtaggttggaaaacatccgaaatgttatactccctattcagtgaaatgagttcattgatcacacagttggatgtgattagaataccaaattgttataaaagtttttaaatgcttcacttcgcttctcttctgtcttcttttctcttctcttctcttctcatctcctctcttttcctttcccttcctttccctcccctcccctccgctccctctcctcccctcccctccactcccctcccctcctctccccttccctttttgaaacagggtctcactctgtcacctaggctggagtgcagtagcgtgatctcagctcactgcatcctcaacctcctgggctccatcaatcctcccaccttagtctcccaagtagctgggactataggcacatgtcaccatgcctggctaattttcatatttttttgtagagatgagatcacattgtgttgcctgcactggtctgaaacccctgggctcaagtgatccacctgctttggcctcccaaagtgctaggattataggcatgagccactgcgcctggcctaaatgcttattttcaattttgcagttatttcatcatggaccagtaccaaacccatagcaatccacagaccacagtttatcactgctctcagtcatattttacatgtcaaatatatggaaactgtttaatggaatatgatagatagtttaagcagttttattctaaaataagtgaaggtatttttcattcaattcccaaaatgcaactagtgaattatgttggaaaacaatctggccatataatatagtaatgcatatgttgggttttagggttagtttaagtagcctggggaatagttcagtaattttttggagggatagattccttggaatccagacagttttcctgataggctgcactgtggtattgcccctcaaatgagcttgaatgtcaagtccttgagaggcgatacagctgctgtatggatggtcatgagtctggaatccagaaagagataaaatcaaggtgcaagagccaacggagtctttggggttgagcactctatttccctaactgtgctatgaggaaaaaataattaatatatgctatgctggcaaggaattgtgcttccaaagctcttccaagcagagttaattaagtaatgtatgctcacttcattttgtagttggttctctttggcatcaagactgttaacttaagcaaatggaagcagcattgcagcttagtgcatagttccaaaagaataaagcaaaaccaaatttgaagagtttgtatgctaaaaatgatagtagtaattcacattctactctaaaactttgaaagaaaaatccacatctgatccacttttgtgagtgcagccagtattgatagttttgtctgccctagggagtctcattttccttcttttggaaactattcctcctctactcctccctggccaaggattcacggtctttctatcctctttcattagctactgtgggagggaacttgaccctagacaggtcaatatgggccttttcctgggatgtttttcaaactgcaagtaagaagagagtcagtcctctgacggggtgccagccttcaataatgaaacttgggaactagaggttcgtgtggaagaaactcatgaacagcaagagccaataagccaacatgcagggtgggcacacaagagattaaggaagtccagggccccagtacctgaggccttggtttacagctgtttcagtgggtcagctgcatccccaccctgtgccctgctgggttatactggactctgtaatccaatatatgcctatttacatctggatttctctcacttgcaaataagagtccctcatgaccccttcctgctcaaaacacttaacatactacctttcaaacagcaagtatgccattgatagctttgaataagctttaaaagttaaagttaacatagcctaagcactgactcgtcatcattctaacccagactcacactttgctcccattattgaaaaaacagtaacagattacttcaaaataccgtaacatatcaaactttatattcttttttttattttgttttattattattatactttaagttttagggtacatgtgcacaatgtgcaggttagttacatatgtatacatgtgccatgctggtgtgctgcgcccattaactcgtcaattagcattaggtatatctcctaatgctatccctcccccttccccccaccccacaacagtccctagagtgtgatgttccccttcctgtgtccatgtgttctcattgttcaattcccacctatgagtgagaatatgcggtgtttggttttttgttcttgcgatagtttactgagaatgactttatattctttttaaaaaataatttttagatacagaatatgggatgggtgaagtgaggggatttaaatcttgggggctaatgacatctgtgagtgagcagaaggtgaaggcatggcagagaggtggaaggaagtagaggaggcttgttcacacttcttccaagattggaagagggggctgaccaaggatgcctggaaggattaacaagtggatccaggagcctactgatgtgggagctcataaatttgtggcagctccaggcccaatcatggcagcattttgtccagtagcacagggagccaagcattagggacttagggtgataaataatattcccctcttcctcttctagctgagacataaacatgggaatcagacagagatcacaatatcatcttgacttctcatggaacaaattggagaacatgagtttagctcttcaaccaagtgggtttgccaatcctcaatcctgaattaaatgaatttatccacccatttctggcacagctgggcaaccacaggcctccgccacagagagaggccccttaccacatggcagagaccgagagcctgtcttcgtggaacggaaatagctgaggagagatgtcccatttcttctcccaaaccaacttagcaaagaaggagggagggccaggagtgttatcccagctgatgtccctccatatagacagacggctgatccttcttccagtggaggcaagagatggctgggttcgatgccaaggatcattgtcccaggctaactgttccatctgcattatttcctcctcctagtccttgttctcttatagaatgacaaagaggtggggatgctgaagctacatgcagtggcctagactggatcatgaaggaaataaggcaacaaggggagagagaaatggactgagagaaaagagcaaagtttgtaaatgaaagagcaggtgttataggtgagaaagaatgagaatcctggaagaagagggactaaggtaaaagaggaagagcatttacttcttatgtcccagttattgttgttctaggtgatatctaggttaaaagagagcgagagagctgtgcaaaggccctggcaggagctcacctggcatgtctgaggaccagtgagcaggtgcctggctgaagccgcatcgggggtggtgggtgggggagagccttggagatgtgatcagaaatgtagtgggtaacaggttctgcaggacttgtaaggacataggcttttagaagagaaacctgggacagagaagggttaggttattcagccaggaaggggcagagctgggatcctcagtgtggtggtgtggcatttgaccccagacacacagtgcttcctgaaacagtgctctggtctggcttccctgttgctggcttcccaggttctcctcctgcttatgtttgcttttcttcaggcacgatgaacttgtcctcctctaactgtcctttacatgtggatgatgtctctgggttagcctcgctcgttctgtgtctgacctctcccaggaaatatcctgctttcccttggcttctcctgtgttcctgggctggtgattcccaaacctacatattctgcaggggccttgcttctcaactccaaacccaaatataagtccctgatgagctagggctctctaaatatagagtgctcccagtttatttcccttcctcacagatctcctcttgcccctgttccttaggacaatctcaatgtctaaaaaccatggcattacctgaaatcccatctttcccctcgtcctctatccccacatccactcaatggccaatccaaagagaggtgctcatatcttccccctctggtttagctctccctgggatcttttaaaaatagttagttaattaattgttcttttttttgagacagggtctcgctcttgcccaggctggagtgtagtggcacaatcacggctcacttcaatttctgcctcccaggttcaagccatcctcccatctcagcctcccgagtagttgggtctaaggtgcgcaccaccaggcccatctaatttttttatttttgtagagataaggtttcgccacattgcccaggctggtctcgaacttctgggctcaggtgatctgcctgcctcctaaagtgctgaaattataggcatgaactaccacgccaggcctgggatcttatagtagcctcttaaatggaccctctcctccacccattggctctctccctctgcacctgacatcttttcccaaaacaaagctaggatcccaggactcctgttctcatgagctggtctggcttccccactgcctaaagaacagtctagatctttagcaagacactcagaggcctcctctgtctcacctttcatagttctcttctcctcccacctcccattttctcttctgtgatccgctgtgcttctgctcatttcccatccataaaatgttttcttctgcttcaagcagccacccagctgccaccttctgggtcaaacgtccccagaattcccccaggcagaatgagttgctcttttctctcagtggaagagctggtatcctcattaagtgctcctggcaaataaaaatgcattgaaagtctggcaagtgctgattgttgttggacatcagccagtcactggagtgtgactgttacccatacaggctgaggcagcaactgtgaacacacggcaggtacaggaaatccccaaattctattaattatgtggtaagttcctggagatattttggtaatgtattcctaaagttctgagtttcttaattgcatttctgttaaagggagtttacttcaaatgtagaaaacctaaccaaaaccatgtttaaaagaaaaacaagtcttataggtagaatagaaaagtaacattattgttggttatgggtttcctaacaagatctgggtcttctatgatagacttgcaaatctgaaagcctttctgaggtatgctagtccgtattaaaatttctttctttcttttctcattctcttttttctttttctttctttctttcttgcttgcttgcttgcttgccaaggtcttgctttgttacccaggctgaagtacagtggtgcgatcatagctcactgcagcctctacctcctgggctcaggtgattctcccaccccagcctcctgagtagctgggactacaggcatgctccaccatggccagctaattttttaaaaaacgttttatagagagagtcttgctctcttgcccaggctggtcttgaacttctggcctcaaggggtcctcctgcctcagcctctcaaagcactggcagtacaagtgtgacccactgcacctgggccttactaagatttttagggcaaatatttgttatagaaaatgtataaaaatgagaacttcaaaagtggtaattctagtttacattttaatattttccacctagtcttttcatttgtggaaactgagaattatatggatgctttatatgtatatattgcattttaaatatgtggcagtaaaggtgtctggattcatttgaaacccaaatgagcattcccttcattttctgtgaacgcaaatccatgatcatgttgatctctccctattggggtaaaagaaataacgccaagaaggttgggcacagaagggagcttctcattccctgtctggtttccacagagaactaccaaatgcagggtgtctgccccagagccagaaagctgcttgctctgtgcaggagataaaggaaagagagaaacctttttgcagatggaaatgacaactgaagaaagagaaaggtagcaaggagcttcttgcttgccttctgaagaaaagaggaagaagggcctggatgaagccccctcctcctgccccttctccctctgatagcactgccatgggctgaggaaacctcttctgtaactgctgggatccttgatccaactgtagtcagaggacaagtgcacctggcatctctgaatatgttttcccactgaagtgttctgtccagcttttagattccatcatgtaattcctactctccttcatgtgtactttggatgaaataagcttttctggcctgaacttagaaccaccatgcaaggatttatttctgtgggttaattacaaatgatggcttataagcagctaccctccaaatgaacttttggtatgtagcctgcccctaaatttgaggctgtttgtataaaactgtcaagctggtggttaataacaactaagtaacaatagcagcaactatcttttttttttctttgccatctcctatgtaactggcaagggctatacctacacagtgtgcctgtttttcataaatggataaactgttcttcatcatcgcatcttccatggtcctttcttgacctgagtgaacaagaatgtcttaataataactcccagacaatgagtgcccagaaggtgccagacgctgagctgtgttcttaatgtatattttctgtaattttgacatccccacaggtcgatagcatcccccaccttatgagttagaaatctgaggatcagaaaggttaggaactatgcccaaggacacgtagctaagaagcagacaaggctgggattctaactagaaaagctatttgtgccctgttccttgatatgtttgttattctcttacttctattttctaatttgatgtcagaactctgtttatgtgtatgttgaacaattccagttatttgatggattgtgaagactaaggaattctgttttattcattacagatacctagaagagtacgtagcacattgaattgagtttatttaaatatttagtgagcacttgtacatgtcaggaactttgctacactctggggtagagaccatcctgggctattccctcaccttgcctttggagtgtgaaaggaaagggagtgagttgcaaggatgtctttagagtaagaggccctgggaaggtagcaagctcaggtcttacccatagcccttgggaaatgtttttatacacagggcaagcccacaaatcaatgaaatgagaaaccactggcccatgaacaaggagggtttaatgtatggaagttacataaacagtggtataaattcatgtattaatatttgtctagtacaaaatagactctttgaggaactttatgttatgcctttctgttgaactgagactcatgttatgcagtacttgccaattagccagaaatggtaactttccatcagtagcacctgaggatttaccgccatgagtttgcagtggtcatctcagaggtgacaaccatttttccttgaattttgtggaatagatttttaccaatgaagtcacaatcctacctagttgaatatatcttttagaaagtcaagaaccttttctcacaaccttttttgggaaaaatctcaaacatacagaaaaattcaaagaatggtatggtgaataagcgaatacagggtcatccagctatggtctatgggccaaatccacccaatgcctgctttcataaataaagtttgttagaatacagacacacgtttgtttacatatgatctggttacaacaacagtgttgaattattttaacagagaccaccatatggcccacaaggcctaaaagatttactatctgaccctttatagaaaaagttgactgtcccttgatctagattcactgcttgttactattttactatttgctttatctctgtcttcacagacaggcagacatactcgcaacctctctctctctcccttcccccacacgtgtgaacatatatatacatgcatactttttttgaaccatttgaaagttatgttactgacattatgataattcacccctaaataattcatgtggatgcttaaaaataaaggcagtctctcatataaatgcaaaatcatgatcacacctaaaaaattaacattcattgagtaatatcatccaatgtgcagtttatatttaaattagactattacacccttatttagtttttcctttgggatctggggtctaatcaaagatcatacattgcatttgttcatgatggctttgattgccaatttttgttttacatgacattgacttttttgaagagtcctttaaaaacttcttgcaaagatgtatgggtttgttagctccacgatagtaagagctaaatatatagccattatagtaaagcagtgtcttgtacttcttttcccttgggattgagacacttttagtgtttggcttccaaagttaacacactaagttttgggttttgctggaaattgtaaatgtggaaaaatctcagtgtgaacagcaaggcagatgagaattcacagaatgcattttatgtaattaaaggcacagcccttctcgcttgctccagtggctgcccttgctagctcttggctgggtggctcttccttctggcttttcttctgcctagggcctggctcccctccagcatcattaggttgtagcaagaagctggaaacagacctgcagttatttaaatcttctagcccaaattgtttgggctggctggcagcacaaagcttttgtgtttgcaggctgcacgctgaacacagcatggtgttcaaaggcgtgcatcccagatctgtgtgtctgggatgcacataggaggagcaccttgttgagaatctgtgggggtcacagtcatgcacctcttaggggactacatgctggtcacaggtcttgtcttttattgtggtgccaaatgatgtccagagagcatcaacactcagcctttgctttcctctgggcagaaagcactcagagcttaaaggccagtcagaggatacttgcactcccaagtgaagactcacctggatctgtactagtcactcgttggtttggagttgcctcatggggtaaagggtttatttactgttcctgaatggtagaattgtaagtgagtggtgcacgtgtttttgaatgtggtatcctcaagattgttcaaggctagagcagtggagcatttgagaatcacagagccaagtaagttaagagggtgcatatgtatgtgtgtttgtttgccgttgggagggaaggaggaagaagaacatcatagagaaagagaagacaagaagaaagagaactaaaatggaaatttcaggaaggctgaattcagaataaggcacctggaaatttggagaggcgggaaaaggaattgccacttttcagacttagcatttttaacatctggggaaactttattttattttttccactgtgtgaagttaattgggagtcagatttagtagcggggtgactggtatggtatataacctctctgtgcctcaactactcctctagaaaatggagacaataacagtacctgctgtgtatggctgttttgaaaataaatgaaataatccatgtacatcctcagaacagacctggtagctagatggcaaatgcttgaagagtgtaaggtataaatgtttagttcatattattaagtgccccacataattcaccataatggtctgatatctacagccttcaccaatctttaacctattttcttaagaataatgagtaaattttttaaagccttttaaaaaagaattcatcaactggacatggtggctcatgcctgtaatcccagcacgttgcagggccaaggtgggcagatcacttgagctcgagaccagcctggccaacatagtgaaacttcatctctactaaaaatacagaaattagccaggcatggtggctcatgcctgtggtcccagctactcaggaggctgaggcagtagaatctcttgaacctaggaggtggaggctgaagtgagccgagattgcatactgcactccagcctgggtgacagagtgagactccatctcaaaaaaaaaaaaataaaaaagttcaccagcaagctttgattctcatattgacaaagtatttttccacttttcagcaatactttattgtactaatttttatctccatacgtgctcataaatattccagtaatagtaaagtatgtgacttttattccttctttttctaccatttttgtaaccgatcatttacatgtaaacgtaccaaatgaacatccacatgtacttcttccactggcaataagaaaagcaaaattccagggagaaaattttgctgtctctggaaaatgatgtgacccaaattggaagtctgagtactgagtaaagacaagtctggaagcaagtaagactggcatggtttgcatagctaaaatcagtgataaactgatatgtccgtgtgataacaaagttaactagaaaaaaggattgaaaacgatttatttcaagtaactgaaatattgggacaaaataagtgttttggaaagaaagatgttatatttaaattcagcgacaggatgatcaatgcacaactagaaaatctgggtcctttaaaatggactctgtatcaccacttttttcaatccttgctttctttccctttcttttctacctaggacagtgtcaatcaatgaaacatatatggccaagaaagtggaaaactgcaaaactcaggggatgggagggaactcttacatttgataatttaaaaatgtggaaagtaaccgaaggagaaactggtgagggtgtaggtgacttcagactttgagcagctagctcactgtcagcctccaagaggtcttgtgaacaatggcatctcttgcctgctgaaaaaagacctaggctttacccagaaagaaaacatcctgggatgaagccaccctcactgggggaaaataaagttgtagtaactcgtcattgttctccctgtctcccatcttcttcctttttagtacttccttcacaccgtctacctccccccaaccccacctgcaacaatctccttccaccatagatctgggttttcacttctcagatatagcccccctgtgacattctgcaacttgtcttccatggccttcgaggcgtctatgatcagcctctacctgcatagcctcatcttcctttggtgctggcctcagattttatgcttcagttcctcatataagacatgttgttttgcacctccatcgtttgggggctgtgtgatcttggacaatttgcttaattgttctgtgccttagatcactcatctgccaaaatttttcataaagttgtacaggaattaaatgagtgaatatatgtaaagttcttggaataatgcatggtgaataataagggctatagaaaggttagcaacttattgctattgttcttgttgttattttgagcctggatgtattaatttttttattactgcatacaacctaatgtctttaacaccaatggttatctctcattttctgaatgtcagcagtctggacatggtgtaactggatttttagctcagggtcctgcaggactgaaactaaagtgttagtgtgggctgaggtcctatctgaacatcttccaagctccttccaagctcatgtggttgttaacagaattcatctccttgcagctatagaattcatggccagcatgaattctgacctcaccttctaagagtttccctgattaggtcaggcccaatcagataatctttcttttgattaactccaagtcaacttgctagtgacatatcacagagttatagcccatcatattcacagatttcacttgcactcaagaagaggtgtgtacattgggggcaggattcttggggtttatcttagaatcctgactgcaaactgggtaactggaaatattctctgttcactaagttgaattgcacgtgggtgaatacgtgattctgtaatcaccaccatcgtttcagatttttgtagcatgtttctcacagcattcagatggattcacatcagtctggcttctggagccgacattccctatcctgtagttttcactaactgatggggtcagttagcaccttcaaaagtcttttaggaagagaacagttagagacttgtagctggtaaacttcttgactaataccctggagttccaaaaggatgacccacaatttgcaatccctttcagaagcatttgtttgtacttaatgacttaaaatagatgaagacagacccctccttaattgtcattggtgcctgccaattcaaagtaaatttgtatctgctagagaaaatttcactttcttgacagtcttttgcattagtattttaaaagctttccctgtccttttttctcatttcgattgtctagattttttttcttgcatttaactcagtgtataatccacaaagaggtattactagtcaaaatccctaaaggatgtaaaatacatctaaagaatatattttagaagatcaattaagaagaaaaacttgctaaagatgaaaaacctttttaaaaaaaaaagaaagaaaagaaaagaaatcaatttcaaccagattctaggcaacaagacatggacaaagaagcaataaggaatacctgtttttgagtacagttccccctaacaatgctaagttttcctttttaatggcattttacttgcagttttatacaaatgtgtcaagctaacgggaaaaaatgaatctggcatggttgtgggtttggaggtttgaagtgtctgtttatctggcatttcctaacaaagtatgatttgttatgcaagctatgatttagacctgaccatagctgccttagtgaccagtatccctacagcaacttgggaggggctggttcataaagataatctaagataatatagacttatatttctttttttccttctaggacaatattatcttattcttgagaggttgtaaagagctcggccttaaagaatctcaactttttgacccgagtgacctccaggatacatccaacagagtaacagtcaagtaagtaaagcgtgatttatgtttaagggaaactcctttatagtttgatttgcaattttgtgatgatgttgtaagttctaagagacagagaattggttatgcttaataaaataaaaatgtgaaggtaaaaatcaactttcaaaacaactcacattgactttccctctgtgcatagctttcattctgatcaaacatcattttttgaatgcaaaattcttgcatatagagtttgaattttgaagaggagaaaaatgttaagtaaagattaacagagaggcaagaaagaaataggcacagaatcagtgtgttagacaaaaaacttttattggcaccaattgaacatttgagtaggctcttggaaggtaaacagatctgaactctgttatgcaaagaaagcattagattatggagaacttgcttcttcatttacatgtgtaactgtcttctcatatgtgtcagtgatcaagttctttgaagatggatcaagaactttgactatatctacttaatgagccctgtttgggccaaataattcttggagcagaatgtcacaataaaagagacagcagtgtactttgtgtaaagaaatagcttgtgaccagggtatgagatggcagagataactttcctgtagtttagaagttctttagatcctactgatttcatataaaacattttccactttagccaaacaatgtttgacatggatatgccttaataataaacatagttacatagatagggtctgtgaataggtaacttttcttcttttgattgtttttggagtcattttatcatgaaggaacagaaaagggagagaagccaaaattcagagctgttaattttatacaatttgcttgattttatactatttgcttgatttttatattatatttgcttgatttttatacatttgattttatactatttgcttgattttttgtactatttgattttatactatttgcttgattttttattttttaaaaaggatgaggaaaaataggaaaaaaatgagaactactggataaaataaaatttggggtttatgttggattttgtgattcatgactgggaatatgggagagttagtagtgatctgttatctaaaagtacttttctgttgtcaatatgccattctttaaaacttctcttggaaaaattttaactaagcgaaaaaataacagaataaaaatcaggatatttgaatatggaaaccgcactaaacctcatcttggtcatcacatgccccatttattattgtacttaaatctatcctctataaaccattgttcactttaggaaattgttttaggttctgcctcatctcccattcatagtttcacccgggtggcaagtgaccagaaacaatagcaactgtgcagcttcgtaggtaataattagtcacacacacattgcttggagggtgaaggaaaggtcactttgaaagtgtctgcagctgcattcatttttttttagagccactttaaatcagtatgttactaaaccagaattctgagcctgattggttttaaaaattcaaatctcgtatcacctttattgcttatctacaaaaaactgggcatcaggaaaatgaggatctagccctaggtctgctgctcactagatctgaagccctggttaagctcccttcttcagcaggccccatgtattcatctaaaaattgaaactggatggaatattccatctggtatgattctgggtcaagcttgctcagtgcagatatgggaagatggaacaactgacttgtaaaaaaaaagagatttaaatcaaggtgtggaaagaaatctaaaggggaaaatgtcacgtaggcaagtgacacgtggatacagtcccttcttagttactgtaccatctttttgttttcctgttgatttttccgtctttttttctgtctccttttcttccttctgccttccctccctttttaatcccgtctttccatctatctctccttttgtatttcttctcctcattttctttttaatgtttccttcacttgggtactcttattttctttaggcaatactttgccatcacattcccccatgaccctggcatttttcattcattcattcaacaaatgtttgctgagcagcttctgtgtgttagatacttttcatcactagagaaatagaatgaactcagatagccaaggtcttctgctcatgtggagtttacaatccagtgtcaagaaatgagaagcaaagaagtaaacaaagaagatcattgcaggaagtgataagtgctgagaagaaaataaaatggagtgataagcaaaagacagtggccagtccggaggtggttgagggtggcttctctgaagtgctggcatttcagctgagcactaactgggggctgagacacaaataggaaggaagaacaggctgtgggaagatctgtggggcattcaggacagagaaagagcaggtacaaagtcaggggaagaggaaccacaagcttcatgtttaaaagaaagaaaagtaactggtgtggttgaaggataatgtgtaaggacatgtgtggtgggcgtggcagtccacaagcagggtaggatgttgaactcagaatcattatagagaaaaaacattttactgtatgagtatttcaaagaacataaagaattttatcttaaaatgatgctataaattcacttacagtacgtagaaagttgtttctggttttagtaaggagtagagtatggaataaactatcggatttcgtgtatttttgataagtgatgctggtttaatttggcactgtgcagggaatgcttgtaacatatgcagattttgtaaactaaggtagttaaagtggaactgctatatttctctgttgtccctctaagagctgagcaggacatctgtagacacagagaggagcaccccattgccaccaattactagcggaagcagtaaggtatagggatagatcccacagaagagctttggatggttttctggaagttttgtttcagaaaatactctttcatttagctttcatgataggcagtttttcttgtgtggtgtgtgtgtgtgtgtgtgtgtgttttcttttagaagaaacttgagtagaccaaaaaaaaaaaaaaaaaaaaaaaaaaagaggaaaagcctgcaagtgattactgcatgtgtaatttagtgaactctacctgtaatggatgccagacaaccttgatgggaaatgaaagtgtaatctagacaggcacacagcaagtattattccaaggaatcaaagcaactggacgaaatgtacgcaggctctggattgctcccgagtgtctctgtcaaaatttggaagtatttccacataataggtgggagtcattcaacaaatattttgtgagcttctactatgtaccaagcataatttttagcactgggttacagtcttagtgaacttttatcatcactgcagaaaaagctttatgttccctattcttaatttgttttccataaaagtttcaaatcttttatagatttttaaaaatctggtttctttcttaaattaaaaaccctagcagattgggaggccaaggcgggcagatcacgaggtcaggagatggagaccaacatggtgaaaccccatttctactaaaaatacaaaaattagctggtcatggtggcacgtgcctgtagtcccagctattcgggaggctgaggcaggagaatcgcttgaacctaggaggtgtaggttgcagtgaaacaagatcacaccactacactccagccgggcgacagagtgaggctcagtctcaaaacaacaacaacaacaacaaaccctagcagatatccaagcagataaggacatcccattttttttcctattaaaaacagaaacatgaaacattttttaaatcaaatccaaactggactaatgcttctttcaatctatgtccttgttgatgggtttatttccatggtatgctacttgttttctatttcttcaaatttcaatggacttaaaatggttcacttattcattaatatgtactttaggtcagtgtatgctgcaatgaagtaatcagggtctaaatacttgcaggaattcttgactggtttatatgatagtcttacactcccttccccctcaccgaagttactgtggaaaaaagaagtgcagtttgttttttctagtgtgtatttgttgacgtgttaaaaaaactttgaaataattttgcaggaagtcttatttcattgtatgaatatttcgaagtagcttttttgtttatagttagagagtaaacatgggtgcatatttgagcatgcatgtgtgtatatttgaacataacaggcatattttcctgcttatggcttattcccagtgctaatttatgtccagagcagaaaagaacaaatatttggataggattccttcttgtacacatattttcaggtctgtctaattaaataaggttttagacctgtgttaaaaatacttgcatgaagattttggaagtgcagtcggatttcagtttgacggtggtctataatcaaggcagaatcttcagtggttaatctttgagaacacaactatgaatagtcccagttctgatcggactttttctatttccagaaattataaagcatcgtctttttatagcgtactgtggaactttaatcccaccttgtccttctacattttgtttcctaattaactttattcagtgcccgaaatcacaaaacttaagccttaaaaaataatacattcttctgatttcattatatatgttagcttcaagtacatcttagtggcatttaaggaaaggtcacaatttagaatctgctattctgacaatattttcttttccctttccttgactaggagccttgattatagtaggaagctgaaaaatgtaagtgttttaacttccaaacttgtatctttgatggttcaagtgtaaaatttagctaattcagtgtttctcatatgccttgctggaaaaagtccttagaaaaaagtatatgtgtatttcatagaatagttaatgaccatgatagaaataaaaatagtaaattgtgtatgtgttgggctggggtggtggtggttctctttatttagataagtgctcaatccagaaataaacaagtgaaagcttgtactctgtttatgattcagtttcttaaacacaaaatgatcaggctcaatactaacattagcccctttccatttgtaggcacagatgggattattaaattaaggagtttggcaaattgttgtagggtaagatctgcacaatatgaatagtgttgactgccatgggcctatactctatgtattttgttctcctttaaatcttttgcacttttattagtacttgcccaaatgaactttttgtagatcttattttcaaaaggcaagtatgttagtgctgttttattttcagtttagattgaggaatgaaagaagtcacattctgcatctaaaattttaaaattggctgaagcctctttttaaaaaagtttccctaggtgctattatatttgattggcattttcattcttatcttctttttcctcctttataaaactagaggtatacgccatttttcatcataaaattttaaacaaatcagaaaacctttaacctaaaacacaacagtctattttccattcccccgttataccttttaagatagcctcatactctcagcacacattagttattttatggtcctagttaatgtcctgacgtttgaatctctggaaatttatttgtaagcaatcagttcaaaaggatgttctggaagtttcgagggattcatgaagtaaaattttcccacagaggtagaaaacagaatcacctcttagcatcagtgcacataaccatattttgggtctgtcgccagctggactcatgtaactataccatgttgtccgaaacattttctggcctaccaagtagaaggaggcacaataagtacttcccagactggctgaagcgataagacagagtgtgaaaagaaaatactcatcttagcttctacatgggcctcagatacttgtaattcagtgtgaaggagctcatcttcagctgactctgctgggtttcatgggaagtgaatgtaaagaggatttgcttttgtggacaatttctttggaaatacagaacaaaattaacttgggaccgtagcttcagaccattgaatactcatagacattcttaaatatccaaggttgtttaattggtagcaagccttgtcaaggctcaaaatttcccatctcagattaatgggaatctaactataccccaaagctaggtatctgcagatcatattcttcacgacactgctttcttttgactttaattagatatattatgttgatcctgtgctgggaaccactaattaacctttatcacttgtttgggattttattttttttctgccattggccttagcggaacctctgtgcccacaagtagaaattatgggccttcaaaagcacctttctcaaaaggaattgacagtctctttcattgcttctctggataaagattccaaagcatttttgaaaaattgtgaaaccttcactacataaaagataatgtgggtagattcatttttccttcttgctgtcttagagatcatttcctcactacctaactttccctaacgctggagtcgttttaactactcaaccgtgtttgtgttgcctgacatggcattgggttcttattaaagtgattttacatttaatggatacctcatgggtggtggttttttaaaatcgatgtaaatcagctctttccttcctgccttcctgttagtggtacattattgactccttagtttaaacgtcattcttgagggaaaaatctgctcttgtgcgttttgttccacaggtattagttaccatttactggctgggaaaagcagcaaacagctgcacatcctacagcggaacgacactaaacctgaaggagtttgaaggattgttggctcagatgcgaaaggtaacttggcttttcttctttatcccataagcgttagacaaggtgggaaagctacacatttgcttgtttttaagattactagagtactgggttgtggaatggtatgagccaaagatatgcactcaaggaaacgatcacttgtcttaccaatgacatctttgcctcatgcatgtcacacctacctgcactttcatacccttcagagaacaggagttctgagctccatccaactttttaattccaaaaaagcaaattcaatctatcagtatatgcctttgtatgccaagatgctcagtgcttgttttcttgggggaataatgcttgaattaaacaatgcagtattatgcaaaaatgaagactcgctctgcacttttgtgctaaagggcattttgcttacccactggggccttgatgtgggtgaggtaacgtgaaccaagctcttaccttggcatacgctctggacaaggcgggatacattaaatgcattctcctctaacatgtgcatgttatagccactgtttttgaatgacataggaatttggaaaacatttcatacattgttaaaagcttcatttgtttctttgagtatagaaaagactgacctaaggtagggatttgtcaaggaaacagttgaatgtttcatgtgtactacttgcctgaatgtttcatctgaaggtccagcaatatacaactcatacaaatggctagtacatagtgttacccaggagaggccctcccaacccgccttagtgtacaggtaaggcttatttataatggacctccatgtacttttttaattattttatttttttgagatggattcttgctgtgtcgcccaggctggagtgcagtggcgcaatctcagctgactgcaacgtccgcctcccagattcaagtgattctcctgcctcagtctcccgagtagctgggattataggcagccaccactaagcctggctaatttttgtatttttagtggagacagggtttcaccgtgttggccaggctggtcttgaactcctgacctcaggtgatccacccaccttggcctcccaaagtgctgagattgcaagtgtgagccaccgcacccggcccctccaggcattttggataaagtccacattagaggacaaataattgaggccttactcttcctcatttctctagtatgcaaaataaatgaactagaaacattcagttccttgcaatttttcttttaatactgaaagcaagaattggttccaattttctaaacatttattttcctttccttaaattaaagctaatggtcctgatagttcttcacatttggctaaggccagtctggctcatgtatttataaatggccaaagctttcatattggtcataacgcacatacacaaggtactttaagctgaattcctttaaaaattaaataaacacagacacacaatgaagcacaactcattgcttctcagtctcacctcttatttgccctttaatttctcatctaacatccagtctggatttgagatgtctaaatgtttattgtttttatattaaatttggacttgaataataatagatgggtcatgaagctttgtctcacagttcccctgctagattctgttggaatctgatttattctcatgattgacatttcttactactagtccagctcctgtagaatctgagcagctattggtttcttcaactctcctagcttctctttctacagttagtttcttcaactgctgtaaaatgacctgttgttaacagctgttaccctttttgttgaatgtaggtaacatcacaggacatggtggagtaagtagtatccctggatacatgactcttagcaaaaatggccagccatgatactgccatatctccatctagagagaaaatgacttgaacttcactggactatctgagcacctggaaatactagttttatatgtgatatatataatctcattttgtcagttaggatcgggttcagctgggaaacacaaaagcctcaaaataacagataaaataagacaacaattttatttctaattcacataaatgagacgtggacatgagcagtccagggctgatgtggggttccatgtcttttcaccaacagaaggcccaagcttctttgtctttttgtaccaacaacctcaacccatggctgttcacctgctgatccaagatggctgttcaggctttagccatcatgtccacattcagccaagaaaagggaggaatggcggggagaagattccatgctctccctttaaacacacctctgggaaattacacactacacacatagctacatcttacagacttgaacttggtcatgcatccatatctagctgcaagcaaagacttggggaaagtagactttatttcagctaaaaactgtaggcatttttgttaggagagcagatattgagggacaactgtaatctcttctgcacatatgcaggctgaaataaatttgaaattagttttttttctttcacaaaggagattatccacaaatttttatattcatttttctagtgggtgaaatgtgcataaaaatgattcactagggtgcaacttgttaagttctatagtaaaggtgacccaggtagagcccttggcataaagtctggcatgtagtaggtattcatagattgctgctactgctgtatttttttttaaaggatctctaacatcacagtgacagtggcctttcactgagactggatatgtcagaaaagtccttccaaaggaagtggcacttcagctgaacaaagaggatttactacaagaatattaagattgaagggacacccatggggacgagggtggccctggagatttcaggatctttctctcatctcttatctctccttaaactcattatttcttcctataggcaaacattcccttataacagggagcgtggccagtatcatccccaggattacttgcttctagctccttgcccagaaaagcaagggaatgctgtcccctggccccaggtgtaaaaaattcctagtaatgtaccctggccccatgtggaccttattcctgaagcagtcactgtgatcaggggcaagtgataccgtgactggcccaggctactcctgtttcagggggtgaggggtattacaggaagaaagggaaaaggggagggagcatggtgggcaagcagatgcaagatctctgcctaaaagagcaaccatctcaatttctagtccctcaacccaccttatgttttttttttttttcatgatacttatcatccaattttgtattcatttgtgtttttctgtgtattttttgtcttctttactggaatttaagacccatgaagacagggtatttgttgatttttctggaatgttgtgaactagaacagtgcctgtcacacagaagatgctcagtagatatttgtggaatgaacagcttccacaaccagagggtggtgggtggagagtggctgagcaggctggaaaagtagaaccctaaagccctctagatcagggtgagccaccttacaaatcacaaagggagcagaaaatgttgagcagtaaaagagaagcatctggagtttctcagaaactgttaagtcatccaccagtcctagctggttcttgttatgtctgagaaagggggataggaggaagatgagtaaaataatcccaaaatttcatgaagctagtagttctcaccccttcattaacatactttaactagagtaactcagtagcagttagcacaagggactgagattctagatgaaaagcagagacaatgttaattagagcccaagaaaggagaatgtagatgtgctagtctctgttggtttatatcttctgctcgccatcagaagcttcactttaagtgaccagaaaatgagatatggtgacttgatgggaaccaatagaattgtccatccagctgatatcctcatttttatttctggctgaagagccagcctgtcacttcaccctgagcttcctcgggacgagcttggccaagcacagccctgggtggcctggttttcactgttcaaactggccatgccattcagctcccagctcttgcacttggtccaaggtttgattcttggctttctacacagccgtgaatataacggcctctctgtttttccttcccataactatctgtgagaaagcaactaacgctccaagaggcatgttgactttctcctttcttctcctgtggtttgtagggtgagggtggggaagacatttgggcctgtggggagcctttctgatattattttcttgaaagtccagttgtgtaatggctgcaccaaggaacttgtagctgtgtcatttccagatgtgaccagcggtccgcctccctgagtgtctgccttccctgatggtaaattaggctcaagacatctagacatgggatataaatgaagagagagatagaggagtgtcaggatgtgtagaaagttgtgtccttagctacatttataaatgttttatgatttgtatatattgaaatttacccatttgagagaataaattgtagtaattataactatagctgacacttttagagtacttgttctgtaacaggcatttttctgaatactttccatatatgaacacatttaaccctcccagcaactctgtgagacaggcgttattattagtcccattttacagatgagaaaactgaggtctggagaaatgaaataacttgcctgaggtcacagctggcaaggggtggagccaatagttaaacccagccagtcggtattcggagaccattctcttaaccattaccctaaactccttctctcttgcactaatcatgcttcatataacatttcagtcaacagtagacagcatatacacaatggtcctagaaaattaaaattcaagttgaatatccctaatctgaaaatctgaaatccgaaatgctccaaaatccaaaacttttgagcaaagacgtaactctgaaaggaagtgctcactggaacattttggattttggattttcagttttgggatgatgctgaactggtaagtgtaatgcagatatttccaaatccaaaaaagtcaaatcctgaaagcttttggtcccaagcatttggataatggagactcaatctgtagcacattttactgtatgttttctatgtttaggtatgtgtagatgcacaaataccattgtgttgcagttacctacagtattcagtacagtcacatgctgtacagctttgcagcataggaacaatgagctgtacatatagtctaggtgtgtagtaggattggccatctaggtttgtgtgagtacacactgtgatgtttacacaacaatgaaatcacctaatgacatatccctgtcattcagcaacacataactatatttatagttttgtgatctagtcataatagcatttagctgaggatcataatccaggttagcatcatctacagaataaggaggcagtaagtgtctagtagtagagaagatgctgatggtggaactgtaactgtaccaaagatgatcaaatattttcagctataccgtttgggatttggagacagagtcctgtgttagaatcacagctttgccactaactgtgtgacctcagtcaagttacttaacctctctgattcttatttttctcttctgtaaaatagggataatgctaaccatgttttaggatgagtggttgtgaggattaaataacataacatgcaaaaaacatcaagtgtagctgcagacacataataagtgttcaataaaagtgacctttgttttttagccatttggcctattctcagtaggtaaataatccaagataattacttgcatttccaaagaaattaaatatgaaaccatatccaatttgggtctataattttcagtgagtcatgagttcttcctttttcagttagtcaggcctggcttttgttcaagtcctggttaacttttgacctaagagtaagctaccttaatttccataactggaatttctgccttcctctggagggttatgccggctctactcacccaggccatttgacaacctgttcttcagggcattaatcagtcctctgtctggaggctgcagggtgctcctctccgtcctgcccttgtcctcttgcccactcccttctcttgatgcaaagctgtgtgtgtcttgtaaattacagccactctgtcccccgcaaagggcctcctgctgcggagtatgtcagaggctcaggatataattgatagaagcagccagcaaaggcacttcctgcaaaggcattggctcccgtgggcatcctagacagtttagaccagtttccaaaactgctaacatgaagaatatttatttttcctttctattgggaatgcagaggggactttcgcgagcatcccagggaatctgcagtgtggcattccagtctttgcggatgagaacatgcctctctgccagtgttatccacagtcctaattttaagcgacagtctggatgatattaaattgaggtttatctttgagtgaccagagttatttttgttttagtcagcctggactattgtaattaatgctaagacactggcgggaacaaggcttttattataatacgagggtgaggatggctttgactgacctttcttctgctggagtttcagtgttttagtatgtgctgcttgtgctggaaagaatttataatcacaggctgtcaaagacagccattgttctccctgctctgaacatgtgggtcagccacaagtgctttcagctcccccagcgccaagagctggctgagagcgagagcatgcctggattcttctgaggcatcaggaaaagcgttttgcatatttttcattgcctttctttttttttttttttttttaacttttgcctcagaaagacagctccctttcagagcaggaatttcccttcaaggtagcaggagatgaacgcgtgctgctccaggattttacagaactgattctgcagcaaagacaaatgttgcctgtatttgccagatagtataaacaggagcaaaagttgcacagctaaaccaggggctcattcccaggacagacatgcagttatggattccgaaagacaagtcaaggttaaggttttggtttttcgtttttgttttgaactatcattgtactgttgtgaatccaaactttgtgatcctttcttctaattctttctctactcttttttttttaaacctagggaatatgagttatttggggatttttttaaaaaaaacgttgtgcatgattttctgattgggaaagttgcagcaaaggaggctccaggaacagagcagtgacttttcaaagatgattgatcctgtaactggtttccacaacctttccattctgatgtgatatgcaggggtttttttggagaccactggagacccatcttcctgatagtgtaggctagaattatgtctgtaaccctttcattttcttttttgacaggacactgatgacattgaaagtcctaaacgcagtatccgagacagtggctacatcgactgctgggattccgagcgcagcgactccctctctcctcctcgccacggcagagatgattccttcgacagcctggattcctttggctctcgctctcggcagacgccttcaccagatgtagtcctcaggggaagcagcgatggtaggttggagtcttaataaactatccatcttgaaattaaacatttgcaggggctgcattgcgcctggcagagggatgggcactgggaaagcaggctccatatccaccttgccggaacttagtaattctataaactggcagaaaaaagaagtctttgaatgttgtttttcatggtccttagaattttggttggctttgccaggagtttatttgagcactgcctcagtgagcatatcttctgttggaaaatgtgttacatcattcctcccttggactcagtgaatcaagacactgtgcagaccattagctcataaagtgtgctggaggtttatatactctgggcatgaggaagctaaatgtttgagtgagtaccacactatataagagaaaatggatcaacttccagtaaactggaaatgaactgcacacacttagaaagttctgaagcctgggattgtgcaactttaattggcatgttttttggcaatctgtttgatgcttgtgatacctgactggtatagctagcacgatgcaggtggctgttaatgtatagtgcacaacccaggctgcctgcttgttctgaagctgggattgatttaaaccctatgggttttatatcacttggaagaaatgatcatttttcgttacaaaaatgtgtaatcatgtaacttgatatacacgtaatgcctatttttcagaagccatttgtcttacttatcttgtacctttgtacttttagaaggaaagatggtttggttctacatattctacatatataaacttgcggaaaaacatgagggctagtggggaatttttaaattgtttcttttttcaatgtattgcttggttgatgctgctatatctagctaatatatcttaagcctactctgagatccgaattatcttttgtagctaaaagatcccttccagctataaaattctgttacgaaaatacttgactatttaatgtgtccaggatctaagttaattccttggtacacagtatctcatttagtcctcagctgagattttagagatactcactcagtatctcattcaacactcccacagagctgtgagacactgcttatccttacttcaccaatgagcctttgagaagttaagtaatcatctcaacatttacaagttacaaaaaaatcactgtcagaaagtagcataacaatgttagctttaagaagtgtgaatgcagaatctatgctcttaagcttaatttacccacatttctttctctttgcctaatagatgttttattctggaatggctgcaactaatgcttttgtttaggacttaaactttccagcaaatagtttaaccttggggccacatagtatgtgactcctaaagaattccagggtgcattgtgagcctcttgcaaagcatttctaaaatgttatatgtcattttaagtgccccccacactattagaagttaaataccaagttcactatctaactgagctttaacataaccaaagagtagatttacttttccaaaacatgtcttaaccaaacgatttcatacatattattttgattagttgttttaagttattgcattttcttcatcctgtgtttttcttaactggtaatgtagattatcattatttatcattaccagctttggggggttcagagtttaaacgaatcacatcttgaagggattggaggtggtgattactaatattatactaatatgtatgaagtacaatttagtttgcagcaattaaaattgataagctagagtgtttttatgaatgttttctccatccaaaaaaacatgaaattagagcttcacaaacaccatccatgaaagagcttcttatacacagattttaccaatcaacccgataccttaaggcttatgctcttgtaaactaatcaagacctaatgagattcttaaagaaaaacaacacatttattaatctgccatttaaaatgtagtataattttagccaaatagatgttgggtttcataagcgtttatagtatgtttttaaatggtgctgattaggaagattgctagtcctaataaacacttccaaatttgaaaaaacttgttgtaagtcttgagaatttatttcctaggactcacaatcaattggggaatatcttaccatgaaattattcaactctatgttgggccaatatagacatctttcattttattattatccactcccactaatccattcaataaagataatcaagggccatactcatgagaagcatcatgattctgtgggttggacacagagctacctggtaggatgctgtagatcccagggttgattcaaccaatctgtcttgctagacaggtgtccaatttctcccccagcattaatagcatctcttatgagtccacttaatgggcttcattgaagaggaaataacaaaaccctctacccagatgttttcaaaattaagaacatattttgtaaatatgcattaggttaaatgaacagtctaatgttttatatcaaagatgtgctgagggagggaaacaagtaatgagagaaatcaaagtgctagaggaagattaaaaagcgaagggttgggggtgtgtacggcaaagatacattaaaaaaaagtaatcccagcacttcaggaggccaaggtgagtagatcacctgaggtcaggagttcaagaccagcctggccaacctggtgaaaccccatctctactaaaaatacaaaaaattagctgggcatggtggcgggcgcctgtaattccagctactcaggaggctgaggcaggagaatcacttgaacctgggaggtggaagttgcagtgagctgagatcacaccattgcactccagactggacaacaagagcgaaactccatctcaaaaaataataataataataataaaataaagaaaatcatcatcacatgctagattacattctcctaactctggacataaatggagaagccaccttagtagatttccatgttcacagggagaagtgaagtcaaaacttttgaggtgtcagcctcaaaagaagactctgacatttcccaagggtatactgggccggccacctcctaggtgctttatgtcatctcatttaattcttgcgacaacatgtgatacctgtattatcacctccatgtatcccatgaggaccctgaagtatagaagatttaagtatcccagggtcacacagctagtagatggtagagctgaaattttagaccctggtctctaaatccataaacctatacttctttcaactgagctactctgtcctggagcatttgcatggctaatatttcttgaagtgtctaagacattcaccaaagaataattgggggaaaaagtgatttgcttatgttgttagacaacatatttggagactttcactcagtatattatagataatataaatatatatctatatctatatatgtgtgtgtatagatactatacacaaataggattcatagattataggattttagaattgagggacctgagacaactctaatccatcactaagctttcatagttgattgaagaatcatttgctttatttgttcaacaaagtgcagcacttctcgtagtcagaacacttttatcaggagacattttcccaagacaggtgtgtcacagaggaaagaactttgggagtcaagagaacagaaagtagagtttcagaactgtcactaaccagccctgcagcaggggttcctacagtgtctctgagcctctgtacccacctttataaaatgggatagtatcaaatggggaaacaaatttaagagtttagcaaggtagggtaatgtttgtttataaagcaattcacagggggctctaaacatttcattatgatactgagacagatatacttgtttaaggaccgggtggaaaggagctaaattgtgagtcaaatactgtactaataagtaatgaaatggtcaaaacttcagaaggaggactgaaagcatgtggcatgaataattcataaactgaatatttcatctgcaacaatgaacaacttgtttatggtcaatgcctttaacgtttacagtcttttaaaagccattatatcatttaacctccagggcaaatcattttattcctattttacagaaaaggacagtcaagtgtgttagagacaaccctaggagccccagctcatttctgacagatccagaactattatgacataaagagtagccagcatttattaagcacttaggctgccccaagcactgtaccaatagtttcatatgtatctggttcttccaacagctatgaagtagggatattattatcctcattttgtaaattgggaaactgaggcttaaagtactgatgtaacatatgtaaagtctcatggctaatgagcagcagaactcaaaaggaagtggctctgacttaacaccaaccttctctgccaggatgccacatctcctggctcttagtttaaggctcttttcttaagggtaaataggtatatattttatttgttaccaccatagttgaataatcttgtaatgctctcattgattgttttcaaccagcattgaagtggccgctacttatatggcagtgtttgttggaatgatggcttcatactaatagatcctagaaatctaataagatgagactcaggaaacaagaatactatataattattggggcttttgtccaacaaatggctgatgttgggaatgctgaattcctttgtgttgtttaaaacactctaagccaaaccaactcttttattcatcagataatctaaggatgcccactgtgtacaaaggcaatgacataataactataaaaactataaagcccttattctcaaagtacaaggtagaaagtataatgtgccagaagaaaagacaagatcatgggggcatagggttcacaggaagaacagattgcctccagccgtgggaaccaggaagagctcccatgcagaggaactacttgaaccacttcctggaagacaaacccttggtataatccgaattgatcacttttctgagtttctgttgttctacatctgtgcttcttgattataacttaaattctctaggtatgttatgggttggttaaagatgcctcaaagacaaaatgcttcataatttttatttgctggagtatctagcatagtgtaagacatgcagcaggggctcagtgaaaacttcattggataatttctgttttcttctgagagtagcagaatctcaggaggcataaaatcctattgcagatgtgttgctaattgtaattctcggatacagttaggcttatgtctgtagtttttagttttgcccttgtcaggtttttttcctgatttttttccttcttttcccagagtggagtaatctacatgtgtaacaaatctacactttagatttgttaagtgaatgatttaagaaggaatcctcagaacccacagattgaaccacatccctaatgcatgcttaacattgggaactttctgctagcctaacacactttctcagtacccatcctctcttccctagggagaggaagcgactctgaatccgacttgcctcatcggaagctgccagatgtgaagaaggatgacatgtctgcacggcggacttcccatggtgagccgaaatcagcagtgccttttaaccagtacctcccgaacaaaagcaatcagacggcctacgtccccgcgcctctgagaaagaagaaagcagagagagaggaataccgcaagagctggagtaccgccacctccccgctgggtggggagaggcccttcaggtaaggcctgagcaccgctgccctcttcctggcttgggcatgagtggtttgggaactgcagctcctggacaggaacgaggttaaatgaccaattcagaactttgatggaagattacagatggaggtgggtgggacagatctttggagagagcttgtcaggagaaaatagaagcttcgtgagtgcgcctagaacagtgcctggcacacagtaggtattcagcaactacttgtctaaataagcagatttctgaaaccaattctgttgataggacattgagagcaaatctgtcatccttgtccttctgcggagactgcttgactcccaatcctgtcagattaggcgtagaaagattcctatctttatgcaaaaagatgttttaaaactctaggcttaaattaacttgatataagctcaaatatgtgatgcatggaatgtggttcacaataacatatagaaatagtcataataaatggatttctcatctctttagagaaacagtgttttaatctctgattatgcttttgtatttatttattcatttattcagcaagtacttattgagcatctactatatgctaggcattggggacccaataacaaataaggcagagtccctgccttcaagaatcttacaataaaataaacttgtctaatagtccatctgtactattattttccattgaataaagatgttattacaatttttaatttgctgaacaaactaatgaaatttacctttccagcagaaaaggtttttgcctttcattatcaagtctgggataactctcaatgttgcgggtatgatgcattgtatgaattaaatggctgcgttgaattttcttcacattatcaggattatattgtgtgctatgactttcttttctaaagtgaaaagtaatatcagaatagcggggagatgacatggggtctgctccccagcccagtctgttagtttggtaaaccatattgtccaactcactagctttcctgaaacgatagaggaagaggggagtgaagtggggtctgctggtgaagacaacccagctggccaaatgaatcctggttggaagccttccgatggtgggtgtgaattacctgacggcagtggtaaggagcacccttcttcagacggggctgtggtggcaccagctcccaagtctgaagaaaaagatgctgctgagatccaaaagcgcaaaaggctagagcaagctggaatcaaggtcatgccagcagcacagcgctttgccaggtcagctctgggctgagggctggcccggctggctttctgcatgcctggggatttggaatctgtctagagagttggagttttcatctgatttttccacttcccgcttttcctattgcatcactgttccctgctctgagcacgtagatgatagtctttgccttaaggcatgtctctgctaagtacctcctgggtattttaaatgaaggtgaagagtgagctcctcactgctgggtgcagcccttgtctttgtcatgtatttgtgatcagtcatgtgtgggctgcaggatttacctagcaataacattgtatttttctattgtttgtggcttgttaattttcatgctactcctaaatggctcatatcttactttacacatcactagaaaaatagtctgttgctttgaaatggggaacactctctttagagagtggctggcttacaaaatccacttactttctttgtcccaagagagtactaagtagaattgggtttatttgactccttagtttctaaagcatgttgattcaaaaacaaagaatggagtaattacttctctttaattgtaacaaaggtactagtatccagtcctgatagcttcatattacatgtgagatggagaccttcagcaatcagagccaaggaaaactatagttctgcactcttctgtagtgttttgagaagctggttaatttttcttataaaataaccacaatgatcctaacaaataatagtgcagccaaaatgtattttacaaattgacattcataataatttgacagttggaattcctttgccacttgctgttccatttaatttttttttttttttgagatagagtctcactccgtcacccaagctggggtgcagtggtgcaatcttggctcactgcaacctctgcttcccaggttcaagcaattctcctgcctcagcctcccaagtagctcggattacaagcgtgtaccaccacgcctggctaatttttggatttttagtagagatggggttttaccaggttggccaggctagtctaagaggtggctgatatacccatcttccagaagtccagaagtgggagctgaggatcgttgatagtcagtgacttgcagagctggtcaccaccgacctggtgatcagattcggatgctctgaccacagcaccacatctgcctcccacacattttccatttctctatacagctccacatgtggttatttatgtggtccaggtcttaattaaatatccagtgttgagttacataaatttaattctagagtacctttgtattaaaaaaaaaaacaactaaggatatacttcctccttgtctgtggtatattacagataatcatgcctattctgaacacgtatgtgcttctggaatattctaacataaaattgtgtttatgttacaaacagctctctgagtttattaaataaagagtaatgtaataaaatctttttttaaaactccagattttttaaagttttgatacagagaccttatcaaacacatttttttctgcatcccttgagcatcccatacaccatgtaccagagactggactagatgctgagaagacaaaaataataatagtgaggggaatactatctcctcactaggtaccatttttcagacttctccagcttctgcctttaaggacatagtagtaggtaataagtgatacagataagaatatgaacttacctgaaattttaatcttcctgtctttgacacacatctttcatttatatcacgtgtaaagtctttaagctagtgtttaccaaggataccatcatccttagagtatctaaaacagcaaagggggatgaaggggagcggcattaagctaattcagcacactcaggaataatggtcacatagagaagagaagtggggtaaaggctgggaagtccatacacgtactgtgccacttcagtacctgggacgtttattttattaaaaactttgaactcttttatgacaactcccattcactgtacaaacatcaaatcatagtttaaaaatgtaattctaatgaatatatattatctttgtttatttcacttccattcatgtttcctgttatttggcttaattttaacctatttcatccaagttagctctcatatgcagaagtttgcaggtcagttaatgtcatgatgcctcaggtcttctgacttagcatttaaaattgggctctggataattatgcatattctcagagaatgttcccaatagcaacacaacacagctgctccaaacacccagaattcatttgttaggcagatttttcagctgccagccagcgctctcacaaaggttttacacatagcatgccaccagcctggcatgtctacgtctttgtcacttacttttttgcatgccacaagagttgagagtcattctaagtttatccacatttgggatcctgcttttaatgtggcagaaagtagcttaactggaatgaagtatcatgaaaaagaaaaggactcttggtgtctggaaaataggaatttaaatcattgaaatacgctgatatctctcgaggcattttaacctcagtgttctgtctttgacatccagatgaattctgaccagcacgtctttgcacccaacaagaggaccacttgttgtggcccatttctcagctgggaaatgtttgcagagatgattgagataatagagccatgtccgaggggaagagcatatagatgaacaacaaagctttattttgtagactgttttttgtttgcttgtttcccaagtattcttaaacaccttgctaggctgggtgcggtggcccaaacctgtaattcgagcactttggcaggccgaggcgggcggatcacttgaggtcaggagttcaagaccagcctggccaacatagtgaaaccctgtctccactaaaagtaccaaaaaaattagccaggcgtggtggcataggcctgtaatcccagctacttgggaggctgaggcaagagaattgcttgaacccgggaggcagaggttgcagtgagccgagatcgtgtcactgcactccagcctgggcaacagagcgagactcgcattatctttaaggcagtatacaaaagggagcaaaggtgcatgttatttcattttcacaagaggtcaaaaacctagaagtttcaagcttcctgtcaaacaatatattagcggtatcttagcatcaagagacagaaagtaggatttcttaataaatgtgtggagtttaatatttattagagtttccactgaagggaaaaagtacataaattactttttcttctattttattttatggttgtgctaacttaattatcccccaaatatgagagtctgccaaagaagccaagatttctgtttttaagaggataaaataagaaccaagatgcacttcccctgaattaaaatgccatggagatttgagttcttttacttggtgtttcccattggagaagtaaacttttttttgaactgaattataggtttcacatgattgtacctcttttctaattgttttcatatgtttcagcactcagtgcttgctttctgctagtctgtggatcttctcaaccacgtagtaattaattacagaggggaaaacaaggcagggggtgtgggggcgtaaaaaaacctccgaggaacaatagacattttagaaatctttagaggaagagcagatgcagctaagtgccagacatggattcctctacagccctccttaccaaacgccggttcaccgtggctgctgaacagatccttgggtatcggggaccagtcaggcacataacttgcacgaacctttgtgactctggatgtattagggcggtgcacaagtaattgcggttttgccatttttaaaggcaaaaaccgcaattacttgtgcaccgaccaaatagctgccctgattggagatggggtgaacagggaagtttccagtgtcacccaggacattcccagggggactaacaggcttttctggagagcagagtttccttcattggaacacactagctaccaatctgacctggttgcttatgcattgccacataaaaccgggtgaaagaaaacaccagctcttccttagcttaaatcattacctcattcactttgaaatatataagcctcagaaatgttgagacaagagcttttcttccccctcacctgctttgagtccgtaatccctcctaccaagaaagctagcctgcctttctttaggtgaggctgtgcaggatcgccagttggaggcagggcttggcatttctcgtttcacattgccacactgtattccttccacatgaaacagtgagctgtgcccccaaagcaactccttcttcccaaagctactcatctatgagtgacttggacaaaataaaagtgccaaacctcctcatgaatataaagccagacagcctggcctgccccttgagtatactttaattaatttacctgagttcagatggcttgagctagagaccttaatattctcttctgcaaagtgggcgtcataattcctattttgcagggttgtcatgaaagttagtgtatctggaatgtactaaatgtactagctactaagagttgtagttattgaaaaataaagtaaaacagacccaagtttcacaaaagactgtccttaaggtccttcaaagaaaaaaaaagcacattataaaagtcatttaagtattttgatacctagacacctgtgaatacaatcctacatatctaccttatacatattatttattatttcaaggccaacagggccagctcaaaacttgtatcattattttttgctcgccgtgaatctgccttgaagctctgaatttaaaagactcaagcaattagtggaaaatcagtcattgtgacaacttttcaagtgggtggggagtgtcttcaaatagccaatgatacggaaactttcttcacgctcttttttatatatttttttaagtctgcatatctaaattgagatcacttgaaatgagtcttgccacactgggcatttagcctaaaaataaacacccaacggaatttgcagcctggctgggttcacaagatgcacaagggaccagattctccctgctcaaattggcatcgcaaattggcagggtcatttgcataaatacgaatattttattccaaaaaattctgcccaagttgggggaggttggagcccaggactgtttggtttgtcccaaagtggaaagaatgttgctcttggacttcaggggttcaagcagaagatctgctcccaaattagggtatgagagctatgattgcaccactgcgttccagcctgggtgacagaacaagaccctgtctcttaaaaaaaagaaaaagaagagaggtggagagacaggaggatagaagagggaagaaagagttgctgatggaaaggtgcagggcaagataagcttcctgggagtggaggaccagggaatggaatagtttaagaccatcctatgagtggtcgtaaactatcccagatgtttcaggttagctcagctctgaagaaagacttccttacattttgtaatctgttacacattctaggtgtggtgtcacacagctgcattcatttgttttcccccagatcagtttcttggtggctcaattttttgccctgtcagtcaaaaacaaattaagtgtctactgggtactcatgtgctaaagaaaaaggaacagtaacaaaaagcttcccatttttccccaatttcatgcaaagaatctgcactgtcactttcagagccatttaggatcctgcttttctgttgctggtggaagccctgaaaattaaatgaatttttagtattgctagtgtctggctaaattcaaggttttaaaacccaccctaactatgctgcaattctagactgaaataatgaacagatgtcatttgaactaacaatatcgagaagacttttcactaacaacacagttgtctgtctagagatggagatttaattttttttgtctgatcacatgtggagtcccatttaattttcccctatcagtcaaaaacaattaagtgaagagaaagaagctattcgtgatattgtccttcgcaaagaaaactctttcctgacccaccaacatggcaacgattcagaggcagaaggtgaagttgtgtgtcgactgcctgatcttgagaaggatgactttgctgcaaggagagcaaggatgaaccaaaccaagccaatggtgccattaaatcaactcctctatggcccttatccaaagaaaggggcagagaaatcagatggcagcaaacagctctcaaagggaatctcaaaaaaaagaagtctagaatataaaaggtgtgcatggtgtgtgtgtgtgtgtgtgtgtgtgtgtgtgtgtctatgaaagagacacagggagagaggacataattaagtgaagtcagtttgtattgtaccccctccagttcctctttccagcctctcaattatatgtactttgtaatgggggtttattttgaagcggaactttagatattcaatctcccttaaatgcagatggcagacagtagagtgtccatgtccaaaatagggctgaatttgccaaagaaacattgaattccagtgtgtagatgtgctgaatcagggctcatcaccacatatgggtgctggtgtcatcagttggcattattagcaaaaatagacatgtactattgcctatcagagaacagccacctctcacagctgctctagtccattcaaaggaagcagaaaaacgctaaaagcacttctctcttattagctacatttagatgttggaagaaaaaaaaatgagacttgttctttcttctgtcacaccagcaacatcacctagacaaatgataatggatatttcccatcaaaaacacttctcaaacttatacttctatatgttctgtcatagaaattgttttcaagccagtttccttttgccaacattttccccgtcctcttaatacatgttggagtgaattggggacaggaaaattatagtaagatggaatttgaccagtgatttttgtcctgagagggagatatgatttcatttagggaacctacttgctgaatttcatcctgcagagttaatcattcttgtatttttccttatatcaaaatcagctagagttagcatctacattattgaattgtcatctttttgcccatcactttagaggtttttaagcctgttgaacttagtatataattatctcagctgtgctttagacaattaaaatggttctttaggcagagttgttgagctcaggggagtagttggtctttttgatttttcttaggaagtaccagatacaaaaacccatgagggattcctggatatagaacagggattcgataagagaaaatctggcatcatttctttacaggacacattatagcttcaggaggcccttggtctttgccattgctgttggcaggccttgtaacaaaccattcttggagggccttgtgggagggatcagttgtgcaagtgaaacaaagacttttggataactgactaacatcaaggcatattgatggcaatcagcaatttgagtcaggaaaaggactagcctttgtatctcccttgtttcctttctcctccatgtaattttaattcctgatatttccagctatatttgtctgttgtcacctgactctgtgtttgcggacgcagttctgggtctgaagcagcccttgacctctctagacagcatcaaagaacttattaaaaaaaaaaaaaaaaagaagggtccctagtgcctctttgccatgcccttccttgatctccttcctcaaactaagaaaattctatagcctttctatttttatgggctgtgcaagcatgccaaatcatcaaggtaacaaaagactacctcttgattttccagcttgaatgatatattttgtgggaagattaataggctctatttatatattttttgagatttttctatttcaagaagcatatttagttagaaatagacttttaatggaatatttatatatataaatgccacagctttggtttaaatcgcagttttgtcaacattagccagctaaggttcacttcataggagaacaatggaaaatatcagttttagcatcaataaaggtgaacggttattaacacaagaaacaagtgggtattgaccctgtcaatccaggtaaagaggaataccctctgcttttcaagtttgcattagccaaacctgactaatgccatgaagcagacgttgagtttaaacattgaaactttctgttcagaattgacttagatgtactttctggcagctgtgggtttaggtttgagatgtttaatatgtgaacaatgttccagctatctccaaactaatcctagaatttggatcatgcagagctcattatgaacattttactaatgcagtaaaaaacattccaagagggctaagggattcatcagaaaacccgaattcattacagtaacttgaatagtgtgggaattgggcatcattaccatccaaccaaaatctcattaccattagtaatctttcagcaggcacggcttcttttcctaaactgtagttgagactgtcatctggaaggggaaaaaaacctctgtctcattcagagttgtaataagggtggtatagatgaaagtcatcacagctcccgttgattccatttttgagaaagagaaaagtgtttccatcattttgttctgtcctcagcctgtgagtttccatgcttgacattctctttgtctgctccccttccttgaacttgatttttccattggtgtgggggcccggatcaaatggacagaaaccagggccacacagaagaggtgaagttgatagtgacctgtaacatgagggctcaggaaagtgaacctgtggaaggaggactcaggaaggtgccagatcttcacaaggatgacctggcccagcagagaattcagggcagccttgcccctcaccgcgagcccccgagcttcattacgctctccaacataacagaagctgacttggagacgtgggagagactcaaagtgtcagaaaaggcgaggtgtgtcatgtttcccccccagtttccccctggcagtcatggtatttcattttgaaggcatcaaatgcttatctttgtgtcttttttttttttgtcagggtcttgctctgttgcccaggctggaatatagtggcttgatcacagttcactgtaccctcgactcctgggctcaagcagtcctctccctcagcctcttgaatagctgggactacaggcccatgccactatgcctggttaatcttttgattttttctagagacaaggtctcactatgctgcccatgctggtcttgaactcctgggctcaagggatcctcccacctcagcttcccaaagtcttgggattacagatgtgagccactgcacctggccaaaattttaattaattaattaatttttttaaatagagatggggtcttgctatgttgctcaggctgatctcgaacacctagggctcctggggctcaagtgatccttccatatcagcctcccaaagtgctgggattacaggcatgagccaccgtgcaagccccttgtatcattttttattttgatggcttgaaaaagtgcgtctcacatcacagagctgctggagctcagcatatgcagcatgagatgaatttattaatactaaaagttacaaaccacatggagagaaaacattctctttttaacccagccaactttctaagaatgtttatttattttgatagacttgtttactgtaaataatttaaacttgactttcaaataattttaattattccacagtacctaagattttcttatgcccttgtttatgatgttagagatgttagaattgatgttttgaaagctatagaagcttaaagacaaggtaatgatcatttctaggcaagacaatgatcatttctccatttgagtgttaatgaaaaagcaattttgctctagccttaaaaatatttttcatatacagtcttccctcagtatccgtgcttgattccagaattccccttggataccaaaattcttagaggctcaagttccttatatgaaatggtatagtatttgcatataacctatgcacatcctcccatatactttaaattatctgtagattaccgataatagctacattaacgtaagcataccttatacgtgtatacctaatacagtgctttcacatcactttattcatgtggattcagtgtagtacttagtgcacggcaaattcaagttttgctttttgaaactttgtggaatttttttctcccaaataatttccattgaggttggttgaatcccgtcagtgggatgccgaactcactgatagggagggccaactacttctagtttttttttttgttttttttttaaaaacctcttattgatttgtactcagacacttttagaacttatttctggttttgactagggatggagatgttcagcacatctgtgcttctgagccttccccagaaattaaagcagaaactgccattcgtgatgactttgccaaccgcaaagcaagggcctctaagaaagcttccagccccaggcaaaagtttgtgcactttgggccagtgacggagctagatcagcagaaatggaagcggcttagcattggcaaggctgggcctagagaggatgaagaagaagtcatctgtcatggcagcaagattcaaatggactctgtgtctcctgtctcagcggccacttccagcttaaagggccaccaaatatttaatcgacaaaatgactgcaggtattttttgccatacgtgtgcaaggatatctgcatgggagtcactgctgcttttgtagagtttgctgaagcacattatacaagcccctagagatgacatagttttaacagactatgtatagcagagaagtaatgttagcgggtccccctgcggggaacatgtatgtgaagttaaatggcaggcatccattttgattctgttgtcaccagaatcactgcctgggaatgccaataatcttggcaaatgaccctttttcccttggctgcatccagtactattttattagttgaaaataccaaatgagctaaatggaatgttttaatgatatcagtagggtttcctgggcttatgtataacctctctctttcctgtcccttagagagagaaagaaaaagttattagtatcatgagttcacgtttcagacatacatctaagtagacatattaaaaaagtaaaggtctccttcctcccccactttttaaaattatataataaatcaggagtcttaaaaacctcctctttgggggtttctgtaagtcgagagtttccttggatgaatcgctatccaaatgtgtgagggaagaacacctttataggcctgtctcagttctcatcctccctggaggccacccagttttgagttcccaagccctcttttggggatttggttctgtgggctggtctgtcttccaggaaacacatataggacatgtgtaaaaccggattgccctgggaacctccattccctctgtacagcaggagcaaagtgaggctctccgtagcaggaagaagtgttcatagcattcttctttataccttgcccttgaaatccaaaggaaatgatggatggcctatgacctatagaagggtttctttggttccagactcggggtgacaccatagaagagagaaggctataaacaccagaaataaagagttgaggtttcagaggatggtggggatctggggtggggaggagggggtaggaaattaataagaaatacgtcctcgaggccttgaatcctgagaggcccatcattcagtcttgtggtgacagagtcacacagccttgtttgaccttcataggccctagccagagttcacattccattatctcaatctgattatatcatccttactaaccagcctttggaatgagagcagccacattcttctcttaatctttcagtcccaaggactttcactgtcttctttcgtaacccatgttcctctcctctcttgccaccaatgctacttgatcgtctgcagaacaatgaattgtggccgaggtgactattgcagaagggcctcgtggctggctcctgtgccggagtctcaggaagagtgggtctgcagtttgggcgagtgcccgagggggacagaggaaggtgaggagcagtgtttcctgccttcccgggaggtgaaggaggacaggtggggtcagagcctctggtgtgaattctttcctaggagtgaaactgtcctctctggctttagttacatccaaacagctgccacaggatggcaaagaagaaacagaaagcgctccaagagattctgagaggctgtcaaaggcagaaagatcagaggacagcagccagccactgtgagcatcttgcctgcgctctgctccgtggtgtgttgcccctgctgtgtgtggctgtcgtgttcccaaaaaaacagcttaaagtcacagtctgcacctggcgactgatagagcgtggagtaaagtcactaaaagagtgtgctcatcccaagatcagagttctgcttctggtgcccgctctgggtagatattttagcctttgcatgtggctgagtactggccaaatttcattctcaggactcatgaaaaccagaaagggacccccattcctgtgtgagtatcagctgcatgacagagggtcccagtactcaaaagggagatttcctgctcagctgctctgtgtgccgctgcctccagggatgctggcttcttctgtcttgaattaacgccagtgagtgacactactgaaaatatctttagcagtaagtggcctttgactggctggactgaatgttgccctagggtgtgtcctctggcctctgagtgtgaggcttcagggacagaagagaagttggagaagatgacagctcctgcctggagtggcagtggactgaaaggccagcgaaagttggatgattcacgaaaagatgacatgatggccaggagaactgggatgtcccttagacacactggatccaacccaaaccagttccttccagttccatttgcaaagcaacaggatgtggaagaatcttctaaaggtctacccatgaaagatcagaggtcagaaagttattctgtgcccttgtgactttgtttctccagtctgagctttcagtgtgttcttaatgcattatggcacctcagtgccgcttacctgctgttgctagcagaaacagaatgatcaaaattggcctcatctgcgaagaaatttttcctctttttacatgtaagcaggtgtgattcagtggtgaatttacctgttaaacatttttttctgactcttgtggactgaataaatgggaaattcttttatttctttctagctcacataggagcctttgggcaaaggggttgaacttctatctgacttacttgatttcactttgattccaggtccaaagaagatgaatacatttataaaagttgtaattatattaatttttcaacattagcaaacactcgttgccttctgcagtaggatttctattccatgctctgacttgacttagagtcaaccatgacttgatgacgactaaggaaataattatcctggggttcctgttccagtttagggtcctatatgttgaagcctgtcttgccatttaataaaagtgatacatttttgttaaatgtatggtaagcctaccaatgtagggcaaagaagtgaggagggctttgcataatttataagctcaccataaaataggaagcaatggagttctgcttctccaaggaccctgatggcagtgggagagaaggcagagtgggaggcaaggagaacagtaggtaatctctccagatttttaaaaaatcaataccctagccatcttgatcacctgaatttaatctatattttacattcttctgaataaaacagtaatggagcctagcactgttttcagggagcagaagtaatatttgtgctttacaaccacagagtgctttgtagcgtttcctgtgtgtctgctccctcaagctcaccttgtcctgggaattcacaggtaggttgaaggaatctatgttagctccatttcacaaataagaaggctgatgtagagaaaagctgcgtgagtggatcacacatgattcccgagctggttaggactgggaagacagaggaacagagtggtgaagtgggtcctccacagttactcactttccagatgccctggacttgaccctggatccgcgggcttctgtaaagcaagttagaatgaaaggaaagaaggaggtgaggcctagagactgcctactggatacatttaggcgctctcccattcatttattccttacactacctttgagaggaagaattttcatctgcattttgcagttaggaaactgaggtccacatgtacacagctggtacctacagagccaagatccaaactcagctctgtcagagtggaaaaccagcatccctctccagcatgatgcctacacgagtaactagaggagactgtggaagcctgaggaattctctgtcactttttttttttttttgagatggagtcttgctttgttgcccagactggagtgcagggcccgatctcagctcactgaaacctctgcccattcaagcgattcttatgcctcagcctcctgaatagctgggattatatgcgccctccaccacgcccagctaatttttgtatttttagtagagacggggtttcgctgtgttggccaggctggtctggaactcctgacctcaagtgatccacctgccttgatctcccaaagtcccgggattacaggtttgagccactgcacctggcctgtcactctttgtgattctggaaagattcctctttattttcacatgggaatggacagttactctgagcacagggaggaatggtcaggtgaactatgtgacatattgtgtgaatgagccagcaaacactgtcggtatgcacatttcctatcaacaagtgtttatcaagtaataatcactatgtgtaaagcactgtgctggatgctgggggtgatcttagatgagcagtaaaaacactttaagctaacgctagttcatgatatagaaatagataactatcaaattattgattctgaaatgctttattagtagtgaaagttacataaatacaggcaatgggtgcataggctattccctttatctttctacctacccctaccctcaaaagtaaactttattttatttttttgagacaggatctcactccatcacccaagctagtgtgatcatagttcactgcagcatatcccttccagacttgagcaatcctcccacctcagcctcccaagtagctgggaccacaggcgtacaccactacacctggctgatttttttgtttttattttgtagaggcagagtctcactatgttgcccaggctggtctcaaactcctggcctcaagtgatcctctaacttcagcctcccaagtgttgggattataggcatgagccaccatgcctggcctcaaaattaaactttattgactttttttttttttttgtaggatgcttttgtcaactgtgacctgcgtggccaatttttacctcataacctattgagtcacgtactttgcattggaaagattgctttattacttttttttttttttttttttgctaacttgcctttactttttgatctcctgtaggatgattgggaaagtcacttgacacctcagctctaattatcttccccttgccagcaaaggcaattctgcttaagttggtgcccttttaaagctaatacaagtctcagaggaaattccttaaacccccagtacatagtaaagggataaatgaaggttatcttcggaaactgggctattcttttctcttcaatttctagagcacctgataagtatttaataaatacttattgactagtctggccactgttcagggaacccaaacagaaaaatctctgcttctgtggggcttacattttggtatagatctacatttattggtagagatgtccatgaaatactgttaattactttgtgtagaaacaacttaaattcagatatatcctacatgcaacaacatagttgaaactcacaaaatgtgctaaagaagacaaactcaagagtacatactatttgagtctgtttacgtagtacaaatcactcaacgctaatctatgcatatgttcattttgtgaaaatgcattgaagtatatgtgtggtatgtgcactttctgtatatagcttaaacttcaataaaatgttaattaaaatattcaaattgaaacacaaaaacacatagcaactattaatagattcttgattaaccatccattgggaagaaattctctgctctcttccatagataacttagaaaacactgtgtttgaataaatgtattccaataggcctatttattaactgggaaacacttacctagtcttcagaattaatattgcccttgcactccttttccttttcctttcctttccttttcagacagagtctcactctgttgtcacccaggctggagtacagtggcgtgatctctgctcactgcaacctctgcctccccagttcaagtgattctcctgcctcaccctccagagtagctgggaccacaggtgtgcaccaccatgcccagctaattttttatgtgattggtagagacaaggctttgccatgttgcccaggctggtctcgaactcctgagctcaagcaatctgcctgccttggcctcccaaagtgctgggattacaagcatgagccaccacgcccagcccactctctcaatgtgaaagaacccacttgtcatctgcttcaatgcagtagtgtttttgaaaattgagaatattaggttcaacttaagcaccttccgaaacgatactctggagaaggagaaaatgagtcttactgccagaagaaaaacattcataaaccctttccttgtcttgtttttggccatttcaacagagatttggggttttgcattggtatggttgccttcactgtgaattaaatcattatcaatgaatgtagattattctagaatgataaaagcataagagagaagggggtatgtgtgtgtacactcatgcattctggggtgttttctctaagattctctaagatttctctaagattgcaggaagagatgtttagaaattacccttttcctataaactattgtgaaactgatcatgggaccaggtaatttttgctgccgactccaaaatgtaatttattggaaactggaagcaggacgtattttcttcactattctttgtccaccatcagaattgcagaaaggaggagcttttcagggtataggtaagaactgacccttaaaactcgcctttgctgaagagacaggcatttgtgggagctgtgttgttttgttgttgttgttgttgttgttgttgttgttttttcatgtgctggaaatatggcttgtaatgttctaatatttttctaatttagtctttttgctttagactcatttagacttccggtgactatcgcagagggtacaactttatggatctaaattatcaggagaatataaaagattagaaaaaaactttagtttttcaagttatggagtatcattcaagtctggttttgattaaggctaccagttttctaggaattgtggtttctgtcaaatgcatgcggaaggcactgattggggttctggttggagttctggtttcccttcagaaaactgcagaaacactctttgatgttatttgtgcaaatgcattaacatctcagggacagggtcagtaagggtgcacttgtacagtgggtgtccattacagcccattactgctgaacataaaggcacaaaaagttgaactgtttgtgaatgactgtaatacatgtttgttttctaagctgccttctctaaacgctgtggattgcacctaagcctttctgtgtttatattgaacagattctttctttttgggtagtgtggggattattttcatttctcttctgggttttgagataaattttgcattttttagaaatatcaagacttgtctttgatttttcagcagccaatgaatattgctaattgtataatgccatttctctttcagtatctcagcaaaaaaggtttggcgcacatgtatttcaccggcagtttctatttccagcttgcttacagtgttcactttcaactctgccagtcctctaattttttatttgatcttatagatacggtccgagaactcctgtgtctgatgacgcagagtaagttgccttgtatttgtaggattacattaattactagcctaaactgcatgcttccagtacttaccactaattgaaatgcaactgatgcaagtgaactgaatagttagctgacttgtgcagcaaagcacttgaagttggaatgcagagcatacattctgtgcaggaaagatgaatgaaaaagcaacttaagcatgattctaatatgaagctgctgcttgaaacttaacatttgctttccatagactgggcatgttaaagtcgttgttcttgttatggtctgaacattggtaccccttctgaactatagatttatttaaagggcattctgagttttgcacttaattcttgatatgttggggcttagagttaacaatgaggtagtcattcccatagtctcattttttaactaagaaaataaatcccaaaccactaattatagattcagaagcccaagttcctcccaggttggagtcacataaactgtgggatgcttgagaccaaaacattggagttttgctcaagtcccatggcttagcagggggccaaggatgtaagacatgactggcccttcccctccctgctgcttggttttcactcaaccaagcagaggttcattccttatcccgtactccacatccaaatttgagaagactccaaaccctcccatttgtgaccacattaactctgcttcagaaatggatttcccatatgcagatcattctgcaactgatattcaaggcaaacttttttttatttgcaaaatgctagacttctcagattcaagtaatttgtatttgaagaaacatgattaatatctaaatccagcatcagtagtctgctgatcctgatattgaggagcattttgtggcctcgtgggagcctgggccatccagaatgtaatcaccagtcctcctctgcctatcctttcctgagcctcagtttcaagtcacacaatgaggaatttgaatagaatttgcatgtagaacatgcaaacatcatttccaccaatgacaatgagattaggcaaaaaattaagtgtcttcagattgtgctattttcatgtttgtgttcaagatgtctgcttagtttggactctgagccctaagtggtcaaactccagggccaagtttcccatgtgtgatctgacataaagaacactcatgcctcaaaaccaaattcagcctgagcttgactgactgcacagagttaagtagtctgtaaaattgagccctggttattacttttcaaacctgcaatggcaatatttaacattcactgaaaggaggattttataagattgacaggcaaaacactactttggtttggtgagcgaaaacattttgatagaatggatttcttcttcatcaatgcaaggctgctatacaatttgcttaaaatagacccctgggaaaggtgaaagaaaggaagggaaattaaagagtttctgaattttgccttcacctgaacacaaaacttcacccacaggaaaagttaatgatttcttaaaaggggtggggacagggactcccttcttgccttctctaagtttacaaaatgcagccccagggaccaagaagagtaaaaggagctttttttccagagctcttatctagggatatccaaagtgctgagtttcctgcttagagcagatacaatttacatgaaaccatgtggggaacaaaatgaaaagttgatatcaggaatttattcttaaaatagaaacttatactatttttagtttattcccttaatatctcctttttccaaaatctttaaaggcagttttttggcacaggctatatttattaataattgacacattcttaaaatagagcccaatcaaaaaaaagatgagccctttaaggagaatataggtcaggggcagacctaccgcacaggcaaacagagaaatttccacctcctaaccagccaagaatgtttccatagatttaatttcaccttcttgcccttttcttcactttcacactctttccctcccaatacctggcccaccaaaggagtcggtacgttgtgagagccataggccattttattctgaattcctttacggtagacttggcccagaaacaatttccaggcccttggggtaattccatcccggccctcaaaaatgccaacccaccaccaagggagactcctggactctgcagccaggagccctcatcccaacagcccaagggcatagacgtaggtactgaggagcacaggattagtccaagtcacattaatattctggaagctggccatctccaggatcccatatccgccaacccccatccccagacacacacctcttcatttgggaggccaagtctaacctgaactagggaacatgttctgaatgacaactcagcccattttctttctagtattatcaattctcaacttcttaatttttttttgaaaatggcataaatatatcactcataggtttgttatttcttttttggccagtttgctgatatttcttaaaaaaaaaaaatcttgagaaaaaaaatcatacaggttgagcctgccttatagaaaatgtttggaatgagaagtgtttcagattttgaacttttttagattttggaatatttgcatatacatagtgaagtatcttgaggatggaacccaagtctaaacatgaaattcatttatgttccatatataccttatacatatagactggaggtgattttatacaatagtttaaataattttgtgcatgaaacaaagttttggctgcaccccatcacacaaggtcaggtgtggaattctccacttgtggggtcatgtcagcattcaaagagttttggagtttggagcatttcagatttcagatttttggattagggatgttcaaccatgtacttcctggtacatgaaagggcaaacgagtttctccttttatttaactaactggcttctggccacatttgggctgagctagttagagcttcacagtgggagtagagatgggaacgcaggacagacaaaggtaattcttaaggtctgctctcattttctccatgcccattgggtgagataatcaaatcccagatcctggagaaggctgccattttcttcttggggtcccagaagaaaacctggatctatggccacccatagtggcctaaaccaaaattctgacctgtagatattatagatggcagagttgaatgaagggacctcttttctctcccataatctacaaactacttagtgggatggtaagagggtcccagctcagagaggtttaagtcttctaagatcttagcaaagattataaatcaccttaaaagatgaactgactagattgaatattttaaaagtaagattttttttttttaaactgtgagaggaagaatgggacgaatttttgtgtctttctggaaggcctgcttaagtgaattttgatccatgaagtttaaaagcatgggttagacttttctacctaatcctgcaaatttcttaatctttcttagataccattaatcaatagtctaaaatagatgaaaaatcacagcccttctcctctatcgaggactacagtttctttctttttcttttctttcattctttattttattttatttttttgagatagagtctcgctctgtcacccaggctggagtgcagtgatgtaatctcagctcactgcaacttctgcctcccaggttcaagccatcctcctgcctcaacctccctagtagctgggactataggcgtgtgctagcatgcctaattttttttcttttttctttttttttttttgtatttttagtagagaaggggtttcaccatgttggccaggctggtcttgaattcctgacctcaagtgatctgcccaccttggcctcccagagtgctgggattacaggcgtgagccaccacacctggcccagcttattttttctagaagccacagctgctgaaatcaacattctccactgaatacatggaggcagcattatgcaatggcttgtcatatccatgctaatagaaacctcagctaagagtccttctgtgcagccagattattagaatactcttggggaagacaggttacaagtacagtttttcagtttagttctcttagacttaaattgtccaacatctggagagcagagagaggcactcacacatttatacacattccttttgagtggattgaagggaaggtgggcagccattgctttgggggtcatcttccagacagctgcctgctagggagccctttgcattcggcgatgctgctgctgttcattgtctggccatgggagtaacaattttggacatcattgatgatgtctggaattctttggtgtctaagtgcatggtagttttttttttctttgtgttaggctggtttcaaaaatggactgtcaccatattttgttgctagcacttaacagtgagcttttaagagccctctatgtcttgaattttgggctccatagcccacttgtcccaaagtgagtcatttctttgaaagaaaaataaaaggaggaggattttgctttggtttctatttctgttttcatcttgctgcttcagcttttgctgtaacaaaggtttatgtaagcatcacaaaaaaggccctatggtcttgcacaacatttaataagctcctataaaacatataaattatatgtatgcacagtctaagagttttttaaagactgatttcccttgcatttttcttttaaaagagatattcagagttatcctgacaaaaattaaatgactgtgtgcatattagaatacaaaatatatacctaatttatgtgttttactccttactcttgttataaaatgccttgttttcttgattccaagatgccatcaactgcactatcaattacagcagttttacaagaaataaaaagaaatgattacaatgaacatatacatcagccatccatagttgtcagatgcatctaaaattcaataaaataaaataagaaaaagtgagtgtcttaaacttaaggccaaatgatatttttttggaaatggagaaattgcctccattcacataggaagcctttaagccagctttctacacaaagaagcatttaacgtaatacagttttacttcatggaacaccgccctctttccccacaaattctacccaggttataccttttaattatcttaattttattttttaaatgcatttccaagtgagaggagcctggggcttcaaataccatttttctagctcttctttaaacctattttggcacctacatataaaatgatattgacccgattcagtgacatcactgaagacaaagacggtcacattttggcgtttgcggcaaaaggaggcggtggggtgccagcacgcccaccgcccgcccagggccagaacacaccgccagtcacgcgctgtgcgcagcccgggaagggggcagttttccaagcccggtagcgcccccacgcggcaggacgcccaggcgcgcggagacgcgacgggcgctgatcgcggtccctcttgtgttcgctctctccacactcaggagcaccagcatgtttgacatgcggtgtgaggaggaggccgcggtgcagccgcacagcagggcccgccaggagcagctgcagctgataaataaccagctgagggaagaggacgacaaatggcaagatgtgagttgtggccaaggcgcgcgggcagcggggaggcttctggcagcagaaaatccagccgggtgggtagacgtggacttgaaagccatgcggggaaagggagcccctagagggtttcaaaaggtgacacggtaaatgtgggactcaaaggaaggtgagtagcagcgtgaaggtatggagtgatggcccagacatgtaatcagcaaacaccctggccagaagcttggtcacaaaagaggggaggggaggcaggaaactgggatgggttgtagaattgaggctgcactatcttctgaggttatatatttcaaattgatcatgatgatgatggtagtaacgataacaatgaccaacatcaaatgtgtaccagtaccaggcattgttctaagtactttgcatgcattcatttaatcctcttagtaactcaatgaactagcaactcttattgtcctcgattccacagacgaatcccagcacagctgtcacttgctgaacgtcacatagctagcgagtgggggagccaggattagaaccagggaaggaaggctaaagaggctgatgagggctttgagattgtgtgctgagagccaaagcggggagagaggagggagagtggattatttcatttaattctcacaaagcactctggaggtagctattgcaaacttgactccacctttagtttaaaaagttaacttctccaaagttcataaaatatagtaacaattatgtctaaagtatcttgagcacttactatgtgcctggcaccttacgtctattttcacatttaaccctgcaagcttgtaagaataggtgctattatcatcattttagagaggaggaaatggaggcacagggagactaagaaacatgcctgagattccaaagcatggaaaagacagagctgggattatttcccacagctgcaaccccaaccatctgcctccagaatcctcactcttcatcattatgctataactacctgtaggattgtggtgaggttgttgtaaggatcagatgaattaatacatatagaatcaccagatctaaagactccaaaacagttttttttctgccttgactgccttccatgtggaaactgtaaatgaatccctactattctattgtcagcaaatctgttcacaatgcagaggttataaataggaaggaatgaagtttcttacagttaccttgtgaggcaattctctgaaatttggcaactgacatgaaatgtgattgcatatttcacactgccatatttaaataaatgtgcagccctgctatggatactgtagataatatctggatgtttctgcctttgaggcattccagttccaaccagacttacattggattgtgtgggaatgcacacgatgttatagtgcctgggcccatagtcagttctctaaagagtagaaatgactaaactctgaagaatagaaatggaattatgcacaagtctgaagaagaatattatatctttctttccctgccaggacctggctcgttggaagagtcgtagaagaagtgtttctcaggacttaatcaagaaagaggaagaaaggaaaaaaatggagaagttactggctggagaagatgggacaagtgaacgaaggaaaagcatcaaaacctacagagaaattgttcaagaaaagtgagttctttctgttgtcgtttttaatgtacaatattatctaggtgttttttttttctaaaaattattggctgtcacaaaggttctgatagtaacattttatattccctgtactatctcttcagtgctaccttcgtttctaccaaggtcttctttgcaattttcattagttgactttgttattgcttctcccatgtcctttagagagcggagagagagagagctgcatgaagcatataagaacgctcggtcccaggaggaggcagaggggatccttcaacagtacattgagaggttcaccatcagtgaggctgttctcgaacgcttggagatgccaaaaattctggaaagaagccattcaacagagccaaatttatcctccttcctgaatgaccccaatcccatgaaatacctgcggcaacagtcactgcctccacccaaattcactgccactgttgaaaccaccattgctcgtgccagtgttctggataccagcatgtcagcaggcagtgggtctccaagcaaaactgtcactcccaaagcagtgcctatgctgacacccaagccttactcccagcccaaaaattctcaagatgttctgaagacctttaaggtaggacaagttccttaagagtagaaccaaagctgaactccagggagtggatggaaagaagcatcatgactcaagaaaatgtcattctttttaccatacaaaagaaaaatgtgttgacatttacagctgtgaaagtcataggtctctggagatttggtttgtaaatgcttcagggacagctgtttccctcaattgctgttgttaatacagatggactcctataagactgatagtggagtcgtctccatgagcaaggtctattttctagtttgatataatggcatgatttctctgtactagtggtaaaaaccctaatttagtaataccctagtatttctaggtatcaggaggtatggcagactcctcaaaacaaaattttatttgcttttggttcaaatagaagtatatgcagctacctctcttttaggaagaaattggcattcagcatccatttgacattgtagcatccaaaaagattttacaattgataaaaatacaaggaacacatgggaacatgggacatacttggtcctcaaatgagacaggttttttaaacaagtggaaagaaactgggttgttttgctaatgagtgtgtaaaatagtgttccagactgaagaacttgtggaaaccaaacatcttttcgcttcctcaaattcaagtactttctcttatatcaggaggaagcactcatcctttgtcttaagttcttttgacttgtaaagaaaaatcagttccccttgtccttgcactcaatgagtttgtaataaacagaggtggaatgcatcacttggagatgtgaccattagatagaaaagttttcgtaactgattgagcagtgtgatgccacgtagcttccttgctgtatttcaaagagaacaaaaccacactttctgacttttgctgaaataactctgaatgtatctcaaaaatctctatcttaggctttgatagaacaaaaatgtccagactgtctcatctggatcacattgagctgtttgtccccttataagggcaggggccatgtctctgtcattcatggcttcatcctgagagcctggcacaggtgcccaggacagagtaggcactcagcaagtgctccttaaataaataagtgaatttttcctgagaagatgagctactaatcatatggactcacacacacacagatagacacacacatgctcatgtgtgctcagtggtccacctaagtgtttcagaagctttccttcacctagggcctatgataatgaatggctatggtatttcctgaaggaagattctatgttgaggtggcccagaataggatagagaatacatttatttaactggatttccaaggcatctgaccaaacattctagatgtccactttccctcctttatctaaatagtgcaaagtgatcgtttaaacagaaggattagcataaatgattttatggcagaacttcagctctgagaaaactctgttcttcaccatggcggcaaagtggagcaaggtggtatggcggcctcaggaagcacttccatggagggggttattagagaatttgagcagaggccctcttagagctggagattactcctcatcactcactagtgggggtcccctgcctcattgtaggcctcactggctagtatttctactgatggcctacagttccattactgagtgcatggacagcaactttggtcaaaggtcaaagtaacatgcaaatcagaccgttgttaccagctaataatgccaggacagaagctaaggggtaggggtgtgtgtgtgtgtgtgtgtgtgtgtgtgtgtgtgtgtgtgtcttcttggagggcagggcagggaatacaggccccgttgtttttccagtacaacagaattaagaataaaggaagatcaagagaaatagtttaaggcagtgtttttcaaactgaaagttaccacccgttgctaggttataaaatcagtttagtggtttgaagccaatataaaaaaaaaagaactagaatagaatataataaaaaaacatagtgtgtcacacaatgaaggcaaaattgcttggggcaacttctgtttcagttatatttatgtgtgtgtgtgtgtgctgagttgtgatttaaatttctttttatgggtaacaaataatagagtaaaaagaccagtggcttaaggtaaataaactataactaatatccagccttccattatttcttttaaaagattttaaaaggcctaatgaggctgggcgaggtggctcacacctgtaatgccagcactttgggaggccgaggcaggcagatcacttgagaccaggagttcgagaccagtctggacaacatgatgaaaccctgtctctactaaaaatacaaaaattaaccagccatgttggcatacgcctgtaatcccatctacttgggaggctgaggcatgagaattgcttgaaccaggaaggtggaggctgcagtgagctgagattacaccactccactccagcctgggtgacagagtgagaccccgtctcaaaaaataaataaatacataaataagaggcctaatgataataatggctaatagttaagcacttaaaatgtgtcaggtactgttctaaattctgtacatttgataatccataaaatctccataacagcactatgaggaagatactgttactttaaattttgcatcagagcacagagaataggaaacctgttgaagattccatgcctgttaaatggtagagccaggtttcaatcaggtcacctaactgcacagctccctctcaaaaccactctactttctgcctcaaatttcaagaccgagatttccagatgcctttcagtaagccaggctaaccgccctctctggtttccctttcttgctccaactgcctcccctcgatgtgagtgcaaaacaaaaatattttaatgtgcatggtctttttttctttaaaaaatggaggttataaaagtaactagaaatagagattcactgtaacagagcatagtctcagatcccttgccctctgccttagcttcaaaaaaagtatctgtttcccctgctaccaccatgggataagctgtaaaatattcctgatctgtggtaagttccgcctcatttatatgctatccagaaaaacagtcaaggttgtggaatagcaatcagaactgaagtgaaacagtattggaaccccaatatgtggcatgtatttgtacttaagattcttcggttttctgtactttaaaataaaagcagaccataaatgaggtgaacatgaaatggaatctatagtgaagtggcccaagcaggccaactaccttttaaggaggccctcaaagatagcatttatagaagccctaactcatagatcccatcagaacatttaagagacctcttccttcattggactctggttattaaatgatgatcttttgaggtaattctgaacgtgtcgttttgttacagtctttgattggggtatatatagcatgttttttgttcattctggcttttataggtagacgggaaagtcagtgtgaatggagagacggttcatagagaggaggagaaggaaagagagtgtcccacggtggcacctgcccactccttaaccaaatcccagatgtttgaaggtgtggccagagtgcacgggtctccactggagctgaaacaagacaacggtagcatcgagatcaacataaagaagccaaactctgttccccaagagctcgcagtaagaaccaaacatttccccgcctccctttgggataattccatggtgaaagaatctgtttttaaaaataagtaggtcatgataatgaccatttctttctatgttggcgtattagtttgctagggctgctgtaagtaccacaaactcagtggcttaaacaacagaaactgtctcacagtcctggtagctagaagtccaaaaccaaggtgttggcagggttggctccctccattggtcatgagagagcatctgttccaggtctctctcctagcctctggtggctgctggcaatcttgatgttcctgggcttatggatgtgtcatccccctctctgcctttgtcttcactggtgttctccctgtggatgtgtctgtattcagatttccctattttattttattttattttatttttcgagatggaaattcgctctttttgcctaggctggagtgtaatggtgcgatcttggctcactgcaacctctgcctccaggcttcaagcaattctcctgcctcatcctcccaagtaactgggactacaggcatgcacaagtgcacccagctaattttgtatttttagtagagacaggtttcaccatgttggccaggctggtcttgagctcctgacctcaagtgatccacccacctcagcctcccaaaagtgctgggattacaggcatgagctaccacacccagcctaatttcccctttttagaagaacaccagtcatactgagtaggtccacccttctcccttgtgacctcatcttaactaatcacatctgcagcagccctatttccaaaggtcactttctgagtagtaagggttaggacttcaataatatgaattttgggagacacaattcaacctgtatcattggtataatggaaggtattacaatttatgagccagaaattactttttcttgtctcactattggtgtccagtgttatagaagaataagtaaatctttaaaataccttttccccccctgtttatttaggacctcattagacttgttaatgccatttgaaaataactggtgctatcagaatctagctttccatccccggcgatgtatatataaaagggcctttttcttattagttaaagaaacaaaaattcatttaaaagctgaaagtaatgtaaagcatcagagtactattgaatggcaaagctaaaaaatgtatgctaattcaggtactgcagaaaagtgaactcaaaataacatgatatttgtttctttggagtagaagacatcattgggaaaattgcactttcttccatctctcaccagaaagactcatgctggtttcactaatctaaccgaaactgtcactacacagatgcagccctgctttcggggtacgggctggactctgttcaacctcatttgtactcaccagaggctgagtttctgctgttctaatttatagcatttgggtttatattatagttacaagaagggaaaaactatcaagatattttcccccaggacctagaaaggtttggtgtgaaaggaaacttcttccggcaccaagggagctgagcgttgtgtgacccagctagctaaaacccacctagaaggctggatatcattatttttttcctttatgattagtcttttgaagactaaaattattttttttttcagaggagttgagaagatataattcttccacgcagtacccaagtgctctgtgaaagagattcaaatgggagtagaccaaaatcattttctcaccatggtaacacgtttcctagtctctaggagcagagttttgtgatccaggccactgcggagtctctcctgaacttggacttcctggacttccattttacttgtcatttgcatacgtcttacctctgctagagatttcttgcagatgatcacgagacagaatattgagttctgctagcagtgtgagaacttaactgatagagtaaacattaacttatgctgttaaaattaaactagaagaccccaaattaattagacataggggtggcattgcttttcagggacaattaataattctgttcttatttctcttttgccatttttcatgatgatcgttttctaaattcccttcattaaaaagatttcacattgattacatatcccccaaagtaacttgttttaagagaagcaaaattacacgatctgaaagaaactatgctatttcaaaagtttatacatgatcacatggagaaggatggccttcaggactttcttcctagaaaccagcctgatcctggttgcctaaggatgcaggtctaaactcagaaaagcctgggagtcttttccttttgtgtatttcttccttggagaaattgcctagttcagagtaatttctaggtcagtgaaccctaatgtttctgaacaggtagtagtatttatggaccctgtctatagtactttaggcttttgaatcaactatggcagggggtattgcattactttctgtgtgggaaaatctctgtatatatctgtcagactataagctaagttgttagctgtactacataggactgtggctcattactcaaatactcatcatactcacatgcaacttaggataccacaagttttccattcagagtgtgttatcccaagagtcattttaaaagaatcacttctccagtaaacctactccccattttacttctttgtgcatgattccaagcaaagcatttcttgactgtgttacagccggtatactcctgttaaaaaaaaaaaaaaaggaattaattggtcatggcaaaatatggtgaccagcttagaacaggaggctgcacttcagggcctcccagagactgacaccagcttggacttcattttctgtttctaattcacttgcctgattctgtggggctgtcaaaagattagtgttcttctttttaaatagtgtctttcttccaaaaactgcattcccaacagatacactctctacagaggagtagcttcacccaccactaaaatgtcacaattcctttagggtgagctagaactgttcaaagggcacagcagcagcagtaggcaggagcatgaattcaggaatggagggagaacaacagagaagggcggcccgagacctgctgggggaagggattgcgtgtggagcgtcagcatctgggcccgggacgggcactatggatgacatcatatcatctctttggtttccttctacctcatctttctcatttgaaactcttgggactgtcactctcttactttagaactaggtcctaaattaagttaggaattttaaaaaatgctttgtctgtacctcctcatgccagataattcccagtcatcttcagttgaatcacctttatggtaataagattgtgatagcagttaccttgcagatgggcacgtgttaattggtaaatatgaattaaggacctaccctattacctgttttttgaaatagaagaataaacttctaaacttggtaggaaaaaaatgttcataaagccactagaaaagtatatagaacaacgtagaattaaatacagagggactcatgacttaggatggttcaccttaccatttttcaatcctatgattgtgcaaaggcaatatatgttaaatagcaactgtgcttcgaattttgaattttgatcttttcctgggctagtaatatgcagtaggacactctcatgatgctgggcatggttgtgagtgagccgcagctcccagtcagccacgagatcacgagggtaaacaaccgatactctatagtgcactgaatctccagatgattttgcccaaccgcgaatgtaagcgttctgagcatgtttaaggtaggttaggctaaactatgatgtttggtaagttgggtgtattcagtacatctttgacttaacgatgttttcaatttacaatgggtttatcagaatgtaaccttgtaagtcatggaacgtctgtactagatggtggagtaagaaaaccagaggaatatacgattgcaaagaacaggcaagatcttcataggctgagtttagtctgggaaggttttgtgtgggatgtggattttgaaacttgacagtaagtgtgggatttgtgttgaagtggaggaggggctattctacacaccagaaagggcagaatcaaaggcatggacaatggtgaggagcccaccagaggaccccaagaaggataagaggtgatgagggtgctgtatattctaggcagagggatcaggtcctcctgtggccacccaatccctttgcccccaattatccctgagatatttcaggggttttgttcatttcagcatctctgttaaaggcccagtggaaacctcacacttttttttcatttaaaaatactggcttctgtaagaaaatcatgttatagcacacaagcagactcctagaatataggactgtaaaagaatttagaaggtcttctaatctgagggctaatatatcctatgtttagtggcctacagaaagatatttttatgtatgtctcccccaaagctattccagtgttgtcttgattcactgtcagttatatttgtatctgaagctcttctttcctcaatggcaccaaaatgacccttttcgaaaataaccaaaaaatacttcatacactatatcaaaggtcagactccacctgaacgtcaaactgtctaagcctcaatttatatttaaaaagaagtataataatagcatagacatcagatggttattgtgagaattcatgtctgtagagcacttagcatactgtcagggtgactcagagaccacaggtgccactcagctatctttaatattgtcatgcaacaagtgggagtaaggaagttataatatttaatacatttttcagaggcccaaaaaggcaatcagtatgaagttttttggattaaagtaagttggtcaaaattagcatcttgaacagacgtgaatttcatacaaatgagatgaattgcttttaatcttctaactcaacttgttgttccaattgtaattctctaaaaaacatacagatgtggacagctttttctagaagacagttgtccttgcagacacttacatgattcttcctgcagctcttttttttttcgtctttccccccaccttttgtagagaatggggtctcactatatcacccaagcaggtctctagcaattctccggggctcaagggatactctcacctcttcctccctaagtgctgggattataggcatgagccaccatgcctggcccttcctgcagctctttttgcctctccttttgttccctcctttccagttctggccccctcctgccacctaaactcctaagactcccacccatcgacccctgtgtcactcctttccatgcctgttcatcagatctctctcaccagctcatctcaagtgacgtagcccatgctctgcctcccagtcagcaccatcccatcaggttcgtggcaattttccctcattgagcaagggccaaactcacctattgggtatctaaactacttcatctgcttttctcaaactgagtcacaaggtaggtctgtttttcccattttgaaaaagctctaggtcttcctcttgaaaattcagtacttatgttttctgatccaggaaaacagacaatcggatctttcttgaaacattgcattttgcagtgagagcagggtgaaggcatttgagtaggtgccgtttttcttataactgagaccaactgcaaattccttttagatggcaaatgtcaataaacatttcttgagaaactggttttctccatctagaagtagttgtaagattgctagatttaatgatttttaaaagtcattaaagatatttagataaagataaagatgcatttacagatttcgagaaagcatacatcagggaaaataaaaaattaacctggcctatctatccagttacctgggtcaaaacctcatttttttttaatttgaaaagtttagtacaaaaaaaagtttaagacatggagagcctgattctccatatagattccctgtcttccagtggcagtagatatttggaggtataaaagtgaaaagagaaacccatgcacagcatatgtggcacctgggtctggcaccgcagtgccagagcataaatagactgattttccaggcttgtgtccagataagttgtccaagacgagagccaggaaatcgctcagagtcacagaaccgttgctcgggaaaggacgttggacatcacttgttccaacccatagaggttaaatgatcagtccgagctcaccagcaactccatgtgagaaacaggcccagcacccagaccctcagtctcaggagggtgcttgccctcctgcttcacatgtctagtacatcttccaatgtcgttctctgggccagtccaccaccaagattctagttaaaatgagcagccagatgccaggtaggctttgggctagaccatgtctctctcaagccaggaaactgccacctcccacctgaggccccagggctgagtctggcacccgggcagtttggatcgcattctcagttaaggggaagccagctcctggctgagtcccatgcaacctttctgtgctctcattcattcacgtccagggatctgtttttatttacttgttttcattcttgagaaagtgttaccagttggagaagggaagggctctcctctgttgagctgtaaccaaagaaaaatacaggtcagaaaacacatttttccatcaaggcgggtttgtttgaagcaaaccgctgagtgtatccctgccaactttgaactcatttccttcgaagtaatgatgtgagtacaaaagtaataagcctccaggatggagtatccagacataagttaattaacctggctttggggatttcccttgattacagatagcctatatacattgcagaatacagaaaactggagaaaacatcgactacctattactcagccactctgaaattaatgctaacatttttagaaaatgtatatccttctttttctcagtgtgtataaagtatttttaagtgggttcctgttattcaaattgcttgctttttctcttactttatctgaatattttgctagcagtagccagattttgatgactagcatacatttaaactaagcctgagagtatacattccataaataagtgcataatatttatttacttaacaaggattacgcatgtatctggccgctaattcctcagaacgtggactgaacagaaatccccgagatgagctgatggctgggggcagttgggtccccaggagccctaggaaggggagagattccaggagagttctaatcttttgcagaataaatgagtgggaggtagaggaaagaaagggaatggaaaaagcagtttgaatcacttcagcaataaacaagactcttaggtgatagattgcctctcatgtatcaaaacctctcaatactggaggacagcttggaattggtgtgactccaagcccaggtggtgggacattgaggtcaccagcacaggcagggttcccacctcccctgccttctagcagtatgaccctcggtaagtcgcttaacctcccgggcctcagtttcttcacttgtatgaagggaatcatgttggtacctacctcctaagcttgctctgagaattatgtgagacgattcttatgaaaggcccaacagcactgacacgtggcaagtgcagtaaatattgattgcagtttctgctgttgctactatcaagttaccgtatcaaatgtcaggatgtaacctttaaagcaccttttaaggtaagttatctggagtttagtatttgagtgctgagccatagagaaatgtcttgagaaatgtgagaattcttgaaagcagaagttctccagcatacataagtggtaaaacgttgctggaatgtggtatgctggtacaataagccttagtgaagtagttagtgcttgagcaccccatcccctttgcatcacacattaggtctttaggtctaaagggcttcatgaactatcttatttcattgattctaagtggcacacttttcacattttaacatctctaaatcaggatctgtcttataatcaaaagtgcatcatatttaacagatggcgtgttttctttcttagtagtacctaaagtaatacaacttaaaattgatggcattttagatttaataaaatatgttcatttctttgttcatttttggtctggtgaggctttggccctgttgtgtagttatttattttgtttatagtatttgtaaacaccagtgttctcaagaggctcattcatcaatatttaactgcaaatttgtttcccagtctcagttttctataatgtaatccatttgtggggaaggggaagctaaaaatcagtatttctgccagtattttctatatagatgtcataaaacaaaaataccatcatgtattaatatttctacatgtgcaagacagcactttgaattataaaacccaacttattcttttgcaatgctaaactggttgatcttcaaatcctactaccatgttggaggttcatatagcaaacaatgtaaacacacacatgtaccataacctaaatataacaaaacagaccagttaactattctcactcatttaagtctcttgcagggattcaagtcagacttattgatatattaaaatattacaaaatccaaggtgatgcatatttcctgcctagggttttaaaagtgtgttttaacttaatattatgttcttccagaattgatacatgactatctgtcattagaaaatgcccatctaattatgaggatttcaaaactactccatcctccaaagaaaaatcacatttttgccactagatgctattgtaaaaccttttagaaacttgaaagttttgttgtttaaaatttctttgtttttaaagaattcagtgatggtttccaccaatgcattaactttaaatacctttcattttgagaggcaaaatttgatttatggataaaatatatatacttatgagagacgaataaattcatagttctcgagaacccatggggatattttatgagttaataatgccttttctgaaaccaactttagcctttatcttaaaaccttttaaaatttatgcaatatttcatacacactttaaaatttaactttagctttttacaagaaacttctaccaaaaaatgcaatagtcattaacttgctctctttaattatcaaaatataatctagctagtatttaatttaacattttatttatttttactaagtaaatattgtaatagcaggataattttggacttcattctagagtcaattggctcccagtgaaagacaatgtaaaattacattgattttgttttccaattacagaagtaatacatagtcattatagaacattttggaatatataaaatgtatgtaaagagaaggaaaagtcacccaaaacttaagcacattaaaaataatcacaattaacatttttgtattttcttactatctttttttctatatgtttatgtataggcatgtatataatcatatacatgtaaacatcaaactatgtatacagtttacatttcctatcattagtaagtattttcacgtatcattaactattattcaacatcttattttttcatgattatattgcctttatggacatgcagtaattcattcaatcattccccaattattggatatttaagttgtttcaattttttttactattgtaaattccatcaagcataaaactgacacaattgaagtactactgagagagaggaacacaagcattagagtaattactggaggtgccatggagatgaacatgacagtgatgtaccaagtggattggacagtgaggttcaaatcacagagacttcttagtggagaacaaggaagaaaggcaaacctggagtcccagccatagaaacagaaaggaaatgattgatatgaaaactagtatgttagaaacttagaaggacttggcaaatgatgaatattcatgaggtatgagtcaaagatcacttgaaagtttatgtgatgggaagaactgctgccataaacagaaattgtcaaatttggaggagaaggccattgaccctagaggtgaaaccgaagctctgatggactctcacagctggagatgaaaatacgagttatacacggagaatgtaatggtgaatccatgggaataattgatatatttgagggtaattcagcacaagtggaggaaaacagggtccagttgaaatctttcagaatgacccatattttgatgaaaaggagtaagaaccagtgagaaaagagtagtctgaaagtggggaggagagggaaaaggagagaatgaattagaactccagtaatagagattcactgggagcccaggaaggatgagaactgcaggctaaaatccacaatggtaagggccacaggcaactatgccaagacaggccactgagaagttaattgtaacctttaaagaaccacaaaaagacttcactggtgttatgaccctaagccagcttgaaaggctttcaagaacaagtaggtgatagccatgattttgagcttttggtggtgaaagaaaagaaaatgtgggatgtgcgtccaaggcagtcataggaggtttggtgagatggtgaaccgcatgggtgtcctgttctccatagaatgtctccttccaaccaatccaggctctcgccatgaagctgcctgggaagtagaagagggaattcatatggccaaaccactttgttgacctaaaaattactgcttaaaaaataatttttagaacttttaaaggaatcatttattcaagggggaaaaaaatctctttttcaggcaaccactgagaaaacggaaccgaatagtcaagaggacaagaatgatggtggaaaatcaagaaaagggaatatagaacttgcctcatcaggtttgtttcataagagactagttttaaggcaaatcatggtaactgtttaagatgtaatggaaatagtcaagaatttttcctactgagccacaggaaagtagtaattagactccaggagtggtgcggttgtgctgccacctagaggcttcctggggaagttctgcccgtatggttaatgttgctgtgaaaataggagcccatgctctttcttaaagctacccagttttattttgttttttaaaatatttatccctataatcataaagaatattgtgttcttccatataaatcatgctaaaaattgagggtaggattttgacacacagtaacagcaatagataagcgagaggtcaaaaacataaaaatagacgctgaaatggtaaagctcacatatagttaaaaatgaataaaatagtgccatgaatctggacagtgagtataatatactgtattcgttgttttaggaagaagaccctgttcccgaaagtcttgttcctcaatatttttttgcagccttatcaatatgtttaacacttttcttcttttgataaacagtaaaacctctcaccctctttcaataccaaattattattttttataaggcctttctccagtgtttaccacttgagaaacataatttgtcaattaccaaattatttttaggtaacatttttaaataaattaaatatcacttaaaataatagcatttactttttcaaactagattgtgccttcacattttgatatgcccccttaggtagtgacttttccaccccttctaaagtgaacctaattcttctttatgtatcagagaacactttattttcattgcattatatacatataccccacaatccgtaacacattccaattaagaaattctgatgttaaaatggagcattgaaatacaaaaaaaggaagcatcaggttgctgctcattcactgggatagaaactacctgtagatgttctcttatctagcccagctgtcataattatatatttcgtgtcagcattctgttccatgtggtgttattcagatgtaaaccgtgacccttactaaaaacttaagttcttcatagtgtggttataggacgtgatttgtgttgcttgttgttcaataccatgaaagagctttgggaattccagcatcttaggctcttttatatctctgagcacactgtcattcagcttatattgccaggacgggatatggactgaatgtacttcatggcattgcagaataaatggtcctatagatatttgattttcttttccttctgtacgtttctggatgtaactccattgcagaaccacagcattttacaacaactgtgactcgatgcagcccgaccgtggcctttgtggaatttccctccagcccccagctgaagaatgatgtgtcggaagaaaaagaccagaagaaaccagaaaatgaaatgagtggaaaggtggagttggtgctgtcacaaaaggtgaagtgcagagtggaggaaagcggttaaacccacaagttaacatggccccatattacagctagctgctgctgtggcagttgtgaataatgaagatttatttctctcctcatcttttttcctatctttaatctgtagtttttctttttcgtgtgtgtgtgtgtgtgtgtgtgtgtgtgtgtgtgtgtgatggagttttgctcttgttgcccaggctggagtgcagcggtgtgatctctgctcaccacaacttctacctcctgggttcaagtgattctcctgccttaggctcccgagtagctgggattataggcgtctgccaccacgcccagctaatttttatatttttagtagagacggggtttcaccatgttggccaggctattctttgtggaaaagtgtaatataagttctaaagccttgcagttaggttttagtttgctgtgtgtgtttgcttatttgctttttaacctgtcagcttactggctagtctctctccaataatcatctatttgttagccatggtaattctgatgccactggatttggataacaagaaacctagaaaattattattctgatataataggttttaaagtcttgtttttattaaagtttcttccttgtttagagtctcatctcattcacattagtttgatttgttttcaggtacagagtctaaaaatattcatcagttacaccagttgttcgcaaccttgattactcttgggaatttaaaaaataacaagctagctgggtgtggtggctcacaactgtaatcccagcactttgggaggccagggcaggaggatcacttgagcccaggagttcaagactagcctgggcaacccagaaagtcttcatctctaaaaaaaaaaaaaaaaaaaaatagtaataataataatagttagccaggcatggtggtgagtgcctgtaattccagatactgtggaggcttaggtgggaggatcacttagcccaagaggtcaaggctgctgtgagctgtgattataccactgcactctaacctgggcgacacagctagaccccatctcaaaaacaaacaaacaaaacaatccaagcccattccagaccaaataaattagaatctgtggaggcagagcccaggcatctgtattttttaaagctcccaggtaattttaatgggccaccactacggacttgcacaactggaagactatccgtagtggtgtaccacctttcagaatggaccctcaatttgggtatgaccttaaagtgaaaaatctgccacttgtagttccagtttattcatcatttactcaaccagtattggctgtgcacctactatgtcatgcctggccctgtgctaggtactggatagtcaacagtgaacatgatgcactccctggccttaggagctgagaattctgtatccttggtagagcctctaaaatgcctgttgccttgatgcgttttcaatatttcagaccctagctattcttcatttttatagataattaatggtctgcaggtctggaaaggggaactaaactgggagtcaaacgttgggaggcaggcagaatttcccacctttgcaggtttcgttttatcagcatcacactagttactattatttattacccttccaaatttacttgcttttcccacttaaatctaaactgaaaggaaaaatctgtatcattgcaagtaaaacatataacttgaacagaatgaataccctaagtaaaaagcagtcattgcgaacctcatctgtggaacctcatcttggagttcatctgtggatcaccagagtcacacctgccctactatggaaaaaagtgttttcaggacttcttcagtttgttcgtgtgtgtgtttttgtgcattgtgccttttggtcatctggtaaacattattctcagaatattttttaagcgtaaaataaaatacacaggattaccaagttattcttggtatcatgtggtgccaaatatatatatagcccctgaatactgttttgttgactccaggataagaacccctgccagctgatgagcaaatggaatcatggtctttgaatcaaacacttttctcacttagactatgtgaatttctcccttttcttcctttcttactgtacggctagctcttagataaagggcgaatggtggccactgtgattgcaacagcttttatttcctgatttcacttgagagtgtttcctttataaagcaaagcacccatgcttacaggcttacctttttacatagcggtcattttgatcattgctgatgacccttaactgtttcatttacaaccaggcattactgaaacatgtttttgccagcctccactacaaggaaatgctatgaggttaatgactggtgggttgtcagctttgggaaggctagaccttatcatttgctgtgtagcaccaacgttcatttggacacctcgttgacctctgtaatgcagaatgaggtgattagttttctttaagattctcttagagttgaatatattattcataaaaattccttctgaggataaattctaacattaatttattctgaggaccaaattagggatcagcatatgatgaaacaagtgctctgtggtctcactcgccctgaggtcattgatctatagggaacacagccaccagccaaagagtgaatcagagaaggtcctgcgagcagctgaaaaaaacataaatttatacagccacgctcctcattcagacctatgcacagtgtcaaccaatgcttattttagacatttttgttttaataagtttggtaatctggtctttcagcaatcagctaatcagaagcaacaaaccagaagaagggtgtttctactaaaggtcattcatattagggagaaacaaaattaagtagcaataacaagaaaaatctgttttacaaagcaaacataagaatttttaaagtctgtaattttggaactatttacaagtagtaacaagtagtccaacatgcctcaaaaattccctaagggcatcagatactaaggcactgttcgacagtggttgtttataataatgtttctttgtcagcaggcaaagtatactgtctttaatgtgctttgcataaatttgtggggggttatgtaatgtctttagaataatatccattgaaaagtaatactactttaatgtttagcacttatggagtaagatttgttttaattatcttatgtggaacatctaaatctcctgacattacagattcagttttgtgtggtaccatgaagagaatttgtgattgttcaataagaaaataagagagtaatgtataattccaaagatgtaatattgtcttctggtttggagaaaagtggtcattacgtttttacgctcatgtttgatttatctaaaaaattgacgctctgttaatgtagagaaggatgaaagcgttttagggaagaaacaaaaaatgaaatgtttaaatttaaatgttaactgtttgaactgaatgacttctataacagccatggatccttaaattgtgtgtcacctgtgcatttatcaatggacagttcttgcaatatttatacctgttttccattgtccaggtggtaaagccaaaatctccagaacccgaagcaacgctgacatttccatttctggacaaaatgcctgaagccaaccaactacatttgccaaatctcaattctcaaggtaaagaggacatgttttattttaggtctgcatgttctgggcccatctgtagtaaactattacttaatttaaaggaagattacgtcctttatgttgctattcctttagccagggtgtttgccagagtctgtgatagctgaatttatgacttcagaatggaaagctggagccggattctctatttgagcagaccaggaaccctagctgccaaggccatttggtcagccaggcactataggcacaatagagcctatacaagtgttagagctttaaaattttgtattatcaaaattagctgggtgtggtggcatgcgcctttagtcccagctacttgggaggctgaggcaggagaatcgcttgaacccaggaggctgaggttgcagtgagctgagatcatgccactgcactcgagcctggtgacagagctgtgacaaaaaaaaaaaatttgtattatctccaaaatataaaaagataaaaagtcataaaatcataaattaatgtacttaatagaaagtttaatattatgtatatttcactgttaattctagtcttcataaatgtccatttaatttgacagtaattttgagaaaaagctttatttttttttactccacaataattcctgggtgcatgatgattattgagaaatcattcaccatcatagattaaacaggttataaacaaacattttaatctttatgtgtgtgtattacataaattacattctcatatatatatgagaaacgtgtgtgtgtgtgtaatacacatacataatactaaagatttaaaaatgtttaacacatacatactgaggatatattttaatatgtttgatgtattttaatgtgtttgatataatgtgggaaggggttgcctctagaaacgtgggcatttagggcctataagaaggtcttaaaatggcactgaccactgaaaattccccaagtactgtgtagaccatatatagggttgtgaattcacccctttactctttaagaacccaatttgaatccctttatcctagtgggaatcccaggtgcccatgaccaccagaaagggccctgagggatgtgaacagtggaggatgggttctgagaattccacaacccagagggactatgcttcaaaacaactagaccgctgagttttactgctgtgagatctctctctagatgtggaaatgggccagatgcagtggctcacacctgtaatcccaatactttgggaggccgaggcaggaggagcacttgaggccagcagttgagaccagcctgtgcaacatagcaagactttgtcgctaccaaaaaaaaaaaaaaattttaaatataaacattttttaaaaaaagaaacagccagagttcaggaggcaagaactgtagggtttcttgtttttcttttttaacagactttctccagtgtgttttgtagatttagcttatttttacttttctttttaagggtgggcagctatttgagccactggcagaatctgagttggcttccattagctattattgatgtttggcagataagttgggttttatctacataacagggaactcttggcaataattaactggtacatgtgctgatggatactaggttcttaatgtggaaacaagtttaatactgttttcaaagcatttgtcttaaatttgtccgtcctactgtcctgaagggaattaaaaataaagtgtcacaactgggccagcaaatggccatatttggaccaattttaattctgccctatttctagtactttgtaattgtgtagataagtggtatagagagggaataaatattttaagccattttaaagccatgttttgttttcttataaatttacacatttcattacttattgtgaggcattttgattttgtaaaatgtgctgctgaattgagaaactttacttcattctttacccaagtcgaatgactaaaaaataaaatttagtagagtactgaaacatttcaaaatgtattctttaagatagaattgtatttggaatacaccagttgtatacttgtattagtttgttttcatgctgttgataaagacatacctgagactgggtaatttataaaggaaagaggcttcattgactcatagttccacatggctgaagaggcctcacagtcatggtggaagatgaaggaagagcaacgggacatcttacatggtggccagcaaagagagagcttgtgtagggaaacttccctttataaaaccatcagatctcgtgagacttattcactatcacaagaatagcacaagaaagacccaccctcatgattcagttacctcccaccaggtccctcccatgacatgtgggaatcatgggagctttgattcaagatttgggaggggacatagccaaaccgtatgaatactttcatctggttcatggaaactgtaattatagctgcatgctctggagacaaaatgcctgggttcaaattttcatgtgtctagttcttagctgtgtgaccttacccatcagatttcccctaatctctaatcagcacctgtaaactagaaataataccagtaataacctcatagggattttagaaataccaaatgggagaatccataaaaagtgtttagctcaatacctggcccagaataagcattcataatgtattctagtaattgtagaatagcagcaggaggagtaaaagaataaagcaagatgtcaggcagaaataaactactctcgaatcctttctttaaaataagagtgttcatgttgtggagatcgggtttttcactgtggttctcaaaccctgtgtgccagggtccctgtagggcttggagcccactctcacagtgtctcattcagtaggtctaggctggggccagaggatttgcatttcttacaggttcccaggtgatgctcatgctgcacatctcaccacactctgaaaaccactggcctcaagtatttatttaaattgtgcaccaaaaatatcactgattgatatgaaaataacagtaataattgcttgacatttataaagtctccatctttcaagaagccagagacctctaataaatgtaaccttaaaatacatgatttgtcttcaattgggatggggaaatgggggaggcataggtctctgcccagcacccatttaagggactgatctgaagtcaagcatcaagtccaatgaaactctagggttaggatcaggtatcctggagccacacctaacactttctcccccagaaagtggtctctcccccatttctataaagtcatccattcatagactggtcatacaggtcactgaagatctgctgatcgaccctaatgatgttccacacgttttccttacacacacacacccaggcattcagtttttaaatgccctgaaaacagtcataaaatacatttgaaagtgacaaattcccttttcttagctgcctctcagcagcagaaagatatctcaaactgatgtttcagtaaaatatgtgcgcattaaaaactgatttttttattgaaaatgacgacaacagcagagtttaaggatacaaatccttgccatgagccaccacagaaaggcatatactcaacctttatttatacgtacaaaaaacttctgccacagacttctatacataacctttatgatgtgtaatgtatatgaaatagtaattaaaccacccatctttgctgccttttatacttttctagtgttctccaaaaagcaatacaaattatacatttttgttcttgcatagtatatcattctatcattttgagatttaacattttaacactatcaccattaagtatgaccctgtgaaatttcatctaacaccaaagaagacaatagcataaactgtcctggttctgttgattttgtacatgtcttcaggttttatatgtgtgttattaagacattttgtactgtagatttactgactctcaattctggtattgactagagccaaactccctatagtacttgggagcatggttctattcagttctcaccccagttttcatggttttctgtttgttctgttctgccatctgatctagagtcgcctggcactgccagtgttccgcttagagttcagaactcttggcgacgatcccagtttttctcccagtcaggtaaactgcatactgggtagctgtatttcttttgtgcgaaaatccatgttggggcgatcaatgatgtgtggcacttgtcttcatttctgatttctggggaaaaaattatttcttatgcacagttagcaaagagctagttcttttatattactaccagttatgctaaaattgggggtaggaggagaggaatcacacaactttatgttgatttcaagaattcaaagaaataataatattcatcattttcttgagagtcccctgcctttaaaaaaaaaaaaaaagattaaaagcatttaccagaaactgatcatagttctcttgttaactgtgtcactgtgtttgcttcctgggtgacatctggcctctgtttgtatggtacttctccatgccagacagtgaggggactgctcagtcaagccacaatgcaaggtgcactaagaatcagtactaataggaacagtttttgcttcctgtagtctagtacctggtgttaattgatgtgatcaatcatttgatagtagtttaaacttcttttggtgatgggtgcaacctgctacaggggttgtctgctttattatgattttctaatgttcttgacttaccaaacacacacacacacacacacacacacacacacacacacacacaaaattggtttaaagctgatgtaggaactatactccactgataggtcaaaaacaaagacaattagaaaatactcacattcatatcttttttttctttcttttttttctgtgcagtggattctccaagcagtgagaagtcacctgttatgacacctgtaagtcactcattttaaggaataagattatgagttagtgtgattttaatttataacatttgattggctcaaagagtattcaggccgggtgcaggcggtggctcacgcctgtaatcccaacactttgggagggtgaggcgggtggatcacgaggtcaggtgttcaagatcaggctgactaacatggtgaaacactgtctcttactaaaaatacaaaaattaggcaggtgtggtggcaccgagatcgtgtcactgcactccagtctgggtgacagagcgagacttcgtctcaaaaaaaaaaaaaaaaaaaaaaagagtattcaaccaaaattgagacccaaacaattgatttgtaaaagaataattaaaagtcatatataacgccattgggtaaattataaagacatggattatcattatatggaattgttactgtgcctggaaataagtgataagaaagcaaaatctaagaggcaattaaaatgaatgtgacagacttggcatggtggctcacacctgtaatcccagcactttgggagaccgaggtaggtggatcacttgaggtcaggagttcgagaccaacctagccaacatggtgaaaccccgtctctactgaaaacacaaaaattagctgggtgtgctggcgggcacctgtaatcccagctactcagggggctgaggcaggagaattgcttcaacccaagaggaagaggttgcagtgagccaagatcacactactgcactgcagcctgggtgacagagcgagactccatctcaaagaaaagaaaaaagaatagaatagaatagaagaattagtattaaaactgacaatttctatagatacatttttttaaatgtacctcattttttaatatgaggataatacttgaacatagtatattgttggcagataggacctggcctgaactctccaagagacccaaactctcatttttgcaccccttctcataatgagtatttgaccaataataactgtaatgttgctttctattttgtattttaatgaaataagaaaacatttgttaattaaaataagacacaaggtgctgtggacattccttgctgctgcatggcatctgaactggtatttctaatctcaggccttgttcgccctctggaattcccattagatttggagactttctctgtggcacaaccaactgtggcattgcccatgagcaaccctggctcagccacataatcactactgtgcctttgattctggatttagctgtgtagccctgaaggtgttatataacttctctgaccctcatcttccttgaccgtacagtaagatgacagtacttttcttttgaagttgtcatgtgccttaattgaaataattattcagaagcccctagcacagtggctgatatgtaaataaatcctccccctctcccaatagctaatccaagaggcccaccatagtcaatatcaattcttatctgtaggtaaattgtctcacttagggagttctaagtgcctctgcagaacagagaagggatccatcacttgttgcataacccttgatgtccccagccacagtacaaaactagggactatctgtggaggctcagtcccaagccaatactgggaatcctgagtttcctgggaagctgagttcattgatgatggatgggaaccccagaacgatcccaaagctggcatccatggcacagatctgaagatttccattttaaattgcatttggaacaaagatgtcagttgttcatgccccctgggtaggggtggagaggaagggcattccaaagaaacacattcgcatttcttgtttaaggaaaatagaataagaaagagacaaatcactggcctacttaagtaaatgctctgaaaatttcatgtgcttttgatagtaaatgtctcatcatagaacagaaaataaaagaaacttgaaataagtagcgcttcaagaggagataagcattagattatgctggcctccgtagactctggctatttttggtcagtcttggagtaccagaggccctcgggactatgaaagaaagggactctgatggtaggagatgcattacccagcatgaagggattccattcatttattcaacaaacatttgttgagggcctaaaaatataaggtcttggggtagataggaggatgaggggctcttcctgcctcctgaagaatccctaggccagaggaagatatggacttgtaaacaggtaaattgtaggacaaagtgggttaaatgctgtccattctgacttcctctagcaccttttacatctcttatgatagttatcacactgtcttctggtcatatgcatatattggtcacttttccactccacacacactcaggtgtaagctccatgaggctgggccacttggctagctggtaaccccgccctggcccacagtcagtgggccataatctgcaaattatctgcaaaagaaggagcaagatcattgtttcattctctcttgtttatcatgctggtttcttcccctttatcctcctcttaaaatacccactgctttcctctgttgccttttaacacatattctgtattttctgtgctcaatccccccaccccacacttcctcctcctatctgcccactccttacttgacttattcctgagagcaccgcctagtgaaatttagaaattaaataattcctaattgtttctcttattttcctactattggagtttcctcagtgttttttgtatggctttattcacataaacatccccttttccctcaaaagacaaagaggggccatgcccctggaagagcttctgaatgtttaaaccacctcgaagttctggaacaatgacaggtggagccaacttccaacaccattaaattccgatagaatttcccatctggtataaccacatttggataacatttatggtcatccaagggagtttgggaaattttagattacagatgctcttcaacttaagaatggggtcacagcccaataaagacattgtaagttgaaaatactttaagtcaaaactgcatttgatatgcccaacctactgaatgaacattatagctcagcctagcctaccttaaacgtgctcaaaacattatgttagcctgcaattgggcaaaatcatctcacacaaagcctattttatgataaagtgttgaatatctcatgaaatttattgaataccatcctaaaagtgaaaaatagaatggctgtttgggtatttgaagtacagtttctaccaactccatattgcttttgtaccattataaacttgagaaaatgttaagttaacccacctaagctggggaccatctgtatgcacaattaaatgattttccccctgcataacttccaagagcctgtaatatgctaatgtgcagtgtgaaactcaggagtggcaagcaggaagcaataagctagtatccctagattattggcccacttgggtttgactattctgtgagcatcatggccatcccaatcaattgcaggaagcacagcagcaagagtacaaaatgaggcccaagtttcatttgtccaaatatattaaagttctaaatattgatgaagttataaatcaagcattgcccacagcctggcctgcattctctgcctgaagatacttccctgggccagcccacccgccatgcacctgaatggtaatgtggatctgttgggggccaggcagagtgggaggtgggctggcccaggtaccctgggcactaactggatgtatcaaaaccttggataggactgaccctgttcatcttcccaggctaccagggtacatagattttgcctgcacccctccccaccccaaccctgtttcccatcccccgtcaacttccccacccgtgccttgctttttcaacttaagattcccaggcagttgcttccctgtcctaccccatcagaacaaagggaagggaggagcacagttattgtgccctggtctgcctgggcacctactctgggtgactggggcagccgactttaaacacagcagcccctcttttcctggtttcctgggggcaggctgtgatttcccttccccccaccccccacctgtaccctcccagtctcatattctgtggcctgggcacctgcttcggttcatggatttttctctgttattcctcattatttacttggttcccaaacttgcaaaaaccttttattaatacaaaaaggaagtaagtctttgagcttgagtgtttgtgtcatgcgggccccagggcaagtgatctgcttgcctggatcttaggtggtactggtgagcattggtgagttaaacaacccactgtagggaaaagtggtatggaaaagcaacagtagtataaaagattagtttttatagcgtggcaaacaacacttcttacaaaatgcatttctgctaaaataactggtctcgtttgcttggacccaggatcaatatgcagaatgagcaccttaggttcagaagcatgaatgcatttaagagaaatcacttctaagagaaatgaagcaaagccttccaatgccagtggctaattactttgtgttttcattagctccaaaaagattcacagaatcataccagcgtcttggaagtaaaccaaagagggactaagattaaaaaatggtttctgccaccaaagaggatgtttagatatatgaagccttctgctcctgtgtgtcaatctgggtgccaggccagaggccaattgtctactcttcacccggcctgtcccttgaggacatggctcaattctgatcatggtttcatttttctaagcagtttaagttctgggcatgggacccagaagaggagcgcaggcgacaggaaaaatggcaacaggaacaggaacgtttgctccaggtaggatggagtttgctgctttttttgtttttccttttttgtcctcttgctttccattgcattaaatagacttttagcacaggaaatgaatggaatcaagttattctcggaagttagtgagtctcaagtcagttcattttgtgtccttgtaacagggtaccctgtgtctcattcttcctgccaaagactgcaataataaacatgatgaaaaaccattcatattaacactgaaccaaaaaaccctccaagtatggataagggccagtctacccattcatcacctccttagttgccagtcaatttccagtcaagtagcagtgggaatgaattatctaaaagctctctgctagcatacacgtgaaataaaatttagcctcagtctactttcttaaatagaaacttttgctctacctttgagggctgggcgtggtggctcacgactgtaatcccagcactttgggaggccgatgtgagtgcatcatctgaggtcaggagttggagaccagcctggccaacatgacgaaaccccgtctctaccaaaaatacaaaaattagctgggcatggtgatgcacacctgtaattcctgctactcgggaggttgagacagaagaatcgcttgaactcagaaggcagaggttgcagtgagctgagatcatgccactgtactccaacctagacaacagagtgagaatgtctaaaaaaaaaaaaagccgatgtgagtggatcacctgaggtcaggagttggagactagcctgagaccaacatggagaaaccccatctctactaaaaatacaaaattagccgggcgtggtgtcacatgcctgtaatcccagctagggaggctgagacaggagaattgtttgaacccgtgaggcggaggttgcagtgagccgagatcacgccattgcactccagcctggacgacaaaaacaaaactccatctcaaaaaaaagaaaaaagaaaagaaaaagaaatgtttgctctacctttgggtaaaagctactgattatcaattctagaaaaattctgatagtaagttcatcatactcccacttcatgccagttttatggattaacagggcttcaaaaggtaacctagcaacctaaagaactaacccatgttgggtacctgggatgtgccaggaactgaggttagtgcttgacatttttacttcatttatcctcaaacagcacttcagagtatgtcttattagcccttgtttgcaattgaagaaagtaaagttcactgaaattaagttaattgcccaaggttacacaactaataggtgtcaagaccagattcaaatccaagtctggatgactttaaaactcatgctccttctactacattcccactagtactgattttacaaaaataaataaataaataaataaaggaaaataatgttaaatctcattaattttgatgactttctgctgcttgtagaaagcaatgctttttttgacgtttgttcattttttaaattatacttcaagttctgggatacatgtgcagaacgggcaggtttgttacataggtatacacgtgtcatggtggtttgctgcacccaccaacccgtcacctacattaggtatttctcctaatgctatccctccgctagccccccaacccctgacaggccccagtgtgtggtattcccctccctgtgtccatgtgttctcattgttcatctcccacttatgagtgagaacatgcagtgcgtagaaagcaatgcttaatgcaagtttattttacttactttttcttttctttttttttttcctaatccttttggcttatttcccagggatgaggtggtagacagtgatttagatagcagtagtaggtggtagtgtggttttggctctgcctgttaagtttggcattttgtaacttgcagaaggttaagccttcaataccaaactgttagtaggaacccgattcatcaaaatctgggggctactgggatttgaggtccattgtgagacgtgcacccctgaccatctgctcgtctctgggagagttaggtgctcattccccagctaaatggtgaacagccaagagtcagatttccacaaagtgaagtcaggcaaatgtgctcctcactgtggtgctctattacatgccaaggggtgaccctggtaacagaggcgggcaccaggcctttgtattgctcctgtgtttctaacttgttgcctggtatggcatcgtgagttatgggccaaggtgtttgtaggggagggtgtgagagagagagagagatcgtgtgtgtgtgtgtgtgagtgaaatactgcatctttcactctctgcatctctgcatcatcagttcatcctgttggtgaggggaacacgtgatgtaagttcctagaaccaagaagcctaagaagctttacttgttttcagcttttatgtagttttaaggtctccttcctgtgcccctgaagtccctctctaaaactttacaatacttggttttcgtaacaatttttaccaggaaataaagagcatgccatgagttgatcaacaatgattttgttagagttaataagaacaccaggctccagagaatgccaagaaagtcctcctgctcctaagataccaatgaaacaggtgatgcctggaggaaatctcagtggcttccccatgaagacagaagcagacttgtttcagcctcgaagagaggattgacaatagtcagcctaaaatatctgagtgcgtgaaccacacataaatggttcctttgtctctgtcatgtcaggatgccattcccaaggcatcaggagtgtcacttctcattttatgcattaattttaatccccatttattcatttcttctaatcagccatcagggactccaatcacattttaaacaccacttttattcttagtgtgttcttttttccccccagaaatggtgacttctgctgcattatttctgaaaacaaaaatggcagttctgaagaagtactctaatggactgtttaaaaactactcttaattcagaagttacttaaagctaggaagactctattttggtagaatagtcacaagcaaagagtaattcagctattcagctaattatcatcttgtccacggtggacctttctgtattgtgtgtctaataaaccttcagggtttttcatcttttattacactctcctcgcagcaatgcatttctattagtggaatggcaaaactcatctccaaagggcccaataaaaccaaactattggtttagcacacctggaacaaaactggagtgaaggaagattttagaggctttccacctttccgtcttttctctttctgtaagcaaaacatgagcagcagaaaatactgctgtccattggattatgttcccaaaatgtttgagtgccacaaaaccatattccctttttattgcatgaatcaattaaattcagaatcctaacaagaagaagataatcttgcaacatattgtacatggtggtttaggggggaaaattcccgatgacgtatgcaatggtcagttgagaacaatctatggaaattccataacaggagagataccagaaggagcaggacaagctgaaagaagagtgggaaaaggcccaaaaggaggtggaagaggaagaacgcagatactatgaggaggtaggaaattcccaagaaggaatttgaccttgtcatcccaattcctcaaagtctagcaacactctctgtgtctgtggcatgcggatgcatgtggctgtgtctgactctttactgacagcagaatcccatcaagctctttaaaacagtcatgtcatttaggttctaaaagaccacaattcctcacaaatacagttcgtgataagggtgtgttgagtcacagtcaagggagacgatacaattacatctgttctctaatcagtgagtcagattcttgattgattttagagaggtgacatgaaataatcagttccattcatttgtgtgtttgttgtttggtaatagtgaattaattttatgaggataattttgatattgaggctgaatgactgcatttactatatagcactaaagagacttggaggagaagagaattttgtttaggttcattttgttttttaaatgaataagccagaacacattagataacttaaagggggctgcattttatgtatgttatctaaagtttgttcatgattaatattgtgaattttatattcagcaatactttttgtgcataatcagatccctaatagcatttctaattaggcttcttgtattactctaactaattaatttgcagagtctttgtttttcaaaattaaatgttaatttctaaattattacccatggagagtgttatatgatttgcatgcttttggaaaataagactttttaaaatgccctgcttgttcgaacatattctgatttttttctaaagtgccttaatgacatttttgtcttgacaaatatgatttttattttcccccctttcatcgattcctgtccttccccttaggagcgtaagataattgaagacactgtggttccatttactgtttcttcaagttccgctgaccagctgtctacctcttcctccatgactgaaggcagtgggacaatggtgagaccacagattaaaagcaatttgtgaaataaataaacctaaatggaagtaccaaaccccaagaccaaggttaccgaacagactcactagtttaaatccaagactagctattcccctagaatcacgtcagctactgtgtggccattgtaccccattgttctatcactgctgcagccaaattctagagtcatttcctggggagtggtaaagtcattaccccagcaagatctatcccagtagtctggaagccaaagtctctccacacctggctggcaagatctcaattagtgaagtcatattgtggaatatccttctcacagcccagttgccagatcattcattcattcaatatatatttattcccctctgccatactatacattcttttccattgtttggcagtagcaaagatgtcaataacatgttctccaccagcatccatgaaaattgcttctaacccccccacattccacaagacctgtagtcccagctgcctgggaggctgaggcaaaggatcccttaagccaaggaggtaaaggctgcagtgaacgtgatcttgccattgcaccactgtactccagcccgggtgagagaacaagaccctatctctaaaggaaataataataataaaaaaaactaatgcatgctgggcttaacactcaggtgatgggtgcagcaaaccaccatggcacatgtttatctgtgtaacaaacctgcacatcctgcatatgtaccccaaaacttcaagacaacaaataaaaaaacctaaataaataaataaaatgaacttacgtagaacagcactaaaaacaaacaaaaatccacaagaaatttacatgttgtctttgaaggccagagagagcctataaagtctggtctgcctccacattccccaaataaggtcatagaagatggaagtacagggcagaagttatatcaagacctgggtggtccataatccacgtaaaggaaaataacctgtggataccagaaaaccatttgtcctgaaatgagcggtcctatgactgttttattttgaaagaggggttttctaatcaattcccttttgtgataactttctaaagagattcagattatacatttattccaaatagttggaaatcagttgctattcagttaatttggacaactgttctttaaattataggtaacatgattgaaaaatacttcaaatatccctggccagagataagggttatacagtgtttttaaaatttatacttaagattttcattgtttttctccttagaataagatagacctgggaaactgtcaagatgaaaaacaagacagaagatggaagaaatcattccagggagatgacagtgacttattgctgaagactagggaaagtgatcgactggaggagaagggcaggtatgagcccatcccaagccaccatgaaaatgtacaaagctgggctctgctcgtgcacgctcaggaagggtactcattgctgatgcaaattacattcagcttcgaaatgaatgttccagtaatacattacatattgtttggacatattttgtaataggtctaaaatcagtgcccttatcttttgaatataaatagccttattttttttcttcttcttcttttttttttttttgcttgagacggagtctcactctatctcaggctggagtgccatggtacgatcttggctcactgcaactgctacctcccaggttcaagcgagtctcctccctcagcctcccaagtagctgggactacaggtgcgtgccaccacgcccagctaatttttgtatttttagtagagatggggtttcgtcatgttggtcaggctggtctcgaactcctgacctcaggtgatccacctgcctctacctcctgaagtactgggattacaggtgtgagccaccatgcctggcctaaatagccttatttttaaataggcaaactcttttttaaacaaaggggggcagtatcagtcttcaaaagctgattcaaagccccaaacctaaatattactcacttgaaatgatgaatgtgtctggagtgatagaaattgaaatgagaacctggggtcccaccactgtggtttcactgtggacctgaagttggccattattatcccctgagctgtaagaaatcatgtttgctctggtgataatataaagcataaccaactaattaactggttatgggtagtctccccacccatgctctactgtgttccatggaagatcagaaaaggacagctagagaccccctggagcgctcaaaactagctcatactggagcagactctggttgtggctgagggttgtaatgggtttattcatgccaccccaccccatcccttacctagaagggacccacagaaagcccaagaagctggcagtgctctgccaccaacatgttcttcatgagaaagatgttttcctctggggctctgagttaccagataggtattggcaagagtgcatgcatgtgcacacacacagcataccagagggatctgaggcatgaaaggctaagtgtcattttcaaagactggccaacttgaaaggttggctgggagcagagctttcctggtgggattttgctctgagaattctcctatgctcatcagctagaagactggttaaattgtaagctacaggtgctcagggctatgtccagaaactgtagagcccttggatgactttccagtttaaactctttaaagggacttttcagttttatgcaatgaaaaccactagtcaggaagatctgaatgatgctgataagctatttacaaaatgtacaaaaaatgtaactttacagaaaacctttgaccttcatttttgcaattttttgcatttttgcaatttctccagacaggcattttacatgaattttagctagttctccaggcggtccctgttttcaccagaaaaactttccttttatctcctccatctgttcattctttgcacacagaagccactgaaaggccagtgagttaccatggtcttcaaaggttccatgtggctaaattatttttacagtaagtgctctcttgtgaacatcaggttagctctggcattccttgaaattattagaatgaagacctttgtggacagagaaggcatcagaaatgatagtttgttgagcttgttaaatgggtggataatagaaatttgtagtactttatcattttaaatctattttaaaatagaataaataaagagtcccatctctttttttatattgtaattggtactcccatcctttaagttataggaccaagaagttcgattcagttacttttctctctgctctgaagtatacctctttattttaacagcctaactgaaggggccttggctcattctgggaaccctgtatcaaaaggagtccatgaagaccatcagctggataccgaggctggggccccacactgtggaacaaacccacagcttgctcagggtaagaatggagaagaccagtttcattcaatgtttaaattgttgtaagacccccacattgtccagaaagctatgatctctgctggctgcaggcttctctctaagggccctggacttctagcttatgcccaatatatagtgaataaacttctaccatcgtgtgctcagactctataggaacttgctggggactcagtgagacctgagagcgtgttcgcacttaaaaaaaaaatgtaactttacagaaaacctttgaccttcataagtagtgcattctgagacttcctcaaattcccaattccaccattggacataatctccccataaaatgcttatggaggagtggaatccccaaagccgggtgagatgtgggtgctggaatgttgggaaggtcccatcggttcccattgccatttcaccctcattcccacctgtgtctcccacgctcctggctcaccatagcaaaattcaaatgtattcctcgcaaaaatgatcaaattctacatgccgagggtcttcaggatcattcctagataactgaaacttcaaatgttgaatgatataaagaggaggagtgagctaagaggatgaaagaatgaccctggtaaatgttttattgccaaagcaaatctggctgaccaaataaatattttttaatggtggaattaacgaattttgccttaaattttttagcttgttgtctatacacatatttacctgggtttgattataatacataagcatagatttgtgcgtgttcccaaatggagatatcctgcaagctgaataccattcaggtgccctatggatttaaaccacatcacagttggtgtgatccatgagtcagagaaagcaatgggtgtttactgtgttttagaaatgatgttccaggttataattgcatccacccagatttgctttctttcatgcataagaagtcagtattttaaagtactgttttatgacatcagaaatcagcgaggggaaagggcatggttcctgacctcctttgtttccaaaactaaatcatgatgcagtgatttaagtggcctctctaaccaccatgtgcccatgacctgcatgaaatcgctataaaacctcaacaggcattagcactttaaagaaaggtgacttcctaggtagtaaggtgattttactgtgcactacatttatgttctttaattggcctcagatccatcccagaatcagcagacatcaaatccaacgcacagttcagaagatgtgaagccaaaaaccctcccgctggataaaagcattaaccatcagatcgagtctcccagtgaaaggcggaagtgagtaaccagacacgatggttgtgggattcccttttttaaaaattcatttagttagaagggagaagaatgaaaaatgtgagatggcaagaggacagcagcatttttgtgctttctctccattaaatctcattgacaaggtagtcaatataaatggaagtttgggtcagtctttctggcaagtaaatatgtactctgaatttatcaagttgtaataggcaaagttatgtttttagcccacaaatttaaacattggaaagcaggtgcaggcctgttgtgtttgtaattcatttgagttaaattgcctcagagcctgtggacaaagtttcgttcaaggaaaaaaatgttattctctcattattatgctctcctgtaaggtaattacctgagctgtaatttaattttgtaagaaagtatttttgacaataatagtttctatcgtgtttgaaccatttcaatataataggcactctgttgaagagtttacatatatttctctccttttcatccattaactcactgaacccttccaataacttaatgagattgttcctgccattttacagacaataaaattgaggctcagggaagttaaataacttatccaaattatttaactgattaagtagtagaggaattcaaaatgaaccctcagtttcacgtaagatcatatttgagccagagataccttataacccaatgtttaaaatgttaacattcatagtactgtaaccaatcattctacctagagccagactacctccattcagattttgactcagccacttgcctacattggaccttgagcaaattacttaacctttctctgcctcgtttataaaatgggaatgacaatagtccctacctcatagggttttgtgcctggctaatagtaagtgtaggtgatgatgatgataacttgttttgtaagagaaaaatatttattgtcttatttttcttgttacattttcctttttcccagtgcaatatttgaaccatttcctgtttctcttatgtctatccagtttcatttctatttgtctgtatgacactcagaatcaatagaagctaaaattggctagaagtaatcactattgttattgattattgcagtgatgtttaatcttttttaaagcattggtacttatactttagggtgttacatgaaaatgtgatatttggagaagacaagcattccctggcgagggaggtttgggtgggaagcgggatcagggagttatgctgaaagcggaagacacatggactcccacgctgttcgcttctgtgctggtatttttctttcccttgttcttttctgtgttctaccccttttctttacaaatgatattaacttttaaaagcaagagcccagagctgatggcttaatcacaggcagggctcacgtacaaccgttctagtagcttctagctgggggctattctgacttgttgatgcccacgacatatcagttgttacatgttttgaacatgacccttcatcccacgtatccataatgaatttgttgataagggaagtcactgaaaatagctcctttaagttctgccctttatctctgggctctccttgaagatctgccctggatccctcctcatctttccccttccacggagtccatcgtttttatatctaattagcatgccaaagcagtttggctagcaacttttaaaaaacaacctggcaattttagcgaatgaagaaattaactaaaaataaagattataaaaaattctgtcttttctgttcagcaatgccagcatgccagcctggttttgattttatgtagctaatacatgtacaattcttgctagacattattactatttttgttcattaaaaaaaaaaatactgccaggaaatgctgtggtctttgatttggttgtcacaaaagttttattttattttattttcctaatctaaaatgtctttttttaatggagtttggcttctctttgcttgtcataatttttgactcctttaccacattacaggaaaagtccccgagagcacttccaggctgggcctttctctccctgttctcccacccctcccggtcagtcaccaaacaggtacaagaggtcagcaggcctttctgaggctgctttgttatgactagagcttgccaagcatcatttcaactgaattagtgcttgccaaatgattttgagggatgtgtccatccacatctcttcctacacacacacagaggcaaaaggaaagagaacattgtccatctgcctgcagatttatcagctgcaatagaaaaagtcaggcctgtgacattggtgccgctatggccatagggctttaattacattgtgtggaacctccaatctaataataaaatccaccagacaaccgctgggctccaaagctggcgcctttcccttcaagagggctaagcccttctaggcgggatccactgatggctcttacagagaaccaggaggaggctgacaaacgaaacttcatccttctaacctactccagctctctaatgatgacttctggacattagctgggccccatgatatttttaaaagccgcctgaattcccgttccctggagagacaaattactgagtgctcagagattttctttgatgtagaaatttcatttaactactggataagagggaaatcctaataaatagcatttgattggggaactcttcctcttttctactgtcttcctttctgtttctcctgtccctctgtatcctgctggttttcaaatgatattgcatatttttaaattccttgtgtaattccaagagtttctcagacatttggcatcattgcaatgtgatcttagttatataaaagctgcctttcagaggacagctatctagtttcagatgggttgctgaaggtgtcctcaaggtatcctctcacctggttttgctctgctggtttggttccagtccattgctgggcactgtactgggtgctgcaggggtacagagaggaggtagatgcagtcctgccctcaagaggcttccagtttagagagaaggcaagtgccttcattcacagagtgtttgcactggaagaaattgtagagataatctggtccaatcctttcatattaaaaggtgaaagagaaacccagagttagtttattacaccagatcagagaacttggcgacagagcagacattagatctcacctctccgggccctctgtctagtctgctgtatcacaggtgattatttccaaacaaaaatgttgttttcttaataagtaaaaagaaatgctatagtggaccagtgaaccacttatgggaaatttaaaagcaatattgaaaccccaggaaagcgaaactcagttatcttttaggacttataaaaaaaagtatgataaatatattgaatcatgttgaggcatttgaatagactacaacacaaacttcttgaaacaaataacctaataacttaaacacacgcaccagattcagtaccacagtggagacccagtatatttagtctggcagttgtttgccatttatatctaatgtttaatctcctattcatcatcagttctgtcattctcatttcattcatgatataggcatcttaaaaatccatattttcatttttgcatgaggttacatgtctgtgtgtttgaccaggtattctaaactgaagtttttattcttatgtatatttttaaacctaggtctataagtggaaagaagctgtgctcttcctgtgggcttcctttgggtaaaggagctgcaatgatcatcgagaccctcaatctctattttcacatccagtgtttcagggtacgtacttactgctttgctctccagacacaacttcatgatgtcttttggcatcgttccgtgctgaaaaatgcctcttggaaattctggagggctttgtctgtgaggtctcactgtctaggttgtatagacattccttcagaatgaaactcacctatcacgaatccctctgggatgtcagattagaagaagcagaaaggtttgtgcaatttgtccttacaaaacagtttttgttgctaaagaacatatactccagcaggaggctgagaatgggatgctggggaggatgatgctcttccaaatcttttagggccatgtggatttatttggaatgtaatgtctatgctgtttcttaaactcttatgacttaatgtgaaagggttttagtctttgacctagtggaaaattgtctgtcaattaagtggctagttagaaaattgtaggtctcagaatgaatatgtctgtaatcttagattaaatatcactccctcaaaaaagctgccctgcccacccagactaagttatctttgttataggtccttatagaacctttcttggtccttattactgattattggattatttaaatattatctcctctaataaactccgtaagggcagggaccatgtctgtcttggttaccattctttcctctctacctagcagagtaggtgtcaataaatatttttacgtgaatgaattagtgaataaactgaaaatgaggagttctagattctagtcccagatctcttggtaataagtaggtgagttaaccagttatacctgatttattatgaaatttataagctggactatatcagcatatcctgtattttccactcatggacacatttcaaaataatatataatttttgaaggcgaaccctctgtctctaaggaggagtaatttcttggtctgcataatcctaacatactttcttttcccttcttggattttcttttatttcttgttggtagtttccttggctatgaagtaaatttgcctgggtttaaaataactcccactttgcctataagctaagagaaagtcagtgaagttgtccccaaattactaatttaataataacagtaatcacttgaaagcaagatttatcatagacaaaacacagcatagatacttattttagatttcatttatcaaaagtattagaatgagaccagagtttcctaagttttattttatttctatagagaaccattccacaaaggacaagcaaaaatattctcgttgtaaagattaacctagataatgtatgtcctaaatggtctagggatgttttgaggctcaaggaatatgctttttaagatttgtagttatgccaagataatatgcattctgagaacactgcattctgttctcagaaactttatgaggactagaaataagcaaggtggtaagggctctttgcagattctcaagggtcaggagacttgccttcttaactctcaaggcctttattcactctaatcattcacttcctggagctggcctgatgctttaaggtacatcccctcttggatttattccccactcttgcaatgtagaggcagcttatgacataatttggattaagcctcactctgtcccaggtcaccttagagcatgaattaggggctagatcctggtccccctgcaagaggctggcacccacaccaacttccactgcctttctacccttctggtacaaacatccaagtatatcctacagtctctttctgcactcagcctgtgttggtggaaattcccagtggatttgttgctctgaatatcactgcttttaatgtggaaatataaaatggaacagcaggctgggcacggtggctcatgcctgtaatcccagcactttgggaggccaaggtgggcagataacctgaggtcagaagttcgagaccagcctggccaacatggtgaaactccatctttactaaaaatacaaaaaaaaaaaaaaaaaaaaaatagccaggcgtggtggcacacgcctgtaatcccatctactcaggaggctgaggcaggagaattgcttgagcccaggaagtggaggttgcagtgagctgagatcatgccattgcactccagcctggcctacagagcgagacactgtcttaaaaaataaataaaataaacaaatggaacaggtacttcctagaaattttgatctggtagaacttagcaacgatgctggcaagcctttaaagattattgatggacacatttcaattgataactcattggccatgtgtttatttaaagccactagggtttaatgtgtttaaaatggttcttccattttgattgagaaacggtgtatgatagaggttaagacgctaggctttggagtcaacctgctaccacttatcagctccacaacctaggaacaagccaacaaacctcactgaaccagtgtccttctctgtaaaatgcaaggaattaagctaaaattgctaactgtatatttgcttttgctgtaagttgacactggtgcagcatcttacacataatagatgctccacaaatgtggtgattgtagaagggattattgtgctattcacataaacagtaactaagcattagaaagaaacaattccttatgcatcttatgatgtctgttctttttaccctatagtgtggaatttgtaaaggccagcttggagatgcagtgagtgggacggatgttaggattcgaaatggtctcctgaactgtaatgattgctacatgcgatccagaagtaagtactggggagaatgcctcatgatgaccgagtgtaatcgtatgtcttccataggacccaatttaggaattcaaatatttttccccagccgttgacactctaatctgagagaaaggtttcttaacatctaggttaaaaaagaaaagatatttaccactcgtttcttcctggaagttattgctacaatgtggaccaattctttttatcctgaagtgcatcagcacaccagcaggtcaaaacattgcctgagctcactacagagattttggtgtgatagaaaggagatataaggtctgtcaaacactgtcacttgttcaggcatgtctttagacgactggcaccatttggggatggttaaatgtggagagcggctctccactgtttctcagatcgagcaccaactcatcaatgtctccacgccctacattcaggagtttcattacgtcatatgtgttcccaactgaatggaaagttccttgagagacaacaatgagggttccacttctctgtggattcttccccacctcccacctctacaatatcttagtaacaatatgcgcttaacaaattatttgctgccttagtaagtgagaagcctgcttgctttcccgtcttgcatccgggcctcctactgtggaaggtgcatgttagtttgcggggcagcagggggtgctgttgcctagccgctgtttagaaaatctgaaaatggccagtggcttgcctcggaatgtttcctcattctccatcatgagtacagtccttctggtgggtcacctagacagcagaagaccttttagtgcagattcatcagtcagaaactcttttaaaaaattggagtgaagatagggagtgtgaaattcaagaatgactatttctcaaagtgaagtcacgtttttactgcctttttacatggatctcaaatctctgcaagactgaaaactttgagaataaaaattgaaggtaatttgttttatagctatagatttagtaaattcagttaaatatgcctattaataaaatgggaaataaaaatttaatcaaacccaggtagtttagatttataataaatatttgacttgagatcaaaacagttccaacttagagccgctgctatcaaactggactatttagatcatgcatgatattagtttttatactatgtattttatatattaaattatataaatagtataccatatatcataaatatatacacacaaattaacatatatagtacatgtataataggtaataattatatacattttatttaaactggacttttgcttttatatgctaacaaggaaaacaactcttttctcccagatttcaatgcgaattttcctatcgtcttctataaattattctttttctctacctcagtgaaccacagtgaatgtaatttatggaaccagaagagggcactgttaggttgaaggactgctcagaaagatttgaaaagtgctgtagatctgagtttgtttaataatttaaagtgcttgaaggatgccaacagaacaacctgaacccccctctgggtgacagtgacctcttttcatctagatttttttaaattgagaggttgggtgattctttgtcatttcttttggaaattagctttttaattcaagaccaggaatttttctcttaaatatacaaatataaagggcattaactgcttttaatttcaaaaccatggagttcctgtaatcagctgaaaaataagaaagtgatttggaggtaggccacaaaaatgattttttctttattttatatgtgaaatgcagtgttttaccaggatttaccatagaaaacaaggcccattgttttctctgcttctatagacattcaatgaataaataaaagttacagatgctataatgttagaaaaattgaattgttcagaaagacaccacattaaaagggcagatctccattgtaatcaccttccaataatttcttggggtaggggcagaatatatgtttgtacatgtgtatgcacacacttgcacacatgtacacacagagatacatataagtatgatgtatctacctggatttgtgttggtttttatttcacataggtgatgatcatatagtcatggtgttctgtacttggtttttgttgctgtcattttgaacttaatgatatatcttggtaacttttccagataacatgttgtgtctcctttttctttttaatgacttttaaatagcggcatacaatcccattgtgtggacttataatttaaaactaattctctatgaatggacactttggtggtttcccattttttaatattatttttaaatgaacatccttgtgcatatatcttggtgaatatttcagagcatctccataggatagattctgagcagtagcacaggtgacgtaaaaggcatgtgctttttaaattttcagacatcttgcttaattatcattcagaaaagtgcactctccctgcaaaatgtatgagagaccccctttatttcctccaagcctgtatcagctctggatatcatcaaacattaaaaatttccactctgcttggtgggggaaaaaatctcattgctttgatctgtatttccataattatgggtttgaacatcttttcatatgtttactcactatttatatttccttttctgtaaagtgcttccctagcctttgcccattcttctatttggcacctgatttgtatgagttctttgcaaattaaagaaatttgccatttgttatatttgccgcatattgtggttattagttttcccactctgtgatttattttcatacaaaagattttcattttatgtaattaaatatatatatttaatacatataaaagaaatatatgtttcttttttggattataggtttcttaggaaaactctcatttaaagtgtataaataaatttagctgagatttcttctagaattgtttttttttttctccttcacatgtaaatatgtcataagcaggattgtatttgggggtaaaaaatgaggtagctatctggcctgattttttttccagttagccacttgtatgaatatcactgaatgaataacccctctttttctcactaatttgaaatgccagctttctcataaactaagttcccatatatatttaggtctatttctggatattttattatgttttattaacctatttattctccattactgaatgtttttaattattgtagcttcataatatgttttaatattgggtaataagggtcaccttctttccaattatttttttccaaaattttcctaactcttctcccatgttcatttttccagataacattaatatctttaggctaatttcaattaagttaactcatgacagagagaatgaccagcacatctgagaatactgtttaattctttgctgatgtcctaagaaataaatataccttaggaatgaataggtagaggggattataatttggattgagaagtataaatatgcttgtattggtcaaatatatccaagatgcaataaaagagtcagaatgggaaaaaaaaaggctaaaaaccatttttctttcttttttaaaatttgatttaaattgagaagagtggagatggatagatgtgaagggtggtttacgtcataggcattctaagtgaaacaaaataatttcattttgtggaataataaaacctgaatatataatcctattttctccaagtaactagtcacatttaaatgaaatttttctcttgaagggaaaaatagcataccagcatattaaaatgcaactcctaaaagcaatgtaaacagtttttaagttcatatgtaaatggaaatggacgtgcaaaacaaattacctgtcatacatcaagccgtcacatgtttaacttgtgccatttgtgcttgggtgttggatgactgtgtctttgtacatggtgttctgttccatcattcactcttgtgaaacgcatttaatgcaaactccctggggtcttttcaaatgttgcaattgcctcatcacaactgtagtgcctaaaaaggagaaatcctgtgaaggtttcagcagaaaatatggaacccaaacaatcctttctagataggtttaccagataaaatataagatacctagtggaatttttttaaaccaagttaaagttgaatttcacataaacaatacattttttaagtctgtgtatgtcccaaatattgcatgctctggatttaacataagtatgtcccaaatatcatatggatatgcttatactgaaaaattctgtgtcgtttatctgaaattatactgtactgggtattgcgtatttatacttgctgaatctagcaatctaatttctagatcatatgtcaaattcctcatattacaatgtacttattcttagagaaatcaaaacctaaggaaactgagagaaaagagattattttcttgcttatttgccccagaggacaaggtagaaaacttgatggagatgctttggtttaggggcaatccagagcatttgatcaaacttcacagtgcatgtgaatcacctgggcaccacgttaagtgggtctggaatgcggcttaagagcccggatttcaaacagactccaggtgatgccagtactacttgtcctggggccacacttcaagtagcaggatgggagaagtttctggtccccaggaagaggagactttggtaaaggcagttgctcattagggaggttttaaaatgtctgaagcgagaaatgttgcctaccactcttgtttgttgttgtttgttttaatcacaggtgccgggcagcctacaacattgtgacacggctttcaagcttccggatcactcaccatttctttactgagagtgtcccctggcaactgcttaacaaaatcccaagctcaggggcttctcagcatttacctaatttctgaaaggctcttctgaaaggtggtatctgttctttcgtagcacagtgtttatgtttttcctgtttattgttttggttttttttttttttttgcatttgcacagtatacacaaaagaatatggggttgtaatgatcctgaatagctcaaaaaaggttttagcatggtcaaacaggcttatggtttaaaatgtgttattctcttctttgggaattagctaaatgatgcaataaacctgttttgttttagaatgtctaggaattaaacactttatgtttacagaattgagctgcagaaagtgcaagacatgccaatttgagacacacggtcttctaagactgaaggataaatttaatgcatttcagaaactaaacatcacagcaagctctatctctgagctataatttgtttttaatgcaaagacactagtttgataatatatactgtaatcctgaaacatttgtgttacttacctttggaggtagaaattataccaataaattattgcaccgttagtattagattctgtgtaccttggaagttatgtcattaatataggctggttcatcaaataaagcaaaaccttgcaatatcagctagatttacactccgggacgttgcccaaaggtaggaagaaagcagagggaaatatttcagtcatcatttccaaagtcattatcaaaatctgtgaggaagtttaatcttccaaagagtcaatgtcagacatcaggcctctgttgcctgcttctctcgaggcactagattaggagtcttcaataagagacttaacatgaggtatatggaagatgaggcaccgagataagttcatcattaggtgtgagcactgctcacccttgctggcaagttctccttaagggcctgaagcacaggtgtccaaagaaaagcgttaagtccatcttaatagaatctatgtggtatatgatgtggtcagcccctggtctgtgatcagcaagaacctacagcacagattatgccctgcccacttcaatgaatacctactctcctccattctccatcactttttttgctatcaagaactccggaccttgcccatggagaagtttagagaggaactcttgtggagagctggtttattttctgccctgtgcgacgagtttcagctggccaagaaaggagtcaagttattaaaaagcatcacaatgtagatctccaggctggttttttgttttttgttgttaagactggggaaagggggactatttattctgccttaaatcaatggcaaataagtcaagatgacattttgtgaatgtagactatggatacactcctaatagattgatgtagtcataaaagggggtcaagtagatgtttttctgttatgtaagcaataatttttccgtgtcttattgagtatggctagcgattatttattacatgctagatgggttctttgcatgtgggttccatataggtgcagaaatttcctcagccactggagggatttcgaccatatttgtcatttggatgagctgttattagattgaaatctacacatcatttcattaaaaattgtgccttagaaaacgcaaagctgttgcacatggcgataaattatggatgcagtacattgaagagagatgaagtcacttccaagtttccaagacttctcatggaggtgtttgctgttttacaggaaaaaataaaaataaaaaaag

SEQ ID NO: 37683 - DNA, 768043 bp, Homo sapiens; identical to SEQ ID NO: 35581
  misc_feature (106202)..(206201): n is a, c, g, or t
  misc_feature (390258)..(490257): n is a, c, g, or t

SEQ ID NO: 37684 - DNA, 15634 bp, Homo sapiens
gcgcatgcgcgagtgtacgcgttgccggcgaagaggggagcctgacgactcggaaatttgaataccacagtagcatggagtgtgacctcatggagactgacatcttggagtcgttggaagatctagggtaagattgtcagggcacgggtctcccaagccccacgctgccggccccctgggaacacctcctgcgccccagtctgagacacctgcctctccacgccgcaccccgtggctcctggctgtcgcttccctttggccccggcacccccaatgccacgtccactgtctgcactgctagctcggggtcctccaatcccaacacccctaggcctgcccagtgctccctgcaggcgagctacccgcagcgtttgtcagtcatgcgtgtcattgtctgggctctgattttcgccacccccactccccgagcttctctcctcgcttcatcctcctgccctaccccttaacccctcaactctaaaggttgccaaagttgattctgctttcctacttgttctccaaatttcctactcccatcttgagcccctcctcctaccccaccccacttctctcaaaatttctcctttgcccagtcatctctgcatgcacccaggcttcgctaagccacttgtatgggcgctgcatctgttccgctggccagctcgcttgtgcatctaacctatcaccacgtccctgggaaccaccagcagtttgctttgactctgtgatactctgcctcgttgagccccattagaccagggtcgtcttcacccacgaagaacctgcgtatttgttttgcattgtgtctctccttctcctgatatttattcaaccataattcatcagtatctagaagctggaaatagggtttgttatctcactgggtcacccagatcagtgtactctattaaacttgagaacgtggaccctcttgggctaaatgtggttccagaaacaaattgtatggttagatacttacctacaggtacggtatcaaaacaaagtacagatttagctagctgtatttctaagtaacaagttctttatcaaaattttctcttaggtttttccatgacaaggaaacctttgagagaaacctttctttaggaaaaaacaccttgaggattcccaaagtctgcctatttgaataatttactaccctagtagaaatttttaggaacgaagtagtcttgcttatcatctgtctttgtcacagtgaaatactattgttcttttcttggaaacttgctctgaatttttataaatattccagactttagggggcttctttctttcattagggcatatgttaaagtcattcagcaaaatagtctctttagttgacatctcagactgaatcgcttgttcacacatgaaaccattcattcattaggacttttttaggaacagtttctttgtggcagtgttaggcccttagagtacaaggtgaggtggaagaggggttcacaggatactgggaaaatatgctgtgaggagccctgaggagggtccctttactgggaaaggaaatgaaatcctagaagcttctttctggaataaatgacactatagtactgtagtggaatgagtggaatgaaaggaagggggtagaccttattaaatgtagtctttctgcatggatagtggtcacttaagaattggccacggatgctgtttcttcccattattgtctttttttttccccctcctttttttaactttttattcttttgggtactgtacaagtaattgttactgtagtaattgtaatcacataactacttgacatagagtgtaatgtaaaccatggattttctgaaaactgttataaattttaaccttaactacttagtttggtggcattcaaatattaaaagtcagccttaattaactgaaatgtacttttaaaggattaactgagaaatattagaattaaatgactaccttttctatttatttatttattaagagatgaggtcttgctctggtgaccaggctggtctcgaactcctagcctcaagcgatcctcccacttcaggctccggagtagctgggactacaggtgtatgccactgatcctggcaaatagtcatcttttatctcttacctggcacacagtaggaattcagtaactacttgttgaataaactaatgaagtctaaatgtgaaactcaaggagaaacttctaggcctagtcttttgatttcagtgtctaataatacatagtttataaatctagatgccagactacatgtgatctcatttttttatgtatgatttgttttcattttgttgcatatactgtataaacctataatcatattttaaagggtttgagaactgtcatttctctaacatacctgtagttctcaacattatattatctttttttttttttttttttgatacggagtcttgctctgtcgcccaggctggagtgcagtagtgcgatctcggctaactgcaagctctgcctcctggattcaagccattctcctgcctcagcctcctgagtagctgagactacaggcgccctccaccatgcctggttaatttttttgtatttttattagagatggggtttcatcgtgttagccaggatcgtcttggtctcctgacctcgtgatccacctgcctcggcctcccaaagtgctgggattacaggcgtgagccaccacgcctggcctaaacattatattatcttaagcatatttattgtatcatcttaagtaagcattattatcaatatttaagagaatgtaaagcaatctgaataatatgtatttaagattacttggagtgacagaaatcttatattttagaatattggtgattggagttcattatgactgtcatcttttatgaatgtttgaacatttttaaattttttaaaattatattggaatcacttacaaaggattaggattcagatgcgccagttcattaactgccaatatttattaacctaacctgacgtttctttggtactagaatgtcttactagtcttaactggcattaaatttataaaaatgatataaatggttaactggaaagtttttacttttaaaggaagtcattaaaaacctaactaagcctgggcaacatagtaagacccctggctattttataaaaaataaaaaaaaagccaggtttggtggcttgtgccttcactgcacttcagcctatgtgacagtgcaagacctcatctcaaaataaaaacataatctagttgttttctggaaaatttttagaaaagataacctaagttttatttctgaaataagttacagtataattagctattacttgttaatttgcttttaatactcaattcaattacagtaagaaaataaatctttttacaatggaagcttttagtaaatgtacagaagttgacataatttagtagtatatgcaattctgttagatattcacctacattttgaaaggttgaaatgcagctaccatttagctgctttttgtaatggttcagtatagttctaaattatgtttatatttgtccatttaaaataaagataagtactaacttatctttattaaattattgcttatataaataagacatagatatgttttatctgtaatatattaggtatgattgtattttcttctgaaatgtaatttcttgctcaccagttacaagggcccattgttggaagatggagcgctctctcaggcagtctctgctggagccagttcccccgagtttaccaaactctgtgcttggctggtgtctgaattaagagtgctctgtaaactagaggaaaacgtgcaagcaactaacagtaagtaaacattcacttttaggtacaaagtataaaaataacattgaggtattgtcaactgaacattatcaatactaaagctgaaagttgcaagtttttgtaaatgtaaaaaatttgtaaagaagccaagattttttttccgtccgttgtttttagaggtgattcagaagttgaaataccagaataaagtcatgtaacttaaaaattcgtggatgctgaaaagaccctattactgggatacagagaaatggagaccacaagcatagaatgtatgaacttcctatattttgtaagatgttaaatgtaagatcctagattgatggctagaactagatactgggatatttttcttttaggattaccagattctagaagcatctatagcatgtagagtaaatgcattattattctgttatgcttggggagaaagagaacactttgttaagacattttgtttatcataagaatgcatcgttagatacatcacagtgagatccaggacaatcaaatttatggatctgagagctgttctgcatttaccaattttgtttccactgttgcactagtttgtcgacactgcaaaagaggcaaaagcttggaacctaccactctaccatctggttccttcctgctgtaggtaaacctataataggagaccaaggaaaatactcacctgttaacccacccttatggagagctatacatataattcctttttttccacataatcacgttttgaagagctcaccttcttgcatgctagtgtgtgtgtgtgtgtgtgtatatatatatgtgtatatatatgtgtgtatatatatatgtgtatatatatgtgtgtatatatatatgtgtatatatatgtgtgtatatatatatgtgtgtatgtatgtgtgtgtgtgtgtgtgtgtgtgtatatatatatatataatttttttttttttttttttttttttaactttatgttccgggatacatgtgtagaacatgcaggtttgttacatagggatacgtgtgccatggtggtttgctacacctattgacctgtcctctgagttccctctcctcaccctctaacccgcaacaggccctggtgtgtgttgttcccctccctgtgtccatgtgttctcattttttaactcccacttagtggtgagaacatgtggtgttttttttctgttcctgtgttagtttgtggaggatgatggcttgcatgctggtatatttaatgtgtacgtgttagttgcattcagttctaattattaaggagagtatagtgtaacagtaatgatagcaacagcttacatttattgtgtactcactatgttctaaacactttatatgtgttaactcattaaacctcagggcaaccctatgaggcaggttttattactgttatacctttaacaagaaagcccagagaatttaaatacattgcctgaggtcatacaacctgtaggggtgaagcctggtttcaaccccagaacagtagtcaagttctgagccagtgtgcttgaacactgtgctatactgcctcttgaccagatgtttgagagactgtaggaacctttgaaaacaccagtactagatgatacctctatttaacctggagcccctttttctcaaatgaaacatgatacagaagctaacatgtaaaacaggttagaaggtattctaacaaagtagagacgaggtacctttagcccagctctttcctcctcatcctcccagctgcctctaaaagagctctgtggaactcaagggctcacagatcacagtttgcaaaatattcataatgtaggcttcctgtattacagattagaaaatggactcaggtgatcaagtgactctctcagagtttgttaatttcttcccctttgtgatagtgaatagagaacaatcaaaataatgaagaaagagctttgtttttcctttggttcacccagtgaactctatacctttttttatatgctgtgggaatacaagactgtaagtcatgtttgctgtcttcaaattttttctaattgagaatgttaggcacaaattaaacaactggagataagtacagtccttttgtttgtttgtttttagacaagatctcactctgtcacccaggctgaagtgcagtggcgcgatctgggctcactgcaacctctgcctcccaggttcaagcaattctccaggtcagcctccttagtagctgggactacaggcatgtgccacgacaactggctgatttttgttatttttcttagagacggggttttgccacgttactcaggctggtctcgaactcctgaactcaaaccatccactcgtctcggccttccaaagtgctggaattacaggcatgagccaccgtgcccggccaagtacagtacttaaatgctgaaccactttgtggttcacagagagaggaaatcagcaagtacgagggtgaagtttcagccaagtacaaggaaggtttcatcaaggagcaaggccactgggctttgatggatgggtgggatttgctagaggggaagagagtagaggacatatctgtcacagggaataacttaaatgaaggcacagagtggaaataagactggctattcatgggacagtgaggagactggcctggcacacacaggaaatatttgtggagggaatgtaggtgattatagctgaatatgctaggaagaacaaacctaagcagctatgaagaatctttaaaagcagacagaaaaaaatcagattggatgagggagaaattagggaaccattaaagactcccaaataagagaatgacctaatgaacactgagaaagaaaattttagattgggagcagtggctcatgcctgtagtaatcccagcacttgaagacgccaaggtgggaagataacttgaggccaggagtttgacactaacctagacaacatactgagacctagtctctacaaaagaattttctaaatattagccaggcatggtagcatacacctgtaggcccagctattccggagacttaaacaggaggatccttcaagcccaggggtttgaggttacagtaagccctgatcacaccactgcactccagcctaggcctcagagaccttatctcaaaaaagaaaaaaaaagaagaaactttgcagtggtgtaagaaaggataaattagaaggggaaaaaactcaagttatgaaaatcctattaacaatttcaattatatataataattgttatgctaatggaaaaataatcactatcattaaataagattattttaattcttaaaaggtccgagtgaagctgaagaattccagcttgaggtgagtgggctactaggggagatgaactgcccgtatctttcactgacatctggggatgtgaccaagcgccttctcattcagaagaactgcctcctcttgctcagtaagttcatggctactagaatatagctattactttctgtttatgttttccatgactaataaactgaccatggttttttgtttgtttatttcattatgaatgtaattcaaaattcattttaaaataaaactttcttaaatttccaatttaggagctgagggtagacgtgtgcactggtagcattattgtttttgtaactgatactctttcaatatttcagcctcagtggtactcaggccgttgtgcttctcctaatgtgatcactggtagttttggagtgttgctcaagtgtgtgatcattaaacttacattttagactagaagcacatttttaagtatattaggaagatagtatggaaataatggagattttgtttagaaattcatttctttgaggagagtaagcatttataatagtagatacagttaatggttaatgtaatttaaagtattttgtcttgttgctatttctttgtggttgggtaattggggattttggttttgtttgtaaatattctggaataatacttgcattgttctggtacttattctgagaaatgagtttttatgaaaagttctttccttccatgttttttacatacttactactgttttgtctcttcacactgaaaaacagtaagtagattcaaaaattttattgccttctataaactttccaataaatacaacctatagtcttaactcagaatttatgtagcattctgaagcacatttacattaagctttggttaactggctattatagttctcattatgacagacaattcagaggatttttaaaatctttgtttttacaactctattatggtttctgaaaaaattatacaacttcagtttttaaggttctgttaaaaaaaaaaaaagtgttcatagccattatacttaggcactaagttattccagaatcacttttgtaacttcccctttgtctgtcaaatgattgttattgtgggaatgtgcacgtaaggttaggtgttgctttagatactgatattgctgctggtagttcttacatattcatttaatattcttcatattgtacaatttctgtaactgattcaatagcagtatactcagctgattcttcctttatagcattgcttatcctttaccaatatttggcacttagaatatgttatctacataggaagataatagctgtgtggaatgcttactaatgaccctgaatagctaattcttccaaagagctcagagtttggcctttttagcactgatacttatacaaaccacttgaatgtaagtataaaatgcctttcacacttttctgtttcttaagcagacttcagtgaacattattttggactcagggtcataattctagactttattttaatctgctatcatcacctcaaatgcttttcaagaatataccactatttgctcttcaattaaatgactaaatcatctagaggtcactcactttttatattcttcatacatacatatatacacactgtttccctctttatctttgcttctgccgattctccctttctaaaatattctccccagtttgtaacctctctttcattctagcatttacctacatgtactcatttttgacttggtctatgtaaatatttctcatcttttgaagtatcagttgtcacatctggatgctataattttacttttccagcacccttacctcactaacttgaatcttttatcacattgtattttaggggggaaaacaaaccagcctcattagaattgttggaaaaatagaatagcctttgagtgagaggctgaaaagctctcatgtatcagattaaggactctgtttggctcttcattggccttttatggttctcagagtgttgcccttacgtaaattaagtaagatgtctgagttcctaatagatgaagaactattcatcttttatttttgcatatactctttattcctaactagattatcggaagaggtcatctttttgatgttttaaaaaatgttatcttcagtgcctttcccagtgctttgaacatactgattacgattaaagttttttcatgataattatattggtaacctaattttgtgaatacctgaactatgttatcccaaatttacagaaccaatatattaaatcatatagtatatgattttctagaacaagagttggcaaactttttctaaaagggccagatagtaaatatttttggctttgtggccctaagttctctgtcacaactacatacctttgctgttacagcatgaaagcagccatagacaatatataaatgagtgagtgtggcagtgtcctaatgaaaccttatgtacaaaaacagtggttgttgtcttaacagtggggttttactgttttgacgttttaactcataaatacagtttgctgtatggaacatgttaagattttacagtgtcaaatccatttagaatgacctttccagaaacttagctgtatttattgttttagaacaggagttggcagcctttcagaaatgatttgccaaaattatggcctctgtccttctagcattacattttgggtataggaaatttgatacacaagttgacttttttctacttctaataggacctgagggccttgaaaatatcttttcccaaaactggttttgttatattgtcagaagaatctcactttgtcacataaccagaaatcctaagattcaaatgattcttaatcatcttttataaaaattgaaatgtccttgggaatgttaaaggaatgagattgaatatttataccttcaactgaattacctgaaacagattgcagcccccattataccaggctgaaatcagcacacaaggggatgatactgacacaaagggaaccatgccaaaaagtgctttgaaggttttatggttgttttgaagggaatggggtgaggaaagtagggggaagggagtcctgagaagaatatagatgaaagagggctctctttgattagccagagggcaacataagatttggagaccatgggaaaggagctctggggtgccttcctgcttctcctgtgagttaagctttgacttcttataaatgttgtttcacacctcttctggacaggctcctaattaatgggagacaagagagcaaggtagttgtgtcattgatgctcacaagtagtgagaagttaaaaaaaaaaaattaattgtcattaaaaattggtcacctgccttcttttgcaaaatttttaacagatgccaacccctgttctggaggttccttaataccagaattcaagattccaaatttttagatgttacttacctcgatccttcggtttcaaagagaatcgcttattttaaaattaacatttaaacattatatatcgcttaaataactgaattacataaccagtttatttcttatttcatttgcaggtaaaagtagtttttctttcttgtttttatccattcttgcagctttaacagttacatatcaataggtctatatagttgtgactccagacttatgactataactatagctgtatctcattttgaaatcttattttgtttacttcagcatacctcatctcagaactagaagctgccagaatgctctgtgtgaatgctcctccaaaaaaagctcaagaaggaggcggtagtgaggtctttcaagagttgaaaggcatatgtattgctctaggaatgtccaaacctccagccaatataactatgttccaattcttcagcgggattgaaaaaaaagtaagacctttagtaccaaattgtagtgtattaaaggcatagtcctacatttgtttgaaatgaagcaattaatttaatttctcttaatgggaacctaatgtgcatatattattaagtaattgttacgaaatgagttttgggttttaaatcctagatgccttaaagataaattagtattttagtattttcctaaaaacatgttagcatgtttctttttcaaaaaggaaactttacactggtttgtaagctaaagtaagctagatataatgtaaaaaggattaagatttcagtccttttaaaaattattttatcattgaactttgatacagtcaatttaagttctttatcactaaatgttaccaccctcctccccattgactggacagaaaggatattaatatttttgttttttaatccagtcacttcaaacctcatgcttcaattgacaaaatagatttgttgactgctaacataatctagtatgtgaaaagaaattagaattatttttataccacacattatcagttaagattttctatataattaattaggaacaagcaattttaacaaaaatgagtagaagagaacggtatttgttaaagcacagttattccctatacgcttatctgctggactcttaagaattggtacatttgcattgtggggtagaccagcaccatgatgcacaaatttggctgaactctacaggggagcagcagtgtatccatagtccatattttcctgtgtgttcattcatccattcagcaaatgttcattgagtgcctactgttgtcaggcactgttctaggtgcaatgaaggacttctgtaggcgtgaggagtgggaccagtgagtgtctttatcttgtgggtcttttacatttgcatttcaaaacatcctccacctttgcctctgtcaggaatcttcttttgatggcaagatatgatgggaattgggaagatgaggatgttttacttttagagtttttattcatttatttatgtttttgtgtcagttaaaggaaacattagcaaaagttccacctaatcatgtgggaaagcctttactgaagaagccaatgggaccagcccactgggtgagtagtaatcatcttgagtaaactttgtaaagaactatagagtttatgattttcatgtcaacacttacattttgtgctttttaaattatgttttcttatacatagttttctagttgaacacccttagaatcattttgtgaatctcaggatttctgcagaatatttttatttgtgtaagattagaagcacttttctcatactttgtaaatatttcacacagctgataaaagtaaactgaaattaagtatggtgcatgtttctcgttgccaaatggattgccttcaagccaaaaacttcactgggctgagcttcacacagtaaattatgggaaagataaataagaattgtgtacttcacatactcttcattatgttttgtgaatcagctttttgtcacctatcatttcattaattgttagtatattatatggaataagaacttttgactgttaaatggccgggatctcagttatgaatgacacagacgtagtttttgcccttttgggacagagaatcaagcagatttaaactctaactagtctttttaattttgcttcaggaaaagatagaagcaattaaccaagccatagccaatgaatatgaagtccggagaaagctgctaataaaacgtttggatgtcactgtacaatcctttggctggtctgacagagctaaggtacacattaaataatttaaaagagcagactatttatagacatgatccctgaacatctaaacaatttagctacttggcaactatgggagaagtacatagaagacacacatagggatttttccttagtgagttattgagtagtggctctttcaactattcagcaatgatgaaaacatttatttttcaattttctattttttaacaaatctgaattttacagttcttattggagagagaagttcttattatgagagaaatggagttattctgaaaattactaaaataataaattgatttcaaattacttgtttactttaaataatttaatttgctaatagaagttagaaatattggatttggtatgatttatagacaattggagaatttggtaagacttaagttttttttcagctaaatgagacaatccaggtaaagaccttggtcattcagcagatagttattacctcatagaaaccaaagataggaaaattaaaaagcaaaattgttgaaatagctttatattcttatatttaaatagagaaaatgagtatgtttgatctgagaccaatgatgggggaacctttttatcacgttggcctcataaccctaaaggggcaccctctcactccacccctgcccccacagtccctgtcactccttgttgtgtcaacaagtctggcagctgtacttttaaggtagttcttgactatgtaggagcagtagtgagtatataacttttcctaccatctagagcctagtaaatatcattatcagatattttggagacctttaacttatttaatatgtgtttcttatgtcattttgaaaattgacatttctctttgaacacttttctttcaacagagccagacagaaaaattagccaaggtttaccagccgaaacgttcagtcttatcccctaaaactactatttctgttgcccatcttttggctgcaaggcaggacttgtcaaagattttaaggacaagcagcggctctataagagaaaagactgcctgtgccatcaataaggtgattagagtacctttaattttttccaaatgcatttatttctgttcataaaataaaagtttaaaatatctttcctattctgtaggtgttgatgggcagggtgcctgacagaggtggtagacccaatgaaatcgaacctccacccccagagatgccaccgtggcagaagaggcaagatggcccccagcagcaaacaggaggccgaggaggagggagaggtggctatgaacattcctcatacggaggacgaggaggtcatgaacaaggaggcgggagaggtggacgtggtggctatgaccatggtggccgagggggaggaagaggaaataagcatcaaggaggctggacagatggagggagtggtggaggaggtggctaccaagatggtggttatcgagattcaggtttccagccaggtggctatcatggtggccacagcagtggtggctatcaaggcggaggttatggtggcttccaaacatcttcttcatatacaggaagtggataccagggtggtggctaccagcaggacaatagataccaagatggcgggcaccatggtgatcgtggtggtggtcgtggtgggcgaggtggtcgtggaggccgaggtggtcgtgcaggccagggaggaggctggggaggaagagggagccagaattatcaccaagggggtcaatttgaacagcatttccagcatggaggttatcagtataatcattctggatttggacagggaagacattacactagttgaggctaccgaaccttacattttgctagagctcaagtaatagaaacttagtttcagaatcctgaattcagcacctattttgaattaatgtgagaccacaggtggcaggcagattcctgcttggcataagcatttgtaggtcttcattcaattctgttagatttttttattggacttacataatgccgtttatttgagaaacacataacatctctcctttctatgaaaaattttttaaaaggtggttaaaattgcctttaattgcccagtagactaattccacagtcagaacatgcaaacttttttgaagaaattacttgaataagtagttttcatgttttcaatatgcagttttgaaaatgaggattcacctagacttttttagatttactactaggaaaccttcctcatatgaataaccatttatatgtgttttgcttaaagtattccaatgcctattttccaagcacagttctgccccccggttgacttttatgccacgtgtgcttcatgatggaacttttaggtcagttcctattaaatgagctcttttgcagatagcacattcagtagccttattttgttgatggaatactgtatcatatgctcaactctgaaaaccttgaacacggccaaaatccataaagattataaaagcaaactaagttgtgaagctatagtacatgtaggcatttagttaagtatagcaattcaaactgacctgcatccatccaaaacaaattcctccttcaaccttatttttacttgaaatttgctagaagaaatagcaaaccgaaatttgttttatgcatgagttaataccactggctcagcaaatacaagttagtttgctttaagcaggtaactttttttgtaatggaagaaatgcactacaaagttaagacagatttttgctaagtgcaggaggccctttattattgctgcagaaaacaaaagcctggctgagttgatgttttacattctcccttactgaaatctacatgacatgatgcttcttgctgggtttttgtacatgtaaacattgtcaagctgtgaaagaaaatggctggaggtgtgctttgtgtgaaaggtgagcaataaagtatctgttaagttc

SEQ ID NO: 37685 - DNA, 45989 bp, Homo sapiens; identical to SEQ ID NO: 36456

SEQ ID NO: 37686 - DNA, 45989 bp, Homo sapiens; identical to SEQ ID NO: 36456

SEQ ID NO: 37687 - DNA, 194275 bp, Homo sapiens
ggagttctcagacctccagtttcagccctgccctcagcctccaatccgtaagagacacccagccccagcaattggattgggcagcccgtcttgacacaccactgtgctgagtgcttgaggacgtgtttcaacagatggttggggttagtgtgtgtcatcacattcgagtggggattaagagaaggaaggctgccttgctggagctgtgtggtcttctccaagtgagagtcgcaggcaatagaactactttgcttttggaggaaaaggaggaattcattttcagcagacacaagaaaagcagtttttttttcaggtaaagtaaaagacattgaatgcttctctccccctctctcttttagcatagttttgaatggaatgctagcacggcacacttgtcaaagccagttgttgctgtcctatcaatgctgctattgtacggctgacagatgacggtgagcatagcttgatgcttggctgtctttgtagaactaacactcctcatgccttgcttttgaaggtgtagctaagaaaatacctttgggagccgcgtttgtaccttttcatatccccgttgtatactcaaaacaggagctataacttgcttgtagaggatagataaggctgagaaaggatttattttagctttcaaaattaaaattcactttcaaactgttgcattttactgctcaatttataaagattctttgaagggtctattactgagttgctggcagaggtggaagtgctttcttcaccgatttgtgcaaggtagattatgtctgatttatgacagagcaaagggtgttttaaaatatttttggagattgactctgaagtttggaaactcctgaagagaaggggctaccctctgaacagccactaggtcggctttaaaacaaaaatgcttagagctggaagaaaagcagagaaggaagaaggaggaaaatgctctttaacatagccctcttgcagctgcagggaaagcagatggaggtaattgatttgcagatctgtttgtgaaagttttacaagtcatggaaaactaaagtagcatctctgtaatggatcattaagagtcactacatttataggttttagaccggctaagtgaagtgttaattaaacgtaaatagattttcaggtttggttataaacagacaaacagaaaggatttaattataaactagtcattggaaattaatagtcatctggtgcctgagcaacacaaaatgagttgtcatcatatatgcgagtagccgtaacggctctaccaaaagcacccaccaatattgaattgaactatttataaatataagaagggggtttatatgctatgtttaatttatagtattaaaaaaaaggcctttcaattcaggctctattttcacagggatcaaaacataaaattttttattttccaaattttctagcaagataggtgagccaatgagacttctgctaccctaatatacttgccctccgatagcaacattcatatacctgtggtatgcagagcttctggctcctactggactttcacatttggcagagaaatccagcattatcctcaccctttgcaggtgagagattctatgaataatattgtatataagctgttctgaaataagagctgtttggtaggttgaataacaggatttatggctagtgctttgtgattttagtattcgattgcataaagatgcctgtaaaattatgtttcaagttgcattatacatatttttgcaaccatgcagataatttttttaaaatcctttttttaaaaaagttaagattaaaacaatattttaatatggtctttaatttttattcaaaatgttctccagttatactctcaaacttctccttcaatgagaaattatcctcataaatacccaggcagttattccgactgagtattatctgattcccaatattacataaccaaaatagatccaagttcataagctgaagtctttcggagttccagtcattccattttggctttacaatggaaatgaggttttaaaaaataaagacagaaaggcaagctaatatctcgtgttgtatcaggattagaactacatggacagcatatagcatgcatggtgctaactaccaataccatttttcactactgcagaaatatttcacaagaaagtcaagtgcctcctcacagatcggattttcctccctgagatgtggcatgatggcatctaacagaggcaaggtgctatttagcaacaggtgccccaccagcatacatccctgatgttgcagatcgatcacagggctgcctggacaggactttgacagtatgggacaattcccctgaaaaaaacaattgtacacaggattaggcaggatagaaacaagaaaggaagtgtggagagataataaattcacaccttgaaacggcagccgtgtttttgtccccctaacagggtaatgtgaagttacttcgtgaactgaaagggcttgcttgaaacacagtgtccacagggcaatcccagcttcttgtcaaaatcaaaatctactgtcccaggtggtaaacatgcagagacatatttatggcgacctctacatacctcagtttgacatttggtttcttcctgacagcacttgtgctggtaatacacatgaagttcccatcagcattctaccagctgtgaaagtgtttgagcacacgggatatcccttccagagaagcgaaaaataatggaggttgaggagatctgaaatgtgcactcggtatgcattaaggtgacagatcttagaggtgaaaagtgatctgaaagcttgatttgtgaaagtgacaaaattcatttttatggtggtgtgcaataccaaaatacattagtccaggtattcactgaatccatggtaggttatgagtaggaacctccatcaggaaactagaagggttctactctgttttccttctaagaaaatgtaagtgacttcatgcagattgttgtagccatttccatcataatagtagagacaagtggcaaatgggacatttcctatttccttccctaattatgtatccatattggaagggttagaggtttgtttcttctgtgttttatattgaaaatgggtttattctttaaaaatcctaggaccgggcacagtggctcacgcctgtaatcccaacattttgggaggccgaggcgggtggatcacctgagatcaggagttcaagtccagcctggccaacatggtgaaaccccaagtctactaaaaatacaaaaattagccaggcacggtggtgggcacctgtaatcccagctacttgggagtctgaggcaggagaattgcttgaacccgaaaggcggaggttgcagtgagccgagatcgtgtcattgcactgcagcctgggtgacaagagtgaaactccgtctaaaaaacaaaaaaaaccataaagcaagatttctgatactgagctatatatagtattgagatttccccaaccatcgccacatagatgaggccaaccaaagagtcagctcaggacatccggttttttttcccctgtgcaatatttttgtgtggagaacataaagtaaatttaaggggattaaaatttttaaaaccagactctaaatagatggtcgcttttatcattattgactttggggagaaggaggctcatgtatgaaactaagtctatgatcatgtggtaaattcagcttttatttaggttagaaccatgaaaatttttgaaaggagatatcttatggaaaaaaattgtcctgaaatatgtttcctatttaaattctttttaatctatcttaatatcctgaggaggtggggaattcgccagttagcctttttttcccctctcatattttcctctcccctatagccagtctgtcatcaaattctgtgagtccttcctttaaaatatctcccacatgtggcccatagctaccatcccagcgcaatgatcatctcacatgtgggccattgcaacagcctcctaaatggtccacttgcctccatttccctcttctgtctactactgcagactcagcttcctaaaatgtcagtttcatcaaagctcttctagtctgaaaattaccacataaacccttactacccataaaatgaatttcagtcctattctaatgtgctggccttctattatttggcccgaactttccaaccatttctccccgccaaatccccacaacctcagaagtctacccttccttccagctaaagtgggcagcacagcatctctactttctagccttttctttcagccctaaccactctagttttctatcttgtctttaaaatgagtttgtcatcatgtgcacggttccttctaagtctacattcataagcctgtgtgtaaaatgccccactcagttcatccttatcacctctatatattcatccttcaaagtttcagcttaagttccaccgcctttgagaagcctctctgaccgctacctcttccagcaatgcttttcttcccttcatgttgaccactggttatctatggattgcacttaaaacaattgctttattttttattctgctctatagtttgcttctttattccttgacttctcaggtggagtgacagggactggcctggtccactttaatgacccacagaagaccctaataagtgtgcttactaaactcaccaggacattcgaacactcaagacactttcctctctagagttaccccaatttagagccattcactggctccggtagcttcctccccacccaggacaggaaacgaaaaaaaaaaaaatgaaactcagtgggttttatttgggggaaacttaaggaaaatgcccctaaggcagaaagtgaaataattgccccagattaagcttgagtattatatgaaaaatccctatgaagttcagctttaactgtagtagaaattacatgtattggctgctgctctatcataaaatcccaaatatggctttggagcaggagagtacaggctctgggttcaaacagacctgtgttctaatccagggaccacctctctagctgtgtggccttggacagcgaactgacccattctgagattcagctccttcctctgtaaaatacagataggagtacttatcttgggaacattttaaagaaaacacataaatcacctagctcagtgcatatccaatattgtatgttcaataaatggaagtgagagagggttgattggtgcatatgtagatccagacctaggatgcaggaatgacaaacgttcagctatgtcagtcattaatcctatgtatctatgatgtgccttcctttagcattttcttctgccaccaaaggcaggggaataaggaaaggagggagagagcaagggagagaaagtgagagagagagagagagagaaggagggaggtgctcttggcatttagggatttggagcaactgagctaatggctctgtagggacagtagtgacagttaaatacacgttgagggagaaatgaagcatgaagccctgggtcctgcaccaaggataataaagagcaggccctgggccactgtgctatgctgttggggaacaaaggaccccatccctgtaccatagcagggatttggattctctaagggtcatgtgcttcccttctttcctcctggctcaccatctagaaagaaatattaataaaaacttggcaaaacattgtagagagtcagatcgagcttccagaagtaattgataaagcaagataccatttagacttcaccttcaaaccaaatttaacaaaaaagctgaaagcaatcagcttgagccccttaccattcccaaactctgcacccatcatcaaacattgaaccttctatttctgccttttccctggaagggcagctgactgtgaaattctctaacaaggcactgaatgccacttagcaaatatgtccttagacattggatattcagttctagctttctgatcatctggtctgcacctgccctcagccagggagaggaaagaaactggaactgcctgggatgatgggtaaggcagtatttctggagatccctccctctccctagcaaacatatctatcaaattttcaaagagaggcattaacaatcacatttgacaccatcgtcacctgtagccgctaagctagtcttcgttgccctctaaatatgtggtccatgtactcctgcacagtagtgtattaaactttttaaattttaatttaatttaattttttgagacaatgtctcactctctcatccaggctggagggcaattgcaagatcatagcttacagcagcctccgtcttctgggctcaagtgatcctcctgcctcagtctcatgagtagctaggattgccagcatgcaccaccatacccagctattttttatttttaattttttagagactgggtctcactatggtacccaggctggtctcaaactcttagcctcaagtggtcctcccagttcagcctcccaaagtgctggtattacaggtgtgagcaaccacaccggccctaagccacttttaattaaaaaaaaaaatgtagctcttcgctttaccttcaaaggttaaatttttcttttgctgttttatttttgtttttgtttactacacaggtacaaacctgtaggaaactatgtctacgttttctaaaatatgaatctaagggacttggacatgctactgtttaactgctgtcggtgagattaatactaaatctctgtgcggaataaatgaacagacagattgtgtttctcaatcaaaagttttaattgtaaaaggtagactctctcaaaataaatctataaattttgggtcgtactaatcaaattctaaaataaagttagaaggcttgtgatgggagtggagtttgggaactggcaagagtccacatggctcttgttgaatataaactaaaaaacattctaaagctggatggacaatcaattcatgagcaagcctagacattttcataaaacagtatccttgtaagatggggatttgtcttattacatatccaatcacattataccataacaattgaattgtctgttcttaagcaatggactctgatgtagatttcatctactgtcatgtagttttcctcttgctcttctttgttttgctctattcttttgttggcattgaccaaatcttcagctgagcaacaaactgctgtaaccagatgctagttctgttgctagaattaatggaaactctgaactaatttttttattttgtcctatgatctttccaatcagtaaatagtgttactaatacatgcaactttttccacttcatagtacgcaaataatttctgagacaggtttgtttcaagaactcaggaaaatctccttgtattcctttgatgacagaggctcaaagattattcagtctaagtgtcttcccattttcctgaacaacactggcacatttagcccattcttaaaaaccaaaatggaaatctgaaatacaaagagttctgtttattgtccagtttttttggtatgatgttacaggcataatctgctatattaatttaaagtaaaactaaaggttacacaattaaaagatattagctataccagaattatggtgggaaaagactaattgcattccaatgtacatttattgatcagttactttagaagtgtgcacctctagatattatcttcaaactcctatcacaaatatgcctttgcttcccaatcacctttctgtcatataacatgtgttctgaatagacttcttgccaatttaaagtttcacccttaaccttcacctgccaataatcaatcttctcctgaatagaatgtccctgtaaacagatgtgctttaccgtgcatccagaaattcttgaaaccagcttttaactttcatcttataaaaagtgcatcccacaaaagacaggccccctacaaatcatgttctctttttttcttctgagaactttatgctggtaaaagaaaagaaagttttccgaatataacagataaataaaagcataggacatgtaatattttttacttgggatgcctagaggctttacatgtgttatcacattctttttcatatgtgatattgagatttagtaaaggagatttatgatatggacccaatatcaaacagattaaatctttttattttactttgactcagtttccttctctgtaaaatggagttaagtttatcacaaaaggttgttataaagattagatgagataataaaataagatgcttaacacagaatatagaacagagaaactgcacaaacacaaaacacaaaagctacatttttgttccaagatggcaaaagacatggcttgagctgaggcttggtgataaagtgagtatgtccttttcaaataaaaatagcccttcttaatctcatgatctgtatgacacaatttggaaatataatgaaggtggccacttggcaaagaagagaaagaggaagagggagggaaagaggatagaggcaaagaagagaaaaaaaggaatggaagaggaggggaaacattgtgatcctctcttgcctctgctctgtgccttgctataataagcatttcatgtcatagctaagtcaggccagattctagagtgtcctaacacatcaggtagagaggttggacttgatagctaaacagatgccttaggaagttcaagcagtaggtttttaagaataaagagagattaaggaaaaatgagagtgacagtgagtgagcagagacagagagagaaagagagagggggataacaagacaattgatccccagagttcaaataaattaaaaaaaaaatgttgtctattcccatcgacgcagtgggaataaggaaaggatgggtgtaagaaacatggtgaagaaataaataacaataatgcaacttggtgattagtcaaatagaggacaaaagagagaaaaatactgaggtatcaagcccaggacacagggaaatggtggctcaatctaaagctactgaaaatggaatttcattcggcaacacaatacattcccaaagtgacaatggtcattatggaacaaatgtttatctgttatctgtgaacagactacactcaatagaactttataatgcaaacatatgtaaatatatgtgtatatcaatgtttaataatatatgtgctgctgaagcaagcactcaatgtttaataatataatttaaatagatacaatctaatgttctgatcattggtgggcattagacagaatacacaactgtgattttcataaggcatatgccgccttagatttaaaaaaaaattttctcagattaagaaaatggttggccaagtaacaatctagcatttctataactttggggaagttacggatattcgagtcaaaatactcaactacatctgcataacacctatataattctcttcttttgactaagagactgttagtggagcggaacatgaaatttaaaaagtctagaggcaagaagagatgaaatatttaagttgcctatgctcacaaaccttcatattctaccttggaggaggctgattgacatcctttcacagaatgtaccaatgacttattcacaaatgaaatacacgttcccttcttcactacaaagacaaatcatccttaattttatgatttgggaatggtttccccattcccctgcttttctttctatccccttttgttttgtccttttttgttttatttgtttcaaccatttcctattcaaaataagagggccattctctagtcaagtcttcctactaaatcaatgggcagttttcagaactaggtatagatttcttagaagtagaagattgtgtttgccttttcaaactcgtgcattatatgttggaggcagcatgactgaaagaatacagagcttgagtcagcaaaatctggaactgaaatgtagccctgttactgaaaatttgtgggaatagcattgaccatggagacttgacagcattttcgttcctcaaaagagacttgggtcccattcaagtttttaatgaagactttggcctgttctatgttacccaactgggttttctgaaccatattccctagttcccctggaagaaacgccagcctaagtatcagcacctgtaatctatttctcactcagggttgccagacatgagggattaattgacatgagccagtttatatttggaagccattaatggctagcaactgaattgttgagacatccagtgcaacgaaccagagaggaaagaataacacacaagtgccatagttagatcaataaacatcatcttcggcaagcacaaacgttgggtttagctgccaaacttaaaactaggtctcttcatctagtacccacttaggtcaatgggccagggtcctggtatagagattagggactgaaacatgagttgatatttccaaacttcttaattttggattgtctaagttcagatttcaattcaagattctactcctacatgttacgcttttagatctgtcttggaggtacaaagacttctggaattagagaagtttggtccttctaagaagagaaaaatgaataagtagagaagtcagaaaaaagaatacaatgcagtcaaaacatgttctgtcatacagagtcaccttaccttttcgatgtaaaaaccaggacagaaaacggggggaaaaataagctatatgaaaaacttcatgtatagcaattgttattctcattagcctttcttctacaaaaatagctgtctattcatctaacattctggtgaactactacagtagtctcagaagtgaaattaaaagtgttcctacaattgcttctaccactgtcataacccctttggaagcttagaatactccacttaacttcctcatctgcttcaggcaaatcatatttcttgttgcgcaaataaaattaaaatgtatattttattattcccctggtaacttttcaagtctgaaaaaataattaagcacactattagcaatgaaataaaatttgctgaataatgacagcagtgttggagccaggaaaaagaggcagggtggtacagtggaaagatattagaaatctggattctagaacttggctactattaatagtgtgattttgagcaaattagttaagatttcaggagcatgccatcatctctttgcctgcattctgccattcccttcacctagatggcattattctccttctttactggcaaactctgctcttcctttaagacaagcttaaataaataaagcattctcctttgtttttttttgagaaagtgtctcgctctgtcactcaggcagggtgcagtggtgtgatcatggctcattgcagtgttgacctcctgggcttaatagatcctcccacctcagcctcccaagtagctgggacctccagcacacaccagcctggctaaatttttcctattttctatagagatgggttctccctatgttgcccaactggtctcaaaccgctgggctaaagcaatcccctgcctcagcattccaaagtgctaggattacaggtgcaagccactgtacccagcctaagcattctccttgaaactaaaaagaatggttggaggaaagaggaaggacttcaatccagttctgcatcacctcgtgcatctgaaataagctctgtaccttatctctttcttatctccactcatcttacctactgccattaaactcatcttatttctacactgtttcatcatatcactccactactctaaaacacctgtctcccaattttctgcagcatccagtctaaataaatgaccagcaattaagaacctccatgatcttttccactatgaccatcccactccccctatacactttctgctctttcctaaagtggttcaacatgtcctgaatttacatctttacttctgctacaaggcacgtgctcacactgttttctgggctaggactgcctcccatcatggttctgcatgtccaaattccatccatccttgaaaagaaagactcaagcctcattacctccatggaactttcttttcctaactcttccaaccatcaataatctctctctcatctgtgctctttttccacttaaaatcttgtcacataattttagctcttaattatgtacaattttgcatttattcttattctcatcatttttttaaattgccttctctctcttatattttgagaaacagtaagacaagttgagttttgagcctctgcatctatcaagcatagcttcaaggtggtagagccagtacatcctaaaggccttcattacacattcacagttagaatgatcaaggactactgggatagaacattatattttagtcattgagaattttaggaaactaatcagcagcacattcacaactaccccgggcattcttttgacaatgtggaaggcaccatctcatgcactgattctctggctcagattttttgtttccatcttctgcccacatcactctccagggctgcatttgcgccagctggattccatccagaaacagattcaaatagacaataggccaactagaattcccatcttccttgattagatgtgaaattgtatagctgggtgtcactcacatgccagccactcaggattctatgttatcaattaatttctcttgagagctgaactgaggagattgtgacaattctgttttcaaggacctgtaaaataacagctagaccagatttttatggatagtgctagatatataggcctgtccactatctgccgcatagcataaattaaaacaccctgttaatttcatagtaaatcgtattgggtgtttttttcttctgcagtgtgaatggattgtaaaaattttgtctaggaatggcattctcatttgtaggacaattagcaactgaggtaaaaggtttatattacttagaagaaagacgaacttattgcacactgtcaaaactactgaatcttatttgttgttgttgcttcaataacttagaatttgcagtggattttccaggaaaggatatcatagaaacacagaatgttggaggcgtacctccaacaatctaagctaaatctaagcagaatgttggaggcataccttagagatcatctaagcagaatctctcagtttacatctgaggaaacacaggactgggtttgttgggagacctgcctaaaatcacaaaactcattcttacaaggcagagttctaaatccaggctttatctttctaaaaagtatgagtcggtaaattctaccgggatgaaaatgagttcatgtgtccactttacattgggacccgacaaggaaaagagatgagtccagctcccttttcgaccatggactttcttgctgagggctaccgtgagtaatcaggcagtgtaaatgatgattgggactggaacaaatacaagaaaaagctttttttttttcagatgtactccttatggaaaatctgttctaattgagatcaccaagcaccgttgctatggatgatctgtgcaaacatgcagctttatcatagagaaacttctttgtaaaagcattttttaacatacacttaaagaacacactatccactgttgatgatgacaatattaaccattacgacttcaaaacaattttcacttgcactaaaccactggaacttgtaatatttgagtaaggaaagcagtgtgtcatttctgtacaccagaaaactgaagctgagggacagcatgccatttgcctgagtctaaacacctgagtgaggtaattagtgttagaactcatgtcttctggatcccacttcactgcctaatacttcaaatgatttcaaatataccatatttggtcaatattagggatacctattgcattagaacagttgaactgtccccttagtaatgtcaccttactgggaaataaacatttgaatacttcctcaagtactggaactttcccaagagaagtatatgagcaatattcttcatagcttaataaattacatgattgtatatacaattatgcatctatataatttgcatttgaagctgatttatttgtaaaagaagtagcagtattcattattagattataaatgtatttcctagtcataacttccatttgttattttgtactataaggaataacaatttaataactcaaaataaaaagattaatttagaatatcctaagtatgattctgactttttaaaaaagttttgtttttcactgcatgttctcactcataggtgggaattgaacaatgagaacacatggacacaggaaggggaacatcacactctggggactgttgtgggatgggggaggggggagggatagcattaggagatatacctaatgctaaatgatgagttaatgggtgcagcacaccagcatggcacatgtatacatatgtaacaaacctgcacattgtgcacatgtaccctaaaacttaaagtataataataataaaataaaaataaaaataaaagttttgtttttaagacatgttctagatttcctttttggtgttgtaagtatctcaagaaagccattatgatttccagagcaatgaaagaaatacgtcataggaaaaagagcattttcgttcatatttttaggttattggtcatatttcaatccactggaaaatgtgattgcaaatctggttagatttataaaaatatcaggcttaccagtattacaacttcttatgaaagtgtgaattctgttgagaatgtgaagataaagtggcagaataattatctttttttatatctaaactttataatagtgaatgctgttgaaaaagggattctatgaaagttattttttgatccataagaatactttgttcatactattttccttttcttaaatttccaatttttattttaagtttagggatacatgagcaggttgtgcaggtgtgttccataggtaaacgtgtgccatggtggtttgctgcacagatcaccccatcacccaggtattaagccaagcttccattagctattcttcctgatgcttttcctcctcccaaccactcaccctatgacaggccccggtgtgtgttgctccccgccattgtgtccatgtgttctcatcattcagctcccacttataagtgagaacatgcggtatttggttttctcttcctgagttagtttgctaaggataatggcctccagctccatccatgtccctgtgaaggacatgatctctttcttttttatattcatactattttcagctaagcctatacattagacacttctataaaacagtgcttccctatttcctatttatatctcagttgttgtttataatgaaaataaagtatgccattttcactactcaaagaaaagaccagaagaaataaagctgagctcttactaaactcttaacagctgtattcttgatcttccattgagtagcaactgctctttagtttctatcaccttgcctcaaacatggtcataacctccaccaaaaagaccacataaaatagcaaactgttgaaatgagaaagagcaccaagaaaagatgtaagtccttgcaggaggaatgcaactcaaaaaggatgacacagagggtgagggcatcagactcttttgctctcaccactgagaaaaatttggcactataaccggctagataatgggctctcttcatttgcactctactaccatttgtaaatcctctgaagttttaagtaatttgattttccccatagtttatgaaatatacaacctttagttttatataacaatttatacttttcaacatgcctttaaacatttcatttggttttgacaaccttatggatcatgccacataactaagtacttgtgcccattttaaagaaatagaaacagaggcacatctttggtgacacatactgaaatattaatgtatagtggtataagatcatgatgtgtgcagtttactgtcaatagttcaagggaggaatatatatatatataattttataaaatctctgtttgtatatatagagagagaggggcagggggagggaatgaaattgataaggcaagacattggggcaagtcgttaaccataaatgactatgggtaactggtatgtaagtgttctttctactattcttccagcttttccgtaagtttgaaattattttcaaatacaaatttttaaaaattaattaaggaaaattaagtaatttgtataaataaacagctgattagaggcaaagtgaacaactaggatccaggtctcctaactataatctatttctgtaaactgaaagtaatttccacttaaattatagtcagcccttcatatccacagttccacctcagtggattaaaccaaccttggatagaaaaactattcaggggaaaaaaatacaacaataaaaaaatacaaattttagaatacagtatattatatttacatagcacttaccttacattgggtattataagtaatctagagaggattcaaagtatatcggaagatgtgtgtagattatatgcaaatattatgtcatcatatatcagggacttgagcacccctgattttggtatctacagtggggctctggaatcaattctccaaggagaccaagggaacgagggagactgtatttataatcacaatcatacgttttgccagtcagtcatcaataatcaataccatagctcacgagaaactcataatgatttattaataacctttatttatatatcatactacttattgcaaactgttttcactgaccttattttatttggtcttcataatgcttccaatgaagtggattggacaggcattgtgggacccattttacagactaagaaacaggctgtgaaggttacttataccattaatgttcacagctactaaacggcagaatttagaaggatgccaagagagaatactggaaagagcactggttctggaatttaggatttaaattccaatatgccttcttagcattctaatgcctttttatactcctactgaccatacctaaaacttctagggctcgtattatatttcgcaatagaaaagcaatgttcttgccggcacggtggctcacacctcacctgtagtcccagctaatcaagaggctgaggcaggaggatcacgtgaaccttagagttccaggctgcaatgagctatgattgtgtccactgcaacccagcctgggcaacagagcaagaccctgtccctaacaaagcaaaaaacaaaaacattctcttaaagaacaaaacaaaatgactgagaaagatgtctgttttacttactaatgttatatgtaacaataacagctaagatttattaaatacatgcttaccatgtacaagtaagtgctatacatacattatctaatttaatttatgcaacatctctatgacatagaattatcttggtcccagtcttacaagcaaggaaataggctctgagagtttgactgacttggccaagtttacagacttgcaggggccaaggttggatatggacccagaaatctgactccatacccgctaccattaactagtccttattccacattttcctttttttcctttaagctcagttgactttttaacgaatgtcttttcctcatatttagtaatttttaaattctgaaattaagataatgctttctagaaacatagtttatatggaaaaatatttgcatgaaaaaatagaccctccttcttatttgcaacctcttgaaagcaggcaccacatcttatctgcatcaacagcagctcctggcacacatggaacattcaataaatgtttgttaaatgaatgaataatgttcagagttctctattaaaaagttcttacatgatctaaatacttaaagacaggacctaaaaattaagttggctcaattcaccaaatctcaactttatagtaaagcacacagttttggtcccagaaaaacaaataaatgaaagcagaaaacaaatttcacttttaagaaatttttaattctgcccttggaaagttgaactgctctgtggatgtttcaacaaatgtggcctttaactatctggataatcttttttagattataatctatagtctgcatgacaaaaagtgatgcccaggctcactaatgtctgcatttcattattttccttttgctgtaaccagataggatttaaaaaaggagaaacagtcaagcaaggaccatggtctcaggaaaggaggagaaccacctccaggatatacagcttgctttcatcttcctcttcttcttcttcttcttcttcttcttcttcttcttttcttcctcctcctcctcctcttcgagacaggagtcacaccatgttgctcagtctgatctggaactcctgagctcaagctactgtcctgcctcagcctcctgagtatctgggactacaggtgcatgtcacagcacccggctacagccagctttccaaggtgcccatcacagctgccctctgagcaatgactcaggaagggaccagttggagggaagatgggagctcaggaaaagtgtcaggatacaccttgcaacctccttcttctaacccgtgctttcagcccttccttttgtggtttcttcccactccaaaatttcccataatatttatttgcataaattttccccaaaataggaatgactaggcatattgagaggaccacatttacctaccgcccttcccactttagtaatagcatcattgttctaccctgtgcattccagtatagcacacagacatcttaagtgcagaacttaactttattgcaacataagggaatttcggggtaaaaactgcattcgtgaaatcaatcacacatggggctcaggttactcagcctggcatggttcaaagccttatagcaattcctcgtaggcgctgcctgttgtcactcccttggctgtctgtcacccttgcctcaggctccagccttagcctcagcttcttcttcctaatgcacctgccagccccagacatgggtactttccagattctgcagaatgaggctttttcctgtctaagtctcagcacatccttatcagcatctcacacagactgcaacctctgcagtcggcttgtgtccagggtcctagtccccatcactgcttcctctttatactctccgcccaatgcctgctcctgtgcgttcccacactcctgccctctggcatgtacagtttcacatttgtaatctatgcctctacgtacttacaagaagaggaggtgaaaaactggatttggcacatattgaatttcttggaccgtgttcatttttttctgtgtctggaatccactgttttctagcaaaaactttcttaagatttcaaacaccaaccctaacactctgagtttacctgcttgaatgactgcctgtccctcgggctgaagtcacaacattcaggttattattaatgattgtcaatcaccatctttttgggtccctgttgttttgccttcatataatttaatatttctatttaaacacagaaacttgggcaactgtcagagtcactcctcagctaatgctccctggaaagggcatatgctttttgctcactcaaggcagataatactgaacaagtgcttaagaacgttcatgccataaaagactctcagaaaaggaaggagaaactgaacgataccgagtccttacacatgcaggacacggctatttcctttcagattttgtaattcctatactggtcattctagttctaagtaaagaaaccaggctttttttaaaaaaaaaaaatcacaaatctgtagagctaggatttggacccaagtcagtttgtctccaaaaattcatgcgttttctcaaaagaaagttctatataaatgctaaacagaaaacccagtcattaattacatggaggcagtttacattttcctgcaatttacacctttttttttccagactaattaaatttcctacgctggtaaagtgcttcttcccacagtttactagagtttttggtaaagagctaaaagaaggtttgctgtgaagctggcgaggaagagaagactgagattccaataaaaacttgttaactggcgtgcaacaccgtgcctattaagagtagaacaactctcctacagaacacacagccgagtctatacattgcttgttaagtactggcccaagtgctcatgtctcagacttgtcccttggacccatgcccaagccagccctgagagggttggaacaactcccccgcccctgcagaaaacacgactggttatttagaatctagggcatcacaatgaacatggctcagtattttcataaggtattactactgttgttctgaaaaagcaaggcatgcgcgcacttacttaatatgttctttgttgatttacacgtccttgatttttaaatcacttccagaaattcctagtaaatgggaaaagaatttctcaaataaatatgttatcttttcctccaacagaatgccagatcacttcttgaaagatcgtttccagattcttcttcagttcaaactgattttcacaaacttgaatctgcacgccataattaggaagctactgcaggccaatttatttggttaatttgcatcagtctaaataatttttcctgacagattacttccgttctaagtaccaagtactttttaatcctagtcaggttattgctaaggataaatgatttcacatttctcataaagatgcctgtcattaagaatattaacacaaattccttccccttgaatagaaatgagctgtcattttagcaatcttgctgtgtcagcctttctattgtcaaacacaacaaatgatgggaaaatcaatttactctttagaattagtcaagtgaggaatcctttgaagtgggggtgcagagtttcgcctgaattctataatcacgtaacagcgagtactgtatgtatgttggtaaaatgttgtgaaatttaatgaggactatttgttgccataagaccttccagacagaatctatctctgaaaaagaattccccactcctaaaatagaggtctgatgagcaacagatgtggtttaaatgaacccttgttcaactgaaccaagaatatattgtgatctgtatgaggcacaattcagaagagaggggaggtggctacagcacagcctcagtgttgagtttggttgtggggtttaaacatatttatttatttcataaagtttctctcataaggcacaatgcaaatgagcttttaattaatacaatctaatgttcagaggatggtcttcatgctgtttataaaacaatttacatttttattttgtagtctaagaacgtgtgtcgaaaagcatgtcagtgagtagccataaccttcagagtgatctatgtcctggcaatgatttgtaagttccacaactcagtttctccacccataaagagaagattagatcgttgttcaagaatgacaactatttaatatttggaaatgactaaataatgaagtgcctggattctatagaaatgccgaggagaaaagaagattaatttcaaaccaaagtctagtgcaaacatgaccttcctattgtaaatctcatgaataggagaagaaataacatctaaagctttgtttctagggctgagactctggaaatatattaattttaggttgtttctgatggcaaaaaaaaagatccgtctattacaatctcttgcctgtggagatgagaaaaaattcttcctgctacctttgactgaaataatgcagttagcaaagatttaaatgacaagagtagaagtgtcatctttttgtccctttgcctctaggcaggactacagttaagccatctcaggaaagagaagagtgctattgctcccaaaactctccaggtgagaatgataaaaattaaaaacagcaagtgagaaaactcaggggccctgaaattaataaaggtcagttccagctcacatcgtttcagttaaaatttatttctatttggaaatagcctaacagcaaaactccaacggatgggctgtttggcactagttctcggtgaaaattccatttagtattactactactgtctgatctttttctattcagcctcctcttcaccctgttggtgagggagggaggccatcctagggatctggggatggccaaatacacagcacccaacagtggacagatgacagccacagcagcttaaaagtcacataaactcacagcccagggaaggaggatcagggaaggaggataacacataccatgcagggcacacaggggttgcaccgggaacagagtggacaagcagaggctgcaggaggcagtagtaacaagagaatgcggtgccctgaggctccccggggaaggtgtaattggcttgtttgaataattgtgtgggctggtaaggaagtaaaacccataaggttgaagacctggtggagtgaggctggcccagctgacagaggaatgagccaggtgggcgtcctttcttgctggaggggacatatctatgaaagcaggggagctcacagttaggccttggggggtcctgatgaggctcaaagataataaataccaaggtaacacgtgagattttaggcgttacaagccgatccatacaaactaaaccgacttatatgagactcatgttcccttgaccatgcctgatctctctaaggtcttttccacacctattttgtctcacaggaaaagagccacttttgactagattgataaaatgggagtttaagcaatttttctagcaggaggactctcaggccaagaccatgtaattagctaaatgactcatgcagaagtatcctacactcctccctttggtttgaatgaaaagagtaggagagccctaaatcatccagacaaattacatctttaactctttacttaattttagtctgtcacaaggtaaatattgacaaactttagacttatagccagagggctaaaaaaaaaaaataagtctagcttgccactgtggctgttttctgccctccatttttctttctttctctttttttttttttttttttttttgagatggagtcttgctctgtcgcccaggctggagtgcagaggggcgatcttggctcactgcaagctccgcctcccaggttcaggccattctcctacctcagcctcccaagtagctgggactacaggtgcctgccaccatgcccagctaatttcttgtattttcagtagagacggggtttcaccatgttagccaggatggtctccatttcctgaccttgtgatcaggagcatgagccactgcgcccggcccccgccttccgtttttcaagaatactgtcgggacacacacaggtcagggaaatgtagattctctcatttcccctggtttttaacaaatgtcctttatataaaagacaaaacttgagatgttcaggctctgtctgaaactactggcctcttgcatcctttagataaaggacatttgaagttaatgctgggcctgtcatccttagttataccacgttggacaaggcattttatcttctggatcccaagttccatacttttcttttttttttttttttttgagatggggtctcactgtgttgcccaggctggaatgcagtggcacaatctgggctcactgcaacctctgcctcctgggctcaagtgatcctcccacttcagcctcccaagtagctgggactacaggtatgcgccaccacacctggctaatttttttattttttgcagagacggggtttcatcatgttgcccatgctagtctcgaacttctggctcaagcaatccacccgccttggcctccaaagcactggcattataggcatgagccaccatgcatggctatactctttaatgaggaagttaaacaagagtttaaaaatttttttttagcaacaaaaccattgtctcaaacaaagtcttaagtcactctataaaacagatggagataatatttctccatttgactccaactgagtaaagtccaagccagattgcctggcctccctcacattcgtccccttcccacacactgccaaggttcctgaagtaccccttgaaagcctaaagcttgttggaacccagtttgaaaaccaccagatgagataatatctcaggtttcttccagctttcagtagaatagaaaaatcattgactatggaatcagacctagattcaaatcctagttctgtcactttctaagctgtatgaccagactcaatttacccatctgtaaacgaaaacaaaaatagttctgctaggttaaaaagacatgtaaagcatctaggccagttcctgaaacccaggagggatttgtaaatagtagctataataaaggttatggtcctcacctgagcataacaaaatgagagatgatcctacacttgaactacaaatttgcagtaagatcgctgtcattcctgaagccgaatcctcaggaacttgaggccaaaattctttaaaacctgaattggttttaattgttccaaattagtagaggggggaaaattcttctaattcactgaacaatctgtatgcgtggagagcatgtactgcatagacacaccccaagtctcttaaatgacaccacggtcgatccaactagcacaggtggaatttgaagcatgttacttttaccaaaaaataacaggggaaatgtcattaagaacactttaatacaaagccacaagaaattcagtatctgacagctcatgttctatatttcaccccatatcataaaacaattcaccagagagcagttgttcatttgctgagctgctgttgtgatagcacatattatttcaataatggaggagttcctccataaaatcagtcccagaagccagtgatgtctgaaaaatctcacctttggagaattttcctggcattctgtaaaggaagttgcacttacaggtcctctaatgtgcagcagcaaaggaacaacagatgccaacattcttgtttgcctcatgaacttaagccctaaagtaagctgacttgagtaaagtttagaggctccccttcaagttttagaaaagctttcttgtttaacttatgcaaatttacacaccctcatgaacctattgcatatatccgacaaccgtccatattttagtaccatgtggtggctctcacctatgcccatatagctggcgacaatgcaggtaagatctggtcagctgtcagtttcattcagtgaatactcactgagcacctgctttatgcagggccctgtcctgggccaccagggagaacaacgcaaggttccaaacctatggagacagacaacgcatgcggaatgacaacagagaaacagagtcacacggagaaaagaggggaaattggggaaggcttttgtgggggaggcgggatttgaactgagccttgaaggaagtgggtgtgaggatgggggtatgagtaaagatgggaaatggagaattgaaaggccgtctttagagaatgattcacattataacgtgctggggagtaggtgaggcgggagggcgggatgggaagtgggaaattagtgtggagacagaaattgtgggctttgagtgccaggatgaggaatttctttgcgtgttgggaagcagtggcaggcgcaggacaggataataataatttaaagaaaatatgagtagcaagttgtgggagcggggagggaagcttggtgctcagaataatcagaactttctcagtggacccaggctcagtggaaagagcgctctggttccgtttattgctcccacagagaagagaggagagacccagagaggtttaaaattagaggggtcgacagggcacagggaactcctggccaaccatccttaggaaaacaagagaccaggaataaagagaaccagcagaagcacctggtctgagtctaagaaacatcagtgtttactaagcacttggtctctggaacgcctggctttccaaataccacatcttcccatccactccatcctgccacaggcagctactgtgtcgggtgctcagggagccggaaccacatgcctggaaaccctgagcccctgcccgccgccgtccaagccggccggctgcagcgcagtttgtttgccgaggtttgcatgcacatattcagttgcccttttttttcccccagtcctttcagccgtgtcccgaaattcacccttagtgtaacttctgcctctgctcctcctcttcttggaactgccttttgtttgtctggcagcgttggttctatgggggtgtgtgatgataataatacgcgggcttatataaccgtcttcatcttgcgagcacttcgcagaccgtcgctaatgaatcttggggccggtgtcgggccggggcggcttgatcggcaactaggaaaccccaggcgcagaggccaggagcgagggcagcgaggatcagaggccaggccttcccggctgccggcgctcctcggaggtcagggcagatgaggaacatgactctcccccttcggaggaggaaggaagtcccgctgccaccttatctctgctcctctgcctcctccctgttcccagagctttttctctagagaagattttgaaggcggcttttgtaagtatcgtgctctgcttttactttaaaaagaaagaagacaaactttccttcctgtccctgtccttttcgtattatttattcattattcatcatattattattcattatattctcagatgatggaaagtatgtttctggccaaagtcttccacccaaatttggtcccttgtaatgataataagaggggaaagaggtttctgttgataattaattcacttaacaaaatagtacccaggcgaggtactgaaattggccactttcacagcattctggtgatgtctggctgttgatacacaccacacacacacacacacaacactacacacacacacacacacacacacacacacacacacacacactcctttttgcccttaagaggagccctagtcacctggcttgttagacaaggagaaatgatgccactttggtcttcagtttctctgccttgggtactcacaatttcaatcagttgtaattgttgaaagtttcttttcacactacgaaataaatcccatctttcagtgcaggcttgaaacttgcactggcttgggtaaactgtacaaaacactgtagctatagtggacatgtgaatttttattaaatttttcactgcataaccgaaggttctaatattaaagaaacatggacactaactttttaagcacaggcaaaactcaaagccctgttatcaaactatgtgtcttaaagagtgctgaattaacagagtactcttctcagagattatgctcactgctttgagaaactgcttttcaacaagaggtgaatttaaaactctagaataacatgaagaaagacacaacttctgaatacttagcaactctgacttgctatttgaacaagccaaaaaacaaagggtctattttgggcaattgtacaatttgcatttataaaaccgtgattataacttggtatgctatgagatacagagatttattgttttaataagatttcaggtaagaaaactaagaactataaattggtaataatgtagaaaagcaaggcctctcacttttaatgctgtaagtgctgtgattcatttgtaaggctttatcatctttacctctagatgaatagatgtgaaaaccatgtatagtatgtatgtatatgttagtgtgtatatgtgtctttatcttaaattcttacatttgttgtatctatctagtgctcagtatgttatatgatagtacaacatccaaaatggatcaagtggagaaatttatttcacatcaactttcagattgcaatgtttattcagtatttattaacacacatgggaaatattataaaattatgtctttttttagattctctttaaatgatattttcccttagaattctctgtggctcccatgaaattctaaggtataattaaagtcaaaaataagattggattctagttgcttttacccctaaatttaaaagtgatatttcaacactaaattctatactttacctaatttgattacaaagatgaaccacataatctcagcattagcctcaaaggcaaactcaatcataatagaaggaacacaagctttgatgagatctggatttcaggcttagtttggtcaaactgaattaactgagccttgtgacacacacctgtagtcttagctactccggtgactgaggcaagaggatcgcttgagcctagaaggtggagactagagtgagttgcgtttgtgccactgcacctcagcctgggtgacaaagtgagatcctatctcaaaggaaaaaaaaaaaaaaaaagagagagactattgtagtgttccagtgagaactgctgggggcactgagcagtgtaggtggacaatagggcgcagattccagaaatatttagaaggtagaacattcttgactcagggctggatgaagggaatggaggaaaaggaaacttttataatattagttttgggcctgggctactgggtagttgtaatagaataccatagaacaagaggaggtactggtttatgaagaaaattgagttagttggagtaatatcaggttgagatatcactaagaggttagactgcaacgctgagtaaaaataaaaagcaatttttttaagcataaaattatcatctggatgtggtggcatgtgtctgtagtcccagctactcaggaggctgaagcaggaggatctcatgagcccagaggttcaaggctatggtgcactataatcaagcttgtgaatagatactgcactccagcctgagcaacatagtgagaccctggctctttaaaaaaaaaatgctagatttttgtctttgaaattttgaggagatacataaagactgagctctccctactatgttctaatgccccccaagaaatggtcactatctggactcaatgaaatcagagctttaatcttgtgtccctgctgccaaatgaatttttttctcattaacttttcaataggaagcccatgtctagggcagtcttgcctgtagctatgtgtatcctcaaagagagtaatttttacttcttcagagacttcagaaatgagcagagactaaagatctatgagctagtagaatacttattcataaaaagcacatatgcatgaagaagtaatacttatcaaaaacaaaccctttccttaacagggattcttcacttctcttgaacaaggaactcactcagagactaacacaaaggaagtaatttcttacctggtcattatttagtctacaataagttcatccttcttcagtgtgaccagtaaattcttcccatactcttgaagagagcataattggaatggagaggtgggtaacattcgcaaattttttaaagatgacaactggaagaattttaacattttgaatgaatagaaatcaatctgattagcaggcaggaagctgtgactttttaaatcttgaggtctgattacttgataaccctggttttcttataccctttcaccctttctgtgctcagcacttaatcttctaggcaaagcctctatcggatttcctggatttcagagctgttaccctacctgagcacttcagagcaaatgccatttcttataaaaggggcttagccccagactttatggctagtcttgcaaagtggtataatatttctttctggtacgtgaactgtatcaacacatttaaaaacagatttaaaaagctatttccacctctaaatataaagagccttaccacttattagaaagatagcatttgataacaatctgaatttcttccacttctgatggctcacttaattcaccaaactttggaaatcatctttgacttttgaaatggtgaaaaacatttctatttttgctaaaatgcttttgccataaaaaaagaagtgtcccaaaaaggaaccgttaacatctcagctatgcaaaataatcaccaaatatatacttttgaataagatgactgcatcatgggaaagttcattatttaaggaaggaacaagatatatttggggaaattcccattagcacaattgaagtatgaagaatatactgagcttccatatatggtgctggtcattccacatttaggttactcaagccatttaaacttggcttcataagcaagtactacaccctcacaatctttttaggttagccgacataatgatttactcccaactgggtgctgcctgagccactgtgctttgcctctgcagtgtttaaagagtggatagttcgcagctgtgaagttccccagacacctgagtccaaactgttgctggattttgcttctttctgtgctccatggaaagctggaagctcctcaactttctcttgggtttggcttcctgttcacatgttttctggccccatgtcaattgtgtatgaagtaatagtcccacatgcgtgcaccatccacgatggcaagatttgtgtggttcagcatgagttttctaatgagcacactttggaccttccaacaaccctttaggaaaagcagtttggaaccagttattactttccaaggtgacggaagctaaaacagaatgttcttttctcttttttttttttttttttttgagacagagtcttgatctgtcacctaggctggagtgccgtggtacaatctcagctcattgcaacctctgtctcctggattcaagcaattctcctgcctcagcctcctgagtagctgggattacaggcacctgccaccacgcctggctaatttttgtatttttagtagagacggggtttcaccatgttggtcaggctgatctcaaactcctgatctcatgatccacccacctcaccctcccaaagtgctgggattacaggcatgagccaccaggcccggcccagaatgttcttaagcaacaagactaaagccacttttaagagacaattaaaggacaactgcataggaaaaatgaacatttaccttacacatctgtctaaatgtgtgtatgtgtaaagtatataaaaatgcctccaattcacagtttaaaaatatcagttactgtttcagcattttgctactgatgaatggtgctagtgttttccactaaggactgttattttaatgacatttctctgcagcaaaatttgatgagtttacaaagtttcagagccaggaaatgcagcttgatttctgaacaacggggacaaccaagagagttaagttcaatcatctagttgctttatagcatggattcctaagtgctaactgcagtaacacactgacacagagagcaaagccaaaccaaactcttaaagtacagctgttaaactatcaagcttaacttctcgatatattctcaacaggtgaaattctggcacacacccacacttacttgaagatggtaatgtcaaattaatcaccatatgtccaacattttatagaattttagagtaagaagagatattggaggtcttccagttttaccttatcctttcattataggaacagaaaaactgagactcatgagtgctctctctctctgtctctctctctctccacacacacacacacacacacacacacacacacactcacaagcacacacacatcagagctgtactgagtcatgacttacagaaaacatcctaagtctgacttaagcaaaagaaagggatgcaatgatccacagctaggccactggcttcctggtcctttcaagtttgtgtggccagcttcagcactgtgggctgacaatttattattgcttgagaaaacattcagagtcttggagtctatatttttaaccaaaacttgaataaactctaaaacaaaccaaggatccatcggtgactcagatcctgactgtcctttacagtgaggctcagccaccttccaatagttactggggccacactgtgatcccataagatggagacaaagcccaagacacaaccctcactctgagggatcctgaaacctgaccagagagatgagaccatcctgcatgcaggccatagagacggtaaactaagtaccacactatgtggcacaggttttaaatgttatgagttctagtgacagggattaatgaaaatagaggctgtcagaaaatgagattttagctgatcccagaggggagattagagttttaatatgtggaggagagaaaagtggacttttccagataaagaacagaggagtgaaagcagagagaggactgtttatgggtgggaccccaaagaagctggcctgaggaaacatttctccacccacgcaatggaccatggagctccagtacagacttaaaattatttattttgagacagagtcttactttattacccaggttggagtgcagtggcacaatcttggctcactgcagccttgacttcctgggctgaagccatcctcccacctaagcctccctaggagctgggatcacaggcatgtgcaaccatgcccagctaatttttgtatttttagtagagacagggtttcacaatgttgcccaggctggtcttgaactcctgacttcaagcaatctgcccgcctcggcctcccaaactgctgggattacaggcatgagccactgcaacgggtcccagacttacattattatctattaaaatgttactgaaatatgtacccaaaaagctatgtataagttgttttatgtttgtatagctataaatacacattagcataattctatttatactattaaaatttcaaaataagtctctaaggataaacgaaacccatacaccaataatactctaattcatattaatcctctttgccagatgatgctgttttgctgaaactaaagaataaatttgttttaactaagtattcattaatgaaattggaaaaaacattttaacaaaaggaatttctattgcatattaagaattacacctgtttataaggaactgttacaagatggcacctatagagaagaaaggatccaggcaatcagtcctctggggtggagattttggagctgagaactgtgagggccaagtcatcctatcacccttctctattctgggaaacaaacaaaccttcatacaacacagcaggaagtatttgactctcacgtgcatacacatatcagcaggaacttaggctgcctctgttctttcttcaatagcccataacaattaaattattatatgattataccacacattattattatttatttttttaaagacattctagctctgtttcctagactggagagcagtggtgtgatcatagttcactgcagcctcaaacacctgggctcaagtaatcctaccgcctcagcctcccaagtagctgatattacaggtgcacaccaccacacccagctagtttttaaattttttggttgagatgagggtcccactgtgttgcccaggctggtcttgaactcctggcctcaagcaatcctcccatctcagcctcccaaagtgctgggattataggcatgagccacctcacctggcctacacattatcattttaatgatgagaaatcaaagtctacatttataaaatttaagaaaattctggtctcatttcatgaaaatgtcttttgattgcaaatatgcaaggaaggttgtatctttattactggtctaaaaaaaatcagtccaagtaataatgattgccgatgtttattgaacccttattttgtgctaggtcgtcttgcaagtttttcacatgaatgttttcatgtaatcctcacatcaaccctatggggtagataccattttaaattcccatttgtcagaggagaatactgaggcatagagaaattaagtaatgtgctcaaggccacatagccagtgaatgccatagcctggtattccggcatctcattccagactcagctgcccggtagcatattcagaacagtctcagaaaaggtattctttgacatcagactgtgccagcctaaccacagccagatacttttgacatcacattcagatgtaaactttcactgtaggagatcatgaggtgcacatacaattataagcacaaacatgtatatgtcctctcagaacatattttacaagtgggcatctgcatgatgcttctaataatttgtgatatcagcaccatggagacaggatggaaaagttcttctagaactccccaacccccaggaggagaagcacagtgaagcgagtgatctagaggcctaatgggtgaggtgggccacattgcagagggtggcataaaactagcggcggcggagtttcactgctgtttggagtggaaagaggggtgatgagagtcgtgtgggaggaaagtgaatcctgcagcaccaggccagctccaaggaggcactgctgcagcaatcttgtggtaggagtgatccatccagagcaaagcaaaggacctggggcttaacctgactcgccaaggccagctcaggataaaaagagattccaggcctatggagggaaaaaatctgcacccattacctctgagatccccccatatgtatacgaaggtacaactgtagtcaccagtggaaaagtatgaagactttaaatgaaatgctttattaaacattaatatttacatgggcatgatcaatattttttaaatgtgaaggaaattctgagttgttaaataagaggtctcatttccttattctatcttatattatgttctcttttatatcatatgcacatttacatacagtatgtatatgtcagatgttcatggcagcaagattgcttcatttgatacttaaaacattaaaatgggaatttcctcatattcaaagtgttcaaatttattttaatcacttacatttttcagctgtcaaaaatgtggaatataaacaaattttaccacttggaaatgcttactttgctagtcatcaaataatagcttgctgcaactttaaaagattccatgattcagcgcgttttcctttaaaataggtctcccaacctgaaattagacagcactcaacctttaaacttggaacactttgtaaacttttaaaaggaaactcttctttaatggttctatgaaatccagtcaaagaatgatatgaaatgaatctaatggaaagtcttttccttgttggagaagcagtcaaaatagaaacttctacaaaaggaccgaatcacccacaatgcttcaaagactcttgcgagtgattgtaagaaaatcggtctggatgaaatttagagaatattgttcctaatgatcaccccctttgaggctgtgaaagggcaacatctgaaagatgagaggaattgctgataaaacgtaactgatggcaattttgctcttttccatcgtaggtgctgacggccacccaccatcatctaaagaagataaacttggcaaatgacatgcaggttcttcaaggcagaataattgcagaaaatcttcaaaggtattcatcaaatttttatctctagcttaaaccaaggaccacctgggcactctatgtcacttgaagaggggaacatttcacggttggggaattgttaagaactggcagaaactgaaaagtcaatggtcctctaccttcccatcacattctcattcttgttgactgagagagctaaaaggggccttccacgtggtagagccatgtcacgaaatcagtcctaagaaatgtcagaagaaccatctgaaaaatgggaatctaaacaatcatatgactattgacatattatgagctgctcaggaaggaagctcaggggaattagggggcagtgtggtaggcccgccatgcacagccatccacaacatactccacagtgtcaggagtgaaagctgtacagatatctgatttattcacagctcgtcttcacagtttctttccttggccagataaacattagtgccaagagctttcatggagccagggagagttgtggcaacccatctcagcaatttcaccttggtggcaaaaacatttctagggtttgggttcatatgagggtacaacctcatgaggctttttcaaatgtcaactttgagagttgctccctttcacccctaaaaactaatgcaatgaaaatgttcagttcctctctatttcattagtcactcttcagaatcattgctatttgcttgattttttttttcttttctttttctttttttttctttttttttttttttgagaggaagtcttgctctgttacgcaggctggagtgtagtggtgtgatcttggctcactgcaacctccgcctcctgggttcaagcaattctcctgcctcagcctcccgattagctgggattacaggcgcctgccaccacgcccagctaatttttgtattttagcagagatggggtttcaccatgttggccaggctggtcttgaactcctgacctcaagtgatccacctacctcagcctcctaaatggccgggattataggcgtgagccaccacaaccagcctgcttgatttttattctaagccttccgttggcccaaggtggcttggaataagtcctgtaatcaccaaaactttcatgaacctcacctaaaaagcaacgtcttcaagtctggcccgaatttcaggtttgccttttgagggttgttttatccagcttctctttctaatacttatcgaattaaacatttttgccttcattctacaagtattacgtgaagaaagtgaatggttcaaagtgtataagacaggttagttctttgacataaagttataagcatcagcagtttttctagaattcttggagctttgtctgaagatggcatggggtattaacccccatggctgattacagcactgtatcagatgcttgtcataaacgagctgaatccacagtaagagaagataagttgaaagttaggtctccttacttcaaagctctaacgtaagaaggaaatattctaaaacagtaacttcaaaagataaatgtttaataattcaatgaacaagttcattgaataactaataagttcaatgaacagaactggaacttctcaagagttatttatctcttgaatcaggttgtgaacaattttctttgtgaaactctagcctgatgcatcaatttttatgttggaaaaaacaaggttggccttcagtgccataccattcaaaattaaccgtagaagagactggaaaacccctgatactacaagagcacccttcatcttctgaagaggtccctgaggatctgatttctcaaagtatctttcttagtttctcttatgctatgaagaagccacttttctttctttccttttttttttcttttcaaaacgaacagagtcttcctttgttgccaggctggaatgcagtggcacgatcttagctcactgcaacctccgacccctgagttcaagcaattctcctgcctcagcctcccaagtagctggaactacagacacgtgccaccacgcctggttaatttttgtatttttagtagagacagggattcaccatgttggccaggatggtctcgatctcttgacctcgtgatctgccagcctcagcctcccaaagtgctgggattacaggcgtgagccactgcgcccatgaaaaggccacttttctacaatgccatgttgtttgttatctagctggtaatctttcatgttgcacttttctccccctaatgtgtgatttcaccactgtgttatgtcttcttcacttctcagcacatctttattatgggaaaatacaagtaagtgtctaggctgggcacagtggctcacgcctatagtcccagcactttgggaggccgaggtgggtgaatcagctgaggtcagtggatcacctgaggtcaggagttcgagaccagcctggccaatatggtgaaaccccatctctactaaaaatacaaaaaattagccgggcgtggtggtgcgcgcctgtaatcccagcttatcaagaggctaaggcaggagaattgtttgaacctgggaggcggaggttgcagtgagccaagattgtgccattgtactccagcctgggcaacagagcaagactctgtctctgaataaataaataaataaaataagtgtctaatgttggatcatttagattcacttgctcaaatttaacatacagaacatttttcttgaaaatctatggattctgtatgagacctggcttcaatctacttttttttaatcttggggctggaaaattcaaatttaatgtttggcttcagagatctctgccccttttcaaccaactccaggatttgagctgaattagataagcagacgagtcacttcccaccactacctctgtatttatatatccacaatcctccttctagtcaattttatggaaagaaatggatgtttttgggtatgtgcttggacaatcatgtttataaaatagggaccactttactggaccttagagtttcaaaatgctgccctgtgcatttttgattgcctctctgctcatatcatttgggtataaagttctttcatttaatattcagaactgcttacctgtagctcattgaacttggcatcacctctaaattacataacccaagagaaagttcaaggagatactataagcaaatctcagaagctgcccaagcatttcctgtctttcagattgccagattgtcccttgttccaaggagagataggttgtattcacatatgagaagacaccaaaaggacaattaaatttcacagcttgggggagattttgagggttctcatcaaaaatgtttacacctatggaacagattgcttttgtgtatgtgtgtgaagcctggttttcagcttaaaatacacctgccaaaatatgaatggcctttattgtaccttctggacactaatattgcactgttggacaaggtttggtgcgcacagatgggataacttagaacagcaactatgttgtttttgagaaaattaagatttttcctagccttgttaatacctatttgggatggaaaattttattataaggatggcttagctgtgcctggcactttatttttaatattattttaattattaagttaaatttagtatattaatctaaatgtaggtggtttttaaaattgcccgtagactgtaacagtaaactaaaccttttcaaggaatcaatatcagatgtggaccctaaaacttatccttgtcttgctttaagtgcatattggataccaagacaatgataatttgtcttgctgcagaatatagagacctatatttgggggtgctaaaaagtagactcttttcctttgtgattccccttacatattttgaaacatttctcattgaagaggacaatttattacacagaatatcaactcatttaaaattaggtatttgttgtaaaaaccatataacagtcgcttaagagttttttttttttaaatcacacacttaacccaaatcagttggtcttttctttataagtatatactaagtagaatcatagaaaattgcttctatttaactattgttggcctacaaaagcagtgatttcatagggtattatctaatattttataaaattggaaacatggagaatgtacaatgtttattgttttgttttcacctacctttgtgtcaaaacggttcatacaatttctgcattgtctttttagttcttttaaatttgtgcattgtgttccattacatggatgtgggacatataagttgctcatgctttttctttataagagagataacactaaacatacacacacacacacacacacacacaatcaatacctcccttcacgtagccattctgtttagttgcattttaatgatggtttttaaattgtcttctcctgcaccatcctcttatccctttgagactaatcactttcacatgtgagacttcaatgcaaatctaagtgataagcaaatgttagtatgtacaagcacacagatttgcacccatgtatgtacatagctaaatggatctgcttagaccacagtcctcaaagccagtgagcttatgtttaaagaaaatgccaaactccaattggatgagaaacattgtgcccatcaggctgtgccatcttttgcaggctcctctctcctcccatctgactgagacctgtcccagcaggtggctctgtcagtatgcttcggctgccagtaaaattgtgctttgcctgataatggtgaggaagcaaactccagagatgttgaccaacccaaggaaaactctttgctcttgccataatgatacattcaggcaggaagttaagagaaaaatagctcttcccctggcaaggaaaggagtttaattacgatgagggtggggactgggggacattcacaagtggatattaaggaaaaagaatgggatgatgtcattctttactgaggcagtcactaaaatgaaatcagctcacacaacaatggtcttgttctatgctcaaaagcgcaagttggtatgagacattactttgcggtgatgctctcaggaagggcctaaggggccgtgctcacatgaaactatttccccaaacatcttgaagacaggtcaagaagtgcagaatcattccatccagtgctgaaatggcccacactggaccatcatttgtttcagatcaccatgccacagtttaggatagaaaaagtgtctggattcttacaacaccatgaattcaaagaggcagaatatagtggttcaatctggtatcaggccagatgttttaaattggttccttttttgcaggataattttaaatggcatactgaaattaacatggaatatattcctcagtggaaggtttcaggaagtcacttcccaagaagaaatactgccttgtatcgtgctagagaatttgtagggctgattaattccacttacagaggaagcatttgatctatgttgatcttgagtccttagttccaatggcaaatattcaattttaggttccttttctcaatggtgtcctaatttgaccgcatttatctgcttagatttcacaagagtgcatcataattataaatgaagagtagactttctaagaagccattcctggaataattaggtggtggggtcaaatcctgttattaagattctgtcattattgcattaaatagggcttaaaacaaataagccattggctgaggccttttttgaggatatttttactgcaggaatatttataataggagaattgaagtactataggctttttacattggtatctgcagtttagagaatttgcaaaaaaaatattttttagtaagccactggtcttcaggtgtacgaacatattgagatatgaggtccttctctctcttgcagattacatgaaaatgtaaaaaaaaatggattacagtggaaattcatatttgttttatgattttgctctcaaattattcaagaaccttgtgtcataatctggcatgtaggggaagctgagatgtgtatgggacaaatatatttgaagactgctttggatcgtggccatcagaatgaaaagaggcacattttgaaggagtccttttttggcagacactaaagtaaacctcagggattcctgctacccttatttttaaaaagaaggtaattcagctgtggggtttttgagagaagataattattatttttttttttttgagatggagttttgctcttgttgcccaggctgaagtgcaatggcacgatgtcagctcacatcaacctccgcctcctgggttcaagcgattctcctgcctcagcctcccgaatagctgggattataggcatgcgccaccacgcccagctaattttgtatttttggtagagacggggtttctccatgtttatcaagctggtctcgaactcccaacctcaggtgatccacccaccttggccttccaaaatgctgaggttacaggcatgagccaccaggcccggccaggtaattatttaaaaataaaaagtaactaaaatatttccaaacaaattgtcagcaccatcagaagttctcaagtttccaagaaagtgcttaatattcttttctatttgtttattagtagcctttaaagaaatctaagttcattatctgcagtcagttgacactagcactgaaaatacagatggaattttaagcaaattcattatttacaaagcaaataagtgagtcctggtatctgacaatgggattcaccataaaattaattttaaaattactaggttttaaatttttacccgaaaatgatttgatgcatttttgcattaaaaactgtatttattacatgaagtataaataccccaggagattaaatccatcctgccatattcatgggagcctgatctagcccgaggtatgatgcccagcaggacacagtggccataggagaaaggttagcagccattcagagcagtcggtgctgtgctggaggcgttataggtattgtgagtatctctcttcatggtaagtagccataatataatgactcataggattcttctctccaaagaacactgtgctgagagtcaagatatcggctctggttttagtcatctaatttactctataatttcctacaaaattagaatgtacttgtcccatttccctcactaggatgtggtaaagaccaagaacataaaagcacttgtagggggagtagacatatgaagccactcaaacacaaccgattgttattgttgtaatatttaaaggataaggcattacatggtgatcattagttcccatcataactgtgctatttccatcaccttatttctctctcattatccttttagttttatgtctctgcctgccagtaaactaatcccaatgtgtattttttaatggttggcaaaaattcaaaaatgttcttgaaaagaaggaaggccatagaattgccaggattataactatgtattcagtgcattaaaaataaaaaataatataacaaaacaaaatagaatgaaaaatctttactggcttaagccttcaaaataaaagtgaaaaatatagcacatactgtattagatacttgttgttggaattcagctgagggttgacttcaaatcatctttaggattagaaaaaatttctataattaactcacctgggacatgtgctgctgcttttaatatttgttgattggctcctgttgggcactaaagtgactgaaaaattgtcatcatctggattccccaaacagcagccagagacaaaaaatgacatccctctgctcactgtccatacgtgtcatgaggctgcccttctcacagggaaatattcaattttctttttgccttttctacccccaagcactgacttatggaggaattttttcaaatgtcatatacagtatcagcttagtagtctgtaagtgctgaaatgtccctcctgggtaaaaggagaggaatgtagtttacatttctcatttgaaagtccatttaggttaaacagctttctggttgtgaaaatattaagacagagtttgtatgacatgacttgtgcatacatgtttgaacgactgttctagtgatagccaacctctaaatgtgacagacaataattctgactataaaaacattgattttttttctctgtaactcatgtagacagtaataccatgtatgcacctagttataactagctgagctattggcttttgtggatgtctgaaaatatatgcagtgatatatgtcagggtagtgcaagaaagagcccttcctaccttaggaagcctttgggaggcgttcaagagttatcacccacaaaagtgaacttgtcttctcaaaatgggaagctctttcttgtcctaatttagagagacccatgagagaagtatggtttaatggttaggaacacagatttgggagccagactgccagggtttgaatttccactctgccatttgctaactgtgacttaatttctttatgcttcagtatccttattggaaaaataggggccagtaatgccatcaacttcattatgctgttctgaagattagatgatttcaaatgtataaagggcccatacaatgcttaacaattagtaaagtgctttatgcacagtaactatttttatttatagaaattcaaaaatccagtaattcacaaagcagaaaataatgtttttgtgttgggttttttggtgggtttttttttgttttttttttttttgagacaaagtctcactctgtcacccacactgcagtgcagtcgtgtgatcttggctcactgcaacctccgcctcctgggttcaagtgattctcctgcctcagcctcccaggtagctgggattacaggtgggcaccaccatgcctggctaatttttatatttttagtagagatggggttttgccatattggccaggctggtctcgaactcctgacctcaagtgatccacccacctcagactcccaaagtgctgggattacaggcgtgaaccaccatgcccagcctgataataatgttagtccatatcatcattacacacacacacacacacacacacacacacacacacacacatattgtcaatgtatcaggtattctgtagaaacctgtctcaggactctgcacccaccctctggaaaccagtactagacaggagcaggacctatgcatgtgcctcacacataatagtaataacaataccttaatcttacatgtttaaaatgtacatttgcacacttgtgacacttattgagaaaaccaaattaagcaatgaatgggaaactactttgggaatatattatcagcatctgtacagatggaaaaccttttttaaaccagtttttaattttctaatttttgttttctctttggatttgtttaccctttggttcagatttttttctcccattcaatcatgatttgacaaatactaataaataacaactaataatcacgaaaatccgataaaaagatcctcctgatggagacttttaagattcagtgggtccagattctgagccctaactggctggatatttttactctggtctagcatctcccctagtacaacatcacagagctgcatgctgagcttcacgaaagagtaaaatagatctgcctcatcaaaacatctgttgagacttaattttttagagccatttttggttcacagtaagattgagaagaaagtacggagatttcccatatacccctgtcctcacacatgcacagcccctccattctcaacatccaccactagggtggtgcatttgttacaattgaggaacctacactgacacatcattgtcacccagagtccacaatttacattagctttcactcttagtgttgttttttctatgggtttggacaaatgtataataacatatattatcagaacattttttactggtttgcaagttatatacattcgatgacttttttacagctacaactataattagccacactatttaaatgatctaattttaaagctccaggttaaacactgcacagaatagcatcctgcccttctattttgccattattaagattccctcattgaaagatgaaaataaaattcctagagaatgatgaaaaaaagcatcacgaagagaagtttcctaagtattatggagatgtttcacacagcatagagcactaattctgcttgtgttttatatttttgaaaacaacactttatatttaaaattcaaaattcaagtcacatatcaaatgttgccataggatctcaaagtaacaaacatagtgttcggtttccctacttctctttctttgtcattaagtatgtgacagtgccaagggctggcaagtccctgctccaccaaagggagagtagaaaaagtgcctcttgagcgagtattgtagaccccatcagcccaccaacatctaccaagtgaaagttaaaggtgatcatcagcatggcctgaaatgaacaacagggccatggcttcttatatgtacagaatccagttcaaatcttttcaaagccagccaaggaccatcggtatgaggaaagaaatatggtattgtaaaaagacaatggagagactccaccacttaccagcttgtgaatctgggcaagccgcatgttcttttgggtcccagattgcctttctgtaaaatgtggataacagcatttacctcataatatcgttgtgagggactcaaagagaagctgtgtgcagaacgtcaagcctagagctggttggagagcgtataaccgagaagcattcatttttctcctcaccttgtcttagcacgagtgttctttcctccttcacctcccccctcttaacttggccctaacatatctcatcttagctaggttccccaggttccctacacaacaccccagactgctcttgcttcctcagacatacccttcatgggcagagccttgcaactgacataggccagaatacccttgtgccacacttatgaaaagctaaaatgtgataacctttgtaaaatattccttgatttccttaacttattattattaacatccagaatttatttctccctttgacctcttatggactttataccttaattatgattcatatttggtaccctactgtcatttatatatctgtgtttcacattagattctgtgtgtttttagactaggatattatctgtctatttattcttagatttagcacagtacttgcaggtagttaagtacacaataaatgttcattgttaatttaaaaaacaaagttgcaacttaaattttaaaacactgagctttgtgaactgccaaaaagaggcatccatgctttgacttgggccagtccccttgtggtaaatttttaagatcacctacataatttttcttctatttgcttatgtgtttgaatatctaaaagactcctgtggaaatagagccagaaataaatattgagaagaacctctgggctggcatctgtcttagagagtttagtgagaaatacagctacataaagagctgttgtgaaaggcaagaactccatggaataatgaatgaataatccccaaagctctttgccatacaccaatgtctcttaaaagtagcatgttacaaagtattactgtggaagaccatcaacctttggtcataggaacactacatagacaactttaagcctaatggtacaatcattcatggctaggaaataataagatataggcatcagaaaagccacatttgtgatcaggtgcctgaaatgaggtaatttaatttgaacaaagcccttgtgaatcccagggggtgaaaagggcacagccaccacctgttgtttcatcagctcaactggactgaaggacagcctgcccatgcccttggtgtggccagggtttctaattggacttccatcatttcagccacattacagaaaaggaaagaaaagattccaacagatgctaatagttgagagacaaatagtaacacacactcttaataagttttctgtgaaaaggctctaaaatgtatttttgttgttgtctaaaaagataatgaaaaggtaacagtataagggaaagtttcaggaggcctgagctttgtcccagctgcataactgactggttgtgtaaccttggtcaagtcacttaatctttctgggcctccatttctcatctgtaacatggaggtgctcactttcagcactgagattgctgactgaactctaagattatgcttttactgtattctaccccagattgtatcaccttgtattagtccattctcacattgctataaagaactacttgagactgggtaatttataaagaaaagaggtttaattgaccgacagttctgcagactgtacaggaagcatggatggggaagggctcaggaaacttacaatcatggcagaaggtgaaggggcagctgtcctacatggctggagcaggagaaagggagagagaagggggaagtgctacacacttttacacaaccagatctcatgggaactcactcatggaacagcaagggggaaattcacccccatgatttaatcacctcccaccaggttccacctccaacactcaggatcacagttcaatatgagatttgggtgggggtacagagtcaagccacatcattcttcctctggccactctcaaatctcatgtccttgtcacatttcaaaatataatcattccttcccaatagccccctaaagtgggggagtgggaggaggctgttccagcattaactaaaagtccaagtccaaagtctcatctgagacaaggcaagtcccttctgcctatgatcctgtaaaatcaaaaacaagttagttacttccaagatacagccagggtacaggtattgggtaaatgctcatgttccaaaagggagaaatcagccacaacaaaagagttacaagccccatgcaagtctgaaacccaggagtgcagtcattaaatctcaaagctccaaaataatctcctttgattttatatctcatatccaggccacactgctgcaagcagtgggctcccaaggctttgggaagttctgcctctgtggttctgcagggtacaacctcctgggctgctttcacaggctagcattgagtgcctgtggcttttgtaggtgcagagtgcatgtgttggtggatctaccattctggggtctggaggacagtagccatcttctcacagctccactaggcaatgcccctgtgggaactttgtgtggggactccaatcccacatttcccctccatacttccgtagtagaggctctccacagggctccactcctgcagcagacttctgcctggacatccaggcatgtccatttatcctctgtaatcttggtggaagctcccatacctcaacccttgtcttctgcacacctgaaggcccaacaccatgtggaagccaccaaggcttggggcttgcatcctctgaagcaatggtccaagctttatcttggcccctgttagccatggctggagttggagcagctaggatgtggggtgccatgtcccagggctgcatagaacagtggggccctgggcctggcccatgaaaccattttttcctcctaggtctccaggcctgtgattggaggggctgccacaaaggtctctgaaatgccctggaggcattttccccatcgtcttggctattaacattcagctcctccttacttattctgcagccttgaattcctccccagaaaatgggtttttcttttctaccacatggtcagactgcaaattttccaaacttttgtgctgtgcttcccttttaaatataagttctagttttgggttatttcttcgtttatgcaaatgaatatatgcttttagaagcagtcaggccatatcttgaacactttgctgcttagaaatttcttctgccagatatcctaaatcatctctctcaagttcaaagtttcacagatttctagagcaagggtgcaatgccaccagtctctttgctaaagcatagcaagagtggcctttactcaagttctgaatgagttcctcatctccattcgagaccacctcagcctggatttaactatccatatcactatcagcattttggtcacaaccattcagcaagtctccaggaagttccaaactttcactaattttcctgtcttcttctgatccctccaaaactatcttaacctctgcccattacccagttccaaagtcacttccacatgttcaggtatctttaaagccatgccccacttctctgataccaattttctttattagttcattctcacattgctataaagaactacccgagactgagtagtttttaaataaaagagatttaattggctcacaactctgcaggctgtacaggaagcatggttgggggaggcctcaggagacttacaatcatggcagaatggcagaaggtgaaggggaagctggcattgtcctacattgctgaagcaggaggaagggagagtaaagggagaagtgctacacacttaaaaaaaaaaaacagatcttgtgggaacttactcactattatgagaacaacaagagggaaatccacccccatgatcaaattaccgcctaccaggccccagctctaacattcaggatcacaattcaacataagatttgggtggggtcaaagagtcaaaccatatcatacctcttggatgagaattgcacctttcatttaagttttgtcaggaaaatgatgcaatgagaataaaaaatgaaaccataaataatttttactttatgttttcttattcaagctgaccctagatttatttctcaacaactgagatagaatctttgttgatacagatgtttctaaatagaggcaaatcctttgttacaaacaggcaatgttaaggatgataatttgtaaataaactaccagaggttctatattataatattacctagtaatattatcattgatattatatgttttacagatacattaaaaaacaaataccttaacaagcttcctaaaaacctaagcataaagtttaaagttttggtgggaaaagacatttcttgtgatagtctacaataccaaaaacatcttctcacctgtgcttatctctcctttaccctgctgtcttagtccattttctgcttccataataggataccatagattaagtaatttataaagaaaaagggtttacttgactcatgattctggaggctgggaagtccaagagcatggtgccagcatctggtgaaggtcttgtgctgcatcatcccatggcagaagggtggaagggcaagcaagtgtgcaagacatagaaagaatggggcaaaacttcttgctttaataggagcccactctcatgatagccaacacattcccacaataatggaaattatctgtccatgagggcagaactctcatgacctaatcacctcttaaaggtcccactttgtaataccatcacaatggcaactaaatttcaacgtgagttttgaatttaagccatagcacctgctttctcagcttttgtaagaagaataaagagtccttctttccttttaagctaattctgatgacatattcctgcttgaaattctaataagacataaatttaggaaccaggaagtaagggttttaggggagattaaaagacttgaggtagggaaacgatataaggttttatcatttaaaaggcaggtaaatgggtgggggcaaaatgaacattaatagcattgatggaagaggcccagtaagagttgaggttatcaggtcctggggacttcaaacagtaactatggggtgagttaattttaagatatgaatagaaaataagagaaaaagtatccagtaaaaaagaagtcaatagacagcaaagaggaaatagaaaacagtttctctatattttcatttttgttttccttgtgcatttctgcatcttcccttttcattaccacagaccacaatcatgctaacactgatgaaagaggaaggtgggaaactgataaatcctccaagtgattggcagaaggaagaaaaataataaatgcacaaataaatcaaagaaagttatatattttacatttatcataggcatatggtttgtatatttttgttatagaattaatcacattgcatttattaggctttcagttagttgaactttttggatctgtgaatttatattttttaacatatctgcaaacttttaagtcattatttcttcaaatatttttccattaccaccgccatcttctagtactcaagttacactgtatgtcagactagttgatattgaaattgttccactgagacagaattcacttttttattagcctttcatttccaatattgtacttttcagctctagaaattgtatttggttcttctgaatagtttccatttatctcttcattatgttcaccttttcgttaatatgctcgagcatatttgtaatagccacttcaatgttctcatctgccaattccatcatctctgagtctttttctcttgactaatttttctcctggttaggcatcacattttctggcattttcacatgtctagtaatacttaattggctgttggaaattgcaaatattacattgttgaatgcctagattttgttttcttattttatagaatattgggttttgttctggcaggcagttaattcacatgaggattagttgggccagaccttttaaaacttgtttttaagttgtgctaggtcagatctagaatgacctacctctcagactcattgagtcctactcttaaggcttgacctttctaaggtttctgcttatgtgtgttcacataaatgcctcatgtgtgatcaatgagttcttcccactatagttagtcagaacttgagggccgactggctgtgtgaagtgtaagttattcaaggtacagcccccagtaattgttctttggccatctttgtagtcttactctacatatctgtagcttaaatattcagcaaaggacttgaggggaccccatacagatttctggaactctttctctttatgtctctcttctctcaagctctgtcccacaaatttcacttcacttccccaaacacactctatcctcatctctgcttagattctcctctctgtgctatagtctagaaagtgtctctagtggagcatacattacttgtgtcccttctcttggggatcacagcctgttcaatgtctgagagttgcttcatatgtcatttgtccagttttctggctgtttatggcaggaggaccagtctggtaccagttatactatcataactggaaaaataagtcccaccacattcatattcaaactttgtttctgtttcttttctccccgcaaggcagtgagacccttcaaggcagtgacagggactcattcatctctgcattctcagtatctaacatatgaagcatagcatatatcaggcataataaatattattgaataaaagaataattgaccattgttaaaccaatccataatacttatggtatctatatttaagtaatttacatgaatatctaagtgcttctgtaacatgtggggtttttttaagcaactgagaataatctattaaattactgaatatatgtaagctagagatcaatgctagagtcaggttagttctatgctaaccttacataacattccttgtagctgtaagatgccagtgtccagaagcaaatatcatatgtgttcaggtatctctaggacaataatgacacgttattctagaataaaaagtagcagggctgttttcagcattcagtctatgaagttgacaaatagagtatctaccttcagagatttctgcctctatgcaagcaaaagggttaaaaactttcagactatagtttcatttatgttagtcttctaaaggactacggtggcttttaatttaaatagcaagatgcattgagttggtcttttaaaagtctatgcagctatcttctaataattaaaaagtagactcacaaaataagaattacagtcagactgctgtaaactacagaaattgggaaggaaagaagtcttgcattttcacattaaaggtttctttctgaaatcttaatacaacatctgtacaagaggtttcgtataagaaatatctgcatctggaaggatgaagtcttaaaaatctatgacgcttaaaatctgcggatatgggcacatctataattagaatacctgcacttcactgtttaaagagtccctaaaattccagttacacacacacacacacacacacacacacacacacacacacacacatcactgtgtctatttcataggtcaacacagggttcacacaatattgttattatcaatcacacagtcttttaatacataatctcatttgatccacaggattcttaaaattcccttttgttcctttttgactatatttctgtttttttttccaatgaaaagaagacttttttaggttaagaactcagctgtgaatgagatgtcaactctgttggttcattcttctagttaccttcagcaagtcaccttttcatctttgttctttgattacacaacctaccaggtagaaataataatttgatctccacatgagagttaagaactcctgaaattttaagataggataacaaaaaactggtgcatatgaagagaaatttttcaaagtaatgtttgtacttgtttaaaactaagcaaaatgacatttaaagaataatgatttaagttcatggtcccaaaacgatttaaaactaaaggttttatttcactgtgtttttttccaacatttccccctttggtttacatttgccagttaagaatttaaagtgaggctttgccaaagccttaggttccacctggtttggggttgaaaccacatgaagccactgaattttgcatagtttccatttgaaatgatttatcagcttgggttctctttcagtgagagccaggtttacatgaaacttggccaagcattagatgaacctgctctgagttttgattttatatcagaccctaaaatgaggccactcaacctaattctgtctttcaaaaagctcttcttataatgtccccagagtatacatagtagttactagagactgaggcacagcaacactttctttcagtataaaatgggggaaaatttctcggctgcttggaacctattctaatttgaaaactagacagatttaatagaggttctagtgtcaagcataacactttagggaaaaatttccttagaagtctcaacaaaagggttttcaagtaaatagctcagaaagaccaggttaattcattttttcctttattttttcctttatttatgcattcattaatttaataaatatttgttgggcacctactacatgcaatgccaagccctgttctaggcatgggatacattactgcacaaaataattagagatcccaacttttgtaggtcttccattctaatagcaggagacagacaataagactaaccacaatatacgtagtatatttgtactatgaaacaaaagtagagcaaaattagagatcagggtgggttgcagtgttaaagaggatttacaaggaaagactcattgaggtggtaagatttgaacaaagacttgaaggagtgaggaagtagcaaccagatcttgacgaagaatgttctagacagagagaacagctagagcaaaagccccaagaggaaagtgtacctatatattacaggaaccacaagggactattatgtcagaaatggaatgagcaaatgggagagtggtaggaaatgaagtcaggcaagtcacaataggctaacacattacctggaggccatgggaaggattttggctatttctccagatgaaaaggaagccacggcaggattttgtacaaaggaaacatacattccaacttacaagaatatataagttcaaaaggctctatctatcatgttgtgggtagatgatagatgggccaaggtaaaaaaaaaaaaaaaagaaacagtaagaggccattgaaaaagatgagtgctttagatttggtgatagcaatagaagtagcaaaagtagtcagatgctagctatttttttgaagatagagccaacagtattgcctaatcaactagatattaaaaagagagaaagaaaggaagacagagagagagacagggagagagagagatggatcatggacgatttttttttttttgagacagcatcttgctctgttgcccaggctggagtgcagtggaatgatctcagctcactgcaacctccacctcctgggttcaaacaattctcctgcctcagcctcctgagtagctgggactacaggtgcccaccaccacacccggctactttttgtatttttagtagagatggggtttcaccatgttgaccaggctgaactcctgacctcaagtgatccacccgcctcagcctcccaaagtgctggaattacaggcatgagccaccgtgctcagccaaagacgaattcaagatgctgtcccaagcaactgaaaggacagagctgccatcaacagagattagaaaggctgcagttgaaagagtgttggggagatagataaagagttcagtttcggaagttgagtttgagatgtctgttagaccttccagtggaaatatcattaattaggcagttagcttgatgagagcctatatttggaaataaagttttgcatttagaagtcattagcataatgtcaacaagtatgtgagtatagacagggaaaagcactaaagtctaaccgccgaaatactccagcattcaaaagtcaaagagaagaggagagaagagctccagtaaagtaggatgaagacaaatgggtggaggagttttgggtgccttggaagccgaatgaagacagtgtttcaaggaggagaatgttatcaactgcatgtggcagtatgatgaggattgaaaactgatcattggatttatccattggaggtcatcggtgacatgtataaaagcaacaatggtgaagtagagagagagaaagcctgattatttaggcaaagataaaatggaagaagaaaaaaacaagaaatatgacaactctttcagggagtttgctgcaaatggagcagagagaaggacagtagctgataagagaagcacagtaaaatatgtgtttaaataatggaagacataaccacctgtttatatggtaacacgagtgatataattttgaggagaagcatgatcatctgggtaaaaaagaagagtattgctggagctgtggttctgaatagatgagaagaggtagaatctggcccatgggtagaagaatcagcttcagacagagagaatatgcagaacctatctactccgatagaagaacatacgtgtagtggagtagatgctggcgggtgaacaagttgaggagttggggagacctgtggaagttctcctccagttgcttctatttccccagtgaagtataaaccaaggttatgagtgaaggtcagggaagagtatgaggagggatgaggtggtgtgaaacagatatttgagagaatggaagagtcgtgggattagggcaataaagtatgtttgcgaggcagtattaggacctctttgaagttcatggcactgaacataacatgagaccatttaggggattctatgttcttctccaggcacatagagttgcacaggtgcagatacggagcagccagagagctggatttaactcaagtttggggaaaccaagcaaggatggtgaagtgagagagggggaaggaggttgagaatgtttacaaaggactgatgataatgactgtcggtggaattataattcactaccctcccctgataaggaggggaattaagacatcaggggccggtgaaggagtgggaggatcaaggattgaagagccctgccttgtcaaaggattgttggggttggcatactaagagcaatgatcagagagtgggatgcatggaaccaagatgatggagcgggcagttaccagtactcataagggctagggttgattagattggccagggagtggcttggggagaggaggggtgatccagaaaggaagaggcaattgtgttcatgagctcacatccaagagctttgaaatcttcaaaaattcagacaggaagaaatgacagcgaagcaggagctgaaatcatttagaaattaggaacaacgtcctagggtcagtcaataactagggaagtagtaggctatgtaatatgataagattagagataagaaagctaagagatttgaggtggacaatagagagcatggagggagggagaaagggacagagaagaaaagcaggccggcaggctttaagaaagattttggcatgacactgattcaacggtatgttcatccattcttgccttgctataaagaaatacctgaggctgggtaagttataaagtaaagaggttcaattggcttacatttcctcaagcagtacaggaaacatggtgctggcatatacttctggtgaggcttacagtcatggcggaaagcaaagagggagcaagcagttcacatggtgagagaggaagcaagagagtgagcggtgaggtgccgtgctcttttcaatgaccaggtcttgcatgaactcaaagcaagaactcactcattcccatgaggatggcaccaagtattcatgagggatctgcccccatgatctaatcccctccaccatgccccacctccaacacagaatcacatttcaacatgagacttggagggagcaaaaatccaaactacatcaaatggatacactcacatttgcattgaatatcctagagttatgttattcaaagatagtatagttatagacaaacctgaataaatcattgcattttgtataaagttacagtttgccaaaatgagattcttcctccatcagaaagtatcaaggggccaataacatgctgcttcttttttttatagtgaaataaacaagaaaatccttagaaaggtgccaaatgatactgcagaaaaaggaatccaatttacacgtagatggtctaggcttactttatgacaataataaagcaagtattttctctaggaaagagagcttaaatctctgaagggcagtggatagctttataacgtataatactggctttattacccttttatggttttgcatcttctctttactttgacaaaagatcattcagaagtgaacttacttcaatgatacctgcacagactttatgcctacaaaagtaattcatagtatttatcctggtgacaggtcagaggagatgatcaaatttttttattttccctagttaagctatatttcattcttgatgccagagaagttttttttaatttcctgggaatcaggaatggcacttttggcaggttctgcaccaatctgagctcacagatgcccagaaattgctcaatggtactaagtctcctaagtaattccaattttgtagtgaaacaaattctattttcttttggaataaaatagagaaacagggccaggtagaatttccctggagtaagtttccttttcgtgtttatgaattatgtctttgcccatggtgagcagtggcaaggatgacagcaggtggctcattttacaaatcagtaaaccagaggaaaccttggtttgcaaggaagttgagtggggagaaagaatattcaaaaggaaaagaatattaagtagaggatttcaaggaattaagttcttgctcgttctttactacaaatagcaatataataaaaattgcaataaacctcccaggcacctaactctatgcagagtggatttcgtggacttcatctgaaatgacaaatctcaataattaattcaacaaatttcaatgcatgccttacatgtgcaggatattgtctaggcactgagactttaatggtgggatgtggcccacaggttccactctcagggagcttacattctcagatgaccacaatctgcccccgtgtgagccgaagttgtgactgcaagtgacaggcactgaaattcctggtgtgataatcggagactgcctctttagaggttgttggaggagggatgaagcgtctttagcacttggaacaaatttcttgaagctctttggtgtagtaacaccctagctctattctttggataggttttacacaaatttgagaatataatatattctctgaaaatgattagaagttaataatgaaaatgtgcaggatcctaagcagaattgtaaagtttggaaatataaattgctcataaccaaatacctggcttctgcaagaccgtgccagcttaaggacactttgtaccatagaagtatatctcaggaaccttctcactgaccagcatcttgagttcaacgaaacccctctcctatccagtcacagagctcttcttcagtttcctgtaaagataaaggacttctcccaaggccgttagctgtgtcttgatgcaaaagagaatttaaatttaaattctttttatttaaataaagatcattctattcttacattttcttttattagtcaatctgttcaaatgactgactttttattttattagtcaatttttaaaaaatcttccatttcaaaatatttgtctcctaaagcttatagaaaaaggcaggccaggcatagtagctcatgcctataatcccagcactttgggagcccaaggtaggaggattacttaagcccaagaattcgagaccagcctaggcaacatagtgagacagtatctctaccaaaaaaaaaaaaaaagaaagaaagaaagaaagaaaagaaaaattagtcaggcatagtggcatgtgcctgtagtcccagctacttgggaggctgagatgggaggatcgcttgagcccaggaggttgaggctgcaaagagctttgtttacactactgtactctggcatggaagacagagtgagaccctgtgtcaagaaagaaaggaaggaaggaaggaaggaaggaaggaaggaaggaaggaagggaggaaggaaggaaggaaagaaggaggaagggaagggaagggaagaaaggaaggaagaggctacttgagtttcactcgggttacaggattggcttcaagagaaagatagaaaaaataataatagactcttgtaagtgtctgaaagagagaattaatccaaaagtactttaaacactctagaaatgcaaataataaaatgtcggtgtgaacagttcttgtttggctttggctggtatctttttcttaagcactcccttccggtttgctgatagctctctatctgctttgcctaggatgacatccaaggcaggcagagtatacaaggactcttcaggacagataattgcatgtgcaaaagtagcttggattcagagcttcattttaacggttcgtaaccatattatcaatctgtaaaccgcatagaaacaaaagatgtcaagagaaaataacaggaaaaaaataacactagcagacagattcctccctacaaagtcttgtagtagaaaccaaaataatacaaaaacctgacaatagccatgtcattgggggcaagcggaaagacaaggtaaatgaccagtagagccagaggaaagaactagaggtcaggaagcacaaagggctctgcagagaggacgaaagacttcattccagatgctcaaagacagaggatggtggtgtcagcgggggattcctgggcagcttagggactaagcaagcacagggctttggtttacttaaaataccagttatgcgaaaaacagaattgcaggtgtctccacaggatgtatttctgcacaggttcctaagtaaatatagaggacagatagatagagtgaacaaaaaataaacaacccttatccatacagacttaaaggcttaaaaatgaatgagattttcattgtgtggtttctacccatttagtgtgggcaagtgtgtatgtgtgtgtgtgtttctttttctttagaattgcagggaaaatgcatgatgaaaaatgatgtttaaataaccaaattcctatgtgtttcactggctgagagcagagagacaaggagggaggaaatgagaaggagggaatctgtgaagagtttgactaaaaattgtcctcttccctcctccaatataatgcatcaaactaaaagaccagtttggagaggataaagtttaggttaaaaatgtgctatatgcagcccgtttctttctttcccaggaactcttttatgtccaactgcacagtctctatcttcctctaatccttttcagtctccttgccctttgcccccacaggacctttggcacattgcctcttgacctcaaaaaatgaggagttcagagtttcagggagattttgatgaaaccacctgctgttcttctctaccattttccccaccactgaattcaaatagaacggtagagggtataaatatgctaatattctgaaccacaccaaatccccaactcagcaattcctgtgagataggacagttgtagggatgggtttgagttaataattctcccaccactacccaaataggaatgggattggaagagcttgtagacagacgtggattccaatctctctcatatggaaaaagtgcaaaaatccaaattctcaaaagattagtcgacttagtattgtgctttgtagtcgagacacctcttgattttctcttacaaaacttggttttctttaattatgtactggtaaactctgaccagaaaactggaatattttgttatctaaaatttcgcttttataaatccaacttttggacatacaactcttagaagaaagggtcataccagtgtgtcctgagatagggcatcatttagcttggggaatgaaataagacaagcacagcatggcatttaagccattagtcctgatgagacatattcacagttggtcaaagcagggaagaaagcaggcaagatagctgaggaaccacagtgggtttgttgttgttgttgttgttgttgtttcaggtagtagttccctgtctgttttaggtttcaaatttaatttggaaaatgttttagttgactaaataaaagacacatgaattcacggatcatagaaaaagaaggaactatagcagagttaaaatgtttgggttgtgaaaataaattagtaatgaaaaaggaaatgcttattaggaactttctatgtaccagctcttctcctaagtgtattacatatacaaagttatttaaacctcaaaaagtctgtgaggttgatactcttactccagctttactaataaggaaactgagatccggaaagtttaacctgtgccaggtgtcacagctagcaaaggggcagagctcccgtcagaccccaaagcctgtgtttattgtaaaaccattatgctaggtgccaaaacaatgcttggatatatgaaagggaaaagaggtgatgttcttctaagaaagccattaggaaattcctttgaactatcactgatgtagctcctaaatttcagaacccctctactctctattcttatgaatcatcaacggttagcactacgttgatgctctaactacgacctctaactacgaaactgaatcgcaccttcagttgtttatgacattgctcttttttagaaacttattgtattaattatctattgttgcattttaagaaaacaaaatgtaagagacttaataataaacatcaatgctcttacacagcttctgtgaatcaggaatgtgggagcggcttggctggatggttccagtttaaaatcttttatgaggttgcagcctaagatacagagcagaccctacattgttctaagggacttactagagtaggaggatcctctcccaagatggctcactcacaaggctggcaggttggtgctggctgctaattggaggcctcaattccttgccatgtggacctctccatggggctgcttgagtgtcctcaccacatgcatggaaactgagagcaggtgatctgagagaacaaggcagaagctgcaaagtttattaggatctagcctcagaaatcacattctgtcattctgtaatcccattggttacccaggtcagccatattcagtgtgggagggagctgcacaaaggtttggataccaggaggcgagagtcactggagactgtgttggaggctgactaccacacttactgtcagtttattaatgatcctatttggtgactcggtctcatttttctgctttagggcaagaccaacagagagatgaaataaatgcagtaaatgcattcagttataattgcagtggacaatctgcccttgcatcttcccaggagagctagcgcttgaggagtctttctggactctcaactccggtcattctattgccctactgcttgcatcaaatgtaggatttgtcactaaacgtcaggctcaccaggatagtcaaacatcaggctctttgagcaaaaagaaaaagtaatgtctagggctaccctacatattcattcagttatctgaaaaatattttttagatgcctactgatggatagagccattgtctatgtggaatcttaggcataatgtaccattaggagggctcagtctgctaattgtagagattctttgctgaaatgaactttagagatagttaaatatagtcaccactccttattacaaataaaaacattgaagtcctcagaaaactaaaacttgcttttgttacttggttatgcctgttctgctttgacttctctcatcgataaaatcaccatcaaaaccactgcctaaaatgggttttagaggttctctctggatttcattgcttttcctctaccgtagtaaccagatgaactatttgaatgaattgtacctctttccagagttcagtccaagagtcataagttgtttatggacatcactctggtccttctgtcttagaaagaggaaaatctaactaaacctcaatactagcattgacctataactaagtaaccactttctatctggttagccaacatgtcaagttagacaactgtcctttccaaagggattgaagctgttggtgtcctgcacaagtggatgctgagaaggggtagaatggaatgaggtaaacaggtacttattgaggacctactgtactccagacagaatgctagcactttcacacctgggccaaccctttaatttccaaaacgatggcatgaggtgggaggcatgatgattatcccattttacaaaagagaaaactgagggtgatttgtccaagaatggttggggatcaagagacatatttgggatgtaaatccagatctgcctgagcctgtattctgacccactaagctgcccaaacaccactctgaactgacttctcagtgaacatgcctagctcatgcctgtgctctgtctcctctcattgtcccttgttgctttggaacactgaggtttaaaaactcttttagctttatgtttgcatatatgtgtatatgtgtaaatgaacagttttcaaatacattgttatctccttaataacagtatcccttttaaatttccccttccccacccatagggtggagtactatgctctgcccacaatgagctctgaagatagtttttgttcttgtgacagattttcaaccaagccaccacccacctctcctccacctcaactcactaagtgttctcttctgctggtggagaaaaaaataaatcatttcgaattttttaatatcatgttatttccctccaaacatgtatatattgtgcttctgcaaaaagtctttcttaaccagtcaatacatttgtctgctttagagttgtgatgacagtaattaatgtggaagctgaaaagtcagatttattatgactgagagaagtctctgcggataacctgtgtcttcacttaatttcaccacagaagtatttttttattctggaaatgttttttaaatgtaagcacattataatcgatgctgcttctttgtctttctctggaatttccaagacgaccttttcctctttgtttctgcttgtagtggctccacagctcagtatcaacacgggaaagagaggcggctctaagctgattacatacgcggccacccctctaagggcgaaactgcattgctgtcagtcttaggaattcacaaccttaacagcagccatggctcttcagcagaagccctgaggctcagttgccagctgatgacctttgatgggataatttctagctttgctaagactgcaagaggaacaagtgaggggttaggaagcaagagttattcatgaagccactgtgtctttattcaagaacgttgagaaacaaaccttcatggctattcttcgttaaataaagtagcatacccatttaaatttcaaaattgttcaagtcactcataaatcctcgaactttatctttttcatttaaaaatccttttttgcctgatggtcttgtaaggaaacaagtcattctatgtcttaaaatgattgtttcaagccaaaataggcacatgagaacattttaaacttcattgaacctcgaaagaattttcaatatttgaggagagaacccttcaattcttttttttttaaaggaactggacaacaatatgaatgtaatagatccattagcattgtgagaaacaggtcactaaccccccttttcattcccacaacaccaccaaatacttttctggttttaataactgttagaaaggtctgctcaaacacagaaaggagctagtgttttcacaagcctctgaaagaagaggatgcattgcaagatctttaaattcattgtacagcaagagaatgaaaaagaatgtaagaggaaagtggacaactacctgtttgacctatacatataatagatttgttactaattagaatcagtttgttttttgttgttgtttttaccatcttgaactttattaggtttatgattgtgcaatagatctctagaactcttttatcttgcaaaactggaactccacattcattgaacagcaactccgccctttccctcccatccttctctccctcctggagtccctggcaaccaccaattttactttctttcctatgaatttgactattctaggtatctcatataagtgaaatcatacagtaaaattattagaaccaatttggatacaaataagatttagatgtacaaattgactaatctggatgtactaatatcaagacaaacaaatgaaaaccaagtatggccacatgatcaagaacacttgcttggctcttattgcctctaatagttttctgtatgctcacttttgtgcaaaagctgtttaaaatccagcttaccgatacctattatcccagcaaggacagggttgtgttgggcagtggaaaatggtaaaacctaactctgaaggcccttggaccatttgttccaaaagcaaacaagttggaaagaatgtgagttttttatattttattttaagttccagggtacatgtgcaggacgtgcaggtttgttacacaggtacacatgtgccatggtggtttactgcacctatcctcaataacttaggtattaagccctgcaatgcattagctatttatcctgatgttctccctccctccgtccccctcccccagtgggccctggtgtgtgttgttccccttcctgtgtccacgtgttctcattgttcagctcccacttataagtgagaacatgtggtatttggttttctgttcctgcattagtttgctgaggataatggcttccagctccatccgtgtccctgcaaaggacgtgatctcattccgttttatggctgcatagtattccatggtgtatatgtaccatattttctttatccagtctatcattgatgggcatttgggtcgattccatgtttttgctattgtaaatagtgctgcaataaacatactcgtgtatgtatctattgtagatagaatgatttatattcctttgggtatataccccgtaatgggattgttggatcaaatggtatttctggttctagaactctgaggaatcaaaatgtggttacttttttacctccgatctgtctttattgtaatattaaaatcaaagacttgtagagaatagcctaaaatcccttaaacaaagttaaaaggcaaataatagtctagaaaaaaaatttgcaatgttcagtgctaaagtcaactatttttcctggcttaagggagttttattcttagcagttatgataatgacaaaaaacatgatatggaatgggaatgagaaggaagctgtcaatggtttgggaaaatattttgctaatgacttcattgagagtaacataatggaagttcatcctgggggctgagtactgtacattctgcattactgaaccctgaagtttgcttaccgaaaatacttgcaggaagtagctactaattaaataggcattctccaagaattggatgaaaattgaaaaattcagaaagcatttacaaataatttgtttaaatgtctttaatataatattacatctttatagtcaaatagttctttaagaaattctttcattaagatcactacattgtgcatggtggatatttttctgggtgagttagtattaactccgtctttaagagaattatttatatatcataagaaacaagaatcttatagtgcatttgaagaggccaactctgaagaattaggctacatttttagaaacatcaccaatcactgaagttttagaatatataagaacaagtattccttccaggaaggtaggaatattacatttcttctacttacatgttttattaccaattcacacttaacattggtgaagtaagcatgatctttcatgtatcacagacttcatttccttgacaaacgacttaattataatactttattccaccactttttttgagacaagatagcagtatttgaaggcaatttgagaagttggcaagcttacaaatttatgagcttatgaaatttatgtgttacattgatacaactgacgtcatacatattttataagaactgccctaaacatagacgtcatcattcataatgaattaatacttaaaggaaatttaaaaaaaaaaaattcagctaagagagtactgttttgatatgaaataatataagactttataaggattgttgtttaaaaacaagcaagttgtttttaaaattagaattttgcatgatatatcaattagaatgctttgggttgaaatagaaacttcagcctaaactgtcctaggcaagcaacaagacaatgtctgggctcacaaatgataattccagagaataaggaaagcatgctgcagttggggctgtactggagctccattaaggtcacctgttctgtttccttccctatctcgcttggctttgcctgctgtggagagctccatatttaggcatgtttaggcccttgtgtttacaatgtggctgctccagctccagcttcacatcttcacagcctgaagtcaatagacaacagagcactgacttcctccactgctcaaacaacaaaacctctgaagtgagtctcactggccctgagtgacctggcgttgggcattgatcagcctttaaaacaatcactcttgctgaagggaacagaagagaggtgcactccagacagtgtgctctatgggagagaggaggaggtgcaactattcctggaagtacaagggatagcaaagaggaaaaattatttcctcaaaacaaaatcagggacagttacaagaatagggtgcagctcctggaaaggaaaaaggcaaatagggcctctagcgttaggatgtaaggagtaaagctctaaccttttttctggattaatataaaatcttagataagatgagggtgccaactaaggagagccagtggggagcaggtattagaaaatgtatgccacctaccaaggaacaacacaaccaccctcatccaaagcaaagccataagaggccgggtgagatggttcacgcctgtaatcccagcactttgggaagccgaggcgggcagatcaccaggtcaggagtttgagaccagcctgtccaacatagtgaaatcccatctctactgaaaatacaaaaaaattagccaggcctgtaatcccagctactcaggagactgaggcaggagaattgtttgaacccaggaggcagaggttgcagtgagccgagattgtaccattgcactccagccccagcaaaaatacgagactccgactcaaaaaaaaaaagccataaaatccctgcaagcaatcaccagcacctcactctttttcatggtgaatgtcacttagatagtagaaacttcgatcaatttaatttgatcatgtactctttatagtatttacgctcaggtgttttgcgcagatcatttcactagtcttcatggtattgctggttaacaataccacccattgtctgtttggtgtcagtgaaggcttgtgtacctgcttacatgtgtaaattcacctggcagctcctaagaagggcttgtctagttcttattcaaacaatgtgtaaaggatcagaaagtaaatgttgttccctttcatcaaacatgccacagaaattaattttgtttatattttgtgtaaactccatgatcctgagtatcattagcaagttaaatcaaaaatagctgatatcttaccactactactatatatcagaagacatttgggctttctttgcagcctgttgtttgtgtttattaacatctttgattggcaagacattctgcttctaggtacatttggttggagggatggtcagagtgtaatctattagccacatttcccaggctaaagtgggctgcattttaaaataatcacttaacaaacataaaattactaaggatggagccccgaagcacagacacctaagaatattttcctttttcgaggaatccttggtatgttgattcactaatttctactcacttagagcaatgtggtagacatagctgctattttttaggccaatgtgtcgaactcacactctcataagcaagacatggagtggtaactgccaggaagtctggtgagatcatcgaaagccatgttcctgctctttatggccctcccagggaggaagggtggtgtcctgcagaaggacccaggcgcttgactgcctgagttaaatgccagtcccctacctactagttgtaaccttggaaaagctattcaacctctgtactatgatgacttcagctaaaatgggggaatgagtcctacctcctccgttttgtaggcacttaatgcatggttcctggcttatactctgtgcccagcaaacgtaagcttctatcattagcacctctgactcactgcacagcattaggagactctgtgccctggggagagagtgaaaccctccagctgggctttcagaacactctatttgtctctgctggtggaaggagattagctagcaaagggatttctgggcatccctgacagcatctggtacacagtagggcctcttagaggtttgttgaatgaatgccaggaccctggctgaaaggtgcttctcatccccaaggtatcaggcactttaagaatagtttcatacatttctttttaataacctcaaccttgtcttctatgaaatagagttcgattgccagaaactgtcattaaatatgcatgactctgttaagagattttttttgaacagcttttggtttccaagagtataccatattaaatagatataaaaattcttaattctaccctcagcatgagtgtgggcatcttaggggtaccccaagaatgtgaatcattcaaggggattcgtcctcatgactaagccatcttctgacactaaagttcaggtgtttaccatttttaccacaaagggggaaacagcctgcagaaacagttactatcctgccatatgtcaggggacactgaggctaatatctgcacgtttggaatgagagtgtgtgacatgcagtgctttgcacaatacaggatgacggcaacttttgactttcaacttctcgctttcttcactcattttcaaattcctcagagactgtcttttcagggcccttttaactgtgtgtctggaactgaaacagaagaaaaagagaaaacagaaaaataaaaatagaatagaaaattgaaaaaaaagtaattttctcaagttttataacatttcaaatcctttttttttttttttagacggagtctcgctctttcacccaggctgtcgtgcagtggcgccatctcggctcactgcaggctccgccccccggggttcacgccattcccctgcctcagcctcccgcgtagctgggactacaggcaccagccacctcgccctgctaattttttgtacttttagtagagacggggtttcaccgtgttagccaggatgtcaaatacttttatacttttttatatgtatacttttttttcaaggaaaaagcctgctttttgttttgtttgcttattggtttttacatttctgttgcctttttttttttttgagccattaagctcttgctcagacacatgcttctcatcccgtccttctatgcaatgccatgaacattaaacccttcagcagccgcgttcatttgcctgcagtcagtgactatcaatttggcttgagatttctaggttaagtgcagtaatgcactaaggccgggcccctttctggagataccagcctccaggagtctgccccaggtagtccagaagttgagttggtctgaaagcacctgtctggaaggcgagggggagtacttgctaatggtatggagaggtgcttggaaacaaagtgcagggcaaaaattagaccatgagagaaagtagaaagtcctgtcatgtcaaaccttccaacactatagtcttttttctttttgcaaagtttagcttattttcttttttctttttttttgtttttttgagacggagtctccctctgtcacccaggctgaagtgcaatggtgcaatcttggctcactacaacctcctcctcccagattcaagcaattctcctacctcagcctcccgagtagctgggattacaggtgcctgccaccatgcctggctaatttttgtatttttagtggagatggggtttcaccatgttggccaagctggtctcgaactgctgaccttgtgatctgccggcttcggcctcccaaagtgctgggattgcaggcgtaagctaccgtgcccagcctaactcattttcaaaacaaagtgatatatgccaggattgaaccctgtagctggatcccgtctagtgtccagggctgcctttgaaaggacagcagaggtccatctgccagtgaattcttcccactgctcagacactcgcctttgtcattcgacctgctgataggctgagggggctgcctctgagtggaaataccttagccattgttcttggaaagaacaacttaaaagctgagaaatggcttttagactgattgggaataaagttggacttccacaactttttacttttttttagtctaccgaataaaaatgatctttttgagaaaccagggctctgtgaaaaaggaaagtcttttaaagatgaaagatctcatgttatttgaaaaagacatttagatgtcctaatatttctcagattatactatgatgtgcaaatatgaaaagatcttgcgcttggcaattgctaactagatatgtagatatgactgcaaacaccaagggatgaggtagccagttcattttattaaatattttacatttgagttgaagaaatacccatagaagagaacattagcatctagacatccattcttctattccaaagtcaatgactaagcccctatgatgtaccaaattccaggtggcctctagagggaaaataactgtccgatatgcgcagggcattcctcgagtctcggggagggacagggaatttctacgatttctacggaagagaagtaagtgtgttcatggcagtgggagttgaagggaggcttcactgaggtctgaactttcttagggtataaaaatggtgtaaccattttggtggaagtggagttggttgggcagacagctgcaggttcatgagcccacaggtgtttttaataacagggctgttgtggggaacagggaaaagacatggttaggccagcatctaagaagattggtctggtacctgggtgaatttaagggtaatttcaggattaacagacagaaggcaaaaagaccattagaagccattacagtgatctggaaaagtaattataaaggcatgaactgtggtagtgatgaaagcaatggagaaaaggagacagaatcgagaagtattttgatgataaaatcagcaggataggggattaatcagatctcatgagtggagaaagtactgggataaatggaaagagaggatacatatggccaccagattcatctctctattcataaaacgatggttgtgccactgaatgagataaagacactaataagaccctaagtcacttttctttctaacacaatgacacggattattttctacaaatagagaacaaaatactagagtatctaatatttgtaaggcacttttgcatttataaaatgtttcactcattgtaagtcatttggtataattacaatgctgaaagacaggcagggctattatattttatggacgagaaattatgtttcacagaggacatctacttctcaaagtcacacagctagtaagtgggagagcagaaactcagattcagaactcccttccaaatccatccctccttccctgtagcaaggccagttcttttggtgaggagccatctccctgccaggacagagacaagctgtttctgccttggtgacagcgtttcctgccttcttgcccgggtttctgtaactagcactgtgcattggtgaccatggtcaggagtggatgttcttgctgtaggatcatattttagggctccacttgagatacatatgtgttataccttctttttcctcttgccacataaaatccacaaatggaaggccgatgaaaagtccctggagcaaatgtactctttgtaattttcacaagacctgtcaaattctagatgactgcaggcatttcattaaatgaagtcagtagggacttactaatgcctctgttaacttcactctaaactaacccaaattaacctggatctcaaaaatctggggtttcaataagaatttctaatcttgaaagcttatagcctttcctatatggcacagctgaaagattcctgaaaacagaaatttaggaaaagggaaagaaacaagcagaacataagtgtgggtttgggagaagcatgatggagaatggtggagcaggaaggtggtgggatttacagggaagaaaggataatgtctccaggcctatatattaatttcccactaaattcaatcagatgtcacagatggcatccacattacacagaaatatgaggttaaagcaaattgatatggaatggccctgcttgtgagaccggaggacaccccaactagtcttaacctaggcaaaggcaacatggcacttcccctgagaagtatgatggcaggtaagcctgccagtgtcgctgaaggaacatgaaagagcatctaactcccatctgtggcacagctaaaagattcagaaaaaccgaggcagtggaaatagtgaaatgcattctcacatttcatccccttgggtttaccctagcatatgatttgaggatgagggactgtaacaaatgcatcatatgtgaaagagaaggaagagaaagtagaaacgaaagacgtctgcttctaacagtgacatttttaaagcaagcacagtaatctctgaacatgtatttgaaagtacagatttcttgttcaaatagggtaccacagaaacacagaaccctaaaatgctcacaggtagaaaagctcaggaagaatgtctttgttttcaaatatttgttagggacaggaagccattaaataagatatgtgggtattgttagtgtatgacatatgggtaaataatgatgtttgttttctagagtggttactacaaaacttaacttcttaattaaaaaaaggaataaagatggaaatggtttaagctcagaactgtgaaggcaccaatttgtagatcactgaaaatatttgatcttccattctttctcaacacttcatccaagctattgatgggaaggaactggagagggagtggaagaggaatatgaggaaggtgtgtccttacttaaacttgaggcttactgacctggaattatacattttctttacagcgctgtcattcatttaaaggtctggaggataggcatgtcccctaacaccttcttcccagagagctggtgacatacagttatattccattcttcttcccataccttcctcattgacataacttctggaggtcactactgtaagaccttgagagttctgcatatgctgaagaatattggggagggcttcacagtgtttaaatatgtggttatgatggaagcagaagacatttcttcacaacatatgcaacttactcatctgagaaaattccttaacccgagacagaactggcttcagtgaaaatattcacagaacatgaaggaaactgctttgcatcaagtgcaatgtgtgtccccagtgtggtcatgatggagtgttctgtggtgtagcagaaaggtacgagatatggcttccttctccactttgagaaacagtgatttgggcttagccatttcacctctccgaatctgttttgacccccgagaaatggggataccaacagtgctgccgagagttactggaggatccaaattagaacaagtatgtgaaacctttgtacagtgtaagtttgatacaaatgatattatcaattacttgaggcctcagcatcctcaattttaaaataagttgaatacgatgacttctgaagtccattcgtgattcctgaaaacagaaatttaggaaaagggaaagaaatgagcagaatgtaagtgtgggtttgggagaagcgtgatagaaaatgacggagcaggagtgaagaggaaggtggtgaaattaacagggaagagaggataatgtctccaggtctatatattaatttcccatgaaattcaatcaaatgtcatagatggcatccacattacacagaataatgggggtaaagcaaattaatatgaaatggccccgcttgtgagaccagaggacaccccaactagtcttaacctaggcaaaaacaacatgggacttactatgacacgcatgacaaacttctatgagtctgtggttctgtgagatagagatttagcaaccatccaattaatgcttcttattgatcaaatcagactatttgtttttttaattactctaaaaacaccactgtatacattccatacttgcaaatatataaattaagcccctggttttgtttttgttgttgttgttgttgtttatttcttttaaattccagggtacacgtgcaagatatgcaggtttgttacataggtaaacctgtgccatggtggtttgctgcacctatcatccatcaccgaggcattaaacccagcatgcattggctattttccctaatgctctccccaacccccaccctcccctcacagaccttagtgtgtgctgtttccctccctgtatccatgtgttctcattgctcagctcccacttataagtgagaacatgcagtgttttgttttctgttcctgcattagtttgctgaggataatggtttccagcttcatccatgtccctgcaaaggacatgatcttgttcttttttatggctgcgtagtattccacaatgtatatgtaccacatttcctttatccagtctatcactgatgggcatttgggttgattccatgtctttagaagcccctgatttttttaatcatctgtgttcaatacctttacatcttttttttgacaaatagccacatcatttaggaatccttatagcccaattgattctctagactgtagcatcctagcatcactctgtgttggcagtgggccacaaatggatgacagatgtgtcaagatgtgaactacaggtgtaccaagatatctacctgctcagcctcaggatggctgggcagttctgggatggccagagccccttggactgtgagtggcctcatctgcttatcccagtgtgctgtatataatcaatgtcagtattttccatgacaggaaacactttgaggatcatagtctaaactaatcaagtttatcaaattatattcatttcatggtagttatgcataaatcaaattggctaaggtgtttcgatttacacattcatgtttctctttctaaactttgctagtttattaataactttagagtttagtaattactataaaatcagtttcacaagtctaagaatagtgtgttgtaatgtattaatttgagtttttggaatcctaatttgaggtataactgagacatttatacaaaacaaatgtttttttttgtttgtttttttgtttgtttttttttgagatggagtctcgttctgtcacccaggttggagtacagtgccacgatctcggctcactacaacctctacctcccgggttcaggcgattctcctacctcagcctcctgagtagctgggattacaggcatgcgccaccacagctggctaatttttgtatttttagtagagatggagtttcaccatgttggtcaggctggtctcaaactcctgatctcctgatcctcctgcctcagcctccaaaagtgctgggattataggggtgagccaccacacctggcccaacaaatcactttttaaaattcctttaaagcatagaaaccttgtttctttaaaaaatccttgctattcagtgaaggcagaattcctattttcaactgaaaataaaagtcctatttgcatgagtgagaaaggaaatggggaaaatgcctgcagatgaagacagataatcaagtttttcttatgaatagacatgtgccaacattcctgtggagttgtttttagtatcatctttgtatccaacttacaattttacatttaggtaagaaaatatagaatatttttagcaatattttctgaaaatactgaaattcttcttttggatataaaatatgaaaatccatcatttgggggttaccacttaacctctttcaggaaaactcaggtagagtccaggtagattgcatgtgtgaagattctaggcttttcattgttgttgttttttaaagaagctaaagagcaattcatggcataataaaatatacttgaatcctaaaaaattataaaaagataaaggaattctttttttttttttttcatttctatggctcatgagagattcctaatattctttatttgacccagaaaccttaaactgcctaaaatattagttgagtttggagtataatgtctgttaagagaatttcttgttcccacttacctctatcaatttcatagcacttaccatatgttattgtttgtcctatttcaaatataaaccaaactcttctggtctgacgttaaaggccgtgttgtcctaacattttaaatctagaatggttgtagaatgagaaaaaacagtagggttagttaggagatataattgggtatttgactacacatagcaaaaaccaaaatagggccttattgactaaaggttttattctctcaagtaaggaaaattcagagtcagggcatcaagactggaacattagccactagggacctgagcttcttttctctctttactacatgatggagcattccatctgtgagaacttctcgtggtccaagatggctgcagaaacgccagtcatgacatgtgacaaatggacacccacactcttttatttcttttgtctttggttttttgggtttttttgttttgttttgttttgttttttggtttgtttgtttttgttttttctttgagacagagtttcgctcttttcgcccaggctggagtgcaatggcacaatcttggctcactgcaacctccaccttccaggttcaagcaattctcctgccgcagtccacgcccagctgatgttttcttttgttttgttttgttatgttttgtttggtctttttagtagagacagggtttcatcatgttggccaggctggtctccaactcctgacctcaggtgatccgcccacctcggcctcccaaagtgctgagattacaggcgtgagccaccatgtccagcctccacactgttttatagaactgtcccacacaatcctttcattacgtgtcactggaaagaaatcaaccttgtgggcacatagagttgctagggcaactaagaaatatcacctatagctggccactgcaaataaaattgggatcttgttctaaataaagaagacaatgaatgatgaggtaggcaattagcaatttgcatcacatcatttaggactctacaacagcaaaaaaatgaaaatgtaattgttttcaagaaatggtaacagaaatgagatgagttcacagtatggagaaaatagactgctgctatcagacaaaataaagttgtgccttatcattattgtatggaaaactattttgtcctctacatttatccccgtggtcaggcaaagctatgattcaagctgaggtgaatttccaggaatgcagcacattctgctgccctctccccgtgagtcctacctagaaaattacaagctttccagctgctgtccacaggaaagatgctaaattcccataaagcagtccttttctatttaaaattttgcgtttcatgtcaagcacaaatgcattttcagtagtataatcaatctaacttcctaatctgtttttgtaaaaagactttaaaatgttaaaatcaacgtatcttcaaggctttccttaaattattaatccttgagtgatttactctgagctattttgtagacatattgttaccaaaatcttgttcttcacatactcttttaaaacataagagtctattaagagtactctgagcaacatcataatgttgctaaaattattaggaagcagcattaacactttaactcactatattctcattactcgggaagtcattacctctttgtatttttactggttggtgggtttgtgcagaaagaataagtaaacctgaaaccaatattctagttgtgtgagttttgtgaaaagtagcaatgaaaaggtttgaaaccagtgcagacacagctttcctttgcttgtctgtacattatattagcttatatatttttgccatctatatccatgaatgatcaagttgacaattataaaacaacaagataaaaatggaaaataattgatttatcatggaaaatagctaccagccttggagtcagaagacctgagtataatttcaggttatgctttctcaagctactgtggcaggaggaggtggggtggggtgggggaggactaataacacctgctctaatttcccatgtaagttgttgtgaaaagcaaatttgatgatttataccaaaatattttcctgaactgtgatgccttgtgaacacagaaggaatcattttatccatgaaagagcaaatatcttcccctgggatttgagatataagaaaccacctaagcataggaaaaatctggttcacagttcaattattatcaatgtaaggtcaggctttcagaagataactaaatatgtgttagaggaaaatgctagttaggaaatagttgtgcactaaccaagttggaaacgtttgactttcatctaccttgactggcgaaaatggctctgtggggtttgttttcatttgaaaaacatgagcgctgcacaccactgtgttgttcagggtaatatcaactcacagagagtatcacacacaccccaggaagccctggggcctttcaaagtgtgccgtctgctctagctttagagtgaagggagttgccaacacattttgaaagtgtattgtacgtagcatagcatatgactttccattcaaaggcaggactcttttctcattatctcactagtgcctgatgaagtgccttatacaggtgctcaacaaagggttgctgaatcaaaatgtttctcgaagttagaataaatggaattgaacaaattgcaggtagtgttaatgcttagtcaaatatctggaaaaaaatctgttaaatatggaaaatggcaaagcaggagtgcttggaacttaatccagctcaatcttctctaagttcatttatctaacaccctcaaccagccagcaaaaacagggaaacacaagcaaaagcaagcagaattctaataaaccgatgatgcccccctacacaagcatttgctaccatgcccatacacaaaggacttgagagagaccctcacgtcttcattcttattttaaacatggatctaatgaggtctaacaagccacctcctggtgtctccctcatgtattattatagaagggagaaggtgggagaatactctccctagcacgttagaagacaagtgtaaacatgccaatgataactagaaatgatcactgatagcaaaggaggtaaaaacaatactatgagaagcatccataaggaatttcaaacaatgttgatctggtgtcatttatgtattgggcaaactgctttccacatcccagtatcacttagaaaaagtcaaaatcatagcctagagcactttggatgttaactttttttttttttttttgatggagtctcactctgtcgctcaagctagagtgtgcagtggcatgatctcggctcactgcatcctctgcctcctgggttcaaacaatcctcccacctcagcctcccgagtagctaggattacaggcatgcaccaccatgcctcgctgattttttttttttttttttgtatttttagtagagacagggtttcaccatgttggccaggctggtctcaaactcctgacctcaagttatccacccaccttggcctcccaaagtgctgggattacaggcatgagccaccgtgcccagacttggatgttaatattgaggacccagagccaaaacaaaacaaaacaaaacaaaacagtgacatcatctgcagtactctttaaagaccaggaaatgtataattaatgtttgaaagtgcatatgttagattttgccacaatccccaatgattgtcaccacctccccacacacatacacacacacaaaccagagaagtgaagggaaccaacatccccacccagggctcccaggagagcggaacttatacccaccccaccctgggctcgaccctatggcttgctttagccaatggcaggtcagcagatgtgccagatgccctgtgtaagcagatgttttgaacagcactcgcagtttccatcagcaatcctgctcctgccatggcaatgccatgcctcagcccaagtcctggagtgagaagagccacagcttggagcagcatggagccactgccccctccatgaaacagcaggagataacccttttttttgttgtgagctttaaagatttccttgtgcaaattccgtgtgctttaaaatattttatttttatttgcttgttttaagttggaacttttaaatagttcaagtaaggcagcatggaaattcatgtatctagagaccctcttttcccctactgtgatagataattgaggtattactgtgaatagcctcagttaaaattgcacttgagatggtgagaaaacagccacaagcagccaaatgcagtgtgttaactagattgtgcctcctgcaccccacaagccaggatgcctggcctcatctccttgaagttagggagacaagtcctgctgggggtgggttgggagggggatctcagaggatggaattttcatggactggggatattgaagatgatgtcactcattaaggtgtgggttaaggacagctttctgtttctggaaaagcaagcaccccagtactactcggagcctgagaatgactgactgcgtgactatgcacaaattatttcaccttctgccttgtcaccaaggattaattaatcattgcaagttgtctcgcgactccacaatgctaaatacaaatagaggagaccctcgaattcatggagctgtgactcgtggtcttgaatattcatttttaaccatgccagtgcactctctcacccagcaacaactctttgttttactgagttctgagggttccccttctgtttggaaggtgaaaggggggctgtacatggtgtgtggctgcaatactgatggcctgttttgttctcctggggagatactgtaaggcacagtggcagattcacctgaagctcatttttgccccccaaaatttctccccattaatttttccagtttgaaattctctaggcatacaagatcttttagagtgtaaatgcacttcaagagaaaatacaaaaacagaacacttatgaaggaagactttggtgtggtgtcatccccattctgcccttactgtgtaatcttgaacagatccctaaacttccctgaatctcagttttctcatttaaaaagaaaaaaaaatgagtgaaaatagttcctacttcattggtgtgtggctatgataaagtgaactaatgactatgaaatgtttaatattggcacatgatcaatggatattagcaaaaattcttgcttcttgattaagagttgagtgtcatccacgtcttggaaattgtgggaatttggaaactcaggagaacaaaaagaaaaaggtggaatggtgagggacttttggcagtcacggggcagaatggggctgtaggatctgaggaatgaaggaggagctggcgataaaatgagggggcgaggggaaaagggagcaaaaagagagaaggaaagaagaccagacatgaaccctttcggttgtgcccagatcccggcactagtccacgtggtgctggaagttactccctgaagtcaggcaactggaaaactagggctccaaaactgttttcccttctcaactgggtatcagaccacgtgtcccaatttggggttgctgtgataagaattgaggtagataaagtcatttggaaagttgcaaacatgaccttggcccaatttcagcccactgcacctggtccccatgattcatgccccacttttccagctcactttgtgtggccgcatccctttccctactcttccacagtgtgggatgaaggattcagctcagcattcccagaggcacctaatgtcatggtgtctttactatcatggtggtttgatacattttttggatcatattgtttaatcgattcgaagtttgtttcctactgcaactatattcacctgccactgtctcaaagaggaggctataggtgatgaaaggcccacagggggcgattggcagatacggctgaacagaattggtaaactgagtcagggctttatgaaaacaaaagccaagtaactcactctgcctccttaatctctggtgataatttaccttaagatggaaatttcagcctgggagtgttgaacctatctttaagcttagcagttgtttaatgaacataacaaactccagcattgctctggcccctgtcagagtccgttacttcacatatgtcaagaatttgagcaaccttactccttcagacatggaaagagagtacgtagaaagagatgttagctggtcatttgaaagccactcaaaagaacacttctggatacttgttgaaggaggtgaaggctctcccatggaaaactccttcagttgttgatgcctaggatagactgtatgttggcatgtttgccttcttggcaactctgggaagggtgatcgtaaacagtcctgtcagctacaaaataattggcgattattttgtagatagaaaataatcctatcttgtaaatgcttagctgcttcagcccatgcgaaggtctgaggagtcagccttcacggaagagacttgcaacacctacttgtctgggcttcacttttcctttcgttagtgctagtgggttgatcgctgtactctagaccagtactgtcagcatcagcatcacctgggaacttgctagaaatgcaattttaaggccgggtgcggtggctcatgcctgtaatcccagcactttgagaggccaaggcgggtggatcacctgaggccaggagtttgagaccagcctggccaacatgctgaaacctcgtctctcctaaaaatacaaaacttaactggacatggtggtgcacacctgtaatcccagctactcagaaggctgaggcaggagaatcacttgaacccacaaggtggaggttgcagtgagctgagatcgccgccactgcactccagcctgggcaacaagagtgaaactatgtctcaaagaaaaagcaattttataggtctcatcccagaatcaaaaatgctggagtaattaacaagacctctagatgattctgatgaacccctactccacgttatgaattaagtacttgagcctagggcctttatttaagggttgtccttctcttgcgtagctcttttaaagtgtccagtattctgaagttaggagccaagtgtggtaaagatgtttcttttgggaagaaaagcttcctcaaaatctaattgctagaaggaagtcagtaagttgtcaaggaattttaaaaaaatcagtactaagattatgactctagcctggatcttcatctttcttgcctggctttattctccaataaaactaattagcaatttaactatgcaaattttggaagatttctgatttggatttagtccaaatatgaaagtagtggtacataaggacatttttcttagtgaatttggaaagcattgatttacagtagtccagtagtcaaaatccctttgagccagatgggcattaaatatgctggcttgctatttgtgtaactacagttttacaggatttattgatccaatacttaaccaaccaatggccacattaaaaacaatcccttccaactctctcccataattaccagtaaaccaccacataggtatgttctgtaagagatgatttaggagatagatagaaacaatcttgaattatttaaatcgtttgttatgtaaaaaaatgtagaattattttgtgtggctcagaagaatacagcatgactaagcatctagaagagaggggaaggcagatttttgttcaataaaagggagaatttcctaatcttaaatctcaccctaaactaaacaggtggcctagtgagtcccttgttacctacacagggacactattcactgatgagtgagaggttttattcattaaaggttgatggaggtgaacttttaagatccctttcagactcagagattccacaaggtgttttccagaacacctccttcacattagctctccaaagtcaggcttgctaacctcctttctcatatatgatctcttccctgaagccatattccaaggagaaaaagcagaaagcagatggcctgcatgccagagcatcatttttgatgatttcacaaaaacagtttatgatcatttacatttatcctttcgtgtgtacttcaaggatatgctgtatgcaagagatcttgatatggagggccagacgcatgtcaaatccaagcctttgtgttttcaaccctgattgaaactaaatacaattatgaaacagaaacaaagatcagagagaaccagcaaattaagaaaacatctagaagtccaccaggactggaggcctcagtaaactttaggagccctggtaaactttgcaggcagccagacttagtagacttctattaatgatggcaactattaatattttgaaattgacaaatgttgttctatgacacatttcatatttcaccatagcgagccaagggaatgttaggcttcagattcacaactttataaagcattttccaaataaaccaagctcctcactattgttggaaatagttgctgtgtttggctaatccacccatcattgaaaactgttttagtttcccctcaatttttatgcaaattttatatataccctaatcaagagaacatgagtgcagtctttatttttgtttttccttaattaataaacatcatctatcttcctttctatgcaggatgttttagtaagcttgcaaatattattaaagattgcttttctttttgaagactgagatattaaaatcagcccaaccctgttgcactgtaatctctaatatcacatcaggttttaataaacctcctttttgcagcacacatgtgcttgagacttcatggaaaccaagtcagaagagagaagggattactttagatgactttaaaatatgcattgtttgaaatggcctctggtgaccagctttcatgaatggctggctttacttgtggggcccatcatccagtttaattatatcagctcctttgtgtgacaagtgctgttcttgcatatgctgagaaatgaaagtttaaaacaaagtagagtaatgagtgagaaaataaattctggaagtggaacacccctgggtgtttgtacggaagaattctaaggactggtccacctataaacatctatttatagagatactccacagtgacagtaagtgtaaatttgccttaaatgtccctggacctagatcataatatgtgccttttcaggaagatttattttacatataagtaacactttaggatgctaatgtggctcttaaaattttcattctataaattcttatgcataaaacttcataaaggttacttttttgtaacattagaataaaatgctaagtttttattagctaaagtatttcccaacttctgtccagccagtaaactaacacagatgtcataaagtttcaagacactacaggttcattatttgaatctataaatgttaggaaagttatggttttagaaatctcctgttgtatctcttgagttgttagcctttctaaaaaaaaagaaaaagaaaaaaagaaagaaagaaattggtgagtcgccgtggctcacacctgtaatcctagcactttgggaggccgaggcaggaggatcatgaggtcagtagatcgagaccatcctggctaacatggtgaaaccccgtctttactgaaaatacagaaaattagccaggcgtggtggcaggcgcctgtggtcccagctactcgggaggctgaggtaggagaatggcgcgaacctgggaggcggagcttgcggtaagccgagactgcgccactgcactccagcctgggcgacagggcgagattccatctcaaaaaaaaaaaaaaaaaaaacaaaaaaaaaaaacttcatacataaactgatctgcattttaaagtttccttgaaaatgtctccaagcaaaggcattggctttaataggatatttgatttttttaaggttctcctgtaagtaatacattttgaaaaaaaaatacagctaatctccataatttgccttgagctaggaactagaattgtcttttgaaatgtgaatgcctccttcacactgtttcccagagctttctttcctggtcctctatctgcctctgcgggaggccaagggaaggaggaaggaacttgtttccccactctgctgtgtttagccctgcaaagaagttagagagcattatattggcagtgaacttgatggcataggaagtaggccagtgggctgggcgtggtggctcacgcctgtaatcccagcactttgggaggccgggacaggcagatcacttgaggtcaggagttcgagaccagcctgccaatatggtgaaagcccgtctctactaaaaatataaaaattagccgggtgtggtggtgcatacctgtaatcccagctacttgggaggttgagaaaagagaatcacttgaacctgggaggcataagttgcagtgagccaagatcttgccactgcactccagcctaggcaacaggcaagactccatctcaaaaaaaaaaaagtatgccaatggggttctcttgactgcagcttcatttatatagtaaagtcaggtgttcctcttcctacatacgactgtgagatagtatttcgagaaatgattttcagatggtatatttatgtttcgaaaccatttctcgtagtacaagatagtgtttccagaaatgccttcaaaacataaatataccatctaattgtctttttaaaaatatttacttcaacttaaaatgtatctcaagaattgtggaactttaaaaatttttgcattgcgccagattatgtacatcaggaaaacagactaaaacgaaacatgtataaaaaatccccgaatctgtcgaaagtatatttttagtgtctaagaatgattgaactttatactgtgagaaagattatgtttcttcgttacttgagatatgtgtctgtgtgtgggtatatatatttatacacatatcttaagtatgtgtgtgggcatatgcacgtgtatgtgtgtgtgtggtatgtgcatgtagagaaagagaaagaaatggggtactagtgaaatgtaatgtttgtggcatagacattagtgctcagcaaacactttggtccactaaattttccagtgtccttgccgttgagtggggccacaagactagtctcatccaatgaaatgttagaagtgaactgggtcacttccaggttgaagccctgaaaagctcctgcacaattcttgagtttattcttcccttgcttcctggtctagttattgcagcaacaggacaacactgcccccatcagtgtgcatccatgcatggctgggcagagcagagttctctgccattctatgtgtgacttgcagtatgagtgacaaatatgcttttatcatatttggaatttctttgttattgcaacaaactacttctgctgactaatgcaatatctcaaggtacttcagtacaaataagccatagatatataaaaccaaaggcaaatttaatgaaatttaatgtaataaaccttatattttaagacctagctaagatgcccaagaccacattttagttctttttaacaatatcgctgcccttcccccaaacccactttatgttttttcatcaacttttattttaagtccaggggtacatgtgcaggatgtgtaggtttgttacacaggtaaacgtgtgtcatggtggcttgctgcacatgtcatcccattatctaggtattaagcccagcatccattagctattcttcctgatgctgtccctcccccaaccctaaagaacccccaacaggccccagcgtgtgctgttcccccacatgggtccatgtgttctcatcattcacctcccacttataagtgagaacatgtgctgtttggttttctgttcctacgttagtttgctgaggataatggcttccaagttcatccatgtccctgcaaaggacatgatcttgttcctttttatcgctgcatagtatttcatgcaaatccactttacctgaagtttccaatgcctcttcttttggaaatccagttgtctcttcgttctcattctcttggatctcactgccaccattgaaaccattgatcatttggaccacaattggtcaccaatgaccattattagtccctttagacactttgtaacatatgcttcaggaatactgagttcttctggtggttttcataatatctagatcactttgttttcctttgtcttgttaatttcatctgaaagaagctggacaaattttaatttggactttatgcattctctaaaatgcccttcggaagcttgtttttatatggttttagtacctgcttttatgaggcagagtctcaaaggcacatttctcacttcatccttctcactcttcaaccctcacttcatccttcccactcttcaactccatctattttcttcctccctgagaagacagagagaaaacctagaaaacttaagtttatttatttctatgttttgtaatgcaacagattattgaaaaaattcaatatatatatgaattaagccaaaaaataaaatctgtccctctccctcaccatacaccagggataaccagcactcaccactgtgtgaatagatgagctttgaagattccttccaatttcaagattcacagtgttgtgtggcaggaggagaggagaaaggaagatctcatcatttagccaaatatttccccacaggtgttccaggtcataggcatacacttttcagctgtcattgtttgttggaagaggatttattattggaggagaataaaagtgttactacaccaggaggggatgattgtctatcttctttgcttggagttgtagtaaattagaccaggaaacaggctttctggagattaacagtaggtgaacttgccagctgtggggttgttaaaagaagaaattagctttttcgtggattcatgtatcttataaagaagatagcacatcctgaagccttactctaaagaaaagaagtaatctctgggagactcaaaagccaaaattaaggggaaagggccatgttaactgatcctaagaaatgtatgtagacagcaatgtaggatgggaggatgagatgtgggtaccagcttcttgctggtgtaattctacttcgcttgcctctgacaataatctaagcgtgttctggctaaattcagcttcgcataactgcataatctcccctgcccctgctgtttcaactgcttatggtgtcccttttttctctggcctaactataaagtgccattgctttgtactagaaataattcttctgccccatccaagagaggtttatttctgtggcgagtgggttgttctgaccctgtcccttgcatacttcagatgcatgggcattcatttgtaaaattttgtgttatccttgggtaataaaaaacacagaattttatcactcatcaacaacttttatctgagaccaggcatttagaactgaggacagtttcaaggctttaaggaaaaaaagtaaatgagaagcttgtgactagggccagacctacagccttaaatgtgagagtctgggcttaactatagaacaaggtacactctaagccagcaattctcaaaccctttggttgtctcagtatccctttatataattaaaatttattgaagacccttgccccaacagtttttatgtggattataattattaatacttacaagtgaaaactgagaaaattttcaaatatttgattcttttgaaaataataaatctattatatgttaacctaaatgatatattttattaaaaaaaactatactttccaaacaaaaaaattgtgaataaattatgaattcattttacatttttgcaaatctctttaatgtttatctgaaaagaaggaagtcgaattcttatttctgcttctacattcagtctgttgaaatacactgttctggctgaagtacagtaataaaatccagaatcacatgaataagtagttggaaagtagaagcattttaatagctttttcagatacttatagatattttctgatactacaacaaaacttggcaagtgataattcattaaaggttagttgtattaagaaatctgaagccatatcaatgaacttttcattctgttacaatagaatccattggtcatcttgtacttcaaatgcattttttattcatgtaagattttgtagcactgtgattatttgggaaatttggttcactgaactatgcgaatattctaaatgttgactcatttcattttacaatatcaaaaaataacatttgttaacatcactaccattgtcatcagaaaaagttttacttattgggagtctgccaagtgtagtatacaagttttccagaattctaattttaacttgaaaggtagatttctatcattggtaacaaacactgtcaattgtttcccttgaaatgataggctcatttcattcattatttgagaaaatgtctgccaaatatccaagtctaaaaaattcttttaagtaaaagtagtgtttcattttttgtttgtttgtttgtttaaagccactttagcttgcagctcagccaccttcatgcttttcctcaagacagccatcatactcccccagccaccaagggactttgtgtgaacctcttatctcagaaaacacaacagtgaaaagaaaagatgtgtactcaaggtcaaggtttaataaaattagtggttttactgcttcatcttaagtgaagctgggttttttttgttgttgtttttgtttgtttgtttgtttttactatatgtgaagcttctatcattcatgctaagacaaaagcggaaagcggttctacctactattgcttttatgccatctgtagaaatgtcagcgcagtgaagaaagcaaataatgtgtcagtattcttatcaaaatagttctgacctcatgaacctctcaaaagggtcacagggtcctccaaacgtcccaaactatactttggacattgctgctgtggacaaaagcaaggtgcttttgatatattggccaccatcccctctagagacctagcaccaagctgcccagccaaagtggggattggggaagacagaggtccccttaaacctttgggagcaacagggcttcagtttagattggggtattgtggaacaaacatatgtgacctaaacttcctatccagttggctggacatcctgccagtcttttttttttttcttttacatgtgacttgaaacatttaatgccacttttatagtttggcttgacggccctaagccaccctaaacaaagtcttgtaaactttccacaccaattgaccataactacaactgctgttttcattttatggcttggagtaaaagcaacttatatcctggtcttgactggtgaagaatagaacactgttcttcaaactcactctgtatgtataagaaaaacctttctgcatttctttcattttctactctttctcaagataaattgttagtctctaaggactcttgttgtcccccacaaagtatccaattcaaacattgcatccttgtctcttctgtcaagctccgcattttgtctgtcaggacttttttcccttctttacttcttttccttctagagctggaaaccaggcagttaagaggatgacaggctttaaaaggtcatttttgaataaagaattgtctgtgtgcagtgtttctagagtggcatgttttgtgtgttttagtgaaggaaggtgagatagagagaggactcgtgctggccagactagtcaaaaaattcaattttcttgaccacttaatgtatatcgttgtaggtatgaattccctgaattgaatgttggtggtggtgggaagaagctgaccaaaagttccaaagttctagtgagacaggaggaataaacattaaagatctgttgcccagcaaggtgaccacagttaataacaatgaattaattgtatgtttcaaaaatgctaacagaatagattcttaaatgttatcactacaaaaaaaatgataagcatgtgaggagatagacatgttaattagcttgatataatcattccacaatgtacacatatatcaaaacatcaaattgaaccctgtaaatatatacaattatcatttgtcaataaaaataaaaattttaattaaaaaaataagatacactgtggcagaaaaaaatgtagatcttttctgcacctttcattcaccagaaaggaagttcatttcataggaaaaaaccactctctcttttccatattaggaaatgatttttgatgtagtttatacaaaggtatcattaaagctaatttgctttttcctaaaggaagaagtaaagtaaataagataaagaaaagaataactagcaatgttgattgggttccagcaaaggttatcagcatctgaattgtcaagaactttcagcttcttgtattgctgattatttaaactcaaatgccactgtttgtctaacgcagtgagcctgtaactgttcctacctggttgctaccatcagcaggggttcatttacagtatagtggatgcacaaaggccctcttcacaaactctcccttcacacacctctgcaggccttgagaggtgagcaaagtttttgctacttaaggaaccaacctctaagaaatttctgtatttaactatttagcctgacccatgctttgtgagaacaagccattgtttatcattttattactttagttttcctgtcccttcatgcctgtatcaggtttctcacgatttaaaacaaatgcacagaaaccaaacagtcagtgcagaataattgcaggctttcagtgttcagcatgtacagcaatcactgtggaatcaccctgcgttattaagaagaaagcaccaaatcttacattagtgacttctacagggctgcgttatcaattggagctgtcttgtttgttgcagataatgtagtcaggactgcctggctgcagacactagagttttgtttaaaaaccgatttcttcttgtctctttctctctcttgcagtataattacaggctgcagagtgaaaagcattagaactgtttacaaaacagctcataaagtttaaaataatggggatacgtgtgtgtgtttgtgtaaaacaaaataatgtgtatggtaggggtaaacaatatccagtctttcttctttcactaccccctgtcaccttccagaattaagggcatgaagttgagagatggagccctttcctcctgctatgcgatgcttacacttaattagttatgcctacttatccaatgccagtttattgttgcagatcaaaatacagattctcaggtgtatggggactgagtggctgatgaaacagactgctatctaattaattttagggcagcctaaattcccataaagatgttccctcatgacatatgagaggaagattttatttttttaatgagccctttgctatctttccaagagaaaagctttcagcaggttagtgttccaaagtgagaggggcatttttccaaccctttcaaaagcctccttctgtgcagctttgcaaagattttgcagctcgcccttctggattttatttatttattttttaatgcggaagggtagccgctgactccagcctcggggccaatcaatcattttgctttgcaggtttaagatctgtgacaaagcgaaacccctgtgctatctgtgccttaccagtctcaccaacaataagcctggtgactgacaatcgagagggggctctgtccacgtaggtgccggcacaagctgaggacatgagtgggacagaggaaccagccttgcacggaggaagcaccttttccttctggtgattgattgatgggggacagtgaggaggttttcagagactggaaaaaattgtcccagtcacttactatgaagtctttgtcagcagaaaagactctccggggtagagaatgatataatgcagatgacaaatgacaggtgtgtgtttcgttctgcttgctaggtactcagtatcacacgcaggtgagtcagcgctccccaacatgccccttgcgccatctgctccccacatgcaaacactcgttcccaacgctctgtggtttccctggcactgctggctcttcctaatcgatcgtcagctctgttggggatgtgtaaagtactgtcagagtgtgagcagggtgataccttaccacccttttatggagctgattatgaaatgaagatagcatttgaatcatttgttagcagttctgaaagttgtttccttctgttcctcccttttggagcacagaagaaaaaatatatgtaatatatacacatataatatgctgttgcaagagactacttcagatcgaaaatctgtttttaaaatcattgactgatatttcctttgtatttttttctcccccttccaggaccctatctgcagatgttctgaatacctctgagaatagagattgattattcaaccaggatacctaattcaaggtattagctctcgtcagaaagcttttacatttgagctctgtgttggaaattctattttggcaatgaattgaaataggaaaagttggaatgagaataaaggacaaaagtgaatttgcaaaataatcaagtgcttaaaaaactacccagcacttgtgagggtttgctatttctgactcatgtgcaaccctgtctctgccagcttatgtgccaatactgacttatttgtagccctttctctgcaactgtgcttggagtttggatttcattttagtctcaccgtctccgtttttctctgactgcccagaactccagaaatcaggagacggagacattttgtcagttttgcaacattggaccaaatacaatgaagtattcttgctgtgctctggttttggctgtcctgggcacagaattgctgggaagcctctgttcgactgtcagatccccgaggttcagaggacggatacagcaggaacgaaaaaacatccgacccaacattattcttgtgcttaccgatgatcaagatgtggagctgggtgagacactggactcttcacttgttagtctcttttgttcagatgatttctcgagtctcaggattatcaggagacattctgaggctttgcacttaattattgcacattaaccaacaccctagtttacgcaatgaacttgtattgaccataaggcatttggtttgtgtttcagcattacttttctgatgttatgcttttgaaatggtcggggaaggggcctgggggagtaggacaatggagaaagagggtcagcactgaagactgtagaaggaaaggattgaaagccctcagttaagacattgtaaaaatatttgggcaaagttgtttcaaagagtatgaggatgtgactgtaattttatgcaatggatatgaatatagactgatactaaaggaactttcagtggttattagtattagagtggattacttattcacagtttgttatagtaattgttaggtaattcaaagttgcagtgttctatatgtcttttggtagagaatccacttactactaccttagatatgatgcttttttatttagcttgcctaggctaagcgtagagcacccagaaagcctgccaaaatctagtgattctaacttaccttctatatcacctgactgggtttcttaccttctcaccgtcttcaatggcccagccctacggtcttgttcataagccaagggccaattcttctagtccacctagtgcaaggcagatagaaagcttgcccctagaagttgtcactaccactcctcatttcttttcctgaacccaaattccttgctctcaggcatcacccagctgtgcttagccatcacattcaacctgactggtagttgaatcttctagcagagcatgctgggcttctttaccgagctcctgaggctcaggttcttgaggataaaactcttcacgctggcacttggtctccatggaaggggactttgctttcccacttgaaaccagacggtgagatcccagtaaagttaattccttgggttcagctggaagcaaatgcgctaaaaagccagcagatgtcattattgctgacgttggtttgaggagtcaacccaacttttttttttttttaacaagggtattgattttcaggcgacaggccaaaatgaaaggtgtcacacatacatgagtgtgtatttagcacatatgatgttagtatgtatgtaagtggtggtttaaatgttttcattcacttacagagcaagtaattttagcttttttagagccttgtgggtccatttcaagttagtttagtgcctaatgtgttaatagcacagtctctgcatgaggattgcaatgttaaacatatccttgccctctgcttgacctcacacctgaactcaccttccttaatatctcacccatccatcgcttttgctacagctgagatctctggatcctctcatctttcccagtttttccctcaccggtttgtcacctggcctgcctgcctcctctagtcttggcctctcttgcccacccttcactcaattgccagagttatctttcaagtatctctctgatcagatcacttttctgcttaagtcccttctgtggtttccctttgccatgagattatgcccttctcctctgtgggcaaatgagttctgagccttgcggcccctgcctgtccccaaggctgtttccctttcctccactttcactctgtgcttcataaacacaattgccatctccccaaaggtgtctggtggcttcacccccctcgcctctatccatgcctttgcacatctcatcccctctgccttttcctctttccccacctggagaaaccctacctgttcttcataacccagttcatgtcatgcgcttggtgttcccaaaacaaaaccaccctcccctccagcagcattgatggaactttcctttgcaccccgagaacacgactccagcatggtgctcattccaccatagccttccatgcctgtcccttccacttgaccaagatcaaccagagagcaagggtgtgttttatgttgcactcctcatgcactcctagtgcctgggaatatagtgggcactaaactaacttgaaatggacccataaggctctaaacaagctaaaattcccagaaataaatataagtattcatcatcatctacctcttcaatatacagcactgtctttaaaatatattaagaaattgctcataactttcttttttaacagaattcaaattttcagccttgtcctatagttcatttattcatccagtaaatattttctgagcagttaccaagtattgccttctgttggaggcatgtgactatcatggtgaagggttatagaccaggctcagccaacccagatatttcctacatatttgcctttaactccttccttgattttctagccagataacatgctaagaactagctcattggctgggtgtggtcattctcgcctataatcccagcacttcgggaggctgaggcaggcggatcacctgaggtcaggagttcaagaccagcctggccaacatagtgaaaccccgtctgtactaacagtacaaaaattagccaggcatggtggcaggcacctgtaatcccagctactctggaggctgaggcaggagaattgcttgacccgtgaggcagaggttgcagtgagccgagatcacaccattgcactccagcctgggctacagagcgagactccatttcaaaacaaaaaaagaactagcttgtttaactctcacagtaactctaggaagtagttactattctctctttaatttaggtatgagaaaaatgaggctcagagaagtcatgtagcttgtggtgagcaagtaaattgtgaaacccagacctgtattagatctgagtctccacagctacgtatttaaccactgtcccttccattaatcagccatctacaaataattattaagcacctcctaaaaacaatcggcaaattcataatattttaggttctgggagagagggaacagaagcaaaagataggccactggcaaaaacaaaatgactaggaaccacagtgaactgtgggttggaggtccagaaaagacctcctttcttggcagaaaagtcatgctctcggtagtggttcccgcttgatggagacttttcctcatttttctgtaatgtgctcataatccttctagaacattattgctctagattttgggtgttggttgttttgtttttgtttttttaccatcttaaccatttttaagtgtacaattcagtactgttaagtacatttacattggtgtgtaacccatctccagaactctttccatcttacaaaagtaaaaccctatacccattaaacagcaactcccgtttctctctccctcaatcctggcaactatcattctactttctgtctctgtggatttgactactctaggtatcttatatgggtgaaatcatacagcatttatctttttatgactggcttattttacttaccctcatgtcctcaaggctcatccatgttgtaacatgtgtcagagtgtccttcctttttaatgctgaataacttttcattgcatatatgtaccacatttttttaacccattcatccactgttggaaatttgagttgcttcctccttttccctattgtggataatgctgctgtgaacatgggtgtacaaagagctcttcgagaccttgcttttagttattttggagctatacccagaagtggaattgctggatcatatgatactcttatttttattattttgaggaaccaccttactgttctccatagcaactcaccttgttacgttccctccaactgagcacaagtgtcataatttttccacatccatgcccacacttgttattttctggttttgtttttaatagtagccatcctaatgggcatgaagtgttatctcattgtcactttgatatggttaggttttgttttgttttttactccagtgcaattttctttgccaagtgctttaataaatcttcacctaatgcaaacctttttgcacctgtaatgctgtaggcaattttggctactgtgcctccaaaaagaaagtaacagacttagtaaagacttagaagaacaattatgaaaattctaatagaatacttttctcactgggaaagcataaaacaatcctatctgtttatctagaaagatgaaggctgagaagggctataatcaaagtttataaaatcgagccagggaggaaagtactagttcattatgagcaggagcccttcccttcactttcaggacaaataaactattactctgtaaagggagtaagacacataaggaattcattaataaaagtactagaaccttgcatatggataacactttatcttttcccaaagaacattttgttcacattattgtgaatgaatattgccatctcacatgagttgggtgggtaggacaaagatcatcatcccaggaggaaacagcctgtggaaagatgaaatggcttaaccatggtccccttacttctgaatttgcttttcccacaacttaagaagttgttcacgttgtgcctatacccgtaagtacttcagagttttaggctagaataatgggtggaagatttacaattttttaagctaagtaaacacgcaaggaagtgatcaacataaagttcaggataatggctaccactggggaaaaagtgatgaccgagagcatcagtacattcacattctatttcaaaactgaaaaaatatatatctgaaagaatataatcatgttaagttttgttaaagctaggagatgcgttatttattctgttacaccctacacttgaaatattttataaatcagaaggaagaaaataaaaaatgtttgagggactcctaactttctgagcctagcatcaaagaaattgggctctaaatctttcccaaatggcctttggtgctagtctgagaaacaaaatactgagcagattagaccattgatctgactcaacatggcatttcttacattcctaggaaattgacctgacaggaacatctcagtaacattgacccgatgtttctcttagatcatatgtatagggaagctatgagtacatggagatattttgtttctttaaaacaaaagccagaacacaagatattcagaccagagctagcccacagatgtatgttgtttgatgagcatacttttcagaattaagccaatattttaaaatcatattttaaaatatatataacatataaaaaaatcagattctgacgtttcttgaaaattcaaaaaatgaaggcttgtattcccatgaagcagtcatcacttggatgtttgaaggggagctgcagctgctctcggacactgggatcccccactactgtgttgtccctcaataacttatgccaaggtgcaggtgccatttatcattgaccatactgctgtttttcttatagtcaggaaaagctctataaaccatgtctctatcaaaggtaaaacaacaaaaagacacaaaaaccctctgacttttcttatacctggctgccttcacttgcctaccttatctatgtagccctgtaggcatgttaacttccattcctgtaagtagcttttaatggccttgtgctcttttggaggggccaggaggaaatgatgagtcttagtgatctggaaacattccagactaatttattatcttctcttttttcccttcttctcccaactaccttttccccctttggttttaggtaaaaaacatcttttttttttcttgccaattccatagtttgggtagaaaaaaaaataccatttaattttgttattttttatatgcttatgcttttagaattagaatattcaatagatcatacaggcattttaataaaggaaatgtcactgtttcatgtttcatactttactatgaaaataactgttggcatgtgaaaatggcagggaagtacctaatacaaacgacttaaatatttaaagcattagccttacttcatcataaaagaatgacatcgacaaacacccctccacaatcagtaagagctgggtttgcttgttgttgtcaatcttcaaaccatgaatgctctaatccacatggaagtatctctctaggaagccaggtgtatatgaatcccacatgtctgggatttccataagtgataatgacaatatttactgttgaatttctggttctgcgagtttttctggacatgacaaacaggtttgatgaaatttttaatgtttagtaatacaaaatactgtatactcaaatgctaagatatatgtatcgggaaaggtaaagctttgttttgaagtttaaacatgtcaatgaagtaattcaggatctccgtgtgattttagcaaagtcatccaaattagggggacattttctccgatcctttttcatacaaatgatttttgtatgaaatcattctgtatgaaatgattttgggaatcaagtagttggagtatataaagtgatttaaattcctcactatggttctgtctagccacaacctatcacatactccatccaaagcactattcctggagctttgatttttaactgtgccaaaattgccaacatggtggatcttgatggattcctgaagggtggcacttctcccactcccagccaccgctgacctcttcagcatcctggtccacagccgatggctgtcacagcatccgcctgcaggagcaatggaagatgttctcagtcccagcctggaactggggcactgggacagtgtgtcttggcagtcctgtggcctggaccttccctctcatcaagccagcccagtcagcagtgcatgcacaccagctacacagacataatcacggttgcttcagagcatttgtgtctggctcccacttcatgggacaacttaaaataacaatgaagttgggctttttgcttagggtgaggagtcagtgtgtgtagaaaagggaagaattgatatttgtatttgaaaaccaatatcaacattttaagtcttacagcatagaaaaggtagttgacctctgttctctcctccagcttttggacttcagatgtagattacagagaagaagatggaagaggcaggagaaaatttaatgtgatggggttgaggtgagcacatagggcaaccacagccacctcggcacactccttacaggaagtacttgatggcatcctgccgtttgctcagcaacaaccttgtaaactagtcggagtggggagcgctattagaagctccattttacagatgagaaacacaaaccaaaaaaggataaatgacttgctcaggctaagctgtggcaaaatccaaatgttttcccacatgttcaagtctagggctctttcccttctcatctttatcatcctcacccctgccttgtgaatctgattatgagtgttcagctttacaattcatatcattcctatgaaataattgttgtaataactgagaatcagcaccgtttgcatttcaggcacccaaggcctgaaacctacagaagtgaagagcttcagcttaaaacaaaactgagcccttccacttatcggacagacattgtcctgtccactgctctcaacagctgtgaataaataactatgagttttattacagaatcatttttagtaaggtttgccaataaaaaaatcaatggcacaatcacagtgggaatatatacagggtaaggcagtgttattgactgacattaatcattgcacagccattaaaaggtgctcgatgctttccttactggtacacactaacacagtggagtgaagagattcagattcctgcacaccgtcatctgtctctacccagagaatccatagagatcagaggcaacaattaacgccaccatggcagtcagcagctaaagacagacagatccacagcccactcatgcctcatctgtgcctgagccactgagaccatttcagccttgaggggagggtaggagacaggtgttaatgtcagtcagtatctcctctaagaggcgagaagaatcaaaagatgagagtgcagaaagagagacctatcgcgactgcaagcagacgtcaattctgtttctcatcttgaaaatgtcaatgtcacagccagcattcagcctagatagagctcaagagcatggtctctgggaagactgcctgcatttacttctgggttctgctactgagggtctgtgtggccctaggcacagcatgatttagccttctgcacctccatttcattatctgtgatataggaataatagctactagcacccaccacaaaggattattgtctggatcaaattaattgctcatgtgaagcacttagaagagaacctggctgagagtaagtagaaaatcgatgtttctttttcctgtctacaatataccttatagtcttggcagtgatctaagccacctagatcactcaaaattaggcacccactacagtctcttccagctctaggcttccctgattctgtgtccaacctagaatactttttcaggtgagattcactgagaggcagcttcggcttcacccaggtttcattagaaacacaaattctcaggccccatcctggacttactaagccagtatcttggggtgggtacaggattctagggcttattatgcccttcaggtgattttttaaagttggacaagcattgtctcagaatctctttactgagaaccttcaagccagattcccactttttgttttgtttttatgagacagagtctcgctttgtcccccaggctgaagtgcagtggcgcgatcttggctcactgcaacctctgcctcctgggttcaagcaattctcctgcctcagcctcccaagtagctgggtctacaggcgcatgccatcatgctggctaagttttgtattttcagtagggacagggttttaccatgtcggccagactggtcttgaattccccgcctcaggtgatttgcccaccttggcctcccaaagtgccgggattacaggcatgagccactgagcccggcccgagattcgcattttcaaggaccccagtggtggagctgtattcttaacagtgcctatggggatccactgttgtcttggttccttttgacgtgtggactggtgggagccagggcatctggagggattgcttgggagccctacacaatcagctcagttagttaagaaaaggatgatactgagaatgagaggagaatcctagctggggcacttccagcagtgatgaattgggataagttttagcccctgtttttatattattttgactttaaatcagatttctacctcggtcccatatttgtagtctaaatgagtctgtaaactagagattacagtgctgcgattcagaaccttggatgatggcctcagctgcatttttcttttatttgaattctgctaaggctcataaaggaaactgggagcttgttctttgaaatagactactggacactgaaaagccatcaacagggtttgctgttttccccaaaatcaagatactcagtaactaactactgcagagatctaaagaggagcaatgagacatggtagaaatcttcagtgtcacctttcaccctctttccacttctacatctccgttcatccacttatctccaggatattccccctgtgtgatcaaccaacacaaatataaaatgcaacatttctaaaatggggttttaaaatctcccataaggcatattcctttttagttacttcttcaccatcagtgaaacgattggtttccagttttcttctcacggtgaaaacttcaaggtgttagccaactcccagccttctcatgcatcaccacatcacttgggtctgcttcttagggtcgctctgtgtcagaggcatagtcgtccgagttcttctttcctcaggggtagacggcttcagcgacctcatctgcacccttcgtggaccagcagcagtgtgccctcctcaatccacacaccaccattgcaactgcaacgcctctcgaggggattgcaatccactgcagcagcaacaccttacaaagacttttttcttaacatgccgttcgtgtctttgacacagaacataactctacctttgttttttttattctatcacatccagtatctctgcccagccttcaagctatttgctaaatctgctttccacatttcatgaagagaattctccatatttctcttcatgccaggaaatcaatgtgttgttctcatcactctacttgtttcttcccacctccagagcatcacacatgtcactcgctgcaatcccccaatgatatacttcacccatccgacatttacttcctcctttttttccatctgtcctcatctctcatttcagaactcttattaagccatcaatccaagttccctctatttttatatgccctgctactgctgtattcacattgttacgtgtgcattgctttgcaaatatccccaagtgatttttctatgtaggttctcctctagagaatttattactgaagaccagaggcagaaaatttcccatttcttttgtttatgctacacttgggagatcagcccggaatgctgaggttgatagaatgttttgcatgaagtaggcactcaagacatgttattcattgactacaaaaggttgcttgatgccctgaagacaaccagaagagaaagagcagttaggattgctcctagccgaggcatattttagggagctctaatgagacccaattagaaaccctcctcctgttctcatatgcgtcatgtgaacggtaaaagctagtatatgaagacacggggctaactgtggctttttggactgttgcatgcttctcttctgccctgaatgcttgcctggtttgcattacgatttccttccttgctggaaaacatagactttcttcctttctttggaagaagtgggacctgttggaaatctgaggctccaagattcaaatgcaatgggcttggctgtagtgctctgtagtacacttcttgacaagtcctgaaaagactattgaattctggcctgtgcttttctgcagtgtttggatgtgtttcagctgcagtgtttggctggacagagtaatcgaaatagtttttttttttttttccttcctcagcaatcttacgttaccagttgatccttaaagttaaaatggaatattttacaaccctgcaaatactttcgagtgcaatcgaattatagctctttcacaagcaaacagcctatctttaaaaaattgtgcataaataggtcaaaatataaattgatgttgttatcctaatagaaaaactggcaaacatttggtgagcttgctagaggataccaacttgcattgaagatcttttttaattattattaaacaaacacaggcattttgatgggacttaatatggaagaaatttttttctcttttctttcatacgattaaaatgctatagtagtaatctacactagtaatctagtagcaatgtcactagtagattgcatttgtgctgggctgggggttttgatgctctgtgtatcaggctattgttctctggtaatcttcaaagggctgctggcctttgaatctgctccatatctaaaattctagctttaattatcagattagcctgcatttttttttcttcgtgattacagggaggagaagtgtatgtttattattctgcaaaatacttgagatggtaggatctcaaatgcttaattttgttgtagaaatgagagctgatcaaattatagactcctttaagctaaggaaaggaaatgaataagtcagggaaacagaggcactgaggggcacaatcgaaataggcattcatgtgctgcactttgctaaacaatgctggcactgtgcctttcagggtccctgcaagtcatgaacaaaacgagaaagattatggaacatgggggggccaccttcatcaatgcctttgtgactacacccatgtgctgcccgtcacggtcctccatgctcaccgggaagtatgtgcacaatcacaatgtctacaccaacaacgagaactgctcttccccctcgtggcaggccatgcatgagcctcggacttttgctgtatatcttaacaacactggctacagaacaggtaagggatgacgtttctagcccatgaacgtcttgtaatatgtcttagactcaggaagaagtgtcatgtaatgaaatgcatgaagttccaacaaatacctaaaaaaggatcaagtgtttttaaactgcttgacatctaccccagggtctgggacacagtaaatgatcaaaattatttattatttattaattaatgaaaaactgatgggtaaatcaatcatgtgtaccttgttgattcatgtatttgttcattcataattaataggatttggaaagtttctttagcttgtggttgtttttaggtctcaaatgttcacttctaccttccaggaaaggaagtcatcctaattgctacacctcctattattgtttaacctacacagggcaagaagaggtttttgattaattggttttttgaaaattggggacttctttcaagaggggtagtgaacatcatgccagtctttctgagaaaaaagcaaggttccttctggtaatattagccccaaggccctatcctcccagcatgtagatgatgtccttgggttttttgtagcatttcttcataaaagggcacaacgttgttcgtagaagggctacagtgcagacatgggttgttgcttgtttttatttttccagaatcacctaggcttattcataagaatcaaatatgttatgattaaagcttgttcaaatgactttcaggcctacaatttctctattttgaagatttaaaagtaaaggagttcagataaatattctcctgcatctcttttaaaagtgaaattaatctttcccactggactcaggaaatatatggccatttgcttctttgcagagcgccctacgggcacttaatacttgttatttatggatgaaaatattgattgtgcatatgatagcactgtcactcgcagacagctcaaagtctcgactcgaagcagctcctcccgtgcatctcaagggtgttttcttatgcgtaggaaagaaactaggttacgtagaggttacagagagtgccttatctgagtgtgttttctcacattagtgatttaaatttatagcacctttcatttgaggactctaaagcaatttgcaaatccaccaaacatccctgtagagttcatagatggcaaatgtacttggctctgttttataactgaggtggggatttcaaatattgcgtgaccagctcagaaacagaatcagaggcggttccctaataaccggttcctgattttaaccatcaaattgtgttttgcttctgggaagtgttgtgtgaaatcagtgcctttcacctcccaggttccctagtagcaaacatggaactggaacgattgggactctcacatatccagagtgaaatggatgacatttgtcataagaaatagagattgagggtgagacagggccctgccaggacttagagcagtcaactagggtttgctaatttgtttcagggctaaattaggaagggcaagaaagaagggaactccattttgccattatctcacctaattcctagggcaatcttgaaagaaaggaatttcccatgttactaatgaaaaaaccgagactcagaaaggctaattgtctatggtcatgagctagtcggtgatggaatgaacccagcacatctgactccaaagtctttcctctgttcattgtcttatttatttatgtaatgattctcttctgcctcattccaaaacgccttccagagatacagactttagaagctacagacccatgaggaccctggcaaacagaaacaaagagtaggactagctaaagtcaaggcaaagattgctgtacaaactgcttgctgtggagttgtagggaaaggtggaatatttagaactaagcatccagatgttaagagcaaaaatggaaacaccatccattgtaaagttcacccagtcaccgggataaaaacaattcagttgcctctaagcatgtttcctggtacttgcttcggttatactgtgctatatccaccttaagagggattgagagagtttaactaaaactcaaagatgatttagttccatttccttatttttagaggagcaaatttacacccacaagaataaagtgactgaagtgacagatctgactgttttttatttatttgtttatttattttattttattattattatactttaagttttagggtacatgtgcacaatgtgcaggttagttacatatgtatacatgtgccgtgctggtgtgctgcacccattaactcgtcatttagcataaggtatatctcctaatgctatccctcccccctccccccaccccacaactgactgacgttccaatgggaagagccggcaccgggaccttagtcttcagggctctctccagtgtgctgatcaaaccttaagaatcgggtctgggatgaaactgtgtacacaccggaaggcttccctgttacctcaatggactgtcacttttttgtgcagcccgagaagtttgtttcagtcgatgtcttctccagggagagtagatttgctcctggaaactaaatctgtttctaaaccttttccccagggtttagacacttaggtaataatacaatttatagtgagtcaacctccaaaataaaaggaattctttaagggaaataaagacttttccaaaaacttagttaacagtaggaaaaggggctgggtgcggtggctcacgcctgtaatcccagcactttaggaggacaaggctggcggatcacgaggtcaggagatcgagaccatcctggctatcacggtgaaactgtctctactaaaaatagaaaaaattagccaggcgtggtggcggacgcctgtagtcccagctacttgggaggctgaggcaggagaatggcgtgtacctgggaggcggagcttccagtgagccaagatcgtgccactgcactccagtctgggagacaaagcgagactctgtctcaaaaaaaaaaaaaaaaaaaaggaaagaaaaaccagtaggaaaaggataatatgggctcaggaaaacaaatctagatttgcctattagtaaatcagaaaaaataaaaattggggccgggtgcagtggctcatacctgtaatcccagcactttgggaggctgagatgggcgtatcacctgaggtcaggagttcgagcctggccaaaatagcaaaaccccatctctactgaaaatacagaaattagccaggtgtgttggtgcatgcttgtaatcccagctactcaggaggctgaggcaggagaatcacttgaaccaaggaggcagaggttgcagtgagccaagatcgcaccattgcactccagcctgggcaacaaagcaagactctgtcacacacacacacacacacaaaaaaaaaaaaaaatgggaagactgaaatggcagtgatagagatctctataatttaatttatccttgatgggaaaacattacagtatctcagacaattaggaagtaaaaatgtcttcatgacaatagttattgatccaaccatggacaacaacccatttgaaaatacacaaataagtacacacaagtggcaggaatcttagaaaattaagagaattggtaggtagatattaaaccaatgtaattatgagacactaaactagtagggagaaagtcaatgtgtaaagattctattgctttcctaataatgaatttattatttggaacatttagctacaaacctaagaaaaataatgacggaaactgaaatatgtactatacatacataaatatccatctagagagtaagttttatgtagaataactcagagaaaacaaattactaaagggcttattttgggaggcgtccagaatccatggatttaaatgagttgaattaatccaatattatatttaccattgtatgacatgagttttctctttcagaactgaggcatatttttggactggctatagcctaaatttttctaagtttactcatggaaaatatgagtctatgagagcttgaatgttcaagaaggggaaaatgcagtaacatgtcgactgcacttcatattctgacaagtgaaataggaatgagattggattatatatcataaaaatgattatcctgcctgaaatcagctccaaaaaaattaacttaaatttattatgaggatatcaacattaatataaaacctggcttaggttttaaggtaaaaataattatccatggttgagtgatagcattaagtatttaacaacaacaaaaaaaactgaagcaagattgaaaacatcgtggaatcacattctaccttgatttgttttgaggacttggactggccagttttccaatctgtatgatgcagagattggcctagaatgattcctaagttttctttcttgtccaaagttacagtgtgttataactttattatactcatggtaattataatattgattcatttaacaattgtggtatttgaattataatcctaacacatggtacataaaatcacatatgagttaaatcttaatcacatgaattctacctcacatcactgaggtagaagggacaatatttaatagacagctgcaataaatatttttgtgaagaattcttttgtcataaatcaaaatcatagaccttagttctgaaaaagaaaaattatatcaaataatggtaaatacaatattggatcaaaaatttttttgtctttttacgttacaaaatttatgttacttatagcaagtatatttattctctaatatgagattttttaaatgtagagttcacttaaagtaagacaaactaatattcttaattttattatgatgtagattcttgatacatgcataaacatgagaaatgtcatacatttattaaaccacagtgtgcttggaacacactagacattgggatgaagacatttaaaggaagattcctgtcttcactagacttacaatctagttgaggaaaccagactgctgtatacaaactgacattaatcataattttaacttggttcaaaattatttatatttatagttactagcgtgaaatccatcaccctaagtctatcaattacgtggattaaaatctcaatatatcttttgatacattaaataagatttgacttttctgcggcatcagatctttgggttagtcactattgctggctttaaaagaaattccttggcttcaggtagttcctggaaatttttctaagcattatggaacaggttgtcctagacagaagtagcatggcctgaagccaacaataattacaatcaggtcttctgatctttctccctgccccccaacccccaccaccttcttaaacagctgtgaagggaagtgcttaatggtatccaaaacaaagaggatgggtaaatggcacattagtgatgtattcagatagtaggagttgaattgaattgccaatgccgaaggatagaaaaatattgaactatacgtaacctacatgtagacataatggcagtaagggcaagaaagctaaattcaccttaggaagggaaaaagagatttaatacatctggaggaaaataattagagggccagataatcaattgcagagcgccgccaggaaacatcgtgttgaaagaggccggggtgattacaaacgagtctcaatgtcatgaggcaacaaaaaggccagagcaactggaggccaacagtgctgcaccctgacacccaaggcccccatcagccttggaatgagtgtgatgggtgagcgcacatctggaatactgagtacatttcttacgctccgttaacacagagacaccaaaaacctggagggagttctgaagcaaataacaaggactattaaaagacttgaaggaatagtttataagggaaggattaagtcaaaggggaatgccatggcaatgggtagaaaacagtacaaaatatcctacaaagtaaaacaatgaggaaagggcaggaatgacttggggagaggaaacaaaaaaaccccaacaatgaagtaacttaaagtgcagaaaaaaaaattaaaactaattaagcagaaaaatgtaagccaaatggaggagtttgttgccacaaaataagtagtagtggggaagaaaatatgtaacctccgaagagatattttcaagtgcacaagtgcagaactctagtgcgagatttccttacactgcaggatggaaaatcatttacaaaagacagggccaaaagaatactgctaatggtgatgctaataacaatattagttgtaggagcacttaacaagccgttgttttgtgccaggcactgttttcagcgctttacatatgtgttgatgcatttaatcctcaaaacaatcctgccaccattattattatcaccatagtggctttgcagaaggggagttgggggagggagaagtgaagtaacttgcatgtagatggataccctagcaagtagcagagccagaatttgaacccaagcaggctggctctagggtttatattctcaatcactatgctttttgccttcttggaaaaaaaaaaaaaaaaaggaaagaaaagtgggataaacccgtagggatgaggaggaggccaaggaaagcacggggcttgaggctgttaagtgcaagctttttggaaacaatcgcttttgaacgttagtggggtgtggccttggtctgctgcctgtggctccaagtcatactgcattttgttggaaaaggaaaatcatcttgtggttctatgtgaaaaggtcagttcgtctctaagacaggaattcctcattaaaagaattccaactacacgtagtcagcacagaaggaaatcctgagtcacctgatgtgagaccctttgacactttgccctacactgatcaacgtgctcagtgcccctggcagaatgcttaagcagcgggcacttggctgactgtagacctaattggttcactcattcacagagccaacaaataaacattcattcaacaaacaaacattgccatgtttctcagactggagtctagattcttttaaaaataatataataagaaataacaattttagaaactctaaagctctattctatgaaaatgttttgaaggccaaatcagctttaaaaaatatgatgatttgattgggcgcagcgcctcatgcctgtaatcccagcactttgggaggcctaggcagatggatcgatcacctgaggtcaggagttcgagaccaacctgaccaatatggtgaaaccccatctctatttaaaaaaaaaaaaaaaaaattagccaggtgtggtggcgtgtgcctgtagtcccagctacttgggagtctgagacaggagaatcgcttgaacccaagaggcagaggttgcagtgagccgagatcacaccactgtactctagcctgggcaacagggtaagactccatctcaaaaaaataaaaaagataattcaagcaaaatcacaaaatttttaaagtctagacctcgtaaagtccccagaatacattggattcatgaacccaaattcaagaaacaaaaaggatggagccctgaactgtgtgcaaggatggagagtgcctcagagataaggcagaggcaatgtttgccctcaaaaagcttacagtctagcaggtgttcagcttctatatgaacatgactataccacaatggagaaagggaagatgacattacaaccacaaagacagtgttgtggaattaagacagagactgtgagtgaaatggcatctgctctggccttgatatataaagaggcaaataaagagaattgcacaagcaaaaatagagaggtgggaaccagagagcaaatagaggaaacattagctggagagagggacgattaacagagaaataggagatggggttggaaagggaaggattttgtccaaactcaaagtaggcctctgagggcaagctagcagagtacacttgattctgcaggcaatgagggtaatctgagattgcgagaagagggtgaagtaaccagagcaggtccttgggaagattaaccagtggcaatcgaagtggaaagaccctccatcctggctgggaaagtcagtgagaccatgagcatctgtgaggggtggcaagttaccagggatggcaggagggatttgagcactatttccaaggcagacctgataggaggtggcaactgcccagcaaggggagcgcaggagcaggcgaaagcagagggggctctggagggccaagcatggttcatggagggtgattatgccattcagaggaatggagtaaggctgaaagggaaaactggtaattccattttaggcaatggcattaggaagcaagtaaaacattcagatggaggaattctacaggtacaggtgctccttgacttacgatggggtgacatcccaataaacccatcataagttgaaaataaggtaagtcaaaaatgcatttaatatactgaacctaccgaacaccagagcttagcttagcccagtctaacttaaatgtgctcagaacacttatattagcctacagttgggcaaaatcatcgaacacaaagccaataggcttgtaataaagtactgaataactcataggattgattgagtactgcactgaatgcataccaattttacaccactgtaaatgtgaaaatcttcaattgaaccatcgtaggtcagggaccatctgtagtcgtatatcaaagataaaagcaagctaaatacctatcccatagagacatcaaaattatgtacatcattaagtttaaaattcagaatgtgtgttttaagaccaatgtcaataaagtgctgcaattctagaattcgtttctattatcccaagccagtcttccaggaactacttttttaccatggatataagcgagggcacctataaaatctgtttaatgaagccaggcattggctttgacatggaaggcgtctggcaacagctttataacatcagaaaaactaaaacttgcctacatatgtatatgcatgcataggggtgtgtgtgtgtgtgtgtacacacacatatatacatacacgcacacatgcttatacctatacagacatatataaaataaagttttctctagccctttctacttgaagggaaagctatgtgtgtggctggagtgactaaacatttaggtttacccagaatcatgcttgtttatacctgcttttctgtaattacagcaattacaaataacatcctcttgctctctcaaaagtattccagtatatttatgactaccattctgctaggttgtaatgtctttttcacttcaagaatgaacccatattgttcctggaatcccagcttcttctttgcttcccgtacccctctcctgtcatcatcttttgcagaagaccaaatttctagtcaccctctcagagagaccgagtcagccctgtggcacagtggtctttcttggaagtgacatgccaaagttataaatgtgaaggccttccagtggcttttttagtgaactgtggtgtctttgtgacacatacacttctactatactataattgtatgaaaattagtaatctatgtagtaactctatgttgacagaatttttattatcgataatagatgtatacattcataaaatacacataacataaacacccattacatactatacatgtgatataaaccctgaccatatcccataaaaatggagtttaccatggttccctggtttggaaaatttgtactctctggatatgtaaaaacgaaaataagcttttcaatagtgtttttataattcacaattctcaaatagtaagttagaaaacttatcacaaagactgaactttcagttctccaacacctgcccggtggttgcattccaaatctcacgctacttctctgattgttccatcaacttaacaaaagagcatagcctgattttactccagtaggaccataagaaatgaatgcacccagagtgctgtgatcattatgatggtttcattgagctgtaatccatgtacttggatactacttctatttattttttaaaaatgtgtttgtgtcactttgccaaaggattggagtattacactaatgtcattttggcattcactattacctagggcaacttttgttttaccgtctctttttcaagtcataattttatacttatccatttatttatgattaatcattttacgtgaaaaaaataattcttttttcccactgcagccttttttggaaaatacctcaatgaatataatggcagctacatcccccctgggtggcgagaatggcttggattaatcaagaattctcgcttctataattacactgtttgtcgcaatggcatcaaagaaaagcatggatttgattatgcaaaggtaattttcaggcacttttacactgcatcaatttactttgtgcataatggggaaaagccattttcagtgagttaaactatccacaagattggctttctatgttctcacaatgttagcatgagaaatgttaaggtaattttaaactctaggcaaggaaaagactctcaaggaacgctgcctttgtgtagtgatttccctcattaggatgaaaggcaatcaggctttgatgaaagtatcatcaagaaaatcagaattctctgctctcttatgataatttttgtcctcccagttcccccggacccaaccaaggacttgtccacataatcaaatgttcatcttgtactgttttacttttcactgggacaaaagtatattttgtctgtggcttcagatttaggcacaagcataagagcaaataaatatgataattaaagtttgaaaaaccacattccttgcttttactcctgtctgaccaagcttagtatacgtgacaaggacaccttccctatcacggcaagcatccacaaaagtctctaatgctatcaattctaggattttcaaatcagttcagagaaactgaaatcaacatgtcccatagttctttgaccagtgggttctagttttgacttaaaaattcacaaagattttgtgatagctgacttaagtttaaatttttttcaaatcataagaatgaaggggaaaatatcttcgaatttagcatgcttatttgccaaaatatccccttcccttccagccatacccatctcttcttcatttatctagaagaagccgagaatctgctctatctagcaacctctcccaacaggctagatcacttggtagaaatcggaaggagagaacttgatttaatgttggcatattgctgtctttatgcttggcctgatttgagcacaagggacttgatgggagataagattaagtccagctcctttatacccttcagaaaacaatgaatgcaaatgaattcataaacattgctaataggcttccaaactcatgaaagttaaaagttagcagagaccttggaggcaaatttgagcaatgtcctcatttgcaaagatgagaaaaaagcattctagagtggctcaaccactcatcctaggtcatatccccagctgtggatacaatcattgcaagcaaatggtgcagaccacgtgcactaattgtcactgctctcctttgctgtctgtagggatgctttttcatgctccttgttcaagttattaacctttctttccctgctgtcctaaagagagcaaagtaatcaagattctctccaaatactaaatcagcgtaacttgttcattatcacagctgattaagtgtcaaagacaactgtgtctgaaaagaatatatatctttttttagtgaggaaaagaatgaaacagacactcccttggaagaggaaggggatagcctgtagacttgccctaacaatgacatgcggcacacaccatccctctgatactgcttttgcagctgttctggtccttaaatccacaacatgtgattagccatgcctggaagccttcaacatttgcaaatattgcctaaacactttctgaataaagtttatactggagctccaagccaatgacacacacttaaaagaagcaggtggtttaagttttcatcttttctttccttttcattccatttcctccctccctcttacagacctgcatcagccccccctgactgtgggttaagtcattttattagcaagtcaggctctaatcccagcagctgtattgctttagttgtgcaattaacacagtataatctgcaggaaatcaactgctccctattcaagtgtttcaagtaaattaactgatcaaatgttgcagcttttccctgtgctcctggattttggccatggctttgattactgattattgtaattcccacaggtggatttttcgtttgaagaaaatatcttttcttgtgtttatgtattcatgggcgtgtgtgtgtgagcgtgtgtgtatgtatgtgtgtgtgttctgcaactgtaaatttgaagtgggcgtgggtgtttcctgcccttaaagtaattaaattttttgccaaggaattacatcaatgaaacctgagactgaaatatgtatccggtgtttcatgtgttctagtacttttatcgccagattaatcattatcttgggcaaacacgacttgactttttttttccccattgctaagttgtgtattacttaaaatccatttttcgtatgttaccaagctagcaaccctagaaaacaactggcagctgattttctctattatcgaaaatgttcggctgccttgggaggtgcagccttccttcctgctgtagaccttgccacttcgtgcagtgaattgcttctgaggaaagcagttattcaaatgcgatctgatgaatgtcaccttttgtaatttttgttttgtgtcaaatgtatgtttcaggactacttcacagacttaatcactaacgagagcattaattacttcaaaatgtctaagagaatgtatccccataggcccgttatgatggtgatcagccacgctgcgccccacggccccgaggactcagccccacagttttctaaactgtaccccaatgcttcccaacacatgtaagtaacaaactcaactctgcgacctgccgaacatgcctttcccttttctcctcatcccactcctctcctttaccccgtttccttccaccctgcgtatccacaaggctttcttcatgaaaggataacttaagagcagaccacggaacaggcagagccgctgagcctgaaagaaagcgccttatctgggtggtttgaggaggaatcaaatttccagcatttacaagtagctaaatagaaaggaagagatgcacatagagtgaatgggggcaagttttacaagagtttcctttcgttgtcttaaataatattcgtgtgtctgatctaataatgatgatgatcaaatagtatgcttttcatagctgcacagtggggacctctggtctggttatagaaacatggatttattttccaggcgaataccgtagcagctttgctgcagacgtgcaattagaattcctgcagaaggcagcttgagtggcttgcccaagagggcttctcaggtcacagctttaaaataacctgatttttttttttttaaagaggcaggagtcttggagatggggggtgggaaggcacaagggagagggctgatggcgtggagggatgagacagaacaaagagctgtcgtgtgcccacaattctcaccagccaaaggtggaaaaatctagatgctttggcagcaaagaacatgattttgttgttcactcagttgacaccatttcttcctaagctttgccatcaatatccagtcttccacacagagcagtggagttggctctgtgtctgctgaaagcctgaccattagggagacagggaacagaaaattggtatctgtttcctatattgtgaaacctccaaaattggttcttaatctatttgtacttaaatatcatctcttttcatccacactggttattagccaagattccaggcagaaagaaccttacgaaaataggtaagtaactatgcaggctctctagttgccggtcactatacatccctagagaagtttttataaaatgttctcttttttttgagacagagtcttgctctgtaacccaggctggagtgcagtggtgcaatcttggctcactgcaacctccgcctcctgggttcaaacaattctcccacctcaggcttctgaggagctgggactacaggcacacgccaccacacctggctaattttttgtatttttagtagagacgcagttccaccatgttggccaggctggtctcaaactcccctgacctcaagtgatccacccacctcggcctcccaaagtgctgggattacaggcatgagccaccgcacccagccttataaaatatttttatttgtaccttaatgtaactgattgacttatgactcctggtcagtggtacacagatcatctctatgatatcatgtgacttagaccagaaagaaggaggccagagctgactcaggacaagaactaacaatatgaagccagggtgggttacctactgagcatgcccaggaactcagaggatggaagtgttttaatgcataaaatatcatcgacaaatcatgaaggttgccccagcacctgggaatatagctgggataagccattatgttttggagtcaactccatgggtggatatttaagcttctgaagatcttcccctatatacaactctgcgagtaaattcatgaatgaagcccatgtgtgacaagtggctctccattatagctcacttacaaatttagtagccaactgattcaatgaaaggaaaaagtcctgcgggctttttcaatacccctgaacccccctgttcccatttctgttgaatcagaaatcactttacctatctttgttgcattagcagaaacccagtctaaggtgacttcctataactgtaaactttacagatgttccctcaagctggaggagaaggggttgacaaaacagagtgttttgtggctccttaaaagtcagcctgcctttgaagctttgaggcaaggtcctaagcctgcaggaaaatcagcctcaggtcaagagtttataagagctcagttgcatggaatcagtactgcatgaggggaggagcctgcagagttctcagggtctcagcaatagctttttgaaaaacatctctgtgctggccaggcgcggtggctcacgcctgtaatctcagcactttgggaggccgaggcgggcggatcacgaggtcaagagatcaagaccatcttggctaacactgtgaaacactgtctctactaaaaatacaaaaaaaaaataaaaattagccaggcgtggtggtgggcacctgtagtcctagctactcgggaggctgaggcaggagaatggcatgaacccgggaggcggagcttgcagtgagccgagatcgcaccactgcactccagcctcggcgacagagcaagactctgtcttaaaaaaaaaaacaaagaaaagaaaagaaaaacatctctgattccagtaattaaaaattctatttcattccacgaatatttatcagtgccacatgtgacactatgcagcccagcagggatatagataagcgtgaggaagacacagttgctaacatttaaggacagataaactaaggcaggggttggcacactggtacccacagtccaaacctagcttgccaccagtttttgttaacaaaattttattgacacacagccatgctcattcatttatgtattgtctgtggctgctttcacaatacaacagccaagtcgagtagttgtgtcagataccatacagcctggaaatactatctcatcctcgataaagtaactttgccccaacctctgctctaggggcaggatgggcaagtgtcccaatggcaatatcaccaatagggccagaagtgacaagcacagagcagacgttcgcagggctgtggagcggggagggagaagccttcatatctttgaaggaaaccaggaaaacttcatggaccaaggcttcaaagtgggcctcaaaagatgggtaaaatttctgcagataattgtttagagattgggtttcaggaagagaatatggcaaggacacgtggtcactgtataagggaggcaatctaagatgtgtcctagaaactggagaatgggctacaaagaaagcagcactaaggaacaatgctgcagagggaaactgttgcagaatattgagggtgtcagtgagtttgtatgtaactgcaagcagagagtcactggaggttgggtagtaacaaaataggaggtggctcagacatttccacatgcaaatagattcagtagttcctttttagttcaaatgaaccttctattgcccttattagtgattctataaagtaaaatctacacagtgcagagggtggccttagaggctaacgagcctggtttcctgcctcagctgccctcactgagtgtaggggtgctttctttaatctctggaaacctccactgtctcatctgtaaaatggagataatactaacaccttgatgtgatgtcatgaagagaaattaagagaggcagtgtaagtaaagtccccacatagagcctgggacatacaagccacttcataagtgtcaattcttattgaacctttttattaagaaactaacaatattctatcattctggacctacaaaagggcaatttcatgtggctcaacttaaggtttaggggaagcagtgagagaaatgacaacttgatgcttgtccattgtgacatgacagacctcttgacaagctaagactcccattgtgatgagcctctcacacctggccattccaatggaacagacagggtaaggaccaatctggactgtgttatcttttccaggtgcaagtatgtgctatgggtaagtgccagtttggagaactcccttagccacaggaaatgaaaattcatgtgattgtttgaaggattcagcttctctttgctgctaatccttgggttttgtgcacctagaatgtggtctcctgcaggccctgaaagccttgaattcctggcatctttgctgtgaaggtctccctggctgctgctggaggaaggggctggaaggagtgagtgtgtgcacaggttcagagttcagtcttcagacaaaaggagtgagataaattgaagacaagctgccgatggtagtgcatggaactgctcaatgaccagcttccttagcgaaaacattagcaacacattcaggcaaagggatgcgagaagttaagtactttgcagaaatatttgacaggccctgcaaacactgagcaagaaaccataggttctccccaattgcagggatgcaagtaacgtgaacactttcctttcggtcatcttccttggtggtcaggcatcatctggatcactttcatctggcatcgggttataactacctgaccctctcagactggggtgaatgtatcatctttccaaggtgtttgccgttcccaacaaagagaggaagccagttcgctattggcctgttagctttacaaacggatggtagagcttatgcttaccaaggaagagtgaaaggggattatcgaccacttgttgacagggaaaatagtttaatcaaactgtaactcagctactcatggccactgagaaatctgagaaagcctctgtcataataacacacataataatcctagtattagaaagccctgcgctctggctaagactctactatacttttcagtaacttatttccccagaatctccatagggatgcaattccttcacccctgctttaagttacttctctctcctcgcctcagtgatgtcatcatatacacctgtggacaaaagccgtgacagggaaggagatgccatttacgtccctggtgattctataggaaactaagggacctccttatcacccttctatgaactatgcccctgtcagctttaaaaatttgttgttgttattccaatttttttttttttgagatggagtttcactcttgttgcccaggctggagtgcaatggcacaatctcggctcaccacaacctctgcctcccaggttcaaaccattctcctgcctcagcctcctgagtagctggaattacaggcatgcgccaccacgctcggctaattttgtatttttagtggaaacgggttttctccatgttgttcaggctggtcttgaactcctgacctcaggtgatccgcccgcctcaggctcccaaagtgctgggattacaggcatgagccagcacacctgacctgttattccaatttaacagttctttcttcccatacctgtaaatgtgtgtgactgtgtgtgtgtgcatgtacactcacacacacacaaatacacaagttcaagtgaaatctaaatgcttggtaaaacagtccatgtgcactaatttgcaagagttgttgtgagggtagagcttttgaataaacataggttgtcaaaggaaaaactccctctgtgtaagccacaggacaaaggttttgaaacacctttgttatctaaagctggaaagaaatgtcttgccttaaaagaatttgcacattcgtacctctttccacaaatacgtgaaaggacgtgcttttgaagataagaaaagtttaaattctacaaaaaaaaaaaatctgatttgggcagaactcattgctcccttttctctgtttctaccttgttcttctctgggtggatcatttactacttatactgtcagtgttggtgttgcttgtttacttagatccctgaagtcgagttgcacaactccagggggcattcagataaaatatcatgtgaatgatgccctggagttttgcaggtagctttgtcctgaagacagggacaaaaatgtttcatctctttacctcccagtgcctggtggacatgccttcggaccaagtagttgcacaattcattgttgcttagcaaatgaacaaatatgttcacctcactaaatagctgacatgaaaacattttaaaaatagtatcaagatatttaaacagtcgattttatgaatttaaaagacacctagagatactacaattccgtagttttttagattaaaaaacaaagacccaaagtctatattttttaaaggaaggcccagatggttttgtgaaggtcatgtgagtatttagggacaaaactagagctgaaactcaattctcttggccccaggtgatcttctcactccaccagacttactcagttcacatcacagtcacaattcagattagagctatgaacaattctatccatttgcacaattctaactggtgtttctaacttcattaaaagactctgaattatttttcttatatacctctaatcaagatcatttggtattatcctgcatatgttcaaatgttacctatctacagatatttgaacttaggtggggaatatctccacaaagtccattaagtaagttcagttttagtgaaaactgagatggtgcagcttgagagattaagtgtagaatttccaatgtaatgctttgaatgtgtaccttaaatctgtatcactggcttattctgggaattgaagtcttatttcatttctcagagaatgatggttctgctaccagtaatctttaagggttagatcattcgggttttttgtttgtttgagactaaataaatgaagaaaacacatgttagatacaaaacactagaaatatattaattttcactggagcgacaccaaaggccatcgacattaaaaatgaactcctaagttctttgcaattccccaggtatagatttaatatacaacacatgcatctcttgaaactctttctttgctagtaagaattattctcctgaaatacccacctgtcaaaaagaaaggtaacattattgatttttagaattcttatttctgtcgtgtcagtaagcaataccggaaagaaaatcaaacactcaggagaattggcatgatggtgaaggttgagcttacaagtacagtggactcaagtatccatgatccagcgcactgagcaataaatccaaatgagcagtgaccacaggaaaacaatatgcagggaggcctcgctgggaaaagctaaacttttatatatgggaatagtctatggaggattacagggatgttttcttgggggtataaggtctggagtgtgcagtactgggtgaagcccttatctaacaggcaacagaaaggtcttcccaggttaggcacacgtgactctacctccaacacagaatttttttttttaagaaagcaacagaaatttgcaaatgatagtctggtcttttgtcctctcaattttaaagcaaataaccagtattgtgttatctaccttttcatggatgcatccagtgtgcctagaagggccagactttattctgtatttgcaacaaaagtagacccagcaactgatgggaagatatctgattgggaagcagaagcagctggtattttaaatcaggatgaaagctaagattttaggactcacttttgataggaagaaaggatatatcaattttccttttaatgagtgggatttttgaggtactttgtggggcctctggttcaagactgtggccagtgtggtgttgtaggaggggcactgatggagagctatcccggtgcattatttctgagccacctctgtgcactttacttcctcatttgtaacatgggactaatgtgccctgctgagtcctcagagttgctgcaacaatcaaatgagctattaagggataagctcttttccagctacctatgagaatgggtatgatatggtcccagaatttgctctctagagccacagaaatctcttaacccctacaagaactctttaaagttgttatccccattatatagatgaggaaactgagacttagacaaaaagttgtccaagatcacataatattaaggaacagagctgggatgaatatttgagtctaattccaaaacattctggaataactcaatatgtggttttccatttctcccaaaaacaggtacctgcttttttcagtggcttgtgttccagctgacagctccagggcctgtttgaataattcgaagacaatccttagttaggaaagcaagctttaattatcactggggaacagaaggccgcatcttcgaggaatttggcagacctcagcagggggcaaccacaggcctttggcaaaagatcacttttcaacaacattgtcaattccagtgacccccgaccttccacctgcaggtccctgaacagctgctgttctgtgggaagcagtggcagtctgtcttcctttaaaaggcacatgcacactctgtccctgctgcctgctgagatcccacctgggacctcatccccagagctgggggtcatctcccatatcaagaaattaagaaaaataagggggggcaggaaaggacagctttgacaacagtccctgaactttcccttttaatataagccagatttaacgtatgtcattctgtaaatccgggagtccaatttgaggcttgtaatttgctgcaagcttccctgttcctccaagtggggtggagctatgccaagcacatcaaggtaactggtggaagatataatttccccactgtgagcctgcatttcagttccctattgtaatttttatttgtgttgaggttttgtggttttaaaaaagtcaaccagatttatttttaaattaacccagcccaacatcaaaggcaataagtagaggatgtttaggtattataaagaaaccctgtgtaatctgttatagctgtattctttctcagggcatgtaatggtaaatggttaggggcctttcacaaccaactttctatatttctctgacctcggactaccctcatgggcaaaaaaccctttttgaggggatttagtagcccctctctcctcctcctcaacctcttaatctaatcctgtttgtaacgcaacatgctgcatgaagaatacgaaacatgggcttaagtccctccccacttcccttatgactgtggtttacttttagatatgaagaactctttcaggccaaaaaaaaaaaaagggggggaccatttggttaacgaaccattttctttggtaggcaggagaaagtttatattgaaagtttatcttaaggatgacaggtcatacctgaagggtttgttttggaatactgtggattttttctaacccaaataattacaagagagttccttgtttattggctcatggaggaaattcaagcgcctctgttctaggcattttaagtgctctgtatatatggtggttgttcctcaaaacagctttgggtttgttttttgttttttgttgttagtggtggttttttgagatagagtctcgctctgttacccaggctggagtgcagtggcgcaatctcggctcactgcaccctccacctctctggttcaaaagattctcctgcctcagcctcctgagtagctgggattacaggcgcccgccaccatgcccagctaatttttgtatttttagtagagacggggtttccccatgttggccaggctggtctcgaactcctgacctcaggtgattcacccgcctgggccttccaaaatgctgggattacaggcgtgagccaccatggctggcccaaaacagctttttaagaaaagtgctattaaccccatttacagatgagcacatttgagccacaccctcttttccacactctaaatcttgtctctttctttaaacatgagttacttatacttctgagcataactgaggcacttttagagacagtgtcttctaagctcaatgtgatattatttgtgctgctgtgctgctactgggtaaccagcacccatcctggtcaccagggtaactttgtcaaccaagaaggccaaggatcccaaaccagcattttctactatcaaaagagaggttctgcaaatccactggcaggagagaaaatataatagcaggtggcatttatatgacccagtgtgcatggcagtgtcccagggtatcaccgtgaatctcagaaactccaggctttccccatgggaaatccacaccaccacagatccagtggaggactcggtcaagactcctgaaatcaaagaactcacagtgactgattctttccctagttttataatataaataatggcatggggtcacattcagccgtcattatccacatcatttcactgatgggatcctcctcagacagagattgggaatcagatttctcggtcacataaactgttgctcattctgtgaggctgcctatttgtaaagttgtggttcttattaaaagcaatctcagacgtagcaagcacccctcacttcccttctcattcattttgttaaagcaaatgggctttggaattcaggcctgtttctaccacttactaatgttgttaatttggaggagttcctcaactttgccaaggcttgattttctctgctgtaaagagggaataataaacctattttacagagcagctgagacaattaggtgagttaatgtatataaaatggtttgcataatacccaacacatattaaactctcactcggtttttaatattaacctctatgtgcttaataacattgaagaagaagattcaagtagattatagtctgttaaagagttcaaatataaataaataattctcagggtgagaattgccatagcatagatatgttacgtacccatggcagagcgtgaggtggcagcatctaatggttgagggagttgggtgagacatcaagagaaggtgacatatttttttgagtacccagtggaaggcatgggataccatgtggatctctgcagtagattaaatatagacttgaactaacctatcctggaacaataggacaatatccttgtggcttacagaaattattccctgcacctatattgatttgtttattaaacgaatagctttattggtaaacatgtatattgcggaagtagacttggttatcattcccacaagtccagttaaagtaatggcatctatataaaaaactcataaaaactagatatgtaagtaatcaataaaatactcttctcaagtattcaggagaaaaaatgtgttgaaatgatgattcatcattccacataacgtatttgtgactacatttaatagcctcattagcaataaaatttttatgagttaacatcatatgaggatattcccttgtaccttaccgagactttatctgtagatttgtaacataaccataatcatcttggtatgtttcttacacattttattcagtgaacccaaatgaacttctaattacatgttcagctgccagtcatggttttatatgtttgaatatatataccttcagaggatatttgctctttggggtggtgaagacttcatcttcttataaatgcaaacagaagatagttggaagaggaaaatgttttagcagtgtctcaattatctctccttaatgattatttcacaacctcgagatattttcctaaaagactaagtaagaaatatatagtaagattcctttctggatattttcagaactcctagttataactatgcaccaaatatggataaacactggattatgcagtacacaggaccaatgctgcccatccacatggaatttacaaacattctacagcgcaaaaggctccagactttgatgtcagtggatgattctgtggagagggtaagcacatgaacctacctcagtgatagtttttggcccagcttcctttgtgtagacttattcttgccaatcctgtttggttttttccccttcattttccagcatcattttgagagagaaagaaagagagagagtatgtgtttagtggcttaatcatccctcccttatcttgtcctcattccatctacctctccagggttggtttcttatggagccagtaaaaaagaggagagaaaaatcaaatcagcgtagatcaggggccacatcctcaaaggcaataaagaattgatggagcttgtgctgaacttgaactttaagttaagggccccatctaaaggaacagcaattactcagctccagctaaattttgccatgtagaaatgtggatcaagtatcagcaggtcttctgacttttttaaagaagccagaaacacaaaaaattttatttgaaattttctgaactttgaaacatagtataagccaaacaagacgtgcctcaggctggatttaactggatcaggctcagaagcagcctgtttttaacccttggtaattagatatgtgatgataattttaacaatggattttcaaagtacaacctataaagtttgatggtagaggttgttgtgcggggtgtttttgtttttgttctaccaaacaagcaaacaaaaagcctaaaagtagaatgtgctagattccaaaaagttacatttcacctttaccattggacctttccctcccagactgtaagcaaatagaaaatgtggataatgttattaaagcaactcttgccttttaaaaataacaggaaaaagatttgggggcaatcgtggcaacactattgagcatcatcttataccagcacaattgattctgacttgttcctttgctgtatttcagctgtataacatgctcgtggagacgggggagctggagaatacttacatcatttacaccgccgaccatggttaccatattgggcagtttggactggtcaaggggaaatccatgccatatgactttgatattcgtgtgcctttttttattcgtggtccaagtgtagaaccaggatcaatgtacgtatttctctgtttgcaacattcaactgtcgtacctcaagtgtgtctaagataattcaattaccagtctcagtatctggtttcctttcatccaaaacaaaaaaggatgtgtgtaggctggttaatttcgaagatgaaaaccttttcctccctgccacatcttaaattagctcaagtatactacttaaagagaaaggaaaaataagtgtatcaatgactaattctctcaaattgactggaatctatgtctttttggtctgtgtgcacagacaggatgtgatcttctgggatatcacccttctttgaatcagagatacgctgtcatttaaaaaaaaaacctgacaccatccttttagtgtttaacttttaaaaattattccgaaagaaatgtttttaaaagataaattttgaaaagctggcttttcttttaaaggaaaaagagctaaaggactaggctgctatttctgtcactgtaggcaggtcactgcttctctttgcatctctattttcccatcatgaaatggccttgcctattttcccatcataaaatggccttgtcaatcatctcaggatgttttgaataaaatgggattgcatccatgaaagaattatggaaagactaaaagaaaaagtggaagtagaatccagaagctggaatggcccttgaaaagcatctagcctggacccctgatgtaacagtgaagctaggcagacagcgtcagtgcccctctcagatccctgattctggaagtggtggcagtggggcccagagcccagatgttctgaatctcccccgagtaccacatgtgctgctgcatcatactacatcctggagagagggcaattgaagtaagaaaggtttctttgaagaatgttattgtgcttcctaagattattagaaacaccctgagaattgtcagatctatatctagaaggctttatgttttaaggactagatagcatagattgaattcaactgtaaaaactgtacatccttttttaaaatattgattttaaagctcttgttcaacggaaaagttatggactattgggttttaagcaaaagtatgcttgctgcaaaaaccatgtatcaggctgcatcttgcctggtgatgtggtcagaatacaggggtgcaggcatctctccagcctgaccctggcaagagtcagttaatcttgctcagtgccattgctgtgatcacacacccacccttgccacacaactacccatgcctaggagaccagatgagagggtgagaagagttgaaggccaatgagtcactgctgtagaaaaagcagccctaagtgccaccttcccctggcattggatctcagccatcaccgtgtgcccctttacagagtcccacagatcgttctcaacattgacttggcccccacgatcctggatattgctgggctcgacacacctcctgatgtggacggcaagtctgtcctcaaacttctggacccagaaaagccaggtaacaggtgtgtcattgttcctcctctcagccagccccaaatacactgagctccagctggtgcccagagccagccagcagctgaagacatggaggcagaatatgccttgcccacaaggatcaccccaagctgagcatttctcagctgcttgtgaatagcatattgatggagatgcactcatggtctgtgggaagtgagaggtgtttctttaaataagctgttagcacagatccatttggaaaaacgtccagatgccaaaagtaaatattatcattttgctttcaggtttcgaacaaacaagaaggccaaaatttggcgtgatacattcctagtggaaagagggtaattattggttcctggggtgcttctgggaaccagtcctagtgggcagctttccctgctgagtattttttttctccttatttttgtttactaagcatgcagatttcgtaaacctagtcacaagattgaatggtttgctgcttattctgtagtggtcaatagagtaataattgctggatcagaattgtaaagaataaccctcaagttggttaattggtacaaaaacacagttagatagaagttatagaatttgatagtatagttgggacattatcgttaacaataatttatgtatatcttaaaatagctagaagtgaagaattgcaaagttcccaacacaaggaaaagataaatgagatgatgaatatcccaattatcttgatttgatcattacacattgtagactggtatccatatatcacacgtacccccaaaatatgtataattgtgatatatcaatttttaaaataccaaaaaagcaagagaatgacgactccacatcccccaaaaagaataaattctcataagcttggaccaaagcctttatcatgggtgtagatttactgttgcatttctcagtgctggtttctaatcagaccagtggattgagtttctctaccatcctccccacgttcttctctaagctgcctccaagcctcacccggcacccttcttcctacttcctacttcttttccttgtgtgcctttcctagttttaaatagataaatgtatgccattgtaattatttccattgtcacttctgggtttccccttttggttcattaatacccattgccttgtttttctctgtacataaattaggagagagaaaatatttgtataatttttttaacaaaaggaactttgagcatgtaaaatgaaacatgtatgcccaaattttgaaattaatgcttttgggaagaacgaatcttttcctgacctctcatcttcatcctacccagtttgtcattttcataaaggacccatcaaatgttgaactcctgtagacagagctttaacatctatttcttgctgtttaaagaatgtggagtcatgtgacagggtaaaaaaaaaaagggggcaggactcagggaccgtaattcagatcacttctcatgtacgaagcttttccctttttgtcgaagcaaatttctacgtaagaaggaagaatccagcaagaatatccaacagtcaaatcacttgcccaaatatgaacgggtcaaagaactatgccagcaggccaggtaccagacagcctgtgaacaaccggggcaggtgagtgacgcaggctttctttaccaccactcatgtgcttctccatctctaatttagaaaattgtccacatataaaagaatgtacatttgtgtataaataagcttttcctagtggccttgagggcaagctcactgagacacctctccgcggacagaattacgtaactggttcaggctgggcctccccattactacttgggctccctccagttaaaaaagatgatgatctcagagaaagttctatgccaaaagacactggtttcctctgaggagaagattcctgttatagtccctgttaactagtcactgaagagttgccaaaaggctacttagtcaaagcacaggtacgtgctgagcctcttggcagtgaaccaccccaagagacatgatagggccttcaccctaggctaaagtcagaatgtcatcttacccccagtagaggacagagcctgtgaccaagcttgaggaatgagaagagaaaccatattctgtttgtttattgttcctacttctgctcacaaagattctggcatcaaatatttcattagaatagatcctcttcgttagtagaaatattactatagaccccagagctacccagaataccagttattatcagtaagaataaaagaaatactgtgtgatgaattaacattgcttttaaagaaagtgagtacgtatgaatttaaaccagtttaaaaccattgattttaaatgcccttgattgaaatgtatgctagctaaaagaaaatgctgtgtcatgacaagaggaactgaactttggcccaaatcattgcagctgagaacaaaatcagaggaaagtgaaaaatactaacacatagtgagcatttgtcttacatcaggcacagtacgcaggattttgtagcatttactcaatttaatcctcacaactgtagagtgaggtgggcattggcatctccattttacaaatgggcagctgggattcaaacaggagttgtctgattcaataactcaggccacttgctgccttccaaggtaagttacaataaccaggtgaagagaagttcaaatctgtgagtcttttttaacttaactgacctctagatatccacacaattcaccaacaccagttcaagatgtcaggctcatggaatgagtaggtaacaaagttattattaaaatggcctcactcattatacgcttattatatggtatctagcttgttgaatagacattcctaataaacaacttgatccttataccctgcatttcctcatgctttcttgtacacaggatccctttgaaatagaagaggatagggagggagagctgttgaaggaagggctaaaactaagccttcactacattctagtacatcttaattttcaagtgtttagtggagaaaagctgagacctattcattatattttaatttgaagtcttcaaatctttcttatgaaacctccaaatattattatgaataaaacctcagaattgttttgtagctctaagatgatttttatgagctagcctcaatagactaatttacttttattcaggagttgcaaatgttcagtgttaaatatatctcatgcaaattggtgatcttgttactcttttagctctaagaggtgaacattatagccttttgggaataaggtacactgcctacatttcagtgtgtaattttacaaacctctccatatggcttgccctaaaattttaatatatgtcctaaagggcaaatgtagcataaaccagattatggtactttggcacaagcttttcactcacgagctgaatgctaactaagttacaaacttaattttgctttttcatattttttgaacttgttttggccccatgaaatgctttcatatctggaattttcttccactgtttcatttcgctgtgaatcagtctgaatttagatccattatgtggatatatgagaacgtcagcaatggtctcttttagaaaggcctgaattcgtggaacaaagaattaggctatgccctgatggtgatttctttctatagaatttctttatattgggcctgagtgagctttagaagtgaagacctggagagtatttcagattgtctctagcttcagtgtatccacagcactagtgaattgttactctaatcccgaaccagcaggatcagcatccctgagagtttgtcagaaatgcaaattctctggctattgcagaccttctgaatcagaacccctaggggtgaagcccagcaatctgtgtgttaacaagtcctccaggtgactctgatgctccctaaagtttgagaagcactattctaacccacgattgtgtttactggtggccctcaaaccatagcttaggaatctaagaacttcaagaaaattttgagccttaatctttaaagcagttattgaatctgtgggtcaaacctgatagctgtgttgtgtgttgttgttttgttttctttgggacagggttttactctgtcacccaggctggagtgcagtggcgtgatcatggcccactgcagcctcgccctcctgggctcaggttatcctcctacctcagcctcctgagtagctaggactacaggcacacaccaccatgctcgactaatttttgtgcttttttagagatggggttttgccatgttgcccaggctgatctggaactccaggactcaagtgatccacccaccttgacctcccaaagtgctgggattacaggagcgagcctccatgcccaggcagctctgttgtgttctatcgactttttatatcttggccttttgctctttctttctggctactttgaagattatctgtttttggcgacagtatccctgactttaaaaaaggaagaagaaaattcagaataatgacactgaattgttcaggttcgaggtggcagcggaggctagaactgacctgcttggaatctgctctctctcgatgtccctcctgacatgcgccctgcttccgttcctcttaacaaggtgaatggccttcattccaaggcaacacagtcaggttttgacactccatggggaacaaagggaaaatcagcatgactagccccattctcttcactcttaatcccagagatagtgaatgcccccctcctaccacatctttgtgccaggtcacctaaaggttgtttggtggagtcaatgtgggtgcatgaggtaagtcaacagagaaaagagatccaaaggttggggttagaatattggccgccaccactttctagttgtgtcttctcaaataggtcacttactttctcctgagtctcaggttttctatctctaaaatagagaaaattaacctcacccttgtgaggattaagtgatattatacatgtaatgtactaaagtgagactgagattttctctagtgtgcgaatattgggtgttattattattccaagccatcttacctgctgttttcattcctatgaagccaattagaattaaaatgggctgaggccgggcacggtggctgatgcctataatcccaacactttgggagcccgaggcgggcagatcatctgaggtcaggagtttcagaccagcctggccgacatagtcatagtgaaaccccatctctactaaaaatacaaaattagccaggcgtggtggtgggcacctgtaattccagctacttgggaggctgagaccggggaatcacttgaacccaggaggcagaggttgcagtgagtcaagattttaccattgcactccagcctgggcaaaaagggcgaaactccatctcaaaataaataaataaatataaaaagaataaaaatgggctggaatcccagagacttggcatcacttcttgactatgtgaacacaacaaccagcggggactaattaagacaacatggacatatgtgtttgcattacttccacgttcctgaattaatatgagatggagtgtgaattcccaccactctctcagctgggcgttacacccccggacacgtttatgtacagacactccccatccccctacaccatcacacacatgcacatgtgcatactgaggggcaaatctcgacctctttcttaaagcatgtttgttccacagagaacaaagagcagtgatgctcaatgctggcggcacattaaactcacctggggccgagcacggcagcttatggcttactcccataatcccagcactttgggaggctgaggcaggagttctaaatcccctaagcccaggagttctagaccagtctaggcaacctagggagacgccgtctccacgcacaaacaaaatagccaggcgtggtggtgtgtgcctgcagtaccagctactcaggaggctgaggtgagggaatcgcttgagcctaggaagtcgaggctgcagtgagccgtgatcgtgccactgcaccccagcctgggcgactgagtgagaccctgtctcagaaaaacaaaactaaaataacagaaaataaaaaataaactcacctgggtggcacttgaaaaatgctgatgcaccccccagaccaaccaggttaaaaatgtctggaagtgaggccaaggaatctgtattttttaacgaggttaagaatcacaggcctagaaccagagaatatcaaagtttgaaggaatcttagaaatcttctaagttgaatggtatcatttttctgataaggaaatttaggtccagaaaagttaagctacaaacccaaagccaaaacctgcatctcttcacttcacgttgagtactttcttccctgtaacatgctgccactgcaaaattgcaagacagattttccctttgaaactatgaatggcaatcaccactcacggtggttctcaaccctgactgcacgttagaatcatatgggcagctttagagatgcttatgtttaagtcccagcccaggcaagttaaatcagaacctctgggtatgagacccaggtaccagtgttttttccaagctcccctgatgattcctacgtgcagacaagcttgagatccacaaatgtcaagtgagcattaatgggttggtttttcttcttcttctaggcataggtattgacgtcttaaataggagctacataaaagagaaattccctgggcatccaattttgaaatacactttacatattatctggcatttaagtggaaaaaagcagcctgctttgttttgatagggcaaatatcacatccttttgatgagttgttgaattccagcatctttacaatttagtttgcctttctactattggatcaatataaaatcaaacatttgtttaaaaatctgtgaggacccctgcatcaagcaagctgatgctattataacggaaatagaatgtagtttgttgagtggaaactggtttagctccaggatggatctttgttcctatacaaaacttatctctctggccgtatatccttctgaccctttgtgaccagcagcagagcatgaataataagacatttaccatggagatcctcctagaattgttagttttccagaagcagacaaacctgtttcccaaaactcactgaactctggtcaaaatggcagcatggctcatagacatcttcccctggctaacctgattccagagggcacatccagaaggattgagctcccagtgccatccttttactgaattctcctctgtgcatgggtccattgtggaccactcagcctttaaaccttgcttccttccctcttcaacccatgctgaagctcatgtatgaacagttgttcatctaattaaatctttgacttctgtgcatttgttctaaacaagtcaaaaaaagacaaacatgagaataggcattttactcataaactgtataatacagccccattctgcttaatttgtactgtgtcttcttttccaccatttcctaacagcccatcctaatcaggtcctcctctatgtttcttaaatgttacatgtgaatcccactttctcacttgcatggaggttgttacttctctcttctcacctaaggctcaggtcctcctctatgtttcttaaatgttacatgtgaatcccactttctcacttgcatggatgttgttacttctctcttctcacctaaggctcacctgaagactcatactgccttcgtaccattctccttttcatcagtatcctgatcaaggtgctttgggattacatcctggatatactgctttcttggcatttgcctatgtgcaagtttcttaacctaactctgcctcagtttcttcatctgtaaaatgggcatcatatagttcttgcctcataggctgtggtaaatgttatatgaattaaatgtatcaagcatctgggacaatgtctaggacatagaaagcactcaacaaatgctggttgtcaatcattggccaagatcagtttaccaatttcattttctaggaattacaataatcatacatcttccaacattccagtgttgacttttacaagggattatctagattaaaatctataacaggtaacatttctctctcttctgcttctccttttctgttttccgtccccctctctttcccatcttacaccatctcaaagaaaacaggccaggagataaatcctcctggcacaagtaacactaattcatatttgtgagagaaaatttgacaatgacttgagctaagtagcagtttggacaaagatgtgaatatggtctttgtatattccccagtgttaagataaatattttaaacacatgtccacatgcaggtaacttttttatgatgttcatgttggcatgaataataatcagtttatcacaaaattactatacagttgtgacatttcagagaacatgatttgacctgcattatggccaaatccatgtcataagacatatggtaaccaagaactagtgtgtgtttatgtataaaattaagctttcactgcagtgcacctttgaaaaagttgtacacaatttttttaatttttctttttatttcaatagttttcgggatacaagtggtttttggttacatagataaattctttagttagatttctgagattttagtgcacccatcacccaagcagtgtatactatacccagtttgtagtcttttatccctcacctgcttcccaaccttcccctccaagtccccaaagtttattatatcattcttatgcctttgcgtcctcatagcttagctcccacttgtaagtgagaaaataaaatatttggttttccattcctgagttacttcacttagaatagtggtctccagctccatccaagttgctgcaaaatacacattattttgttcctttttatgcctgagtagtgttccatggtgtatatataccacattttctttatgcacttgttggttgatgggcatttaggctgggttccatatttttgtaattgctaattgtgctgctataaacatgcctatgcatgtgtccttttcatataatgacttcttttcttttgggtagatacccagtagtaggattgctggatcgaatggcggttccattcttagttctttaaggaaactccatactgttttctgtaatggttgcactaatttacattctcaccagcagtgcaaaagtgttcctttttgccacattcacgccaacatctattgttttgttttgactttttattatagccatgcttgcaggaataaggtggtatctcattgtggttttaatttgcatttccttgatgagtagtgatgttgagtattttttcatgcttgttggctgtttgtgtatcttcttttgagaattgtctattcatttctttaccctacattttgatagaattattggcttttttcttgctgatttggttgagttcctttgtagattctggatattagtcctttgttggatgcatagtttgcaaatattttctcccactctgtgggttgtctgtttactctgctgattatttcttttgctgcgcagaaggtttttagtttaattaggtctcattcatttatgtttgggtttttttatatttgcttttggggtcttagttatgagttctttgcctaagccaatgtctagaagagtttttccaatgttatcttctcaaatttttatagttttgggtcttagatttaagtctttgatccatcttgagttgatttttgtgtaacgtgagagataggaatccagtttcattcttctacatgtggcttgccagttttcccagcaccatttattgaatagggtgtccttaccccaatttatgtttttgttaactttgtccaagatcagttggtggtaagtatttggctttatttctgggttctctattctgttccattctatgtgcctgtttttatgccagtaccatgctgttttggtaattacaggcttgtagtataattagaagtcaggtaatgtgatgcctacagatttggttttttttttttttttgcttaatattgttttggtgtagccaatttttgggttttttttttttgtttcttactcatgaaaatggacacaagtaggcataagtaagaacagagaacaacatccttaaccaatctgagaaatatttgcaattcaaaatgcagaaattataatgattacttagtggatacttcaggaaggaaaagcaaccagaggtcatctaatattgcactaagtattttacatggaaaactgttctatgagatacatattatgcccattttagatatgaagagactgaaactcagatgggaaaataacttgaccaaagtcacacagctagaagaatgacaaacctgagttcaaaccaagatctgggtgactcaaagcttctgtctctctcactaaataataattattttgtacagtttaccaccagaaaacattagcttgcccaggattggataaactttttaaaggccaattatagtactgctctaggttcatatagtacatcttttccttagaacttcaaaacactcaaacaatctattctcatgactatccatgaagccaggaggagcaagtattattttatcggatgtggaatccagaagaacaaagagattctgcaatttgctcaaagccatagagttagcagcaaaaaaaaaaaaataataaaattaaggtctttgaatcccaacccaatactcatctccattaaaaatggctacctcttatcaaatacacattagatcacattctttaagtaataaaccatgtgtgggtgtatgtatgtaataataataataatagcagctgcttttgttgagtgcctgccatgtgctgagttcttaccgtgtgttatcgctaatgctcataactctgcaaaggctaatgtggcatagcttacttgctcagggccacatagccatgtgatagagctggtgttcaaatccaggctttttgagcttgcaaatccagactttttcctttaagccacaccgatgagtaaaaaacaccattccgagtccaagacagaatataggtaatattcactactacgaaatcctatttcagtaaatgacttgtgacagcactctgggttgtagtgaggattaaatgaaaaattcataaagagtgctctagagcagtacctgctatcaagcaagagttaaataaatgatcataatcatggtagtcaagatgatgatgaatgaaattgtttgaaatgcgtttgacatatttctcattagatttgattccaccaaactagctgcacactatttgtatcctcataccaaaattgccagccttctcttcttcatcaggtgttatttatatacaggcagatataatcaatcaaaaacactaacacataattacctaaccaagtgattctgtgctgagataacttctgggaatgactcaggaatatgagacatggcccttgcccttaattccaacttccaccatagttggaaaggctgaaagaaaattataacaacttaagaaattatttaaatagttttatctagcacctcacccataattgctgtgcagaaatatttgtggaatgactgtgtgctaaattattggcacagactgataaatcagacagaaggagaacggaaataatgtagttgcagaaaacaggaaaacaatttgcagaaggaatgaaccatcagtgaagatggagacaatcggatttggcaattaactgatttactgataaacttcaagagcatagataatagaaagacagtgtgacagctgtgtttctgcaagggcacttgttgaacaaagctcatttctgaggctgactccacacatcccattagcaggtgcctcacctgagctcaggctttcatctgattcctgaaactctcctgcaatgcaaaaaacatcccttctcattattttgactatttaaatggcttgcttcatgagtttcagagcaattcttttaaaaattctctttatctgcttccctctataaactctctaagatcaccactttagttgtagctatttcaaggttttattgtgcagtcataaaaattgtcatgatatcgagttctaaaatggctgtggcaatgtgtgataattacatttcattaaaattcctagtatgcttgccagtaggaagattttcaaagcctctagttaattactttatctaacagggtctatgactttttcaaagggtccatggtagaaaaaataattgacatttttgttcatggctcttgcttcatccaagtatgtgtgtagatatatgtatatatgtagtatgtatggataatatgtttgtatgcatgtgtgtagacatatatgcatatatgtatgtatatttgatttcgtatgatacatcatcatagccaaggacagtgccagacatccagtgtggttaaattcaactcttcagaaaggaaacaccttttcccttcatctctatcccataggaaaccaacaaagaatttggctaatgggaaattcaactaggattccaaatagcctaagtcactaaaacttctgcctacacctttgtgttctacaggaatctacttgtaccctcagctcctccagggcaaaaacaaacaaaataggcagaattctttgaatgcattgtgattataaaaaccacaggttttcactatagtcatgtgctttaaaaattagtatttgtactaaagttgatataaattggatccacaaaaagactttagaccattatttttcaagaatatatatatacacacacatatatatgtgtgtatatataatgtgtatatatatacacacatatatgtgtgtgtatatataatgtgtatatatatacacacatatatgtgtgtgtatatatacatatatatgtgtatataaatatatatacacatatatatgtgtgtgtatatatatatatatatatatttttttgagacggagtcttgctctgtcacccaggctggagtgcagtggctcaatctcgggtcactgcaacctctgcctctcaggttcaagccattctcctgcctcagcctcccaaatagctgggactataggcatgcgccgccacctggctaatttttgtttctttgttttttgtttgtttgtttttggaaacagaatcttgctctgtcacccagcccggaatgcagtggcatgatctcagctcacggcaacctccgcctcccaggttcaagtgattctcctgcctcagcctcccaagtagctgggactataggcgtgtgccaccatgcccagctaatttttgtatttttagtagagacggggtttcaccatgttgtccaggctggtcttgaactcctgtcctcaggcaattcacctgcctcagcctcccaaagtgctgaaattacaggcttgagctactgtgcccggccgttttttttttttttttttttctgtatttttagtagagagagggttttgccacactggccaggctggtcttgaacccctgacctcagacaatccagcctccttggcctcccaaagtgctgggattacaggcgtgagccaccacacccggcctcaagaataaaattagccatattttcctgtctgatagaagatggagcacctcttacgcttccacttggctgtggattgtgaattcactagccgattattttgcttctctaggcattaagcagtcaactcttcatttttaaatgctagaggcagagatcatccaggtagatggataagccttaaaccatttggatttaagacagatatacatacagacagacactcaaatgctactgattcccaaactttgcaaagttacgaaaagttatttattttggcaacactttccccagcaataattctatatagcatatagttatatgttaatggagttgtctgtcagtttctgagcccaggctgtagtgcagtagcatgatggcatgatctcagctcactgcagccccgacctcctgggctcaagtgatcttcccacctcagcctccctccaagtagctgggaccacaggcatgtgccagcatgcttagatgtatataccacaggcatgtgccagcatgcttagctatatatatatatatatatatatatatatatatatatatatatatatatatatatatatatgttttttttttttttggagagacagggtttcaccatgttgcccaggctgttcttgaactcctgggctcaagcaatccacctgccttggcctcctaaagtactgggattgtaggtgtgatccaccacacccagctctgagaacttttttgatcatttcttggcacatcctaaagctaattggatagccatgaatgctataattgggtctgtgagtgccacaaacccaggcctggaaaccactgatctccacattaaatggcagaatcatgaacaggccgcatgcagttttcagctaagtcaaaattctgtcacttatcaactaactgtggagacagcacaaggataactggtttcacttaaacaacgcacatagtcctgaaagcataggtgcactgatagtattcatccatccaactggagtcattttctgacctgcttacatcagtacatttctagacacagcttcctttgcacatgccgcccccaccaattacacgcatccctctcaaagacccatgcatctgagctacttagacttaaatatatccctcctgccttccccatggaatccagctgcaaaactgtccagtaagcagttgctaatgtaaagcagtggcctgaactccaactgcacattagaatcatctggggagcttctgaaagtccctctgtccagccaaatttgagaaccactcatctgacctaacttcctgtgtttaattaagttgacttcacagtttttaagttaaatcatctctaacttagtccttaggctgttcttgtttgtgttgcctttttgtggctttgtaagtaaaatccaccctctctatccgtgggttctacatctgtgggttcaaccaactgcagattgaaagaattgaaaaagaaaagatgatttcgtctgtattgaacctgcataaactttttttcctgtgattattccctgaacaatacagaataactactaattacatagcatttacattgtattagatattacaagtaatgtagagataaagtatacaagagtatgtatgtaggctaaatggaaatactacattttatatcagagacttgagcatttgtggattcgggtatctgcagggcatcctggacccaattctcagtggatgctgagggatgactcgttagtcgcctgtctgtcccttgagctcctgcttctctggatgaagatgctaaacgttcaagacatcctagccaatccacaaaaaaaggttgtaccctgatatggcttgaaacaaccaaattcagtagtaccaagagtatagggggctaaagcaaaatcatagaagaagtcctgtatctctaggatttggggattatatagtagaagccaaaaagcagctctgataattcaacatacattgaagacatacaactcccttaagagaaagcaaaccatggctctgcatcttggttcatcatgaataattgcatatcattttgtacacgagtgtcagttatcagcaaagccatctgggacctttggccaaactttactttgcagtaggacactttgcaaccaagatatcaccccaaatatgtactggtataagagggaggtatgagatccttttaaatgatgcatggaagaacatcttttatttaataattatttatttatttgaatatatttgaaaatatacgtggcacaaaaaaccataattttacagtgcagatagtattgttctgtccacagtttagaaatgcacccatttaaagaagagtttctcactctttaactagatatgaacaaaaacaataaaggataaagaaaagtttcagtagataatggtacacaactgatagacctatatggaaaggaaaaaagacaaaagtgtgataacactatattttaactctgtgacaactgtggccaacttaaaattaaatattcttcctgcctccccaattaattttgtagggagaagggggaaaataaaatgtaaaagaagttattcagtctttaagtaagatgtggaggatcccaggaaatgacccccagggtgaagagctattatttcagccaggttgagattcagtaagtgcaaggacacttagtccagaggcaatgtcatatttacttggatgtaagcctgcagcatctgtggcaggcatgttagaaggctcagtctagaaaagtcagtgcaagctccccgtatgtgtctgttgggaagtgaactctgtctcacatagcagcatgcccactctctgccgagtatgcagttgaaactgcagagttccctgatccccttcacaggatgtgcaacaggggtgtggcatgcctgcttggtcaccaccactgctcaaacccctgatgagagggggagcacgcagataggcaggtacaggaaccagggcgagtcttttgggctccagccctgcggtagtatctaggggcgggtgccgacggccccagtgttacaatgctcttttagccttgccgtctgcagacagcttgttaaccagttcaatggaccctctgccttttgacaagggtagagggccaatatgacagctttccgtattccaagctcttgcctagctcttggaagaatcaggtcacacacgggcttgaaggatgaatgcagggttttactgagtgttggaggtggctctcagtgggacggatggggagccagaagcagggatggagtgggaagatgatcttccccagtttggccgctggatggccacactcctctctgacccctagccaagctcctctcagtgttcagacgttcctcttctgtctttctctgccaccttgttccaccattcgtcagcttgtctcctcatctccttgtctgcttccggagcctgagtttcagggtttatatgggcacaggataggtggcatggcaggccaaaaacaacttttggggtgcaaaaacaggaatccctgtccccatttagggctgtagattcccgggcttgagggtgaggcctttgccaggaaactaccttcttctacccagggtttccctgtcttctgtccatatcacaatgttcttagaaggataagaaaagacacaaaagaaagcctgacaagtttgctaatgtctggggtatatgagagttggctcgccccatgatgggctccaattaaattcatctctgtcttcctcatgtgccattcttccctggctcacattagaaattcaggagcggagaacaaagcagccaagtttgtttttccagagcaagaggggtctggtgaaagcagtcctgacagctgcaccgtgtgtcttggtgaactaacggcttttacgtgtttcattcaagactgtttagtctgcgtgctaaggattcatatatcagtttttggctctagtgacattgaggtagtttgatttccaatgatttcgttgtcatctgtatttgcctacagtgaaagaaataactgagagtcgagttagtgcagggtcacttaaaagcttgcctttcttcattcactctccttaatgatattgccagtgcttctaaaaaaaagaaaaaagaaaaaaactaaggcagcagctcttaataaataacacctggagcagaatcggtaaactgctttcacgttggcttttgcagaagtggcaatgcattgaggatacatctggcaagcttcgaattcacaagtgtaaaggacccagtgacctgctcacagtccggcagagcacgcggaacctctacgctcgcggcttccatgacaaagacaaagagtgcagttgtagggagtctggttaccgtgccagcagaagccaaagaaagagtcaacggcaattcttgagaaaccaggggactccaagtaagccacgcttttgtgaccatctcaatggtggcctaggcctgtgggaataaacaatagagagacgaaagggttgctccttctacattttagatattatcaatgcatcattttcaggctaaaagcacatcattgctctatttaaaataagaaagctaagactaatgtgacattttgctttgtaaacattttcacttaagcatagaatgaaaatatagttcataaaagcaccagatgcaaaacatatgcacacataaaagagtttataaaatggttattccaaaaggtaaaggatatggtttaagtccattttattttatcgtaatgccaacatctcctgacttgtctgcctgaagttgcttttaaaaaatagtaaatacaaggtttcagtgtgtatgcatttaattttaagaggaaaagcataaacacttttttaaggcatatattttaatctctgttttaggacaatatatgtatgttttaattctgtcaaatcattggatctcgttgattggcagggacaaactagttgcattcagtatgaaaaatacttcctagaattttcttaatagctataagaaacctacgattatataaatgtgaaaatccacgggctgacaccctccacgaaagaatgaatctagtaccacctagtggagtaacatggaaaatgactcaattttatggtgatttctttctatactggtttggaaagaagcaatttaagtaaattaaattctatgtcaaagatttggaaatcaaatcatacactagaacaatggaagccctgagaacaggcatttttattgtagactccacaatatgggcttcagggccatgccctgatatttcatccaaaattgttgtgttttccatgtgtatatggacatttgtttccatgtcaacaatttttaacaaattttaaaggaatccgtaagccaaaatactaagaatctttgatttgggagactttttttcttccctaacagaaaaattccaggtctaataactcacacaaagatatcaaatttctgaaaatcaataaggccaggcgcggtgactcacatctgtaatcccatcactttgggaggctgaggcaggcagatcatttgaggtcaggggttccagaccagcctgaccaaactggtgaaacgccatctctactaaaattacaaaaaaaattagctgggcatggtggcacacgcctgtaatgccagctacttctcggaaagctgaggcaggagaattgcttgaacctgagatgcagaggtggcagtgagccgagatcgcaccactgcactccagcctggatgacagagcaagactccgtctcaaaaaaaaaaaaaattaataagggacgaggaccccagcatgctcttttttcagaagctgattagcaacattcagtttagaagtaggagtgccctcttctcttccagaaagttcgaccttgtttcccaggcactgggcataaggcacattgatttttcagtattaggcacaaacacaagtctagggcagctctctcaaactgtatggaatcttgtgtatttgagagcaggagtcggttttcaccctttctgcaaggatggaactcgtaagcactcttattgacacccctactgtcacggaggttgctccctgatctggaaactgcaggattcagctgagaggtgtctcagaagcatgacaattctgattccacagccagtatgccccacttctttctatgttagcagcaggctagagcgataaggccagacgaatatgcctctacagagctaagagcatctagtgtttgtgcattaaagttcttatctggtacacatgagttcttgaaaaggttccatagtcaccagaaagcatgctgccctctccccatccctgcccgcccaccccttgccttaaccctcctctgccaggtataaaagtgagttggctgatgaaagcattaacaaaatttaattcttcttagagtaatcctctactatttgtacaaatagaagttgtctagagcatttgcctctttgaaaaagcagcccaatgtagtggtaagacttcatagtctcagaagattatagtcctagctccataaccttgcaaaatgtatgtgacattcaaaacttcagttttctcgtccataaaataaggatgaaccggtattgacaatctgatgtttttgtatgtaagggtttttataataatacctgtctttcaagactccagattagagataaatatgaagtatataatacatagcaaaagctcaataaaggatagtcattattattaacaccataattgggaatatggttttatccaaaaaaatagcctgagcagttcacattgaaaaccaaatgtagaagttcacagcctgccatgaataaaaaggatcctagaaatcacctggactaaccccctcacttgacggatgaagggctggaggcccagagaagtgtgtcatccatcacactgccaggcaatggcactgccaggcaatggcactgccaggcaatggcactgccaggacaacctctgctaccgtgaattgcaggcaccacgatgccactcagcaatgcagcatggactgctttctccactccaggatcccttctggaccaggtgatcactttcttcccttgtaagctacatcaggacatccatagtaatgtatcttcccttacttctagagtacaagcccagatttgtccatactcggcagacacgttccttgtccgtcgaatttgaaggtgaaatatatgacataaatctggaagaagaagaagaattgcaagtgttgcaaccaagaaacattgctaagcgtcatgatgaaggccacaaggggccaagagatctccaggcttccagtggtggcaacaggggcaggatgctggcagatagcagcaacgccgtgggcccacctaccactgtccgagtgacacacaagtaagaaagctttatttgttcactagggttgagttcagaattaccaccacaacacaccatattatcaccattttgcacttggcaaaaaagcagtatcacttggcaatacagtgcctgagggctggcctatgtagcaactgggggttaaagaaacaatgagtccacgcaatcataggcttggacacatgctttgggtttgatttcacattaagactgatcagctaggaatccagccagagtaattcacattaaggctgatcagctaggaatccagccggagtaattccgtcacatcttgacttagcaggcatggagttcatgagcctaagcagttaccttcgcaggcatctagaaaacagatggaaacaatttcagaggctggaagttcttccatgttacacaatcactgtcacttggagcagttgtgtagtcacagactcagaaacgaaacacagtccaagggaggacagtgagtcccagagacgcttccagagagatgatgtaggttacaaatggatgtaagacatacaaacatctaaccagtcccggatcacagagagggccctggaagtcaaggggacagggaaggcagatgattccctcataagtttaatgaactcactttgttctttggctccatccaaagtctacttactctcttgattaggaaatgttttctttctgaatttattagcaagatctttgttttctctccctaattgtatcactttgaggagatgggacactgtgtgctctgccaggatttttatctctgaggctctggtctcctggtgcctgaagttgatgcagttatatactaaggggtttagaccagaatgcatttctcttacattattaaccccacatcccacctactgtctatccctggggctgtttgtttacttcaaaactcagtggggtacttaaggcactctctttttaacaaaatgagtggaatgaattccccttctgaatctgcttttcttcaaacaagccatttgcattatgatgtgaaaggtcccttttgttctatgtctatttgaacttgagttttttggtggtatcctgttcatgagggtgtgagcattgaaaactgccttgaaaagtggttgtagggatgatcttagtcacagagctgtgacaccatccacccatgtgacattttgtcctcactggtggctagaacctattgtgtccagaattggtgggttcttggtctcactgacttcaagaatgaggctgcggaccctcgtggtgagtgttacagctcttaaggtggcgcatctggagtctgtcccttctgatgttcagatgtgttcggagtttcttccttctggtgggttcgtggtctcgctggctcagcagtgaagctgcagaccttcgcgtgagtgttacagctcttaaggcagcgcgtctggagttgttcgttcctcccagtgggctcgtggtctcgctgggctcaggagtgaagctacagatcttcgcggtgagtgttacagctcataaaagcggcgtggacccaaagagtgagcagtagcaagatttattgcaaagagcgaaagaacggagcttccacagtgtggaaggggacccaggcagattgccactgctggctccggcagcctgcttttattctcttatctggccccacccacatcctgctgattggtagagcggagtggcctgttttgacagggtgctgattggtgcatttacaatccctgagctagatacaaaggttctccacttccccatcagattagttagttacagagttttgacacacaggttctccaaggccccaccagagcagctagatacagagtgtcgattggtgcattcgcaaaccttgagctaaacacagggtgctgattggtgtgtttacaaaccttgagctagatacagtgtcaaatggtgtattcacaatccctgagctagacataaaggttctccaaggccccaccagagcagctagatacagtgtcgattggtgcagtcacaaaccttgaactaaacacagggtgctgattggtgtgtttacaatccctgagctagacataaaggttctccgaggccccaccagagcagctacatacagagtgtcaattggtgcactcacaaaccttgagctaaacacaggatgctgattggtgtgtttacaatccctgagctagacataaagactccacgtccccaccagactcaggagcccagctggcttcacttagtggatcccgcacaggggctgcaggtggagccgtctgccagtcccgcgccatgcgctcgcactcctcagcccttgggtggtcgatgggactgggagccatagagcagggggtggtgctcgtcggggaggctcgggctgcacaggagcccatggagtgggtgggaggctcaggcatggcgggctgcagtcccgaggcctgccctgcgggaaggcagctaaggcccggtgagaaatcgagcgcagcgccggtgggctggtactgctggtacctccgcagccgctggcccgggtgctaagcccctcactgcccggggccgcaagggccggccggcctctgcgagtgtggggccagccaagcccacgcccatccggaactccagctggcccgcaagcaccgcaggcagccccggttcccattcgcgcctctccctccacacctccctgcaagctgagggagccggcactggccttggccagctcagaaaggggctcccacagtgcagcagcgggccgaagggctcctcaagtgccgccaaagtgggagcctacgcagaggaggcgcggagagcgagcgagggctgtgaggactgccagcacgctgtcacgactgccagcacgctgtcacctctcaatattcccattgatgctggtcttggatcagctcaacggttactgcatgtatcaacattaaggattttgaggattaaaatttctctttgttatctttagtgttttctgctattagaatataaacctatttcacatggttttggtttgttttgcaggtgttttattcttcccaatgactctatccattgtgagagagaactgtaccaatcggccagagcgtggaaggaccataaggcatacattgacaaagaggttagccatggctatgtgactgtcagatatattccaaactcaaactcggcctgccagccctgctgtgtctggtgggacataccacagatacacatcatctataattatgtgaaaaaatacaaaaaaaaaaagttatttgtctttctccagtgatttaatgatagtcctactgaaaacaatatagagtatgagaagagactgggaactgactcaatggtcttttgaaatctctgtgagaaaatgattcagttataaaagaggaatctgctaatgtttatctataacacatgggttggaatatagagtctatatagacatattctatgcccagtttgtttctatgttaagtatcatctcagatgaatagctgttattacagaacagagaaaacaaggtgaaaagaaaagtactttgtaaagaaaatcctgatcttaatacgtaagtgcttgaaaacatgttttccagattgaagctctgcaagataaaattaagaatttaagagaagtgagaggacatctgaagagaaggaagcctgaggaatgtagctgcagtaaacaaaggtgagcttgtttccatccatgctccactttccaaattcatttccgcacaagccagaggcattagcactgggctcatttttctctcttacctatagaatgtattgtcatagagtacgataacctaagctatttaagtaaaactaaatatgcttaaacttaagcagaaagtaaaaagtcacattcagctaaaatacttacaacatcactgccttccttctttctattttgctttctttttataaaatgaacactttgatccaatgcaaggctatgaagtctcactttttaatcttctctcctgcagctattacaataaagagaaaggtgtaaaaaagcaagagaaattaaagagccatcttcacccattcaagtaagtaactctctgttttccacatttgctgggagtcaatgactgtccacctggcccttcgaagaggctggagggacccctgtgtttcctgcagtgccgcttcagaagaagtagatccatctaggagggcacctagctcatgaagttgaaagcaaagccccacctcaccaagggaccgtggcaatgctcttggcatcctttgttggggaggcttgctgaactccactgtcattctgtgggtgctccctacctggcagatgggaccagtaactagattttactccatgcactgctttctgtggagagtgcttgagggttacagactctctcgatgcagttggtgttctacagagcagcctggaatagtgctgaattctgaaagtgggaagaaatataaatttttttaaataatagcaaaatttgcatgtgaaggagatttagtatttaaacttcaacaaagtttaagccttttatatataaaaaacaaaataataaaaaataattctaaaaaataaaggctatctaaacttgtttagtagaatttgtcaaagaattttttaaactttttaatccaagccatctgattcaactaacctttaactcgatggctgattggtactcggctgccaaaaaaatgagccatttgtccaaagagtgtggctagcaggatcctgtcattcacattaacatttatttccatcgatgtttccatgcacatgaggaggaaaatgttggtcctcttaggttcaataaggtcccaagaaagctgtcactgaatgcatttgcattcagtgttccttttttgttgttttttcgagacagagtctcactcttttgcccaggctttagtgcggtggtgcaatcttggctaactacaacctccacctcctgggttcaagagattcttgtgcctcatcctccctagtagctgggactacaggtgtgcgccaccacatccagctaatttttatatttttagcagagacagggtttcaccgtgttggccaaactgatctcaaactcgtgacctcaagtgatccgcccaccttagcctcccaaagtgctgggattacaggtgcaagtcactgtgcccagcctgccttcactattcctgattctattttaagtccctctatacaaaatgaaggtcgtccattatctcttatcaaggcatctaaatatttgtgcaagactcacagcaacaagcctatttgtaattgagaaagtgccttctgaacactcaaaataatcccttctcttggaacagggaggctgctcaggaagtagatagcaaactgcaacttttcaaggagaacaaccgtaggaggaagaaggagaggaaggagaagagacggcagaggaagggggaagagtgcagcctgcctggcctcacttgcttcacgcatgacaacaaccactggcagacagccccgttctggaaccgtaagttgcttgttccaaatgccacttcctgccgccatgcagagacagcgactcataacttagatcagaaattcagcataaaatgaggaatctacaaagattcaagagaaaggcatcatattctactctatactggaaactcaaatgattttgccatgtattactgttttctttaaattttttctggcattttgtttggtaatgccaagcttctccctggctttttcctcctgatgatgttgtttcacataatacccagcacctggcacagtttttacccagtagaactgttctatagctaaataacgcaagggatgaacatcccgtaaatggatgaacaattttgccccaaatagattttgtttctgctttatttcaagtacataagtgtaataaaaggaagaaaaagaatggtaaaagcctcttaaatgcagggcccatactctacttattctcagtccacttcagtaccagcactagacttgtagaataatagatactctacaaaattatttggttttacattgaactgctaaggatatggcataataacatttgtgcacttttaaaatagtgcttatattttctttagtggcctgtgcacattattcactgaggccatatagaagtaataccccacattcttatagtacatcctctgattgaagcttaccagcctatagagtagatgaaacacaaaatcttctaactgagaagctcactggagaccacccgggctactgtttctcaaactgggatttggagactccaaagaattgatagaccattcttggggggatctagggcttgtcctaggagactttatgttttccctttccattttgatgtctcttgatttcagggtccatgtttgcatttctgtttaaaatcacatcgaggccgaatgaactcttaaagtcacagcatttaacttttaatctagtttctgaaactgtggtgtgggaatccctgagggttattcagatcgctggggacagtaactggggacgcaacatctagcaagacactttattttctgtgctcatattttaatggggtacaggtagaaaaaaaagaaagtaaatgaaacaaaataattatgagttgtagtaatgctatgaaggaaacagtgatcaacattgttttttattattatactttaagttttagggtacatgtgcacaacgtgcaggtttgttacgtatgtatacatgtgccatgctggtgtgctgcacccattaactcgtcatttagtattaggtatatctcctaatgctatccctcccccctgcccccaccctgcaacagtccccggtgtgtgatgttcctcttcctgtgtcaacatttttaaatgggactctttcggagagcgtggggaagacgggtctttgaggtgaaatttaggctgaaacctaaaggatagagagaagcgatccctgtgggagggagcgtgttccaggcagagggaacagtgcaagcagaggtcctgagggagtctcacctttggtttatccaggagtggaagctccttgaaagctgaagcattgcaaaacacagggttatagttgcttatggcagaaggaggcccttcatacctctatctgctttttatcatctgagttgaggccatcctgctcaagccaccaccatttcttacctcggccactgccagacctcctctgtggcctcccaggctcccctctggtcctcaccagtccatcctgctcagaggagctagggtgatcttttaaggacacctgcttttcttaagctaaagagcagaatcccttcacctgaccccagaaggctgaggcttcagtgagctgtgatcgtgccctcacactccagcctgggcgatagagtgagacgctgtctcaaaaataaaataaaatatagcaaaatccttaacatatccaacaaaaccccatatgctcctatccaatcttacactgggaccattgcctcctgttcttgcctgcttcagccactcaacttctctttattccacaagcatctcaagctccctctcgccatggggcctttgcacttgtttcccctccctggaaggctcttgcccacagccccgtgcccagaaaacactactcacccttcagacctcaattgcggtgtcactgctcgtggacaccctctctgtgcctcagactagggtccgcccatttgatacgctctatcagcaagctctgtttttcccccatgggacgtatcacatttgtaatcatagtttttttgactactgtttttgcttaactgttgtcctttccactagactgtgagtttctcaagataaaaaaccatgtctctatgatactgtattcctgacccaaaggaattgcttagtcaattttaggtgaataaataaacaaacaagcaagccaccctgtccagatcaaatcaactcatgtcaatttaacaaagctttgagtgcctgccactgggtgtcactgtgctggtgagtgaggaacgtgcctgccatcactctgctcttgtacacaggagcgaattaggaactgatcccattcaataccaaatttgatgctccttctgatacacaatgtattcttggtgctctggtattctaggacagtggcttccagaattttttcccaaaaagccacagtaaaaaaatgcaccttatatcaggatcctgtacacatatgtgcacatacacaagtatatatgtgtatctgtgtgtatatgtaatatatatactaaagtaaaaatttcaaaaaagtaatactatgtgtgctatgcttaaatatttttatccattttctattacatattttaataatattattgctgtattcctcatatttgctatgtcaacttaagcccttggcacagtgagactcaataacatgaaaaaaagaagaagaaaagaaaagtcaaatccacccaggcacaagatcctccaatgcaatggtctctaaacatttttttattatgtacccatatcaatttttaaaataaacacaccgtctatatttcattacactaatatacaaacatgcctgtgtattatgaaaatatacaaaataaaaaggccaagaacagcaattcatgcctgtaaacccagcactttgggaggccaaggtcagaggatcagctgagcccaggagttcaagaccagcctgagcaacatggtgaaaccttgtctctacaaaaaaatacaaaaattagccgggcttggtggtgcccgcctgtagtcccagctactcgggaggctgaggtgggagaatcacttgagcatgggaggtgaaggctgcagtgagccatgattgtactccagcctgggtgacagagtgagaccgcatgtcagaagaaaaaaaaaaaagaaaagaaagaaaaagaaaatacacaaaatagaaatgtaaagtttgagataaacgtttaaaaaagagtttttaaaaatagttttcatattctttggaggtccaaaacattttgttctcacttattaaagaatgcttaaggaaaacaaatctcagtgtcccacttaacaatgcagtgagacattcagtttatgtttgatgtgtgatcttaattgctttcatatgaaacatgactcagaaagattttctggttccatagatgtgcttcacggcatgctgagtcaatcaggacattctttttttttttttttttgagatggagtttcgctcttgttgcccaggctggagtgcaatggtgcgttctcagctcactgcaacctccgcctcttgggttcaagtgattctcttgcctcagcctcccaagtagctgggattacaggcggccaccaccacgcctagctaatttttttgtatttttagtagagacagggtttccccatgttggccaggctgacctcacctgagatcacctgacctcaggtgatccacccgcctcggcctcccaaagtgctgggattacagatatgagccactgcacccggccaggacattcatttatttatttattttattatttttatttttattatattttaagttctgtggtgcatttgcagaacgtgcagttttgttacataggaatacacgtgccatggtggtttgctgcacccatcaacccgtcatctacgttaggtattttttaatgccaccattaactaggcagtcatctctattgaaattacacttttaaatgtctgtcctccctgagattgatcaattattcttgcaaatacaaaggtattgtatttgtatatttcatgaaacaagtttaaaacccatttaaacggttaatttggaagatttctacacagattagaaaatttgggttccgtggtttttaatgtatgtagatgtgagataaatgttcacatataaataatatgttataaataacataattagagatcttttaatgaaaagtcgtataatgatgaaagcattttcaatcatccatttttaagatattatcttttcttcacctgtatttgatctaatctggttcattcaattcaatttaggattttttccccacagctaccccttcatatcgtttcctataagctttaggtctttctttgaaataagcatatgtagtttgttatctgatttgttaatatcaaatctcaagtattaaggctttttaatgttttgatataatttagaagttctttagaatagatggttttcattaggtgacattcctagaattattgtcataagttattataaatgtggtaacatattttacttaaagggtgcacatctattacaaagactgtttgcgttaaataaaaggtcagaaaggatatgaaaagtttaagagcgtaaaagttggctgggcacagtgactcacacctgtaatcccagcactttgggaagccgaggcaggtggatcgcttgagcccaggagttcaagaccagcctgggcaacatggtgaaaccctatctctaccaaaaaaatatgaaaattatccgggcttgcctgtagtcccagctacttgggaggctgaggtgggagagtcacttgagccccagtggaggaggctgcagatcacaccactgggcgacagagtgagaccctgtctcaaagaaaaaaaaagagagagaggcggagagaataaaagttttaagttggagaacataatgtgtaaaaaaaaatttttttctttttgagatggagtttcactcttgacccccaggctggagtgcaatggtgcgatcttggctcactgcaacctccgcctcccgggttcaagtgattctcctgcctcagctgggattacaggcgcctgccaccatgcctggttaatttttgtatttttagtagagaaggggtttcgccatgttggccaggatggtctcaaactcctgaactcaggtgatccgcccactgcagcatctcaaagtgctgggattataggcgtgagccaccgcacctgaccgtgtaaaaatatttaaattagctaatcaactaaaaacaaaatcattcctggagggagagagggttgaataggcagaacacaggatttttagagcagtgaaactactctatgtgatacaacaatggcagataaatgtcatcatgcattgtccaaacccagaggatgtgcaacaccaagagtaaacacaaatgtaaactatgaactttgagtgacaatgatgtctcaatataggctcattgattgtaacaaatgtgccaccctggtgagggatgtctatggtgagagaggttatgtatctgtggggactggggttataaataagaatgctctgtacttttccctcaaaaccgctctaaaaaatagtctattaaaataattttttaaaatcatttctcattcattgtttaaaacatctcttttagcctaaggggacagatttagtgtgtctgatactacataggatagcagagtctagtaattaagagtaaactcttgcccgggtgtggtggctcacgcctgtaagcccaacactttgagagaccgaggcaggcagatcgcttgagtgtcggagttcgagaccagcctaggcaacatgccaagaccaatctctacaaaaaataaaatattagccgggtgtgatggtgcatacctgtagtcccagcaccacaggcggctgaactgacaggatcacttgagcctgggaggtcaaagctgcagtgagccttaatcatgccactgcactcgagcttgggcaacagagcaagaaactgtctcaaaaaaaaaaaaaagtaaactctgtagccagatcccagtgctaccagttgtcagccaggtgaccttggacaaattacttaacatctccttgcctcaggtttttccatctgttaacatgaggatgataataataacctctgtctcaagaggtagctttggggattaaatgagttaaagtacatagtgcacaaggaatgctcattacgtgtacctatcctattaggttggtgcaaaagcaattgcagtttcagaccgtgaattttaaatcattataactgggctcaaacacatctttctcaatcaaaataggaaccattacacccaacgcattttcgccacgagaaataagtttgtttattcctgtagcataaaaattcatgtttcagaccgggcgcggtggctcacacctgtaatcccaacactttgggaggccgagatgggcagatcacgaggtcaggagatcaagaccatcctggctaacacggtgaaaccccgtctctactaaaaatacaaaaaaattaactgggggtggtggcgggcgcctgtagtcccagctacttgggaggctgaggaaggagaacggtgtgaacccaggaggcggagcttgcagtgagccgagatcgctccactgcactccagcctgggcgacagagcgatactccatctcaagaaaaaaaaaaaaattgtgcttcaggattcaatgaactcttggaaagcattttctacgttctgctggttgtggaagtgttttccctacagaaagttgtcgagatgcttgaagaagtggtagtcgattggcgagaggtcaggtgaatacagcagatgaggcaaaacttcgtagcccaatttgttcaacttttgaagcgttggttgtgtgacattcagtcaggcactgtcgtggagaagaattgggccctttctgttgaccgatgccggctgcagacattgcagtttttgatgcatctcattgatttgccgaacatacttctcagatgtactggtttggccaggattcagaaagctgtagtggatcaaaccagcagcaggccaccaaagagtgaccgtgaccttttttggtgtgaatttggctttgggaagtgctttagagcttcttcttgttccagccactgagctgttcatcgcacgtcacaatctgattaagaaatggttcgttgttgttgcatagaataagagaagacaacacttcaaaacgacaatattttttattttcctctcagctcataaggcacccacttaccgagctttttcacctttctgatttgtttcaaatgccaaatgaccatagaagggtcgacgttgagttcttccacaaattctcatgtagctgtaagaggatcagcttcaatgattgctctcaaggtcattgtcaacttccaatggtccaccactacactcctcatcttcagggctttcatctcctttgcaaaacttgttgaaccaccactccactgtatgttcgttagcagttcctgggccaaatgctttgttaatgttgcgagttgtctccgctgctttacgatccattttgaactcaaataagaaaatcactcgaatttagtttttgtctaacaccatttccatagtctaaaataaacatgaagagcaagtaatacattattagcaaaaaaataaagcaagaaatgcccattaaaatgatgattaatataaccacatttattgaagaatgtattccaatatcaaacagcaaatttcaacaatgcaaaaaccgtaattacgtttgcaccaacctaatagttgtttctaaaaaaattttgctgggccaggcacagtggtgcatgcctgtagtcccagctacttgggaagctgaggatcacttgagcccaggagttctagtccagcctgggtaacatagagagaccccatctcttaaaaaatacttgttaggcagcacatttctgaaattcaagaaaggtcagcaaatttggaacatgtgcccttttgtaaacagaagagtagatgagttgattataaatgggacatctcttctgcatacattctacaagttaaccagagggctatgtggtataaaagatgtttgtggtcacagcctagctcaggctagagtgttgcagagaccatcccaaatcctccaggctgggctcaaggcttctctaaacccttctttgttgcaaaatcccatcttttcatgcttcattggtgacatgtggccatctgccacatagaacaagtgagagtactagttccatatctttattaaataaccatttttcttttgtacaaagaataaatagaaattctgatatttttcttctcatacttccgtcactcacccctctttggaaaccactgcataacagagctaaggggaggataaactaatgtgcctgaaattttactttagtcttcagcctataagagatcactatcttttttcccattttcacctagtttcacagcaaatttacctacggggggaaaggtattattattcttaacatgaaaccacaatatttataagaaagaaattgtgaactttaaagtgtaaagataagggaacactggaatggcaagcctgcctaaggtttttcactctttttgttttgttgtgtttttcttttttacccaacagtgggatctttctgtgcttgcacgagttctaacaataacacctactggtgtttgcgtacagttaatgagacgcataattttcttttctgtgagtttgctactggctttttggagtattttgatatgaatacagatccttatcaggtaagacaatatatgttcattttatgaaggttgttgaaaataggataaccagacataagcttaaatagattgtcctgtctgcattcacagctcacaaatacagtgcacacggtagaacgaggcattttgaatcagctacacgtacaactaatggagctcagaagctgtcaaggatataagcagtgcaacccaagacctaagaatcttgatgttggtaaggaaaaaaatactattttttctattttacctggaaaattctttgtgttactgagctttctgccttggaaacatttaattgcacagaaacatataattcaagatacttagaggagacactttccaggcaattctaaatacaatttgatctctaagtttagctctggtgtactaatgaaaagcttaatccaccaaaagatttggtgagcatttccttccaatatctcccacaggtctattctattagtaaaccttgattcctgatagaagcatctgttggaagatgacacgaaagcgttaggtatttgtttgttattgctgtcaacagtctgaagatatactctgagtaaaccaggatattctctttttttaagagaactttgatggaaagacacaatgctctatttctgctgtcccagtttggagttcccccagttggatccctgcctatgacactgaattagatttcttttgccagtatttttcgtctgaaactagagatattggagcagttcattaacttgggatctaaaaatataagaggatctgaatggaatcagccagatgttccttcccagctatgtgtgttaaactggcttatttctcctttgtttcatggagatgcagttcttttcagtgtccgccccagctcttttctggttaatgaaaatactcatttcctcctcatgatgtctgcagaaatgtaaataccagctgtccatacaaggaaggaggaagaactaaagctggcaagggcatggaccttggcatggcatgccaactccagaagggtgaagagctggactcacaggcacttgggtgcagtttgcaggagctttttgtggtgccgctgggttttctctgtgagtctggtgcagagccagtgtcatcaacagtaaaagtgggcagctttctgggtcacatgccttgaaaggggtagggattcccatcccagaatgatcaatatcaccacctgtcatctcctttccactgcagggtcacaaaggcttttgagttctgggagtcccctaagaaaatataaatcctcagttctcaatcaacacctctcaattaacacttagtggaatcagttgtcagtcaagagcagactgtacttgcaaaataggtcttttggtcactgaccccactcggctcaaatcttttcaaatatcctgcttatctgttgaccttttcctcaaatcttacaaaaaaaagagagagagagagggagggagggagagagagagagaggaaggaagaaaggaaggaagaaggaaggaaggaaggaaagaaagaaagaaaaaaagaaagaaagaaagagaaaagaaagaaagagagagagagagaaagagcctgcaaagacttggaatctcaaccaaccattagaggcactagaaatattatacccagatatttctccccaaaagaacataggacttttattggtggtgacataacaactctacttagtgaaatctgatcgagtcccttaatggtgaaatgacacactgggtggagccagttatgctgtttcacttcaagccgtcctctccaccttccagactattcctatgggagatgattattagcccgtttttttccaatgttttgtctaaaaataaccaaaatttaacttttcctgagaattacatggacttctggaagtacttttcccactgcttttaagtgggctctcctccctttaacacccacccatttttttcatatgaactcttatttttttttttatcttaaaccttttcattcatagctttcaatctgcattttgaacctaataggaaatctctgttgggcttcagcactgtctgtatttaacaccatgtgtttctttctaggatttagatgttgtgcatgaaaaactatatagtgaatggttttataagttctaaagctaacagaaattactcttgtattttcctatatcaggaaataaagatggaggaagctatgacctacacaggtattcacacttttttattcttctcaacagcttcttccccaataattgcatgatccagtggtttcaactaatttctgtttcttaccgtgttgcacagagcaaagctgggggtgcatgcttgttctaacagcattctccactatgttttgtcattgatcacagaactgtcattttgcttttaaatcagctcactgtcccatcaagatgttccagagcatttactcactcccatgcttgtttgcttgttggatgatgcttttaagcatggaatgatgtgaaggaaaaaaaacagaatggcctttgggagccccgggaaagggtgggagatttattttctttgtggtacttacacattgatttggtgggggagcttcatgaaaatgggttggagatttttattaaatatagcatcaaaggcacaaaatgactaatgagaattttaagagcactgtaaggccgaagttgaaggaaacaaggaatttctttgttgatgttcattcattaactttggtggtgaaaagcagcagccgtaagattctgaaagctctgcagagaggtggtgaataacgagaaggtgctgggagttggggacagagtaccgggagtcaagatactagtaaagggccacacacagtggctcacacctgtaatcctagcactatgggagcccaagcgggaggattgcttgagtccaggagtttgagactagcttgggcaacaaagtgagataaaaaaaaatttttaactagccaggtgtggtgatgcacacctgtagtcccagctactcagctactcaagaagctgaggcaggaggatcgcttgagcccaggaggttgaggctgcagtgagctatgatagtgacactgacctccagcctgagggacagagagagaccctgtctctaaaaataaataaataaataaaaaaataaagacactcaatagtgtcaacacagcaccaagacaacacacaaacattccataaacaaccctcagccctgtcattttatgcccctccaaccctcatccatccctcactgtgctctggaggggggacgcacgctcctgatggccgtgtcacttggtcacctggcaatattcgccattgctaattttctactctgagcacagacctcaggcaggtctgccacccgaagcagctgggcactgtccttaccgcctctgctgagacaaaactgaggcacagacgttaccagtaccctagttaatgtatccacttgggagaaaaacatccgtcaaagaaatgtgaacttaattggtgccatctatattaatatcttctttatctatattaatatcttctttatctatattaatatcttcttcatctgtattaatatctttaaaattaacatcccaaagaatgttgctgttcctggtaccctgttcggcccctctaacctccagagctatggtctcagatgcttccttttagagagaaggtcattagtccaccaagaagccaaatgacaacaggaaaggtgatgggaagatgaaaacaaaggaaggtggacttttgggtatatgttatagccatgtatgtatgtcttcttttttctattttctcttgttcttcatcttaactgtcctcaatctgccccacaccaaccctgtgtcactcccagcacacataagacagagcagaagaccccatccttgagctggtctcccctgggtatgggctgaggtaacatcccacacaccaggacgatcttccctgcctcccatcggtcacattaagacattttcaaagtgtaatattataaatggacctacctctaaatattgactttacagttattttatgaggcactcaatttatagctaagggtttttcagtctagtgtcatgaaagagataaaagggtgttcacagattatttaagacataaggctggtcagggatgagtcagagagtcattctccatgaagtcacccctggccaactttgaaaggaagaatgtttaactgcactttgggcgtaaatgacaagcatctgggaccctccccttccctgatccctgccaccaccactcaatcggccagataatcaattgtttctgaggtcactttcacataatcttggcaactttagttgttgaaagcatgcatgcaggggcaacatggtgttacctgttgctttttttttcccccttctaagctccttaccagagagcagatctaaggatactgtgtaacttgaaataaccggcattttcagactttgccatttcatagtccatagggcaagccatctttcagtggatatccacatggtgggcaggaaatcttgacattggtttctcagaaaatatctgcctagtcacacctgggaattcactaaacacccaaatgcagtgtttgatgtggccttacctgctccttgtatcttattggattgaatgagaacagatgcaaaacaagtatgtacagaaatgccaggaaaactactgtcttccaatggggttcaacagttcaaagccctccattgatggagccacttaggaggtttcagtgtcttaattcttttagattttgacagttttagaaaactaaaaaaaaaaaaaacaagtttttatcgtgaaatttgattacaaaagattttgagagaaatgataagaaccagatctgaagaatttgaaatttgaaaattcagcagagcatttttttaaatgtatcttgtacaagatgaactaaataaatgtttttaaactgacttctttttggtggatttcaaaagttaaccttcagacttatttagagggttttcataaagcaagtttttttctgttgctgctcaatttctttcttttcttttctatcttttcttttctcttccttttgctgttccctgtgtgtgaagcaggaggggcagctgaaatgctttgcatactcaccctggtcattttccagttaggacaagctcaaagggagagcacagctcagaaggtggcactcatgactcaggaaataatttgtggctcatttgaaagcagcatcttctaagtgtgttgcaaaatagagaaaaatcaacaggttgttggggtgtttattttccccactgcgtatgaaagctggtgctgctgccctttgatggccaagaggagctcctggcagccgtggccatgtgtcccgggggtgtgtggggcaggcggtcagttcttggcagccttcctctggcagggctgcttcctgatcctttgcttcaagccttctgggctgttagaccacacagagctccaccctcagcagccacgctgtaaccacattgctttcactgattttgactcatctcccccatagtgacagtgtgtgccaaaggtggctgtgggtgacacagccgtgtgttcgtgctgtacggcactgtggtcatgggggtggacgctggagctcctgattagtttgagttcaaatcccagcctcgctggtgggcatgcttagaacagaccctagcaggcgccaagccccagtaagtggtggagtcattggtaaaggataatgctgaatgcaggacatttatatggatgaaagagtatgggaaagggaatttcagtgatatgaattccaaagcgtgttagtatattttataagaaacaaaaaggtattcaccagcaccaccaaactccatcatcagtcacaggcaaccaagaattgatcactctcccagaactttgggaggccgaggcaggcagatcacgaggtcaggagatcgagaccatcctggctaacacggtgaaaccccgtctgtactaaaaatacaaaaaaaaaagaaaaattagccgggcatggtggcgggaggctgaggcaggagaatggcgtgaacccgggaggcggagcttgcagtgagccgagatcacgccactggactcctgcctgagtgacagagggagacgccgtctcaaaaaaaaaaaaaaaaaaaagaattgagcactcaagtccgtcttctaaactgcctgaacctcttgagatgagaagaacaaaacaaacctgcgctgtcctgatgtaggttaccctaatggagcttcctgggttctcctctccctgtcacatctcagggactccaccttattttaaagctgtcttactagcactgttggacttttctgtttcagatgctcaaacaagagatggagcaggggcagggtttggggttaaatgggctggaggtgagattggcccccctaaggtgttgaggacacttggggtgaaagtcgttagggtatatgtaggtcagagccagggccgctgcgtgcacagaggtgtgtcatggagcggccagtaggcaccaaaatccagccaaagctcggccatgagagctgggtagcggcaggggtgacaacagtggccaccctggtaaggttaaggtcagacttgggttagtctaagctgtcagagggtgttcatcatttttcttacctttccaatagtgaccctattccaaaggccttgtttcttgtgccagagaagaaactaaagtatagcacgtgcagaactccttaagatcctccccaggctgcggaatgaaatgtatctttaatcagttccaatatatagggggaaaatgtgccctcattcatccatgcaacatataaagacagaaagaatcgaaacaaccacctctgtgccaaacgccgccttcacagggagtgcagtctggtgttagaatgcacgatgcaaagtgccttgaccagaaatatatggcgtcataagagccaggagagggccccaacccaaccctgagaaatcaaaggaagctttccaaggagttggcatttatgccgcatcctgaaggcaacagtgcagtgatccagacacaggatggaaaaggaagtcagtccaaccagaaggcaagactcgtgtggggacttatcatcagttccgtgacagtgcaagggaaggagaagagaaggatgagctgaaaaggcaaccagggcctattttatggagtgtgttatatggagaatgatgatatgatgtatcttccaaacagggatgttttgaccatgggggaggagtactaaaaatagttaattatttatattaattattatttatattaattctatataaatattgttatgtatttgtttaccaatgaactagtcagtagatctataaaacagttgtatttaaaactattttctaagctaaaatgtcaaaaattctggacaaatgccaaaatgaacagggtaccagtacagcagatacaaactgggaccctcccaggcaaacgaaaaatgtggtcaccctagttacatgctacatcaaaggatgtaatccctgtcctaaaagcaataggcagacattcaagagtattaaactgggagaaataatatgagaggatttgggctgatcagattaggtggcataaatagttatgagaatagttttgtgagtcacattggtttgtgggtcagttctggctccatcacttcccaatttgaggaccagttgctaacagtattacaacacttactgtggtccagcgctcttctgaatgctttcgtatattaatgtatgtaaccctctcgataacttcgtgaggtcagtactattattatcctcatttttttttttttttttaagacggagtctcacactgtcgcctgggctggagggccgtggcaccatcttggctcactgcaacctccatctcccaggttcaagcaattctccttgcctcagcctcccaggtagctgggattacaggtgcctgccaccacacccagcttattatccccattttacagatgaggaaattaagccacagagtgactaaataactttcccaagattacacagctgataaatggtgaaattcaaacccagcgagtctggttctagctgtgctgttcatctctacactatactgattctcttggacaatttatttaacttcttttattatggctgaattttctcatctttaaaaaggtgataatacatacacataataatacacaaggatttcatgagatattacctgaaaagtaagccctgaattcatattattgtatgactgaagtttgataataaatttgattagtgagagacaaattgtatcaaagagccctggaattttttttttttttttttttttttgaggtggagtcttgctctgtcacccaggctggagtgcagtgacacaatcttggctcactgcaacctccacctcccaggttcaagcaattcccctgcctcagcctccctagtagctgggactacaggcacagaccaccatgcctggctaatttttgtatttttagtagagatggggtttcaccatgttcgtcaggctggtctcgaactcctgctcaagtgatcctcccacctcagcctcccaaagtgctgagattacaggtatgagccactgcgcctggctgagccctggaattttgaaggacatttatcttcacattaatggatgacaaaattgcagtttttaatgtcaatgctatattaataaagaggaaaagttatgtgcatttaccaataagtagatataatcagccattaaccacacacaaggtagtcatctataaatgacatatatatttatttctatttttagactatctttagggttgaacattaattggctttcatttgtaaaataaatagctattcctacaattcatccataaaattatgtaggttagaaatttatggtcttctggttgctctgcctgtggagtagccattttttattcctttgctttcttaataaacttcctttcaccttacaaaaaaaataaaaacggctaggcacagtggctcacacctgtaatcgcagcactttgggaggccaaggtgggcagatcacctcgttcgagaccagcctgaccaacatggagaaaccctgtctctactaaaaatacaaaattacccggacgtggtggtgcatgcctgtaatcccagctactcgggaggctgagacaggagaatggcttgaacccaggaggcggaggttgcaatgagccaagatcgcgccattgcactccagcctgggcaacaagagtgatactctgtctcaaaaaagaaagaaatttatggtatttttactatggccaattctgattttggtgtcctgctagtatcaaaaagccaatttacaatttgcttttggatactagcaggacgccaaaatcagaacctctgaaatttcaaagcctaaatcaaattccatttcaagctaaaacatattatgtttcaagtagcatgaaaatcacccaagatgaataccagtttggtccaaatattggaaaccctgtgccttcagaaaaaaaaaaaaaacaaagagctcagcaaaacatggaagggcttaggagaaaggagcagatgtattaacgcagatagtctgttcgggctcttcccattgtgaagtttaaattagtaccattagaaatgagacttggaagagaatagctatattaattaaaatatcctgccagatagcaacaagcaacaaactacatataatgctttatgatttttctgatcgacccattgcttgcttcttgaaactgtagacacctggcccggtgaaattcaatttgctactgagcacaggtacccagaatcaggtatagatgatgccataatggaggggttcacacaacccaggggaacggccagagaggctctgtggaggggatgagagctcctcttgaaggctgagagctgactgggctaatgaggcagggaagtacattctagaaataaatacaaacactgaggaaggagagagcctggtactttcaggacattgcacttgttcctgtggctggtacagaggtgatgtgccaaaggggaagagaagaggccacagaagctgcagaagtcagcctgtgtctgcagaaacaatcccttctgcttcttatgacaccatcagcacctgttaattataacactgctccaggtagagttaaaattccatgcatgcatgatctcttaaattacccgtctgtggaatatagcatgatgtaattctgtggttaagtttttaaaagtaagtaagtgtcatccagaaagaaatgtgacttggcttgcgacctgggtatgttcttgaatttgtcttaatggattcacggcttttctgtttccgggattggggaataattatctgtaatgtgaaatcatctacatttattctgaaaattcacctgtcagaacaagcctatctataccttttctctctgaataaacagcttccaaacgaccaaagaaaaaggtttccttttttgagctgaagacaggcagaaaccaggagacacatggaaaatttaagttctaatgtcgaataaatttaactttctattttgatataactttacatttacagaaaggtcgcaagaataatttcaagaactgttaccccatttgctttattgttttttcttgttctttcactcactttctccacacaccttttttttctgaatcatttgcaagtaatttgcaaacatcattcccctttatatataaatgctttaggaggtatttccgtagaacaaaaacattctcttacataactgttatgcatttatcaaaatcaagcaatttaacattgttacaaagcaattgtcaaatctacatttcatgttcaaatgttaacaattgtcccaataatgccatattcatcattttttgcttttctggcctgggatccaatccagaatcacacattgcaggaaactcacctctttttagagtattcttttatctggaacagttcctcaacttctcattatcagtcatgatattttaaagagtgcatgccagttattttgtaaaatgtccctctgttggggtttgtctgatgtttcatcaggattgaattgaagctgtggatttttgtcaggaataccacatattgtgctctcgggatatcttatcaggagctgcataacatcttggtggtattacctttgattacttggcaaaggtggagtttgctaggtgaagccactataatttttttcttttttaattaataagtaattcatctaccagcttttaaggcattcacgattcatttctgcctgaatcatttgttgttaccatgatggttgcaaatgatggtttctcccactctgtaattcctcctgcttgctttttttttttttttttttttttttttttttttttttgtctgagacacggtcttgctctgtcacccaggctggagtacagtgttgcaatcttggcttactgcaggcttgaccccccaggctcaagggatcctgccacctcagcctcccaagtagctgggattacaggcgcatgccaccacactcagctaatttttaaaaatttattttgtagagacaaggtctcactatattgcccaggctagtctcaaactcctaggctcaagcgattctcccatctctcaacctcccgaattgctgggattacagtcatgaaccatcgtgcctggctcctcctgcatttcttaggtagtattgtactgtaaagaagagatttcccggccagatatggaggctcacacctgtaatcccagcactttggaaggctgaggtgggaggaatacgtgcttgagctcagaagttcaagaccggcctgagcagcatagcaagaccttatctctactaaaaatacaacattcaaaacattagctgggcttagtcccagcacctgttgtcccagttactcagaggcagagcttgcagtgagctgagatagcaccactacattccaacctggatgacagagccagaccctgtttcaaaaatatgaaagaagagattttcctcctctcctgcgtatttatttctatcagtatggacttagattctcagtttattccatggatattctcttgctatcattatttattttgatgattaaagtgtcttagattggccactggtgtccctgcacctggattccgtgtacttttgaagcatcctcatcattttttgaccacctcgttgctttctggcctaaaagcatgttccaggttcatatggcatttttgccactccacatttggaaacagccatttctccaaagggccccagttccttttaaaggggaatggcatttgaacaccaagatctgggtctgaggtgtataaaattgctgctgaggtgtcttggcatatagatccttttgatggatagagctaagagacacactggcatctatcaacatctattcttttttttcttttctttttttttttttttgagacagagttttgctctgtctcccaagctggagtgcagtggcatgatcttggctcactgtaacctccactttctgggttcaagccattcttcttcctcccctcccgagtagctgggattgcaggcacctgccaccatgcccagctaatttttgtatttttagtagagacagggtttcaccatgttggccaggctggtcttgaactcctgacctcaggtgatccgcccacctcagccttccagagtgctaggattacaggcatgagccaccgcgcccagcctcgacatctattgttgtacctacagatatgtagagatatgtctaattgagtgacctaatgcttccaatataatgttaccctgctcctgatttcaattaaaatgcttttagagtttctctattaaataagaggcaagctttaggactgagttatatatacttttatcatgttaaggaaatagccatcagttcttttttttagtgcttttatctttaatgaacgttgaatttgtcaaaaagctttttttagcatctatgaagatgctcagataattattctctttagatctattaaattattattgtgtattatattaatagatttggtaagaatgaatcctttcattcctgaaataaattccactgggtcattgtgtgttgctttcgtaatattgaattctgttcactaatattttatttaagatttttgtatcatatttttaaatgataccaatctgtgatttcctttttgtttttaccagcattatctcttagatatattagtttcttattactgctgtaataaattaccactgtgcctttaaaacaacacaaatttattctcttgtgtttctaggggtcagaaattcgaaatgaatcttactgggctgaaatcttctgggggctcgaggcaagaatgtccttgcttttccagtttctagaggctgcctgcattcctcattcatggtctcttctgccatcttcaaatacaaaaatgtagccaatcttcaaatcagtctctcccccaacccccaccttcctctgttttctggggtcacatctcgttctctacccctccttcctaccacctccctttccctttataaggactcttgagatcccactggccccacctggatgctccaggatactcccccaccccaatctcaggatccatgacttagtcacatttgcagagtccctttggccaggtaaaggaacttgtccatagtttccaggaatttggatgtggacatctttgccgggtggagtccactattctgcctatcacagctatcaatgttatccttgcttcgtgaaaagagtttggaagttttcttgagttatctgctctagaacagtctattagtattctcttttcattgaagatttgttaaacttctcctgtgaaagtccacagacctgatgcatctttgcacagtggttctttgggcttgctttttcttctatggaaactgttctatttaagctttctatctatattgggttgttaaatcaagtttagcctaaatctgcctcctcacatattttaagttcagcctaaaggtttctctgtatatcgtgaactataacctaaatagagttgtatacagactgtagcctactcttgtgcccatcactgagttttggcccttcaaaggtggccaactgctcaaactctgttcaaataaggcaaacactgagctgtaaccaatctggctgcttctgtacttcacttttgttttctgtccgtcgcttttctttttctgtccatacatcttcttccaccacgcagctgcgttggagtctctcagtctactctggcttgggaggctgccagatttgcaaatcgttctttgctcaattaaactctgttaaacttaattcagctgaggtttttcttttaacagcatcaatttcggcaaactattttcctgagcaactacgtttcatccaggttttcaaatttgttctcactgaggtctgcaaagtagtctcttgtttttattttttttttaagatggggtttccgtctgtcacccaggctggagtatagtagcaatcatggctcactgcagcctcagcctcctgggttccagtgatcctcccacctcagccttctgagtagctgggattacaggcgtgtgccaccacactcagctaatttttaaatttttattagaggtgagttcttgctatggtgcccaggctactgttaaactcctgggctcacgcaatcctcccatctcagcctcccagagtgctgggattacaggcatgagccacatctcttgtgtttttaattttgtgtatttcaacgatttttaaaatatttaccagtttattataaaggatattataagaaatgcaaataaatagccagacaaagaggtacataggctaaggtccagatgggtcccaaacgcagaagcttctgtccttgagttcgaagtgtgctaccttcacggcatgtggttgcattcaccagctggaaatttctctgaaccctgttatcgtttaagatttttaatgaggttccattacataagcatgattgattgcatcattggccattggtagttaactcaatctccaggcccctgtccactccacagaggtctgagagtcccaactctctaatcatgtggaggtctttctgatgatcagcccagctcccaacctagagctgtctagggtaccctagccatctcctcagcatataaaagacactcttatctccctggagattgcaagggcgttaggatctctgtgaactgggggtagaccaaatacatttttcttattatgccctagtcccctggccatgaaccccgtagtgagaagattataaaagtcaaaagatattggcacattcctagaattgcattcagccatcaataattagtccagtccatcattctgtcatatgaaaatacctcctagggcaaggccactcaggtttgccagcttctgttggatcttgccaggagtggcttagcaatatatgacctcacccttttaggagtctggtataatggagctaagagacaatgtcatctcctgttctgagcctttttcaagctgttaatgtaatattggatttctctcatgactcatgacgtaacccacttattcattccttcagcctcagttactattcctccatctctccatttatgaccaaagttttccaccttcggaagagacattagattcagccactgtgctgctctaggcttcaggcagcaatactagtctagtattatcactagactaccaataataggctagcaagtacctcttgctcagtctgctcccattcaaatagagtaagtttatataggtgcagaactaatgaactgtttttaaccaccaggcagtatacctgcattcactgttaaccccagttttgccagatggggtgaaggcacaacctgccctatcaggcccttaggaattctgacatcgttttaaagtataattagggttttttgcttaggaaacatccctgcttccaacaccagcagttgcatctctgcatcacgtataaaaaagaaagttgaagtgctgtgcagaagacttgcatcatcacaccggcatcctctcctgccccctctcctcttatcctcctgcaaagcagagaaatctgtccagtgggggacactcccttagcccccttatgttgagtgtgaaggtatgtaagccagccttcaatgcttttgtctccccacattttagacagcaaatgttttaactgcccattccttcctgttcttatggaactgttactctaaggataatgtgcaccattatacgtccatttgatgtgagctatctttgctcacttttggacattatgggctataaaatgtgtcctttcatctgaagaaatgtaacttggtggtccaaattagtacagtattttccgttcctatcctgtaataatattttaagcatttgcattgcatttaagtagatgcaatgcttaaaatgggtctacaaaacccagcctggggtaagtgtctatttctgttaagaccctgatctatcccgtcggggctactggcattggttgctcccatgtaatccacttaccagctatgcatggggtgcctaccccaggggaatctgccccatagccatctgcagtctctgactctctttttggcattatatgtctgacagtgcaagaggaataggtccagacttagcccatctctgcatggctgcagcaccaccccccatacccactcattttatgagccccagtggctaccacaagggagcacaccaaaaggtccacttgatggtgcccgtaatactccaatacatattcttatttactcttgctcccttgtactgataacacctattgtgtttctatatatttctcattgcatcttctataatttcttctttatcaagatagttgctcttttggtaattgtctttgtacttacacatttttattgcccttaatccctgttttgtgttttttcttttttggtatttttaatagagacagggtttcaccatgctggtcaggctggtcttaaactcctgacctcaagtgattcacccgcctcatcctccccaaactactgggattagaggcatgaggcaccatgcccggtctaaatccctgttatcttatttaacctttcattatctcattagacagtttttaatggcttctctcactcccagctattacctgaatcatactgaatgagattattctctttggtctgtgctccctctcacatttttagttgcattatttctagcgtgtcctataaaatgcatatattattttttcacacttcttctacctttatttttatcctagatctgataaatctattaaatgtgcaccctctatatttttgcttccatttccccattgatttcttggacaaacgagtcacagcctctggaagattgctgaagaagagctgatgcgcacagtatcccctgcattcttgtgtgtttcaaactgttcctttatagccttgatacttgaaggagatctggactggatatgagatgctaggttcatatttgaatttctgatttcagatggcttttccatcctcatatgcttgattgagaacatttaattcacacagcactggtgtgttgtggttttctgcactttatagtttatttcgccaggagcattttcttaagatggttttttaaattcttgttttccactttatttttgttgttgtcgttgttgtttattttatttttttaagttctgggatacatgtgcaggatgcgcaggtttgttacataggtaaatgtgtgctatggtggtttgctgcacctatcaacccatcacctaggtattaagcccagcatgcattagctattttccctgatgctctctttctcccaacaaccccacaacaagccccagtgttagatagttccccttcctgtgtccatgtgttctcaatgttcggctcccacttgtaagtgagaacatgcagtgtttggttttctgttcttgtgttagtttgctgaagataatggcttccagcttcatccatgtccctgaataggaaatgatctcattcctttttatggctgcatagtattccacggtatatatgtaccacattttctttatccagtctatcattgatgggcatttggtttgattccatgtctttgctattgtgaatagtgctgcagtgaacatacacgtgcatatgtctttataatagaatgatttatattcctttgagtacatatccagtaatgggattgctgggtcaaatggtatttctggttctaaatctttgaggaatcaccacactgtcttccacaatggttgaactaatttatactcccaccagcagtgtgaaagcgttcctacttctctgcaaccttgccagcatctgttgtttcttgacattttaataatcaccattctgactggcatgagatggtatctcattgttctactttcttttatggtaatttgatatagatttaggttcttttatttcatggatttatactatttacaaccctcctggtttaagagaattcttttctgtgagtgtaactaagtatacttcctctttacctttttattttattattatttgggagtgaaagtgagagaggttgtgtgtcttccaacttttcgtatctcttttttcttgcaggatctgaaatttcccatcttttgcttcctctttgttttaccacccagtttccaatggctgtttctcccttctctcttcctttgtgtccttttctgccctaagcaatgcctcccagactgctgccttcaatcgtgcacaggcacaaggctgggacttaggggtcccatcctcattgtcagtgctgtggctcaccaggaatctttacagtattttatgcaaaagattgacgttctttccaccaacagcctccaatcaatctttgactccactgacacttccctcttctctcttccatactgttttcccagagcttgtggccacagtgtgacattcagctctgctgggatttggtgtcaacgttttttatctacacgtgatctgaagattgtaggattctctatcttctagctagaccgaggttgtgggtttggtatagttttgcttattcttcttgctggtctgtatggctttatgggtggtcattgcactcatctaggccacctctttccaaatggtacttaggcacaactagagaacaagtgttattttctgcagggctacagtcatcctggagatgtagaaagatctgagagagagaaagctggtgccttctttgcatatgagaaagtcattcagttatctaaggcacacatttatctaggacatagaactttcagggcaaaaacaacaatcaaagaaataaatccaggcatttgatttgaagagcttaattgcattcagatttgcttttatactgagtgttagggaatataaaataaaaatatcatactaagcattgcctattacattcaaatactttcaaatttgtcattcacccagcaaccttataagtagtaatgattttatcatacaactatttctacacttgacagatgagggagcaagactcagagggactcactcacatgctcttctggttgcaaagttgatttgagtggggccaggagtgaaacccaaatcccctggctgaaaggaccgtgccattttcagcactaaccatgcttagtcatagatgttttcacgaatgtgatcttttttttccccaattttctgttgtttaatcacctgtaacctaaggccactctgtgataacaaatgactaggggaaaatgcttttgagtgtcatacttctcattgattaactctgtaaaaacaatgtaagttgcttgtccaggtaagtagaaagccttttctccactaatgattcaccttcttctctcttttcacagaggacagttatgggatggatgggaaggttaatcagccccgtctcactgcagacatcaactggcaaggcctagaggagctacacagtgtgaatgaaaacatctatgagtacagacaaaactacagacttagtctggtggactggactaattacttgaaggatttagatagagtatttgcactgctgaagagtcactatgagcaaaataaaacaaataagactcaaactgctcaaagtgacgggttcttggttgtctctgctgagcacgctgtgtcaatggagatggcctctgctgactcagatgaagacccaaggcataaggttgggaaaacacctcatttgaccttgccagctgaccttcaaaccctgcatttgaaccgaccaacattaagtccagagagtaaacttgaatggaataacgacattccagaagttaatcatttgaattctgaacactggagaaaaaccgaaaaatggacggggcatgaagagactaatcatctggaaaccgatttcagtggcgatggcatgacagagctagagctcgggcccagccccaggctgcagcccattcgcaggcacccgaaagaacttccccagtatggtggtcctggaaaggacatttttgaagatcaactatatcttcctgtgcattccgatggaatttcagttcatcagatgttcaccatggccaccgcagaacaccgaagtaattccagcatagcggggaagatgttgaccaaggtggagaagaatcacgaaaaggagaagtcacagcacctagaaggcagcgcctcctcttcactctcctctgattagatgaaactgttaccttaccctaaacacagtatttctttttaacttttttatttgtaaactaataaaggtaatcacagccaccaacattccaagctaccctgggtacctttgtgcagtagaagctagtgagcatgtgagcaagcggtgtgcacacggagactcatcgttataatttactatctgccaagagtagaaagaaaggctggggatatttgggttggcttggttttgattttttgcttgtttgtttgttttgtactaaaacagtattatcttttgaatatcgtagggacataagtatatacatgttatccaatcaagatggctagaatggtgcctttctgagtgtctaaaacttgacacccctggtaaatctttcaacacacttccactgcctgcgtaatgaagttttgattcatttttaaccactggaatttttcaatgccgtcattttcagttagatgattttgcactttgagattaaaatgccatgtctatttgattagtcttatttttttatttttacaggcttatcagtctcactgttggctgtcattgtgacaaagtcaaataaacccccaaggacgacacacagtatggatcacatattgtttgacattaagcttttgccagaaaatgttgcatgtgttttacctcgacttgctaaaatcgattagcagaaaggcatggctaataatgttggtggtgaaaataaataaataagtaaacaaaatgaagattgcctgctctctctgtgcctagcctcaaagcgttcatcatacatcatacctttaagattgctatattttgggttattttcttgacaggagaaaaagatctaaagatcttttattttcatcttttttggttttcttggcatgactaagaagcttaaatgttgataaaatatgactagttttgaatttacaccaagaacttctcaataaaagaaaatcatgaatgctccacaatttcaacataccacaagagaagttaatttcttaacattgtgttctatgattatttgtaagaccttcaccaagttctgatatcttttaaagacatagttcaaaattgcttttgaaaatctgtattcttgaaaatatccttgttgtgtattaggtttttaaataccagctaaaggattacctcactgagtcatcagtaccctcctattcagctccccaagatgatgtgtttttgcttaccctaagagaggttttcttcttatttttagataattcaagtgcttagataaattatgttttctttaagtgtttatggtaaactcttttaaagaaaatttaatatgttatagctgaatctttttggtaactttaaatctttatcatagactctgtacatatgttcaaattagctgcttgcctgatgtgtgtatcatcggtgggatgacagaacaaacatatttatgatcatgaataatgtgctttgtaaaaagatttcaagttattaggaagcatactctgttttttaatcatgtataatattccatgatacttttatagaacaattctggcttcaggaaagtctagaagcaatatttcttcaaataaaaggtgtttaaacttt

SEQ ID NO: 37688 - DNA, 14664 bp, Homo sapiens
cgcggagtctggaagtgcggcggccgggcgcgcggggtgggcggcgagcggagccggccggagcgggccgggcagcggccgccgccgtcccggggcggacgggcgcgggcgggaggatggagctgaactccctgctgatcctgctggaggcggccgagtacctggagcgcagggatcgaggtagcgctcgcaccccattgtgcgcccgcggcggtgggcgggcggcggggccgtgccgggcgggggccgctgaccgcgccgtgtgtccgcagaggccgagcacggctacgcctcggtgctgcccttcgacggcgacttcgccagggagaaaacaaaggcggccggcctggtgcgcaaggccccgaacaacaggtaccgccccccgctcccgaccccgcccggcccggtccgaacccccgcccccgcccggagcgtgctctccgggccccgattcccggcccgcggccctcagcgccgccgccgcgcgccccggcggccagcctggaggaggaggcgcgcaggccgcggccgcagccccgcccggccggccccgccctcgccgtcgccatcttcccgcggccgcgcctcccgggccgctcgcgtaaacagtgccacgcgtacagcgcccgccgccggggtccgctcccgcgcccgctccccgcccccgagttgttctggacttttccaggcggtagaaaagttgtcagcgggcgctggccggtgccccgtgggtctggggaaacaggctcagccagggtctgcgggggctgccggccctaaccccttctctccgcgggtgggtgggcggcctcctttcgactggctctgccagccgaactctgctgctcggccaccttcccccgcccccaggagcctagacagagaagcgagtggaggcgctgtcctgggccctcactcctcccagggtgcccaccgcttctgcccagcctcctgacacagcgaaactccagccaccagtatgggggtcctcttttttaagacagaggccttttaagggggcgggaggagggggcaggctgcagggcaggggccccatgaagtcgttactacgggtgccagctgcgccctccataccttgacctcgtgttcaggcagcagaagccctgaagctggggtgcgtacaggtcccccgcgtggggagtggggaccctgggccggggctccccggggatttccaccctcctggctgctgtgaggaccatagcacacctggtcctgtctgggcccaccttggcccagcccttttgtgtgagcaggctgggagctgcgtttgtagggggcttcagagccccagggcatggctcattcctgtggtccacctgttctagggaatccgaaaggctggtgtagggacccatttctgtggcatcctgagccaggcgaggaattggttgagtctccagctgccctggctgggacccgtccctgagtcccagcccctggtcccctactggggacagtttggggaaggacaggagtgtgacgagggaaccattgcctcaggcctcctcagtgagcaagcccggcccccgctgccgcttctctccaaaccaagtccctgacccgtggagaactctggggcgtgagctggggctcccccagcatggagaatccaaagctgacaaccagcgtcctggccaaggctgcccgaacactgcctctatgctgagcgtttcacacatgcagccagttcatcttcaccccaggctcagagaggtgatgtgatttttatctctatggccaaggaaactgaggcaaggagaggtttggttacttgcctgccactcacccatctctgatgacgcctgttcctgagatggggtcccagctgtccacattctgctgggacagagaccatgggggcactggtgagggagacagagggctccccaactctggtgcatctcccctggctcctctgggccgagccccgctcccccggggcctgaggcagcccagggctggcggcttggccccttcctcgggtgggcagcactgccctggaggtttcctcagccagcccagacaagtagctgggcggagcagggggccagaggatctctgagcccctgacttgtccccacctgtgaggcttccatgctctgccaaggtgagggaggggacatggcacagtgaggctggggcaagggtagggagtggggccggaggacagtgtcagggttgagggaggcggcagagcactggggccagcctgcaggggggtccattctgtgggaagtgtgcttgtctcctggggtcacgggaatgctgggaacgcacttggcctggcctcagcggggacaggtcccacctctcctgagggatagagtgctcctgggacccatgttgcaaacatccccctcgatggaccccaagggtctctgggcccaggaggagctgcaagaggggccctggctgctggaggagggccccctgcctccagggtggggtccagccccgtgccacccttcaaggggtaggcaggtaggcttttatgttgaagggcacctgctgaccccgacctccctcttgactacagacccacgtggccaggctgcagtttgggctgaggacagagagtacggctcattcctgcggcctgcctattctggggaagcagaaacgctggcgtaggggcctatctctgtgaggccagtgaggagcatatggctgtggcctctgctggccctggtcggccctggctggccctggcagtgattcggaggctccttgtccagcccatgtgaccaacaggccctcccggaccctgagacctgggtctggaggctctgctgaggctacacaaggaggcccagggcctgttggtgcagcgggtgggaggggcaggcccttggcctgagtggttgggacaggagacgccagatcccaagttcctgaagcaggcagtggtcagcaagaagcttcaggaaggagccaggtcctgagggcagggagaggcctcagggctgggtctggaggtgccccgaggcagtctgagctctctgcccacctgtgcagcggcatcctgggaggcccgggagccctggctggcctgtggggtcctgcctggacacggaaggtggcctggagctgggagcgaggtccccctgcctcgttatcctccaggcagatgctgtggcacaccctgtggtgctgggaattgtgtgcccgcgtctgaatgggcaagacaggtgagcagcaggtggggccactgtccccagagaagctgagcccgggcctccagggcagcccatcctgctagcacagcccctgagggaagtgggagggctggcctcagtgtccccctgtgcctactggcctgggaagcatccacatctcagaagccccctcatgggctgacctggctgacgctgctgtgtccctggtccccattggtaaggtgggctgtggtcacgcaggtgtgtgagcccgagagagtggtggtgtcaggacaggaccacctgtgtcctgagggcctggtctctgggctccatctccacctgctgtttgtcccgggtgctaggctgctttggctccaaggacacagctggcctcagggattggggagcagggaaggcaggtggctggtgggggtcagcgccaggacctgttgctgctccctgggcctcccccatccctctggaagggggcctaggtcctcctgtcagccagattcaccacgggccttgctaggtgggctggtggccctgggcgccctggacctgcctgcagctctgggcctccctgtaagcaaggctggcccctgctgctgcttctcaccaaaccaagtccctgacccatggagaactccagggcgtgagctgcggctcccccggcacggagtacccaaagctgacaaccagcgcccacccttagcatgtggttccccccaccctgggtgggcaactgctcacctgccccaggcctcactgctctgggccattccaggacccagacacagccagccactgtctgcaggtcctggccccctaggagagcactgctctctgtgccctggtgggcaggcagaagagtgagctctgtctttctgtctttctaaacaggtcttcacacaacgagctagaaaagcacaggtaagtgaccccccagttccccacatgagcccgacacctggcccacccttttactgagggtgtgtggtgcgttgagcctgcccctgtcccgggcacggccagccgtgctgccaggctgtgtccttgtcttgggaatggtcagacttggaggagaaggctgaggtctgtttcaggcactctgtgctagaggcaggagatggcaggaggcccaggccctgctttccagagctcatccaggtgggggtgagagatgtggagcagggccccttgtgctgtgtgacagtcagggcccttggctttcaggacagtggtctccaatcaggagggttcggctctctgccctgtgcatcctggggtctgccttccaagaagccgtgctagagtcttgtccgaggggcagatggagggcagccagtccctggccgcctgggaagctccagcctagggcaggattcaggcgagctcttgagtaaagctgcggggtgttcattcctcctggtgacagccggaggcagctagggctgcaggctcagctctgctggtggggatgaggtgcaggtgagctcaggggcctaggggctggcagcgggagccctgggtgagtgcagaggcagccctagaggcaggagcccccatgccaggaccaggaagagtcccctgagggatgctggtccttcgctctctcctgacttgtgatcctgtctgtgaaatgggtcagctctgtcctcccttcctagtggggcaggtctgcgtgctgcttgagccccccacagtcccctccagaaagatttggtgctcggccagttctccgcctccccaccatgtctacccccacagcagcaccaacttccgttctcccgggattcaggccgctggctggggcgggcagctgggcagggacagaacgcagtgttctctgaggaactgcacttcctggacaggtcatgtgtgtttcggggggttccctagaggccacagaggtgggggcaggtacagggcccaagagaaccaggcaggcctggaattgttccaggcctaagaagaccagcctagccttgaccaggacccaggagccggggcaggcacgtgggggtgttcagggaaggcttcctggaggcggtccctgggaggacagccccccaatggggacagattaaggggcagtgacattgggggagggtgggtggcaagggcgtggcagcccttggggaggacaggggacccctgcagctgccctttgacctggctttgccctctgtcctctcctcccagaggctgcatttagccagggcctcatggggccttcttgagacacagaggaggggtgtgtgggcagccagggtgtctctgtggactcccccaccccagtgcagggggtctctgtctctggctggccaagaggcggatgtggacagccccaagcacctacaggcctggagcttggggccctggatcacagcctacctgatgccagctgctcttggctgcaggaagggctgcgtgctgtcttgagaaaggaaggaagcccctggctgggccacccagccatccccgggaggcaggccctggacatcgctttgcccggagttgtccccttactggggactgggcagggcctgtgggacttcccctgtgggtgctctgagccaagcctgcccagccctgctcctcatccctttgtagagaggcagctccagcaggtctgaggccgttgccaaccccagggtcctggggaccgtggaggcctcgccttcttggctgctgacctcactggccccactccaggctctgatcttagtgtgttttgggggaaggtcccagccttctttcctggcccttgacagccgctgaatggcaggacccatcccaaaggccagtccagagtcttcagctgagtctctgccccacattcccccaggcacgtccaggaggtccccaggagccccctgcagcccagcctcatgtgctggtgcagcctcacacggctttcacatacctcgggaagttctgttggcaacatctagaaaacgcaggcagagggagtgggaggcacgcttgctcctgggccacccccagctccccggcagcggcagccaggctctctggttggctgggatgctggcgtggagccatgccctctcggtgccctgggtccccctctgggcatgggggtttttgggggagctgggaagtgctgcgtcagaggtggggctgctgtcgataccagcccagcgtgctagtcctgcaggcgggttctgcctcctgaatccacacagggttccttcaggaagtggaggttttaaaagccctttggatgcccagggacagccgtggggtgctggcagggggcccagggcactgcagcggcttcaggaggggagggctcagcaggagcccagtgcagccccgggctgaggggcttcatggctcagaggggtgggtggggatcttcctggggtcccgcaaccagccactgtagagttggctccaggccactgctgctctccagggcaggaatttctgtggcctccagccctggcgcccacactcttgggccaggtggacctgttactgggttttggacagtgcgtgtgtgtggtcagatggcttctgtttgtctctcgagaaaggtgttccgtgatttctaaagcggtctgttcacggacctcccctgcaccccaccccagagaccgcatcccaggcactcagaggctgagccacatcctccactgctccccgcgggcactaacattgccgatgagacttggataaggaggggaccttgttctccatttcctcacttgatctttcacccgacaccacgtacgtaagtcctgtccgcctgcgtcagggcacactcctccaccttctcatccctgatgactgcacaggacacttggctgtgccaccagcgttctttgtgatgaccctctggtttacacagggacttccggacagtcctgcgatgtgccttggtgagcgcagacctttgtggatctggggggatagttttgtaggaccaaggccctagaagtagagatgctggttggcggtcagtgataactgtatcgatggcccttcagacctgtgtccccttttgctctcccaccagcaaaccatcaacgacccctcgaagtggctggcgcaggagccatcccttctcatgtcagcctgtcggagggtgcaagttgtacctccttgtttgtgtgtgcatttcctggctcgggtgagatggagccgggcgttaggttaggttggccctcgtgtcctgcagcctgtttgtgtccttcgcccgttgtgacatcgaggcattctgcttttaatttttgatgtgtatgagctcaaaataccacaaatactaaccatttgtcttttatatgtattgcaaagatttttctacttgttctttgtctctcagctgtgtttttctttcttgtgcaaacgtgtctttctctgattgtcacagcaatgtctgtgtgtgtttttttttaagcgtagaaaacctggaaaatacagaaaagcacaaagctaaagaaataaaattgccgggtgcttcgcctggagacgcacgctccctgtgccttgtttgattctgtcgtctcttgtgtgcgtctgctcttttattttttaaacaaaattgggtcacttgtcacctatgtggttccgtattctaatttttcacttaacattcatgatgtgcatatgtaacacactaaaatgataatgaggttgttttggggtggtggaattcgggggtacttttaatttttttttattttttttcctttttgttgatttgcatttttaaattgttctacagaggtcatatagtgctgatgtaattacatggtgggatggaaagccatttgctagagtggaccagggaaggagacccctggcaacgtccccacttgcaaacctcgtcccagtggtggctgcagtacagtggcgacgcgccttgggaaaggacccctccctgagcagagagagcacgctttggcctcttgcctacacagttcctggggtggggggcggcagggcgctcactcctgttggcggtggggaggctgagcttccaggcactggggtagtcacagagcggcagcctgggacccctttccctgcacctgtgcatgggagacagcgtgggagacgttgaggatcttggccctgttcaggccacctccaggcagacctcccgactggtggggctgttaccgctgcacccagcagccccctccttcttcaggctcctcctctgtccagaggaaatggctgtccctgccgacgttactcccagggggacaagatttgctgggcttgggaacggcaggagcagacatgccaaggctggggtgctcagtgttggcaccacgtggggaaagtcacgtgtgtaggcatcagctgtggcagggcagttgggcggcaggttttcaaaagacaaaaaatattcctgccccttcacctggtcattccactcgtaaggatttacccaaatcaaagtgtcctatatttggaagcagcctctgcggcctgcacgggatgggtgagtccgtggttgaacatggcagtgacaaaacctccgggtgccctgcactgccaggcaggtgcacgtgggcctggccagggtcccaggccgagttgatgcctctgggtgagctgggctccccgcaccccgtgagctccaccagcctcccccgcagacaagcaggccagcagggaaggcggtgtttccacaggggcaggcctaggatgaagccagggcccctctcctgaggtgcccgatgaatgtgtcctggaggattgtggcatgtgagcaagtacccttgagtgtgaacaagcaagcaagcaccactggatgtcatggctccagttttgtggaaagtggattcatctgtggatacggggacagaatctggaatgaggcagtttccaaagggatatgaaacttgggttggaagggcctggtccctggccctcccttgacctaggctgatcatgtttccatggtcacaaaagtgacagagagcacgttgtgcacgatgaggtagagagacgtgaatcttgtctgggtccttccagatctcggtgcagcctgaaaggcaccctcgcctcaccccacccctccctgcatgtggactccagggtggggatgggggatgggggatggcaggggggcgagctggggctcctaggaaatgcctggcggtgacgcgctgaggctttgcaggccatggtgagctgggcgcttctgccaggtgtctgggggctgtgggtgttgggctcctcctgggggtgggggacgggggttcccaaccaggccaggaggggatccttagagagggaccctcagcacatgtgcagcagtggatggtgggggtgggtctgtgcagggccctggaaactgcctgctgccctcccccaccccagcctgatggttctgtctctggctctttcagacgagccaaactcaggctgtaccttgagcagctcaagcaactggtgcccctgggccccgacagcacccgccacaccacgctgagcctcctgaagcgggccaaggtgcacatcaaggtgagtgggccttgctctccaccctgccctgtctggctgcctcagtgtccctgcacgccctgggggggtgctcacaggtgaccctgggcagcccttggatcagagggcctgaagatgggtggggagccatctggcgggtgtgtgtcgggggcctggtgggttttgccagggtggaggagcagcaacaggagctgccaaggggtcgaggctgttccgtggcttgtgtcgggtttgttgggtgctgatggcataagaagccgcatcgcagcatagactgggatggagaggaggaggtcgggggacagattgctctctggggtcctgggctgtgaagaggcagctgctggaaggagagagggggccagggtttcctgggtgccatcagaaggcagactaaaagtaggcagcctgatgggggtgccagggtggggttggggcagcgggagctggcagtgggtctgggctcagggagacattccctgggaccgccccccaaaggacttttgacagccctgttggtttgggggccttgtgacatttggaccaaccagggcaaatctctatctgctctgagggcctcttctgcctgcataggcatggtcaccttcaggctggggtgtcaggagctttgagaggggcacaaccagagccctgggggccctcacagagcaagcagtgtctcagtggggcccacaggaaggtttagagagggcagggcacaggtgttgcagggacaggcatggcataggccacagcccgatgggggcgggcagggctgggagtgtgtgaggagacccgctgtaagcaggactgtcctggagacggtgccagccaaagattgggtagcactgacccgctgccacacatggctcaacttggccaaggctgcctggtggctgcgggtattagagctgggccgtagacagaaaccacagggctgggaggtggcatctgactgtgaccgcctggctggggcagggagggacccacctcaggctgtggggctggcagagactgggcaccctgtggcctgtagccttggctaggtcttggcagggatggggaacctcccgggcccaggcctgggtgccccagtgcctggccagggggatggggggactcctcttcccgctgtgagctcacagcccccctcgaccccagaaactggaggagcaggaccgccgggcactgagcatcaaggagcagctgcagcaggagcatcgtttcctgaagcggcgcctggagcagctgtcggtgcagagcgtggagcgcgtgcgcacagatagcacgggctctgctgtctccacggacgactcagagcaaggtggggcgtggggcgcggggcagcctcacctgggcctccgggtgcgcagtggtgcagctccctgggtggagaggaggtgcctggtgctggggctggggagaaccctcccagctccctgctgcactggggtgtgtgtttgtcactaagcgcagaagggactggacagggagggtgggatgcagaggctgtgtggcccgctgaggactggtgcttctgaggccgggttctcagccagagccctcctggcgtctgctgccccagggcccagacagcgccctccgcacttctgcccctctgcctagagcttctgcttccagaaaagggagaaatgggctggcaccctcagagtggcctgaccccatccccactctattctccctagaagtggacatagagggcatggagtttggccctggtgagctggacagtgttggcagcagcagtgacgcggacgaccactacagcctgcagagtggcaccggcggcgacagtggcttcgggccccactgccggcggctgggccgccccgccctctcgtaggcccgtgccctctgctccttggcctgcctgcccgccagccacgcgtgtcagccctccagttctccttcagttgacgccagcctctccacaggcccactgctgtgccattctggaagctccagctgctgctgggctgcctggcactgcccgcttgccggtcagggcctgccgagctgcctgccccttccagctgggcagagtcccctgcaaggaggcagggcccagcttccacatccggagccctggtcagcatagccgcccacggtctgttctcagattcctaatcattccagaagtattaaacgtcattgctgcaaacctcggcaggtgccgtgtgaggggcttaatgaccaccacagggagctcagaccccaaccctggatcccaggagaaaggagtggaccgaggaaggaaggaaggcaaggctgtctgtccatccgtccgtctgtccacctacctgtcagtccacataggctcctggcgtggacaaggggtctgtgaagggcgggaactgggtgagcacctggggcaggtgggtggttaaggtccttcccacttcgcaggtgtcagaacctagggctgggctctcggggccaggcaggccagcccagcccacgccgagctgggcagcgtctgctctggtaggactgtcagacgcacacgcgcacgcacctagacacacccactcatgtacatgctcacacatgcagacacacctgggcgtcccgaggtcacatgttctggggatgatggccttcaggggtcatctggcaaacagcccctgggctgtgcctggatccccctctagctcctgctcacccacgcccacccagtagtcctgcctgtctgcacaggagaggggcttctcttcctggctggggctggggtgaactggaggctggttaagttgcagccgctgggtcctcgggggcttactcatctcccttttttaaacaaaaagcaaaaaagtaaaatgctgcactgcccagcagcccggttagggctcctggagccaccttaggaaagggcttctcatgagctctgctgcggcagcttcagctggcagagaggctttcccagaaaaaaaaaaaaaaccatttttaaaaagaagaaagcctaaagactctcggcctagggacgtccgtgtgtgccgcctctgtttcctgtaccagatttttgtattctattttcctagctgttgttgcgtccttgtttgctgaggggtgggagccacccagcgtctcagggacctgtccctccgtcacgtcgtcaaagtgtgccttgtgtcttgtgtcaggccttgcccttcccaccagcatgtccctcgtggctcagggtgccccaggcctgcccagctagtgctgtcctcccatctcctgtgggcagcccctcccggcagccagggcttcctggaggcgatgcagccaggcccctgtgggtggcacggaggggctgtgacctggtccccagtgttgccctccccagtggctggcaggggcctgcttgctcactagagagatggattctcacctgtcacctgactcgagccccctgcttcctggcctaggcgagggttccaggtttcagacactggcagccaatgaagactgtgctcgctgggtggtgcaggcctggcaccaggaggcttgcacccgcctttccttcctgacgtcctctgtccttggggctggcccatagcagtgcctgccgtgcctctggtacatctgtagccaattcccatatcatggggaaaattcgtgtctattttcagtcgtacgcatagacgccccaggatggggggcccactgtggcggaagggggtccctggaaacaactctggcacagaacctgccctgcaggctgtagggggcatggtgcctggagctgaggggcatccgaacgcgttgcgggtggttgtgaggaggcctgtctgcatctccttccggccccactggggtccaggggtgcccagaaaggagcttcccctgcctgcctgagtctgtccccccaggcttcatttcaaacaccgtggcacctccgagcaaggcgggccgtgtgtaaaagcttgcttccccagccagcactgcagggccctgaggtggtcgtgtccctgccctcaattcttgaagcaccagctccctgccccaccctccagtgcctgaggcagctaggggcttctgctctcatctctgaccagcagaatccacccggtgaccagtggtggcccctcagcccaccctcccggcagctcagcctgtggctcttgaggccgtggttcccacgtggactgggaggcagtctcagccacccggggtgctgttcagctgcccctccctgccatcagcaggtgggtgaggggttgcccactgggtgggggcccgtgctaggagtcaccacatgctccaacctcccactgctccctgtcaggggcccaggctgccatcactggaggctgcagggaccaagaggccatcaccgtgtctatagagagcagacagaagcagaacagagcccggggctcctgagcctctgcgtgtgccctcccagcccacaccagtgctctcggccactgagcacccagactcaggcttgggttccccagccttattggaaggcagctcccgcataccaggataacccccgcaaaccacatagcagacccccgccatcctcgcagagtgggagaggctgcagcaaggctttgcctctgcagaccccatcttagtggcacggtgcttgggcctgtgtccccgggtggtggaaccctgtaccggtctgtggccctagggtccctgctctgtctgccccggcccgtgctgtccgctgggtgaggcaggctcccccgtgccctgcctccctctgtcagggaacctgggaccccctccccactgcctgcacagaggaccctgaccctcggccagcagggtggccccaggtccatgttgggcactagggcaggttccgtgccagagtcgggggccacacgagggcctggtgccggtgaggggggcgtgcgctagagggggaaaggggcccccggccacctgtccaccgtgtgggccgtgctgtgtccttatgtcattgtaatataaatacagatttttatatctc

SEQ ID NO: 37689 - DNA, 194275 bp, Homo sapiens; identical to SEQ ID NO: 37687

SEQ ID NO: 37690 - DNA, 18234 bp, Homo sapiens
atgcgcagtcgcgcccctccctctccgcccccaccccctgtcggcgtctgggcctcgtccccttctctctgtctcccttgcctcccccatcacgtcccctgacaccgacaccccattgctcccacagtctccccagtctccactttggtccccagcgctgtctgcccgaggtaagatggggagggggcggcccgcggagaaggggaggggcgaagcatcctgaatcccgagataaacaaacccggggagggggcagccgcgactgaggggcctgacgcgggaggagaagaatggggggctgggcctgggggaggtggcaggcgctgggcgcacacaccggggccctctatgggtaacgggggtccctatggttgcccaagatccagttgcgcggaggccacccggggccctggaagctcctaggggcttggaccctggagcctgccgggcaccctctccagctgacctctgcctccaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgttgtgcacccctcggcacctgcccccctccctaaggactacggtaaccactgtccccaccctggaatctggcctggagcgttgggtggccggggagggtgggctgtgctctgctggtggtgatggtgggagaattctggggaatttgaaggtggtccagaggaatcttggctgcagagcacccctcgttaattcattcattcacccattggagaatggaattgtaatactcctagtctttgactcatgacacatcattccatcatttagtcattcaacaatcattttttgaaagcggctgtggacctggctttatgctaggggctggggccacagcagggggcaagagagacccagtctttgccctgagacaactcacaggcctcagtaacagccacacaaataggtattaaaccataatgtaatttttcacatttaggtttatatgcaagaaagaaaaatataatgtaatataaatatgtaattacaagacattatgaaaattgtatttaccataaacaagctgctgcaagagttttttaagacattgtttccctgaggaggttacagttgagaagactggagggtgagttggggttaactaagagaagggtcaggggaaagggctcccaggagaggtaaccgctgggtaaaggatctgaggtaggagggtatggagctgagagggcggcctcttggagaaactgaaagtgtctaatcattgaccgagcgatatttatcgagtgctgctactctgtgacaagccttatgctgggtgccggagatttaatcctaagtgatccaggcatgatcctcccttgcaggagagaaggagagactaaacaagtgaacagataaataaatcagaaatcagataaattcagattggagcaagtgctatgaaagaaagaaaaggtgggctgggcatggtgtctcacgcctgtaatcccagcactttgggaggctgaggccagcggatcacctgaggtcaggagtttgagaccagccatggccaacatggtgaaaccccatctctactaaaaatacaaaaattggctgggtatagtggcatatgtctgtaatcccagccactcgggaggctgaggcagtagaatcgcttgaacctgggaggcagaggttgcccaagatcgagccactacactccagcctgagtgacagagtaagactgtctcaaaaaaaaaaaaaaaaaagaaaaaaaaaaaaaagaaaagaaaaaaagaaaaaagaaaaagaaattaaaggtggagatacgataatgactagggggcagctacctgcaggggtagtcagggctgctctttctgagtaggtaacatttagtttgggacccagagcatggggaggaatcagccataagagagctggaaaaagagtgttccaggcagacagcagcaagtgcaaaggccctgaggcagaattgaacttggaacagaaagatcctggagctgcattcagggaatgatcgaggttgaggtgagaggttggcataggccagatctggaagggccttcaaggctacagtgaggactttggttatattctaagtgggacaggggagaagagtggcaaggggagggtgtttaagagcagaggagtggcaggtctgatttgtagtttgaaagctccctctgggtactgggtagaaggggatggagtgcagccagagttggatgtaggaggggaatttggaagatatgcaggctgggaatccccggcagctgtgaggttcagaaaccaggttcagagagtcagcgttgccaggatagagcaagacagatggcatccatggacatgtcacccactagaggtagatcagggagactacaagttgacttcagtctaatagaaaaataagaaagttggctaggcacagtggttctggcttataatcctagcactctaggaggccaaggtgggaggattgcttgaggccaggagttcgagatcagcctgggcaatggagcaagaccccatctgtacagaaaatttagaaattagccaggcatggtgggtacctgtagtcccagctactccagaggctgaggtgggaggatcacttgagcctgagaattcgatgctgcagtaagctaggattgcaccactgcactccagcttgggtgacacagtgagaccctgtctcaaaaaaagaaaaaagtaaaaggaagttatctggggcctgaggtcgggggggtgctgtacctcagaaaactggaaaatctcctttggaaatgcagctggaggtggctggggcctctgactcagtgggaggtcggagggtataggctgagccctccaagcagtcttgcttgtagagcgggagaggttttgtcccagaatgtgaagaaatctggaaatgtggtcgaggacagggagaaggctaaggtggactccaagaggaaatcatgtatctgttaaatttgtacattaattcaacagagattgactgagcacctactgtgtgccatgtgctgtgcctggccttggggataaaggagtgaatgaggcagaatagaatcatagcatttagatcctagtgagggaagaagagaggaaatgaaggagggagaaagaggagtaaacatgtcaagtagtgatatgagctatgataaaaataaataaataaataaagggctgggcatggtggctcacacctgtaatttcagtgctttgggaagccaaagtgggaggatcacttgagcccaggagttcgagaccagcctgggcaacatagcaaaacgttgtcactacaaaaaaaaaaaaaattgctgggcatggtgatgtatactgtagtcctagctaccagggaggctgaagcaggaggatcacttgaacccaggagttcaaggctgtagtgagctatgatcatactattgcattccaacagaccctatttttttttttttttttgagacggactccaggctggagtgcaatggtgcaatcttggcccactgcaacctctgccttccgagttcaagcgattctcctgcctcagcctcctgagtagctgggattacaggcactcaccaccacgcccagttaatttttgtatttttagtagagatggagtttcaccatgttggtcaggctggtctcgaactgctgacctcatgatctgccagccttggcctcccaaagtgctgggattccaggcgtgagccaccatgcccagccaagaccctatctctaaaaaaaaaaaaaaaaaaaaaaaaaaaaagagtaggagatggagaagggcgggtgccgatttagacagtgtggtttgggaaggcctctctgaggagatgacatttgagcaaagatttataaagctttgtgaagatgtgtgggaagtctatcctgagtgagaagaacagcaagtgccaagaccctgagacaagaatttgcttggcacgtgggagggacagagggagcccagtgtgggaaatgagggaaggggaataagtgaggggagagggctgagaactgaggggctggatgtgcagagccctgagggccgtggggaagactttggtctgtactctggatgggttgggagctggaggagggttctaagccaagaagggctatgatgtgactgcagttctaaaaggagcatgccggctgattcctggagacaccttctatgtggcacttccctgggctgtgtataatctgatcattcatgtagtcgttcattcaccacgcactgagttcctgccacgtgccagggccctgtgctgggtgctgacgtcacagagagcagtactccttagagtcgagtgggaagagacagaagtgcctctaggcaccaccctggctgggcacaggttgattcctgctcatggatacattttattttattttcatttttatttatttatttactttttttgagatggagtctcactctctgtcacccaggctggagtgcagcggcgccatctcagctcactgcagcctttgcctcctgagttcaagtgattctcctgcctcagcctcccgagcagctgggattaccggcgcccaccaccacgcctggctaatttttgtatttttggtagagtcagggtttcaccacgttggaccaggctggtctcgaactcctgacctgaggtgatccgcccgccccggcctccaaaagtgctgggattacaggcgtgagccaccgcgcacagcctctatttttattttttatatttccagagtcagggtcttgctctgttgcccaggctggcgtgtagtggcacaatcatggctcactgcagccttgaactcctgggctcaagcaatcctcctgtctcaatctccttgagtagcaccaatgcgcaccaccacacctggctaattttaaaactttttgtaaagacaggggtcttgctatgttgcccaggctggtcttgaacttatgggctcaagcaatcctcctgcctcagcctcccaacgcattgggattacagatgtgaaccactgtgcccagtcatggatacatttgatgtggactgcatggtatttgaaacaattgagagagttttattaaaaaccaggacttctggctttatttatttttgctctggagattcagccaaacttcactcatactctcacagggcaacagtgggtgaggtcagtagcagtccccctggacatgcagactccaaggtactgcactctctgtcaggcttttgtttcagggggtggagtttgctgctatatgggaattgcctgatcttccaacttttcaagacacactgggcatcgagatttttatgtgaacccacctgagtttgaaacctcatgctggccacacagaaaatgcctgtgggttgactgtggcccatgtgccaccagcttgagaccctgcattagaggctctaaaaggcaaagacctacagctcccctactgaggctggaaggagggggtcagttgcgtggggtgaccttggacctcttgccaccccagctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgaggtgagaacactggggaaaccagggggagaggggatgcggttccccacatgtgtgggtgaccctccctgctcccctggtactcacagattctgcgccgaggctgccatgtgaacgatcgtgacgggctgaccgacatgacactgctccactatgcgtgcaaagctggggcccacggagtcggtgagggccccctacccccaagtcataagccccaaagcctaggcccccagacccaacacgctgaaaaccacccagaactcaggccccatctggaacccgaagcttcggatcccaaagtatagtccctgaagcccagggtcctccccgtgcactgggcccatgctctggaatgggggttccaagctgacccggcctatcgcgcaggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgaggtgaggaggagagccctggctgggagggggcaaggacctgggtgagggacgcggagacccaggtgaggccaggctgcgaggggaaggaggacggtgatctgaggagatagcgggaggttggaggcgtgggagagggggctcagggactaccactctagggagggtcggggctgccaagggagaggggggctccgaggtgggggcggggctctgcgtcggaggctctgggacctgcaagttaagagatgagccccgaggtgggaggagggctggggtcccacaggcgctcacccggaacccctcctcttgcccacttccagtggtgaactccacgtgcagtgacttcaaccacggctcagccctgcacatcgctgcttccagcctgtgcctgggcgccgccaaatgtttgctggagcacggcgccaaccctgcgctgagggtactgccacccttgcccagaacccgttaccctcctgctcccttcctcccccacttccctccagcaggtctctgcgtttcccgtgactccccaaatactacaaatgccgtctgtacattcagcaaatgcaataacagctgaaatatgcctagtgttcattacatgtcaggtgaagtctattataagccttgttttacaatggggaaactgaggcagagattaagggatctgcccagggtcatccagcctatcccatggcagtgcataacagcatttcaaggtcatgaggaaagttgggctaggccttctgtgaatgagagggttggtcctctcctaagccctcaatatgatctttgacctctgacctatgcattaccaggctccatccacaatgctaattaccctgcagccgtccaggcacatgtatgttggggtaacatggcctgtgcccctgagaccctgcctctccccattttccactggcccagagtttgactcctgactctataccacaggagcccactctcactctctctaattttttttttttttttttgagacagagactggctctgtcatccaggctggagtgcagtggtgcaatctcggctcactgcaacctctgcctaccaggttcaaacgattctcctgcctcagcctcccgagtaggtagaattataggcatgcgccaccacacccggctaatttttgtatttttagtagagatggagtttcaccatgttggccaggctggtctcgagctcctgacctcaggtgatctgcccacctcggcctcacaaattgctaggattataagcataagccactgcacccagcccacaggagcccattctcaatgttcatctcccacatgtcctcattacaggcttggggtctccagagattgcctccctgagggcgtgacctacagcactgaagtgtggccctcatccctactgcctacacccccaggcccaccctcaattacttgacacacccccagccctgggtctcaggggtgggtttccctggggatgtggtctgcacctttctgccctgccccttctttttttttttttttgagacggagtctcgctctgtcacccaggctggagtgcagtagcatgatcttggctcactgcaacctctgcttcccggattcaagcgattctcctgcctcagcctcccgagtagctgggattacaggcacacgccaccacacccggctaatttttgtatttttagtacagacgaggtttcaccatgttggccaggctggtcttgaactcctgacctcaagcatctgcctgcctcggcctcacaacgtactgggattacaggcgtgagccaccttaccccgccttgccctgacccttcttattcccaggttggcccaggatatgacctagtcttacccctgcatcacccagactggtggtctctaggggcagggcctccatgggggtgtgacctgtgccactgagtccctgccttcttttcccattggcccccagaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaaggtcaggggctgggatgtgtgtttgcatggtgggtgggggtgggactcagccccttaatcccttggagctgcgtcctcgggcagagtgcagtccctgccctttgtctacttgccgccctaactatccacccagtacttgattttatctcagttgttccgtgggtgtctcctttgagcctcaccctgtgctgagctctccatccagggtgggaaacaacccgtcatctgacagtgacggccgagagtggtcatggctgccatggggaggggtgagcagagtgatctgcgcagctctgtgcacctgtggctccccccgggtcttgtggtcctcgatcaggcccctctgctctcagagacaagtctggctaggcaagtccaggccagagtgattggggtgtgatggggaatgtacccaaattgcagatgtggaggagcaagccagggaaagaaagggagaaaggagtctcagcttgggggagcgggtatcacagctgagagggcagagagaatcttcatttatccagggactccaatttcactcatttcccggtgtcccttgggctccatacgggacccagtctgtccttagggagggagggctgtgtctgcccccgccctgctgtcatggggctccacttgtaatgaaggggagacagtcaagaaagtaaacctatggttgagatgatttctgggctgggcacggtagttcacacctctaatcccggcattttgggaggccgaggtgggaggatcacttgaggtcaggagttgttagagaccagcctgggcaacatagtgagatcctgcctctattgaaaaaaaaaaaaaaaggtaatttctggtagcaacaagggctgtcaacaccattacatgtttggatttagtaaattgtccctggctgaatgctggagtggttttagctggggtgttctgagaaggcttctctgaggaggtgatgtccaaactgagataggaaagaacttcctttgcaaagataaggaagcagaggatgcagtaggtatggagacccagaggcaggaaggggcagtgttgacgaggggagttatgggaagggcggtgaggtggagaggtcagcaaggctgggtcacagcagacctgtaggctactggaaggagtttgaattttgtttttgtgtttttgagacagggtcttgctgtcacccaggccagagtgcagtggcacgatcttggctcacagcaacctccacctcccagattcaagctattctcatgtcttagcctcccacgtagctgggattacaagtgtgtgccaacaagcctgggtttatttttattattatgattattattattattattttgagatggagtcttgctctgtcgcctaggctggagtgcggtggcgcgatctcagctcactgcaagctctgcctcctgggttcatgccattctcctgcctcagcctcccgagtagctgggactacaggtgcccaccaccatgcctggctaattatttgtatttttagtagagagagggtgtcactgtgttagccaggatggtcttgatctcctgacctcgtgatccgcccgcctcagcctcccaaagtgctgggattacaggcgtgagccaccgcgcctggccttttatttttatttttagtagcaacgggtttcaccatattggccaggctggtctcaaactcctgccctcaagcgattcgcccgccttggctcccaaagtgctgggattacaggcataagccactgcgcccggccccatccagaaagcattctgctgtgcacgatctaatcatatccattgcacaattcagaaggaaggttgggttgactcttcccattttacaagccagactataagaggctccaacaggtgaaaacctttatctgaagacacggaatactaatcactgccccttagagaagcagcatagcacagcgtcatgaactcaggctcagggacttgcccaggtaaatctcagctttgcaacttcccacctgtggacctggagccagtgattctgcctctttgggtgtcaatgtcttcatccgtaaatggagataataatagtaaccaccttagggggctggttgaggtttaaattaattaaaatgcgtaaggccattagaacagagtccagcgcatactaaatgctctttgtgtgtgccaggcactgttctagtccctccaccaacactcttaagatcagcactaattgtcggggcgcggtgcctcacgcctgtaatcccagcactttgggaggcagaggtgggcggatcacgaggtcaggagatcgagaccatcctggctaacccggtgaaacctcgtctctacaaaaaaaatacaaaaaattagccaggcatggtggcaggtgcctgtagtcccagctactcaggaggctgaggcaggagaatggcatgaacccaggaggcggagcttgcagtgagccaagatcatgccactgcactccagcctgggccaaagtgtgagactccgtctccaaaaaaaaataaataaataaaaataaaaaaagatcagcactaattaattagcctattatatggaccaggaactgaggcatggagaggtgaatgagcctcccataatgataataaccacactcactaaagtctcactgcagctaagcaagtttacatgtgttaaaaatgtttccgccaaatgtggtggctcatgcctgtaatcccagcactttgggaggctgaggcagaaggatcgcttgagcccaggaattcgagaccagcctgggcaacatagtgagacctcatctctactaaaaatgaaaaaattaaccaggcatggtggcacacacctatagtcctagctacttgggaggctgaagtgagaggatcgcttgagcccaggagttcaagaccagcctgggcaatcaacatggtgagacctcatctctactaataatgaaaaaattaatcaggcatggtggcgcacacctgtagtcctagctacttgggaggctgaagtgagaggatcacttgtgcccaggagtttgaggctgcactgtgccagggtcgtgccactgcacccctggcatgggcaacaaagtgagaccctgtctaaaaaaaaaaaaagtttccgccagatgatcactccatgaggtggcttactatctctattttacagatgaaactgaggctcaataagtcccctgaccaaagttacagcatgataatagctaacaggctgagcacagtggcttcacacctgtaatcccagcactttgggaggccaagatggggaggatcgcttgaggccaggagtttgaaactaacctgggcaacatagggatactccatttctatttttaacaaaagtttgttgttgttgttgttgttttaattagccaggctttggtggcgttcacctgtagtcccagctactcgggagactgaggagggaagattgcttgaacccaggagttcaaggttacactgagctatgattgcaccactgcactccagcctgggccacagagtgagaccctgtctctaaaatagaaaaaaaatttcaataacgaatacttgctgatcctttacttaataccaagccctgttctgagggctttaatttctctataacagccctgtccaacagagctttctgtaatggtggaaatattctgtctgtgctgtccagtaaagtagctacaagctacatgtgacaattgagcacttgaaatatggctagtgtgactggggaaatgcatttttaatttagtttaaatgtattgatttgtatttttatttatttatattttttcttgagacagagtcttgctctgttgctcaggctggagtgcagtggtgctatctgggctcactgcaaccctcctgggttcaagcaattctcctgcctcagcctcccgagtagctgggattacaggcgtgcaccatcatgcctggttaatttttgtatttttagtagagatgggggtttcaccatgttggccaggctggtcttgaactcctgacctcaggtgatcctcccacctcggcctcccagagtgctaggattataggtgtgagccaccgcgcccggactaaatttatttatttttaaatttaaaaatcatctgagtcttctttctaaggtatgtatttatttatttttgagacagggtcttgcttgttgcccaggctggagtgcagtggcaccatcatagctcactgcacccttgaactcctgggctcaagcgatcctcccacctcagcctcccaagtaactgggacaacaggcttgagctactgcacctggttaccttttttctttcttttatagagaatagggtcttgctgtctttgttttttggaacagattaagattagagggtctcgccattttcacccaggctggtctgaaactcctggcctcaagtgatcctccagccttggcatcccaaagtgttgggattataggcatgagccaccacacccggccttagtttaaatttaaattgttggccaggcatggtggctcatgcctgtgatcccagcactttgggaggccgaggcgggtggatcacctgaggtcaggaattcgagaccagcctggccaacatggcgaagccccgtctctactaaaaatacaaaaattagccaggcgtggtggcatgcacctgtagtcccagctacttgggaggctgagatgggagaattgcttgaacccaggaagtggaatttgcagtgagccgagatcgtgccactgcactcgagcctggcaacagagtgagacgctgtctcgaaaaaaaaaaaaataaataaaataaataaataaataaatttacattgtcctatgtggctagtcactattcactatatgagacagggcaactctttaacaatcctataaggtgagtataatttctgttcccatttcacagcaaaggaagttgaggcacacagaggttaagtcatgtagccagcaaatggtgatgtgtgacctggggtttgggcccagggcggcctcatgcaacccaccttgctgcccgtgtgtgggcactccacgttggcctcccagcattccttccttagccatcgcctcccttctctccccagacgggcacactgcggttctgtgggaccacggagtttgccagcggccagtgggtgggcgtggagctggacgaacctgagggcaagaacgatggcagcgttgggggcgttcggtacttcatctgccctcccaagcagggttagtccgacctcgggcccaagaggggtgtggctgggtgtccactcggcagttctgatgctgctgactgggaaataggggatggaggatgggggccgagggcagaggcttggacaacaccaggctcggattctgtacccctaggtctctttgcctccgtgtccaagatctccaaggcagtggacgcacccccctcctctgtcacctccacaccccggaccccccggatggacttctcccgtgtcaccggcaaaggccgcagggaacacaaaggtcagagaggggatccctgtggtgggaagagccagtttggggatgttgtgtgggtagctcagcttctgtgactcagtttctcctcaggcccaaactccagttttggaagacaagctctgagttcctgacttctgtgactcagtttcccctttggctcagtactggcaccccctagttcttagaaggacctgtgggttccctgccctctgtgacttagtttcctctcagacccaaaggtctcccccagttttagggaagaatccttggagatcctgtcttttgtcatttgatctacttttttttttttttttttttgagtcaagagtctcgccttgttgcccaggctggagcgtggtggcacgatcttggctcaccgcaacctccgcctcccgggttcaagcaattctcgtgcctcagcctcccgagtagctgggattacaggtgcccaccaccacatctggctaatgtttgtatttttttctgtagagacagggttttgccatgttggccaggctggtctcaaactcctgacctcaagtgatctgcccgcctcggcctctcaaaatgttgggattacaggcctgcgccactgcacatggcctgatttactctcggacccaattttcccttcattttaaaaggacagtttctgggttcctgacttctgactcagcttttccttatccaacatatcctcagctttgagaaaggattttggggttcttcaggttctctgactcagtttcccttcaggcctaaagccccttcctaattctctggcatctgggattcagtttcacttcaaacgaagaacagggttttctaccttggggttttccaggtggcacgaggttcccaaagctggcctcagccccactacccacctcctacaccttctacccttaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggtgaggatggggactctgggccgggaggcaggcagggccttgagaaatcctgacaccctcgtgctgcaggttactggtatggcattgagctggaccagcccacaggcaagcatgatggctctgtcttcggtgtccggtacttcacttgccccccgaggcatggggtcttcgcaccagcatcccgtattcagaggtgagcccaaacttccagcccaaacccagggcaccacctggagccctgatcccccctcagatggcctcctcctcccagaccagcaggacagtgtggacacccccgagcccccagccctttcctcatagatccctggggcccagctctcagtcagaccctggccttttgtggctctgacttctccccctccccgtgtctcctcaggattggcggatccactgattcccccggggacagcgttggagccaaaaaagtgcatcaagtgacaagtgagttaggggatgatatgttgggaggagtgtacgtttggggatgggaggaagggtcatgggttctcaggtatatactggtgacagtctctggtatttaattggggacacagggtccaggaaaatgatgagacaaggtccacaaaaagataggtgctagaggatatgaggaaattagcaacaaggctcttcggggacatgaggttgagcagatactggggacagggatagtcactgggggacatggtgggaattatggacaagaggcccagatgggtattgggaatgtaggatccaggtggggactggagacatggggaggtattaatgagaaggggtctggatgggtattgaggacacaggtggtctgtcatcccctcacttgacatcctgccctcctcttcagtgacgcagcccaaacgcaccttcaccacagtccggaccccaaaggacattgcatcagagaactccatttccaggtgtgtggccaacccctgtcccctctcctatgtgacattcagggagagggatccataaggcagttggacccagaggtctggagctctggtcagggctggaaagagaggttaggaaaacttgtgacttgtaagcatacccagaaacagtctttagggtgtagggccccgcactgaattctagtgaattccactttcgggtgggccggtaaaggaagcagaacacccttcactccatacgagcctcagaacaacagctagagaccgggcggggtggctcatgcctttaatcccagcactttgggaggccaaggcaggcggatcacctgaggtcaggagttcaagaccagcctggccaacatggtgaaaccccgtctctaccaaaaacacaaaagttagccggacacaatggcatacacctgtagtcccagctactcgggaggctgagacaggagaattgcttgaacctgggaggcagaggttgcagtgagccgagatcgtgccatggcactccagcctgggtgacagagtgagactccatctcagaaaacaaacaaacaaacaaaccacagccagagaggtagaggcagaatccagaaaggcctgatagcaaacactgggggaaaggctgggggtgatgggtgcagatgtccccgctgcctgcctaagggcgtgaccctgtcatcctcctttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcaccctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccagaaaattctctattttttaagtaacgacttccccctttgggggaccccaaaatttggaggccccattctaggactctggggatcccaaaccctagagtacacacgtcccaaactcccctgtgccctcaagtcctacagcccctagaagaccccaatgccgtaactcctaggacccccaaatcatggaatcccaaatccccagggaatcccaaatttgaaaatccaatcccaagtccccaggaaacccaatcatgaggtccttgtgcctggtatggaggagactgcagtcaggatatgcattccaggctcccagacacctcaagccctattcacaggcaccaggaaaccccacacaggaattcccatccctggaaactggagaatttcaatgccccgagtccatgggtttcaagacaccaaattccaagagccccagccctaagggaaccccaaatcctaaagcctccatctctaataaatggaaggccccaaggccctgaggggatctcaaatcctggaaccccgatttcaatctacgttctagtcactggcctcaaaggaccccacagcacctgggccagaccaacagctcgagggagaacctgaaggcccagggggtccagggcggacctggggccccgaccaccaaggacagctcacgactgccccttcactgcatgtccccaaactcagcatgactcctgtcctcttcaataaagacgtttctatggcc

SEQ ID NO: 37691 - DNA, 69464 bp, Homo sapiens
gggtgattcagcgcccggcgaggcggaagcggccgcaagaggaggaggggagagcccgtccgcgcctgggctcccggggtggcacgagcccgcggccggagtgcgaggcggaggcgaggaggccgcggggacgggaggcgaggccggccgggcccccgaagccatggagaacgcgcacaccaagacggtggaggaggtgctgggccacttcggcgtcaacgagagtacggggctgagcctggaacaggtcaagaagcttaaggagagatggggctccaacggtaggtgcagggcgctccgctgcaggggcccggcgcggccgggagagccagggaagatggctgaccgggctccacctcgtgggcttcggctccgcgcccgccgacagctgcgggcggagggtcgggccagcgcgccggccccgcgggagagaaaggggctgcggtcctcgcctcgccttccctggacctcttcgcttctcgggccctcgaccttttcggcgcgcaaggctcggaggcttctctccagcagcagccggccccggtggagggagggacgtggcttctgcagctaggttgagcccggcaagacgttttctcgtcccctgccgatttatgaggagtcgaggtcgttggaaggcctctgaccgttcttgtcctacccaaagttacacatctggcagaagtgatgacatcgctgaaaccactcctaggttcaggagcccgaagtgatttcacgcttagggctagacctcaggccattgattacaaagagtgcatgcttccttgagatatcttcgtggtatgccctctgctaaaaaaatcggatattcttatagctaggtctgtgttttaaagatattgatgcttagaattgtagcagttctttttagaaaaacgaagtgctaaaatgtctctctctttttttttttaacctccctcttgacacattgcttgacgaatttctacattctacagagttaccggctgaagaaggtaatcttaacatgctgtttctgttttttttcctctgttggtgtgctgatggtaagatgacagttaaaacacatgtgtttgtttcttacaggaaaaaccttgctggaacttgtgattgagcagtttgaagacttgctagttaggattttattactggcagcatgtatatcttttgtaagtataaaaaaatttattttctttccccccaaaagctgaaagtattccatagataaatcagaaaacaaatgatgtccattgggtgaaaacatatttggagttgcaagctgtgtctctatgtttaaaaacaatctgggcattttaaaattacaaaacaaaacacttgaagccattggtattcagaaaatagatgcctgacatttacagtgtggttaggagttgtcccagagtgtggcatggtcttagaaattcttgtggtttatcagcttttaatatcaaaaagttcttttctgggaagcctttaatgttttgggttcttccattgttatcgtgttgtaagatcatactaagatgatgttggactctttgtagtctgtaaatagaacttacaaaaggaatattccagttgctttcccttcctggtaatggcaaggtgacagttgttcctgacggtgacaagaatgatgacggctgtgatggcacccttgttgaccaaatttggtcactgacctttagggtggtatatttatctaaattggacccctgtcttaagtgattcttaggttgaaagaacaaggtttagtacagttggttctagatcttaaaggaaaaaaaccagcatggtgttttttcttgttctgtgtgtgcttacccacttgagtgctatatggttgctaagaaactagtgaaatgcaaagaactacagcagaaaaagggtgttggggtggcaagtatatttctaggtttttaacttttttttaaatgttcggtattaattttttgttgcattttttttcttgggcagtagattgcttgctagttttcctaaaaatggtcaggaataggacacagatgttcctaattctaatagcatgagatgccttttattcttgaattacgttattcttacaaaaaccacgataagtgaaattcacccagtgcagtacttctttctagttaaaacaaaattgacaaaacttcacggtttcagttcttgtacatatatgtatgcaggtcccagggatcagcctcagtctttgtgagaaccataccatagagggctattttgagaacgaaataaacaaagcagtgggcatttatttagttcagatgaggaaaagattaaatttatacccatcttttaagtagatagtggcagcagtaaataaatttgtggaataatttttacataaatcctgctatgatactttattatgccatattagccaagtattgtgtagccattaataattcagtccccaagaaccttttctgtggttttcattgattaaaatggggacttacatagcaaaccattcagcattctgagtcagtcacaatgtacctctgataaaatgtttcttcttgattgattaaaaaattttcccccagaaaatggctgctgttttaccaattaagggaaatgagtagacccgattaactatagtttatcaatacattgtcatggggcaaaataaatgatacatttggagctagtgtaagatttgtatttaactgggtacataatagcgttggcagttaaataatggggtccgataaggtcattgggaacttcttaaaaattaatcagctgactacaagccagaagcaaaatacatttttactgaattctctgtgttacaagttgaagcagtgtgggaaaccatgccactggtgttactattggggttgcactgggtctgttttttgagtggccagtttgagtgactttatattagcattttaaattaatgatgtgtgtgggttttgtttgttcattttttactttgaagtaattagaggcttatagtttgtaagcatttcaagcaggtttttaaataaatgctttaattttttttataagataggaccttggctttgtggagcattatagagctatattttggagttgaaatttgagctcctttttggtaactgtggagttactgctcaggaaatgaactgtgttacatttttattttatgagttggtaaatagcaaaagaataagtgtttagggagtacttctatagaattaatttgctttggtttgtttgatcaaggaattgcagatataagacctgttgtgttgattttcttcatgtggggttgggtactgctgctgcattgtctttagtgtttcattcctcctgtctgtatcttttaaaagaaagagcactgactctctttttgtgtcagtttattcctattgatgtaacagaaaaaacatggtagaatattcaggtttttttggagaagtgactaggcgattcttatatacatcatgcgtcatcaagtcatgcttaaattaaaaagaatattagtgacttacttcaaatatcaaactaagtagtaaactgttaactatagttaatattttgctgtggcatagaataggaagctatgcttgtgacctgtagggatctagtttaatttgtaatattggccaaagtgtttttttgaaacggtcacttggattgaaagaaataagcttcatcttccagtgcatatgaacattagaaattgcttaatttgacactgaagaccccccctctatcattcactttatcttttcattctcttcttgattaccaactttgttctaaatgtaacacatcgtatggttgcttaactgatgcctgccctttcttctcttttcctgctttgttaagatatttattgagcacctgtcacagacactggggatacagtagtgaataaaacagacagagacccttacctggaggataatactgctgagaaaaataaagcaagggggtttggatatcagagtatgtgaaagggggaacagttttcaaattgggtggtccggaaagttcttgaggaaggtgacatttgcgaaaagatctgaaggaggtgggcattagggccatgttggtctcccatctgtctaaatcataaagtcataattaatatggtaataatttgcataggtttctctaccttccaccgtcgtttcccatgtcagctacttagattgaccctaaaatgctaataaaactttctagactgtggtacttctcaacctttaggttacatttgaccatttgcatgtgtgtgtctcttttcttcctactagacccccttgagttagtgcttttttttttttttttttttaaatgtagatggagtctcactcttgttgcccgggctggagcgcagtggtgcaatctcggctcactgcaacctccacctcctgggttcaagtgattctcctgcctcagcctcctgagtagctgggattacagatgtccaccaccacgcccggctaatttttgtatttttagtagagatggggtttacctttgttggccaggctggtctcgaactcctgacctcaggttatcacctgcctcagcctcccaaagtgctgggattacaggcatgaaccactgcgcctggcctaagttagtgcttttgatgtcacaaaaacttgggtgagtttgtttcagtagaattttctgaaaatacatgagatctttttactgtagtttctcagaagagaatactcaaagcatttgatactggatttgtagtgattttaattttcttctgtatcttttaatttttgattttaaaaatgggataagaagggcaaattactgattggtttaactagtttattcagagcttttcttaaaataatgacttgaaaggtggatttaatagagtactttttaaaaagattgttttctcatgcctgaaagcattgaatgtttttacatagctttatatctggatcagaagggaacgagttctaattcatgcttttttttccgttttattaatgactgaaagtcctcccccagaaattatcgtaacgtttattggtaattctctgtatcattctcgaaatgtttaatttccatttcctctttatttaaaaaaaaaaaaaaacttgatgtaaatttcttcatttattgagcaattgtttgagggcccaaaggcacagtgcaagtttctgagaatactaggagcaaaatgtgcttatgatctttttaagcacttttttctttcgttttctttttatgatactaagagctcttcctattatcacagtgtatagatatctgagtcacaatatcatgactgtctcccagtttacagcagaacgtgctttttaccttggattaaaatttgctttatttggccgggtgcagtgagtggctcatgcctgtaatcccagcactttgagaggccgaggtgggtggatcatttgaggtcaggagttcgagaccagcctggccaacatggtgaaaccccacctgtactaaaaatacaaaaattagccaggcgtggtggtgggtccctgtaatcccagctactcaggaggctgaggcaggagaatcgcttgaacccgggaggcggatgttgcagtgagccgagattgcgccactgcactccagcctgagtgacaaagtgagactccgtctcaaaaaaaaattttttttttgctttagtatacttatcagaagtataatgcagtacagagtgttgtacagtatttcagtgctgtacagagattaatcttgtggataataattgggagatactctatccctactctatttttaacagtttaatgtagttgagtgttcattagcaagtggttactttgaataatactggcacatttgaagcattgaacttgtttgataatgtatgtcccagaagacaggtattattgtatttagcacaaagcaaagggaagaagaaacactgtttatgtccaaaactatggggcagtggtcttctcttttacttttctttgctgctgttcatgaagcttgttaccttttcgctgtcttttttttgagacggagtcctgctctgtcgcccagattggagtgcagtggtgcgatcttggctcactgcaacctccacctcccagcttcaagtgattctcctgcctcagcctcccgagtagctgggattacaggcatgcaccaccacgcccgggtaattttttgtatttttagtagagacggggtttctccatgttgaccaggctggtctccagctcctggccttaggtgatccgcctgcctcagcttcccaaagtgctgggattacagacatgagccacctcacccagcccagataatccttttacacactgtttaaaattttcaattttcctggagatagggtctcctgtcgcccagcgggtaaatgcagtggtgcgattatagctcactgcagcctcagacacctgggctgaagcctgattcttgagcctcccaagtagctgggactataggtgtgagccatcatgctttgcccttttttttttttttttttttttttgaggcagagtctcactctgtcacctaggctggaatgtagtagtggcacgatcatagctcattataacctcaaactcctggtttcaagcaatcttcccgagtagtcaggactacaggcatgccctgccatgcccaactaattaaaaaaaaatttttttttatacacatagggtctcactatgttactcaagctagtctccaattcctggccttaagagattttcccaaagcattaggattataggcatgagccacctcacccagctgaaacagataattctttttttttttttccttgagatggagttttgctcttgtcagccaggctggagtgcaatggcgcgatctcggctcgctgtaacctctgcctcccggggtcaagcgattctcctgtctcagcttccccagtagctgggattacaggcgtccaccaccacactcggctaattttttgtattttagtagagatgggttttcgccatgttggtcaggctggtcttgaactcctgacctcaggtgatctgcccacctcagcctcccaaagtgctgtgattacaggtgtgagccactgctcctggcttgaaacagataattctttatattcaacctgttgtcaaaatttttagaaacattttcccagttccttgtataagtatactttgtataacttctggcaaaccataattatgaactcacattactatagtactataatactgcagtaagggatcttgcgtttcagtaatgtcactcatccagttttcctcccctttctcttaccccatctccctcccagtctcatggtttctgttgtcaatcctctttctccttacacaaggcaagaggttttcttaccaatagatcagaactgtgaaggactgcccgacatgatctgatatggttgttcttcattttgggctgtagtattttaaagtagaggtttgctctgatggtcccatcactgcttgccattgtctttccctttgctctagctatcaggggatgttgctttaagtttgttccccaggctttactgccaagagggaaattcatacccactttaacaaggtgtgaagcttatcttacagttgctaatgcctcactgaccttttggaaaggtcatagttactcttcaagttgagcgatttttctcccccaagagctaattaaagtttcttgtttctgatatgctctccttggcaaatgtttgaaagtctagtatcagagcagctgtgatcctgcatctatcaaaatttataacttcctagagaagttttcattctggcattattcctggccttaacactagaatgccctgttgaaagcatacagtaacatttattatactcattctggttgtctgtttgccctagctcactggacgttggtggtgattggcatctgtcaggacttggtggtcctggtgcctcctgtttttatttttctttttgtcctgctcaaacagatatttcttattcatgccgtcttctaatgagtcatttggattcattattgccataaatcatttggaggagtgttttcatgatttactaagtagatcttttaaagaagattttattatgaaatatgcaaacattttaagcaattttttaattaaaaaaaattcgacctccaagattaaatcattagatgtggttaacactgtttctggattggtaagtttccacaaaaagaggtttttaaatttttaaccacatagaccactctttaccatattcattattcttagtattcattgtggtgagttctctctttttaccacgtttatagttgttggattgggaagtgcagtgtgactcttactttgtagtttttaaatcttaacaagtttatagttgtatgagctaaaagtttaaacctctgccccattttcttggggcagtgttctgtgaccagttacatttttggacttaggttatctctgaagtgctgtgttgctgtataaatgtcatatggaggataacctacaaaatacacttcggatctcccaacagctttgcggttctgaaacagccttcagtagtaccactgaaaagaaacggggaattaactggttttttgtttcttttatagagatgagggtctcgctatgttgcccaggctggtctcaagctcctggcatgaaatgatcctcctgccttggcctcccaaagtgccgggattataggcatgagccactgttcccggcctagaattaaacagtttatatatgctctaaaatttaagtcagtgatcaagttgtttatactgtggatttatgtcacatggatattacttgatatgaataataactaaatgaacatgactgttagatgatcaccttttactttaatcaagaattgaagttttattttttctaaatagatacatataaaatgaatggaatttattccctctccccagattttatttggattctaaaatggaattattacatcaaaagataaggtatttttaagaagtatagttgtttttttgagactgagtcttgctctaacgcccaggctggtgtgcagtggtgcgatctcagctcactgcaacctttgcctcccaggttcaagcgattctcctgcctcagcttcccaactagctaggactgcaggtgtgcgccaccacacctggctaattttttgtgtttctagtagaggtggtttcaccttgttggccagggtggtctcgaattcctgacctcaggcgatctacctgtctcggcctcccaaagtgctgggattacagacttgaaccaccacacccagccatgaagtatagttttttgtttgttttttgagttttgcttttgttgcccaggctggagtgcaatggtgcgatcttggctcaccgcaacctctgcctcccgggttcaagcgattctcctgcctcagcctcctgagtagctgggattacaggcatgcaccaccacacactgctaattttgtaattttagtagagatagggtttcttcgtgttggtcaggctggtctcgagctccagacctcaggtgatccccccgccttggcctcccaaagtgctggaattacaggcgtgagccatcgcacccggcttttttttttgttttgagaccgagtcttgctctgttgcccaggctggagtgcagtggcacgatctcggctcactgccacctccgcctcctaggtacaagtgattctcttgcctcagcctccccagtaggtgggattactgacacacatcaccatgcccaggtaatttttttgtatttttagtagagacggggtttcgccatgtcggccaggctggtctggaactcctgacctcaggtgatctgcccgcctcagcctcccaaagtgttgggattacaggtgtgagccactgtgcccagctgaagtatagttttgactttcaagaattcttatgaacaagacatagccagttgtttatataattgcattttctaccgtttatttctagagaaagaaaatagattttgtctatcataatccctttagtgctagccacttttttttttttttttttttgagttttcgctcttgctgcccaggctggagtgcaatggcatgcagtacactcacggctcactgcaacctttgcctccccaggttcaagtgattctcttgcctcagcctcctgagtagctgggattacaggcacctaccaccatgtccagctaattttttgtatttttagtagagatggggtttcgccatgttgggcaggttggtctggaactcttgacctcaggtgatcgcctgccttggcctcccaaagtgctgggattacaggcctgagccaccatgctcggccagtgctagccactttttaaaaaagtgacattaagcctaaaaagacacattctaacgtgccatttctcttctaggttttggcttggtttgaagaaggtgaagaaacaattacagcctttgtagaaccttttgtaattttactcatattagtagccaatgcaattgtgggtgtatggcaggtaagcaaaaattcctgtactgcaaaatttcaataagttatgtaagtgattagggctgtattaatctttctgttatctgtttttcctgatgtgttgagtaaaaatatgtttgcgggaagtttacatgtattttccctttattccataaattaattgttttctgacacagtctcactctgttgcccaggctggagtgcaatggtgttgtctcggctcactgcaacctcttcctcccaggttcaagtggttctcgtgcctcagcctcccaagtagctgggactacaggcacgcaccaccacgcccagctcatttttgtattttttggtaagagacagggtttcaccatgttggccaggctggtcttgagctcctgacctcaagtgatccgccctcctcagcctcccaaagtgctgggattacagacgtgagccaccatgcccggcctattaatttaattaattgcaaatttttgaccttaatgcatataaactttgcagttaagattgctcattcttcgccaagtgtggtggcaccagcctgtagtctcagctactcaggaggctgaggtgggagggttgcttgaacccaggaggtcaagactgtagtgagccatgatcgtaacactgcactccagtctgggcaaaggagcaacactgtctcagaaaaacattgttcattctttacggtagcaaggaattaaaatgggtgagagaagctgcttaaggaaatgagaatgtgagaaccattatctttatgtctcctagttgcttcctgtgacaaactttaaaagctacatgtcatttttattctccttgggtttttttggtaggtttagctataaaaattgtttccccttcagtgcttactacagactctgagacttaaaattcatgttaagtgttgatcttttaggtatttgacggatataatcacccctttgaggactgaagtagaccttttttttgtttttgttttgagaccgactctctgtcgcccaggcaggagtgcagtggcacgatctcggctcactgcaacctccgcctcccaggttcaagcagttctgcctcagcctccttgagtagctgggattacaggcacctgacaccacacccagctaatttttgtatttttagtagagacggggtttcaccatcaggctggtctcaaacccctgacctcgtgatccacccacctcggcctcccaaagtgctgggattacaggtgtgagccaccactcccggcctttttttttttttttttttttgtttgtttgtttgtttgtttgttttgaccgactttcactcttgttgcccaggctggagtgcaatggtgcagtcttggctcactgcaacctccacttcccgggatcaagcaattctcctgtctcaccctcccgggtagctgggattacaggcacgtgccaccatgcccagctaacttacttacttttaatagagatggggtttcattttgttggtcaggctggtctcaaactcctgacctcagatgattccccctgccttggcctcccaaagtgctaggattacatgcgtgagccaccacgcccgacacatcttataaacatacttagtcctgttgaaattgtaaacttctaatctttaccaataaatgttaacgatctttatgtggtaggttcatagaaagatggcctacttagagatttgtaattgtgccatatatatgtgtgtgtgtgtgtgtgtgtgtgtgtgtgtgtgtgtgtatatatttttttttttttttttttttttttagatggagtcttgctctgttgcccaggctggagtgcagtggtgtgattttggctcactgcaacctccgtcttgtgggtttgaacaattctcctgcctcagcttcccgagtagctgggattataggtgactgtcaccatgcctggctgttgttttttttgtttttttgagacagagtctcactctgtcacccaggctggagtgcagtggcatgatcttggctcactgcaagctccgcctcccgggctcacgccattctcctgtctcagcctcccgaatagctgggattacaggtgcccaccaccacgcccagctaattttttgtacttttaatagagacggggtttcaccgtgttagccaggatggtctcgatctcctgaccttgtgatccgcctgcctcggcctcccaaagtgccgggattacaagtgtgagccactgtgcctggccttcttcttatgtttttctcaaaaaaattatatttggtcagggcatggtagctcatgcctgtagtatcagcagtttgggaagctgaggcgggtggatcagttaaggtcaggaggtcgagaccagcctggccaacatggcaagtccccgtcgctactaaaaatacagaaagttagctgggtatggtagcatgcgcccccagctacttgggaggctgaggcagggcttgaacctagggggcggagtttgcagtgagccgagatgatgccactgcactcgagcctgggcgacagagctagacttcgtctcagaaaaaaaagattcgagtttttaaaaaaagaacattcttaagtctttagtatactgaatggtatgagcagcaatagagggttgtggccttctgaaagtaaggaaaattataatgacagtataaggtagtatgaggggcatagtcttttatttctgaccagtgtcatcaaggagggctttattttttttaagacggagtctcgctctgtcaaccaggctggagtgcagtggcacgatcttggcccactgcagcctccacctcccggactcaagagattctcccacctcagtctcccaagtagctgggattacaggcgtgcaccaccacgcctggttaattttttgtatttttagtagagacagtttcaccatgttggccaggctggtctcgcactcccaacctcaggcgatccgcccacctcagcctcccaaagtgccgggattacaggtgtgagccaccatgcccagccttttcattgattgtaattgtcatctttgttctcagggtcagagataatttatcttttttttcccccaagacagcttcactcttgcccaggctggagtgcagtgtcataatcacagctcactccaatctctgcctcgcaggcttagtgatcctcccacctcagcctcctgagcagctgagactgcaggtgtatggcaccatgtcaggataatttttgcatttttcgtagagacactgtctcgttatgttcagcccaggttggtctggaactcttgggctcaagcagtcctcttacctcagcctcccaaaagtgctgggattacaggcatgagctactgtgctcagctgataatttaagcacatgcaaaatacagtgctcatgggatatttgtttaaccttgagcagtccagttaaattccacccaacatgatcttgaagggtaagaatgtctgatatgagattgaaattaactttatcatgaatttcccaattaaggtttttttatactttttctggggtatatacatcaaaactgaggtacacgtgttaccagctttcatctttgtgtcatttgattctctttaggctggtttgattctacaacttccattctgaaatcgggaagaaaattactgtgacttctaacggttgatagttcatatatgatgtcatgagaaatatatagcttgggactggcagtgctatgatgagagtccagccattcattggtctttacaactggagggatagttcttagaatttgtgagagatactcatcactcatagcatttactgtgtgcccaaacacaatctaagcatgttacatatgacttcttatcctcacaaaccttgaggtaggaactgttagtgttgtcattttatagacagtaaacttgtgtgttgtgtaacctctctacagtgacatagctgttaagagcctgtattgaacctgggcagcttagcccagagttgggttgggttggggttttttttgttttgttttgttttgtttttttgacatagtctctttctgttgcccaggctggagtgcagtggcaggatctcgtctcactgcagcctccgcctctcgggttcaagcgattcttctgcctcagcctcctgagcccagactattaagctgtactgcctctcatgagacagaattgattttaaatggcagggggatttggctaaaggtgaaagctgtgttttacagtcttagggacagcagagtctgtaattgcttttcctcattgttttatccccttagcttaattgagggtacttaacgtttcgtttttaatacaaattaataaatgtccttgtgtctgttgccttagatgtgaattgtttagtacaaatgttactggtgggcttcctttctttttaaagattagacctctaacattttattccttgggttagaaataattgcagtgtcaggcaggtctttactactcttctgttttcttttatacaggaaagaaatgctgaaaatgccatcgaagcccttaaggaatatgagcctgaaatgggcaaagtgtatcgacaggacagaaagagtgtgcagcggattaaagctaaagacatagttcctggtgatattgtagaaattgctggtgagttgagtttgtcatttttcttttattctagatagtatttctgaatgtagtccttttctcaaggctcataattatatttaaaataattgttttcatgtatcaattaacacattttattgccattcatacaaatcctacattctctaaaattattttgaaatgttttagcacctcccttcctgtcattgataaggcttttggtttttgtttttaaacaaggtattttgaattctacttgtttaaatacattgtagaacacaagtgctagagaggtaaaacctaatgttgatttgacagttagttatagtgaacaatttgttagaatactggctaatgacgacacagtttttcctgttttgtttcttggcaccaaagttcatggtcaagggtaatttcttgactctgaaagctatgcttggccaggcttggtagctcacgcctgtaatcccagcactttgggatgccgaggcaggcagatcacgaggtcaagagattgagaccaccctggccaacatgaaacctcatctctactaaaaatgcaaaaattagccgggcatgatggtgtgtgcctgtagtcccagccacttgtgaggctgcagcaggaagaatcgcttgaacctgggaggcggaggttgcagtgagctgagatcgcaccactgcactccatcttgatgacagagtgagacttcatctcaaaaaaaaaaaaaaaaaacagtatgcttaaaaatacttatgtgttacactgagccaggagtctctgcctgaattccagagatagcttcaaagagtccatgaatccactgtgagtccagaatgctccacagacctccaagggtcagtatcctcactgctgtagattagtgctgtttttttgttttgttttgttttgttttttgagatgggagtctcactctgttacccgggctggagtgcagtggcatgatctcagctcactgcaacctccacctcccaagctcaagcgatcctcccactttgccccccaaatagctggtaccacagatgcatgccactacactcgcctaatttttatattttttgtagagagggagttttgccatgttgctcaggctagtctcaaactcctgagctcaagtgatcctgccttagcgtcccaaagtgctgggattacaggtgtgcccagcagccatatttctgacagtccaaaatcacaacacccctgggaccaaccaggatagtctaggtgggttgtttgttttggctatttcacttagagagtcattgcatactgttattcagattatctggcttttcatacccttctgagttaagtatactatttactttgttgctatttgtgaattatctcatagtaatatgcttttatattgacttgggaagggtgtgctttgtctttattgtcttactcattttaatgaattgaaagagctgcattccttaacccatgctctacaactttggcctctgaaaggaaattgccttgtcctattctctcatccagaaatttttgttgttcctccagaaaaaaaggatagtgttacatatatgccagtaagccaattatttgggactgtgtagtgtttgtgtgtaaatggtgtgtgtaaatgatttaacagcttccttaagtatagtgttaagaagagtacaactcagaatgaaatgtcttggctattggattttttaaaacttcctgttttggccaggcgtggtggctcatgcctgtaatcccagcactttgggaggctgaggtgggcagatcatgaggtcaagagatcgaaactatcctggccaaaatggtgaaaccctgtctctactgaaaatacagaaatcagctgggcatggtggctcccacctgtagtccgagctcctcgggaggctgaggcaggagaatctcttaaacccaggaggcagaggttgcagtgagccgaggtcgtgccatttcactgcagcctgggcgacagagccccagactccatctcaaaaaaacaaattttctgttttgacacaaatgttatactatcacagatgtattattttttcactctgtatacacacatttttgtatgaactgttgaagggtatattgcaggcatgatgcccctttaactcctaaataacatttgttttatagtatcaaggatgttctcttatataacctcagtatgattatcagaattaggaaattgatgcaatagtatgtaagatcttattcagaatttaccagttatcactttttttgatgaggggaagacagggtctcaatctgtcacccaggctggagtgcagtggcaccatcacggctcactgcagcgttgacctcctgggctcaagtgattctcccacctcagcctcctgaataactgggatcacaggcatgagcaaccaagctcctagctaagttttgtatttttttgtagagatgggtcttgccctgttgcccaggctggtctctcaaactcctgggctcaggcagtcctgcctcagcctcccaaaatgctgggattacagacgtgagcccactgcgcctggcccacattttttttaatagcaaaaaatatttgaattagggaattctgatggtgatgaagaaaataggtcagaatggggaaggctgaagatatagggaggctattttagtagtctaggcaagagataatgaggacagtaacattaagaataatgaaggaaagatttttgagttcatgaatagtggctcttaagcaggagtgcacatcacaatcatctgggggcactctttttaaaaaagtttttggcaggtctcaacctagaatattaactctgaatctccattgggtacagagttctgatcgtgagtagttcaaagagtgagcctctgacttagttacaaaacagcagatttgttttgttttgttttgagatggagtttcgctcttgttgcccaggctggagtgcaatggcaccatcacggctcactgcagcattgacctcctgggctcaagtgattctcccacctcagtctcctgaaaaactgggatcacaggcatgagccaccatgtacctggctaagttttgtattttttttgtagagatgggtcttgccatgttgctcaggcttgtctctcaaactcctgggctcaggcagtcctgcctcagcctcccaagtagctgggattacaggcatgcgccatcatgcccagctaattttgtatttttagtagatgtggggtttctccatgttggtcaggctgatctcgaactcccgacctcaggtggtccgcccgcctcagcctcccaaagtgctgggattacaggagtgagccaccacgcacggcctaaagcagctccttccgtcagtctgtccgtccgtctgtccttccttccttcctccccctttccctcccctcccctcccctcccctcccctccttctgtcctccctcttttccttctttctcgctctctcttttttttttttttttttttaacttggagacaggggcttgctctcttgtccaggctacagtggagtagtgtgatcactgcgacctcgaactccttggcttcaagggggtcctcctgcctcagcctcctgagtagctggtaatacaggcacatgacaccatgcccagcttttttttttttttttttttaaagacggaatcttgaactgtcgcccaggctggagtgcagtggcacgattgcggcccactgcaagcttcgcctcccaggtttacgccattctcctgcctcagcctccccagtagctgtgactgcaggtgcccaccaacactcccagctaattttttgtatttttagtagagacagggtttcactgtgttagccaggatgacctcgtgatcctcccgcctcagcctcccaaagtgctgggattacttacaggtgtgagccaccatgcccggcctttttttttttttttttttaaagtaaagatggggtcttgctttgttgtccaggctggtcttgaacttctgggctcaagcgatcctcctcctcctgccttggccttccaaagtgttgtaattacaggtgtgagccactgtacctggctcaaagcaacagattttgataatagataggagagtgtgtaaatcaaagatactggcaagatttctagtttacgtgactgggtgtgatgatggtactctactacctacagaaggaaacattggaaaggagattgtttttccacaaatatatgtggtgggtgaggttgtagatgacatcacctaaatatgtgtatgagattctgtttgattttatgcttacagtttctccagcttcttcttgtttaatttttttaaaaaaatagagacagagtctagctatgttgcctaggctggtctcaaactcctggcctcaagtgatcctcttgccttggcctcccaaagttctgggatttacaggtgtgagccactgtgctctgccttgttgggctgttttagtgtgttgagtctacttgaagccttagagaaattacccccaaagcctttatccttagtttgcatcagtagatggcaatggtagacagcttcagaggaaactacaactgtgatacctcaaagcaccatcctttttgaagaaagagacaaaagccagcttctcttcagttggtgattctggtttctctgtatctttgaatcctgattcttgccagtccttcccgtcttttgtaagacactctaacctaattaactgtgagaaacttggaagtcatcttgattttttcccccctcttatcctctgatttgtccgtaaggccactgattctgtctccagaacacacccaagttcgtgaactccgtttccttggtcagcacactagtctagccatcatctcacaccgcagctgtcatcatctcctaactaggctctggcttcctttgttgtcttcctccagtccattctccacacaagtgccagagtggtttcttaaaggttgtgttatttattcatctgctaaaaaacccttaagggacttccccattgcacttaaaatacaaaattctctgacctgataaacttgcattgtgtgtatgtacctcctgctttcttctatgatttcatcttgtgctgctccttcatgttgcagacatccaggcctttttttcagttttcagtaccaccaaagtcacctttttttggaaggttaggcaaattttatagagtttattaatttgctcaatgcactgatcttatggtggtgaagctttgattattaccctgacctatctcgctttctcacactgaaatttcattttctatattgtaatatagttttgttgttgcatttgatagtttagaaaggacaaataatgtttgatctatagtgtatgtgacttaagattttcagtctaatgggattttccttatttatattgtggtaaagtatacatattataaacttacccattttaaccatttttaagcgtgcagttctgtggcattaagtacattcacattgttttgggactgtcaccatccagaacttttatcttccctaactgaaatgtacaccttaaacactgacttccagttcccctcttccctggcccctggcaaccattccctttatttgaatattcaaaagacaatgaatttaatattcaaaaaaaacctgagtttaaatcccttaggtgaatatactactactataaagtggagtacaaatttaaatccattttcctttcacctgtttctgaatccttcatagatagtgctgattctggtagttatttaccactttttttccccagctcttcccccacagtatggtaattgctaaaaagcgtatatattgctttgacgttgggctctgtttttctttaatttttatttttattactattattattattattattattattactattttgagacagggtctcactctgctgtgcaggctggaatgcagtagcgtgatctcggttcactgcaacctctgcctgcctgttcaagtgattcttgtgcctcagcctcccaattagctgggctcaccagcatgcaccaccacacccagctgatttttgtagttgtagtagagatggggttttgccatattggccaggctggtctcaaactcctggcctcgtgacccactcacctcggcctcccaaagtgctgggattacaggcgtgagccaccgtgcctggcctattattattttagttaagcccagctgtgtgagacattgggctcttaagtgctgcttgctttcgtcttaaattgtgacctttttaactgagtaatgcagaacagacatctaggtttagaatgtatgtgggcattttattaaatactgttgtcatactactaggcagtgagcaccttaaggacagaactgtcatattgactgttgtaacgttatcgtaagttctctatgaatgaaatttgaaatcagaagtatatgataggctcagctaatgtaaacatagttgctgtgcagaacaaacagttgaagtgtatgtgtgtgttcaatacaattattattataatattatacagacagagtcttgttctgtcacccaggctctagtgcagtggtgtgatctcggctcactgcaacctgtgtacctcccagtttcaagtgattctcctgcttcagtctcccgagtagctgggattacaggcttgggccattatgcctggcttgcttgcttttttgtttgtttgtttgtttgtttgttttgagacgagtctcgctctgttgccaggctggagtgcagtggcatgatcttggctcactgcaacctccgactccctggttcaagcgattctcctgcctcagcctcccgagtagctgagattataggcacgtaccaccacgcccagctaatttttgtattttttagtagagacggggtttcaccgtgttggccaggatggtctcaagcccctgacctcgtgatccatcctcctcggcctcccaaagtgctgggattgattacaggcatgagccaccgcgcccagccacgcctggctaatatttttgtatttttagtagaggcagagtttggccatgttggcccggcaagtcttgaatttctggcctcaagcgatccacctgcctcagcctcccaaagtgctgggattacaggcgtgagccactgcacctggccttcaatacaattattgaatgccagattattagtatattcaaggtctgtgtgatcctcattattatcttaattccagaacattttcatcaccctcagaaaaacccatacccattagcagttgttgccctgttttcctcccaccagttcctgacaaccacagtttattatctgttttgtggattactgtctgtttttctggatattgcatataaatggagtcaatcttggtgactggctttctcttagcatagtgttacatttcgttcatgaatatagcatgtatttcattccttactgctgaataatgtttattagttgatggacatttgggttgtttccagttttggtctattatgagtaatgaatagtgctataacttgtacatacatgcttgtactaatttttgtgtgaacataacattttctctctgttaggtatgtacctaagcatggaattatggggcctatagtgactctatacttaacattttgagcagctaccaaactgtctttcagaatggtggtgatattgttctacattcccaccaacaatgtatacaagttccagtttctctacatccttgtcaagacatgtcattgtctatcgttttaaagttttacccaggaagtgagtatcattgtggttttgacgtccgtttccctaatttcttaatgatgttgggcatcttttcatgtggctattgtccatcggtgtgttttctttggagaaatgcctgtttaaattaggttatttgtctttttaatgttgaggtataagaattctttacatatcctgccttatgaggtgtgattagcaaaattttttccccattctatagggattcctttttttcactttcttgatggcatactttgtaacatacaagtttttaatatgataaagtccacttatacattgttgttgcttgtgcttttggtgtgatgtctaagaaactgttgccaattgaaggtcacaaagactttatatattagccagtatatatgatccaggcgtcgtggctcatacctatatgatcccagcactttgggaggctgaggcaggaaaaaccacttttttttttctttttgagacggagtcttgctctgttgtccaggctggagtgcagcgagtggcatgatctcggctcagtgcaacctccgcctcctgggttcaagcgattctcccgcctcagtctcccgagtagctgggattacaggtgcacaccaccacactcagctaatttttgtatttttagtagaaacggggtttcaccgttttggccaggctggtcttgaactcctgacttcaaatgatccgcctgcctcagcctctcaaagtgctgcgattataggcaagagccaccatgcccagcctaggaaaaaaacacttttaaattagccaggcaaggtggtacaggcctgtagtctcactactcaggaggcagaggtacgaagatgacttgagcccaagagtggaggctgcagtgagctactatgatcctgccactgtcctccaccctaggcaacaaagcaagaccttgcctctttaaaaacagcaacaacagcaaaaactatggtgtgaggtaggagatccagctgctttcttttgcatgtggatatttagttgtctcagcaccatttgttgaaaagatttcttcactaatttgtcctgcaacctttgtgaaaaattaatttacaaatgcaagaatgtatttctagactctattcttactccattgatctctgtctttaggtcagtaccatactgtcttgatagctagctgtcgttttgtattttttgaaattgggaacttgggagtgtaactttgttcaagataattttgggcattctgggttccttacatttacatataaatttttaagagttgcttgtcaatttctgcagaaagcaagctggtattttcagtaagaattgtgttgtatctatagatgagtttgggaaatatggtcgtaatatcaagtctttggatccatgagcatagggatgtctgttttttttttgttttttttttttaaggtctgtcatttctttcaacactggttgtcagtgttcaagtcttgtgcttcttttgttattgcatttttggcggggggaatatttgtaattggaataattttttgtaacttgaaattggcctattggtgatatttatttatttatttatttttgagacggagtctcgctctttcaccgctatgacaggctggagtgcagtggcacgatctctgctcactgcaagctccgcctctcgggttcacgccattctcctgcctcagcctccccagtagctgggaccagaggcgcctgccaccatgcccagctaatgtttttgtatttttagtagagacagggtttcaccatgttagccaggatggtctcgatctcctgacctcgtgatccacccgccttggcctcccaaagtactgggattacaggcgtgagccaccgcgcccggcctagtgatatttatttttaattaaaatttttagattcaaggtacatgtgcaggtttgttatgtggatttaatgtgtgatgctgaggtttgggcttctgctgatcctgtcatccagatgatgagtatagatgatgagtatagtacttcacagatagtttttcagccctcgcccctctttccctcccactttttggagtgcccagtgtttattgttcccatcttaatggctatgtgtactcagtgtttagctcctacttacaagtgagaacagacagtatttggttttctgggttaactcacttaggataatagtctctggctgcatccattttgctggaaaagacatgatttcattcttttgcatggctgcgtagtatcacatggtgtatatataccacatttatttttgagatagggtctcactctgtcgcccaggctggagtgcagtggtgcgattttggctcagtgcaacctccacctcccaagctcaagccatcctcccacttcagcctccttgtgagttcaggccatcctcccacctcagcctccttgtagctggaactacagatgcccaccacgcccaactaatttttgtatttttcgtacagataaggtctcaccatgttgcccaggctggtctcgaattcctgggctcaagtgattcacccaccttggcctccgaaagtgctgagattacaggtgtgagccaccacgcccggccacaatttctttttcttgggatatatacccagtaatgggatcgctgggttgaatggtcattctgtttttagtttcttgagaaatctccaaacagctttccacgggggctgaactagtttacattcttgccagcagtgtataagtgttccccccagccccaccacctttttttttttttttttctttttttttgaggcaggatctcagtctgttgcccaggctggaacacagtggcatgattatagctcattgagccatggctttccaggctctagtgaccctcccacctgagccttccaggttagctgggactgtaggcacacaccactatgacaggctcatttttaaattttttcgtagagatgaggtcttactatgttgccctggctagtagttgaattcctgggctccagtgatcctcccacctcagcttcccaaagtgctgggattacaagcgtgagccaccgtgcccagcaataatagtcactctgactggtgtgagatgacatctcattgtggttttgatttgcatctctctactagtgatgttgagcattttttcctatgttgactacttgattgttgtcttttgagaagtgtcttttcataccctttgcccacttttcaacagtgattttgtgtgtgtgtttgtgtgtggatttaagttccttatagattctggatattagtcctttgttgagtgcatagtttgcaattattttctccaattctgtaggttgtcagtttactctgttgatagatttcttctgctgtgcagaaactctttcgtttaactaggtcccaattgtcaagttatttgttgcatttgcttttgaggcttagtcataaattctttgcttagggcagtgttgagaagagtatttcctaggttttcttctaggatatttacagtttgaggccttacatttaagtctttaatttgccttgagttaggaattcttttttcaatttcattttcagattgttctttgctagcgtgtagaaatagttttttacgtattgatcttgtagtttgccatcttgctgaactcattagttagttttaatagtttttatgggttccttaagattttctatatacaagatcatgcatttgcaaatgaaaatgtttttacttctttctagtctggatgccctttatttcttgcctaattgccctggttagaatctccaatacaacgttgaagtaccaagagcagacatccttgtcttactgatcgtaggggaaagcatccagtccttcacagtgaagtgtgacataggtgtgggtctcataggcgggtgccctttatcatgttgaggaagcctagttacagctgtaatatttaggttgtcagtatactctggtgacctttcatggtgtttgtaaacttatatgcaaatcagaaatgatagtttgctgggttactaggaccagcaggtcattgaattgggtaagatataattctaaggcatttgcaactattatatggaacattttggaaaagcataccgtgactgtataacctgggccagataaataggtatttattttattaagactatacacgttgagccttttaaacttccacctcttttagaattagtaatcaaattgactgtgcaatctagcatttagcctgataattcagttttgtgaaaactatagagtgaactttaattctgaattttttcttgtcagtcgaaggtactatttgcgtagcctgaaagattaaatggcataaattgtgcttttagacatggtgacttttatattttcatttacattatgaaattggatgtgaaggggtttttcagatgtgttggaaaactggagagtgttgtaaactaattcgaagctgaaaataaaaaagtactgacttaacgattttgatatttgcagaaaggaacagacctttttgtagtcactgtttggaatgtaagggtcatctcctgactttaaaattctttgtcagcttttggaagatatctggtaggatggttctggctgaacttttcaaagactaagctggaataggtggttttttgagggagatatggagagagagtttaaggaaactaatttttttttttttttttttttttttttttttttttgagatggaatctcactctgtcgcccaggcaggagtgcaagggcgtgatctcagctcactgcaacctccgcctcctgggttcaagcgattctcctgcctcagcctccctagtagcagggattacaagtgcccgccaccacacccggctaatttttgtatttttagtagagacagggtttcaccatgttggccaggctggtctcgaactcctggcctcaagtgatccgcccgcctcagcctcccaaagtgctggaattacaggtgtgagccaccatgcccagccaggaaactaaattttatatgttgctataccagctaatcattccaaagagaaactgggtaagcatacatagcaaatgctaatgtgagtcttaagtatctagaacacaagagccaaatgaaattgatatggcaaataaaaacatggagaaaataacccgcacataggctgtgctcagtggctcatgcctgtaatctcagcacttttgggggaggccaaggcatgcagatcacttgagtccaggagtttgagaccagcctgggcaacatagtaaaaccccatccctacaaaaaatacaaaaattagctaggcgtggtggtgcgtacctgtagtcccaacgacttgaaaagctgaggtgggaggatcacctgagcccaggaggtcgaggctgtggcagtgagctgaaattaagccactgcactccagcgtgggcaacagagtgagaccctgactcaaaaaaaaaaaaaagagaaagtgacccacatgttcacctcttaagaagccacagtaattctacattatcttaaggccaagaaaatatttctccggatggatggaaaccaaaagtagtgaagttgtacataatcttataagaaatgaacgtcattgtttttaagctttctgtattatctgctgacatgaaagtgaatcaagctataatagcctaagtcatttctgttttctttttttctttttccttttttttttttaaagtagagacgggattttaccatgttggccaggctggtctcgaactcctgacctcaagtgatctgcctcccttggcctcccaaagtgctgggattacaggcatgaaccaccgtgcccggccatggttttgtgggatgtttttttgagacaaggtctccctgtattacccagcctagtctcaaactcctgggctcaagggatcctcttcccttggcctcccaaagtgctgggattacaggcatgagccaccattcccagctagaagtcttagttttagaattttggggcttctagtatatgccgcaggggttatttattgacttcttaagaacactgttttcagggttgtttaaaacaaactttatgtatcttggtaacccagggttgatgaatagcaccaggaaataaatattctcagatgacttctgtcttgtagtatatactctggagcgaatcatcttttaagatttaagtagtggaagcaacacaatcttaaaattgcatttgctttagcacttgtacagaaattgataattttatttcctaaaatgaagacttaatagccaacagggtgccagcaatttcaagatttactcgggaataaaaagaataattcttaaacttgacagcaatttaaaggaagaaaactttcaatttaaaggaaggaaacttttacttcagacagttaacatgcagtactgagatttagtagcaggtataaactgcttttgaagcagttgagtaaaaggcagagttgtgaaatagatgagtggattcatataagaacctggattatgatcctagttctgcatgacattggactatgtacattaacctctgcagaattaggtaattggagtactgtttcaaggagctttcttgctctaaaaagtgtgatttagatagtatggccatgagtccatgtggacttttttttgcttttagaaagctgttggggttggaattgactggctttaaacatttagcaaacattaaatgctctttaacacaaaacagagtagtcagtctgctgtagagcagaggagttggcatactatctttgtgggttggttggttggttcgtttgtttatagacatgaggtctcactgtgtcactcaggctggtcttgaactcctggcctcaagtgatcctcctgccttagcctgtaatcccaggtctttgggaggcggaggcgggtggatcacaagatcaggagttcaagaccagcctggccaagatggtgaaacccccgtctctactaaaaatacaaaaattagccgggtgcagtggcaggcacccgtaacccgtaatcccagctactcggtaggccgaggcaggagaattacttgaacccagggggcagaggttgcagtgagccaagatcgcgccactgcactccagcctgggggacagagcgagactccatctcaaaaaaaaaaaaaaaaaaaaaaaaaaacgctgggattataagtgtgagctatagcgtccagctaatattttgggttttgtgggccacaacaatctctgtaccaaagtcttttgtaaaatatgaaaagagaattgtttaaaaaaaaaaaaaaaaaggtgttggctgggtgcagtggcttatccctgcaatcctagcattttgggaggccatggcaggaggatcacttgagcccaggagtttgagaccagcctgggcaacatattgagaccttgtctttacaaaaaaagttttaaaaacttgcatagtgaggctgggagccatggctcatgccagcactttgggaggctgagacgaggttcacttgagctcaggagtttgagaccagcctgggcaacatggaaagaccccgtctctaaaaaaataaaaaatgaaaatttgctgggcatgttgacgtgctcctgtagtccctgcttctcgggaggctgaggtgggaggatcagttgagcctgggaggtcagggctgcagtgagctcagatcgtgccagtatgctccagcctgggtgacagagtgagacagagtaaaactctgtctcccaaaaaaagttcggggggtggggagccttaagattttgcacactgcttagatcaatgtttctctaacttcatgtgtgcaggaattacctggggatgttgttaaaatgtatgttttgattggttcagtctgaaatggggcctgattattctgcatttctaataagctcccaggtcaataatttgagtagcaaggctctagagcagatcttaatcatttctagatcacagtccctttgagaattaatgaaatttatggactttcttccccaaaaacatatattgaaaatcttgtgtgcaacttcaggaggttcatttgtcctcctcctcagaaagtccacctcaggattctagctatttagttttgaaaactgaagtacaggccgggcatggtggctcatgcctgtaatcccagcaatttaggaggccaaggcaggcggatcatttgagcccaggagttcgagaccagcctggccaacactgtgaaatcccatcttcactaaaaatacaaaaattacccgggtgtggtggtggatgcctgtaatcctagctacttgggtggctgaggcacgagaatcgcctaaacccaggagatggaagctgcaatgagcctagattgcacaactgcattccaccctgagggacagagcgagactctgttgcaaaaaaaaaaaaaaaagaaaacaaaacaaaaaagaaaaattgctttagttgttctgtaaatcctggaagctatacctctgtttccaaagccaaggtataaattattactctagaaaacggataagcagaagagcaaaatagtctaaaacaaaaatcagcatagagagtttttgagtttgagagcccctgagcactgtcagaatagctaagacattaagaactgtgagaaatgagagttctcctcaaccatcagaccatgataggccagttgatcttgaagcctgacctgatttcatggggctggcatttccttcctgatttcctgtaatcacctcctctctactccccatgattcagtggtagtcacagtaccaggaagtgccaaccttttcattcttgctactgagatgaagattttggaaaaaggagaagaaaccatgtggtttgggaaccacctttccttttttttttttttttttttttgatacggagtcgctctgtcgcccaggctggagtgcagtggaatgatctcggctcactgcaagctccgcctcctgggttcacgccattctcctgcctcagcctccccgttagctgtgactacaggcacccaccacaatgtccggctaattttttgtatattttagtagagatggggtttcaccatgttagccaggctggtctcaaactcctgacctcaagtgcttcatctgccttggcctcccaaagtgctgggattacaggtgtgagccaccgctgctggccatgggaaccacctttcctaagcattaacaccaaaccacctagatgggcagatttaactgtgaccaacttttatattaaaagataatggaacttttttttttttttttttttttgagacaaagtctcggctctgtcacccaggctggagagcagtggtgcaatcttggaccactggaacctctgcctcctgggttcaagcgattcttctgcctcagctttcccattagctggaattacaggtgtgcaccaccccacctggctattttgtattttttttttagtagagacggggtttcaccatgttggccaggctggtcttgaactcctgacctcaagagatccacccaccgtcagcctcccaaagtgttgggattacaggcatgagccactgtgcccggccgataatggaacttttgaaaaccaagggcttggtggccgggtacactggctcatgcctgtaatcccagcactttggaggccgaggcgggcagatcacctgaggtcaggagttcgagactagcctgaccaacatggagaaacgctgtctctactaaaaattcaaaattagctgggcatggtagcgcttgcctgtaatcccaactacttgggaggctgaggcaagagaatcacttgaacccaggaggcagagtttgtgctgagctgatatcgtgccattgcactccagcctgggcagcaagagtgaaactctgtctcaaaaaaagaaaaaaaaaaaaaaagtaaaacaaagggcttggcattatcagtgccagaaaaatacaagattgagagaatggggaaacaggagggacataaacttggtgggagtatacatttgtatgcaaaagtaaaagataacagacgaagatgttaaccctgtaacaccgtaaaaggaaatgttagaaataactagatagccataaaaatagaggatgattcatttagttcatggtatggttgtgaaatactgtggccttgaacaagtaccttttagtgtctcattttcctcatctataaacagggagggagtaaagataatagatccctccttagagttgtgaagattgaattagtaacctgtgaagctgttccagcagtacctggtctagaaataatagtctcaaaatttcattgcttattattactatacagccactttttaaaatgagacaggtatgtataaatataaaaggtctaatattgttttagtgaatgttgtacataaagagatgtccagaaaatccagaagatacactttttttttttttttttggaaatggagtctcgctctgtcgcccaggctggagtgcagtggcatgatctcagctcactgcaagctccgcctcctgggttcatgccattctcctgcctcagcctcccaagtagctgggaccacaggcacccgccaccatgcccggctaattttttgtatttttagtagagacggggtttcaccatgttagccaggatgatctcgttctcctgaccttgtgatccgcctgcctcagccttccagagtgctgggattacaggcgtgagccatcgcgcccggcaatatactgttaactgtatatatatctgttgaaagaggggaagaagaatggtgtttgaccttttaaacgtgcatttttcttttgtgataaaaatctctgttggtaggtaggctggagtactctaacattgcttagtgcatggttgcctttgcaacatctaatgaattggttacctttctacccccataactctagtaactggaaacttgcttaatgatcagtgtcatttttttagtcagttcattataaaatattccttatgagctaaaatatattttgtctgttgtgtatgttagcttttttaatttggagccacatagaaatctgatttatcaccagtttagatctgaaggggagcttatgaaaccttattttaggggatgagaagactaaaactcagagtttgtaacttatccaggagcatgtggcagtttgtggcagtactaggactgtcaaatgttagcagtatagcgtatcctaaaatttttatttttggccgggtgcggtggctcacgcctgtaatcccagcactttgggaggcctaggtgggtggatcacttgaggttgggagttcgagaccagcctggccaacgtggtgaaaccccatctctactaaaaatacaaaacttagccggccgcatcggcacacgcctgtagtcccaggtatttgggagggaggcaggagaattgcttgaacccaggaggcgggggttgcagtgagctgagatcacgccactgtgctccagcctgggtgacagagcaaacaaacaaaattagcttggtgtggtggtgggcacctgtaatcccagctactcgggaggctgaggcaggaaaatcgcctgaacctgggaggtggaggttacagtgagccgagatcatgccactgcactccagcctgggcaacaaagctagtctccatctcaaaaagtaaaataaaataaaatgtttatttccaagttagtcttagcatttgtttcaaacgctttaccatcttggtagttctctttggtacccagattgaatgcagttatgtaaatggagtctggttgtcattctagacattttttgtcttctgacagtctatggaaatttctttggcagtcttaattactctaccagctaaaactacagtctttcttaggtgttcttcccatccccccattcctaaatttctagacttttactggcatagattattttggttttagtctaaacgtagaatttaagcaactaccattattgaacctcatttagcttaaccaaagctgttatctctttggaccctgattttttattgtttctagcttcgtgatgttcttcaacttggtaattagaagtcttttgctacatgtatactaaaggaaatatgtgtgccaaatgctttattcattgacagatattttatttgacacccactgtgtgccaggtatagtggtagggctaggaaatcagtgatgtctgagtgactctgcctttatggagcttttggttttagtggggaagattcatgaagaccatgcgagtgtaaggaaaggacaggatgctctgtgggcacacagtgagggatgccagcctaatctgggagttagaggaaagccttactatttatgggagaagaaagggtatgtgaaggcccagaaacaagttagaggaactgaagagcatagtgtgtgatgctcagagggaggtgagagggtgacaggcaaacagcacttgggtcatggaggctgttataagcccgggttgggatgccaaagaagctgttgaaagattttaaaacaggaggagatcacgtttgccattttaaagacagtactgtctaagaaacagattgggagcaaaccacagtagtataatggggtattgtgtaatgttccttccctgttcaccgtgaggcctggaagtagtttaaagtagtcaagtagagcttctcaaatgaagaatttcattcagtctctgctaaactacaaaatttatgactcaaattggaaacacggtgaaaattttgagtcacagttaaatgtttaagtagtttaagataaatctgttatgccttgtgtttcctaggagccatttagattcaaaaacaacagtggcatttagaaggtaatttctggtcttaaatagtgtttttcttataaaagattttaataactggtgtttgccacaataaattaggtttttaaaatgcataatacaattgattaataaaaaggattttttaaaaaaataatgctgatttttggtttgtttgggttttttttgagatggagtctcactgtgtcacccaggctggagtgcagtggcgcaatctcagctcactgcaacctcagcctccaagtagctacaattataggcgcccgccaccatgccgggctaatttttatatttttagtagagacggagtttcaccatgttggccaggctggtctcaaactcctgacctcaaatgcttcgtccgccttggcctcccaaagtgctgggattacaggtgtgagccaccatgcccggcttgaataatggtagttttaaccatcagtatttatatttgacataagtggtacaaataatgtttcagtatcatggcttataaacgtttgcatggagttctaaaacgtggcaaactgataatttaatgaactcttacttgaactcttgtgcaagtatactgtgaggattttgttctgattggaaatctttattgtaatagcaaattaaagagctgtggattttcaagagctgaatttgaaaggtgtcagatgttaaatggaaggtaattcagagtttattcttttattgtacctgcctccacccaaagagtcagagaaaaacatttggaagaaaaaattgcagagcatccctttggcaagagtaagaattttccactaccacttgccctaagagcattgacatgcctcaccagggaaatgttacaggatgtgatcatcggaacagcctagcctgctcttcatgcacaaaatcctttgtctgaaattcacagaagcctctccagacaaagggaaattgttgtgtcttcacttgaaaagtattcggtggacctttactttcatgaaccttttaactctaagaacctgttttcctaatagagtcaaccctaaattgactctgatatcaacaaaaggaatgtaacagtcacacagcaagttaaacaaaggttttcattaattgagcttccttagagaaggctacttttacttcctagcctgagttcctgtgcataaaatgaagaggacattggttggtcaagatgatgtgatggtccctctagctaagaaaatactagaatatggcaggttcgttggtttgtttttgagatggagtctcgccctttcacccaggctggagtggcgcaacttcggctcactgcaacctccgcctccaaggctcaagcgatagtcttgctttagcctcccaagtagctgggattgcaggcacccaccaccacacccggctaatttttgtatttttagtagagatggggtttcatcatcttggccaggctggtcttgaactcctgacctcaggtgatctgcctgtctcagcttcccaaagttctgggattacaggcataagccaccgtgcccagtctatggcaggttttttggatttatgtttcttcaatatctttctacaaagatcagtttctaatagaagccaattaaacatagaaactctaaggtagcatatttcccaagtgttgggaggctttggagctttttagcttcgagttggtgtgcctgatagatgagaaacagcacaacagaaaagctgttcataggatccatgactctagctattgcattttttctcttgcattaatttttctagtgtatttgtaaaacctttttaaaaatatggattcttaattttaaaattaacctggtgcaatggcacatgcccgtagtcctagttacttgggaggctgaggtgggaagatgacttgagcccaggagttcaaggctgtagttcaccgtgatcacgccagtatactccagcctgggtgacagagtgagaccctgtctgtaagaataaaaaatgaaaaaaaaaaaaaaaaaaaaaaagtggattcctagaccccactccaaatgcatttaatcatactcttaaagaatctgtaaaagatctccagataactcttcttgtcgtttctaaatatttaattgccacttgattagaatggaagttgtaagatggaaacatttagaacagctgtggtcagtatttaagggtttcccaggcatttgacatttgttcctctagcatttgacatttaaggtattcctcagtatttggccaaaagttaaatgtgtatcaatacagtttctgcacagcaaagaaacacctttcatatattttagtagacctttataaagggaaagagtacatgttggtttccttataatgccagtataaatataatctttcatatacataatatatactatattatatattaatactatatataataaatctatactacacatattgtatatttatactataggaccaataggtaagacctatagtcctgtactacctgttggtcctgtaggtgtatctattagtgttaggtaggaccattactaaatacagtgtgtatatatactaaatatgtatatttagtattggtcctacctaatactgttagataacgattggatatccctaatctgaaaagctcaaagatcagaaactttttgagcaccaacatgatgctcaagggaaatacttactggagcatttcagattttgagttttttgtgtagagatgttcaacagtaagaatataaatcaaacactccaaattttaattttaaaatactgtttccaagcattttgggtaagggatactcaacctgtaatatgttggcagtgttacccaggaaatttaaccttggtatttcttacctgaaaaatacattttctatttatttcaaatcctctgagcttccactgaaacacagcaaaacacatgccaaaacattgcttttgtatcctcttgtaggttgtactcaatttaaatattagatttgttgaccttttaaaatttgtcaagtatatgagagtatgagctagggtttatatattgaattgtttaagtctgttcagcagttacaatgcagaagtaaaatagtgcttatagattgacgaccgctatctcacattggacagaagtcttctactccataggatcatgacattgacgtaaatcaaatcctcagacaccaaaggaacatttggaaataaattttccatttagggtcataatattcatcattgaacttgtcctctttttgaaatgttcgagggcatgtaggatcaggttaatcatgacaggcagaaatagtgcagtatagggcatgttagctgttaaagaccactaaagtttagaatatagttactttgttgtcttaaatcatctgttagatgtactctcttcaatgtagttagagcagaattatattaaaatgaaaggttctcgttgattcagtctgaatattgctgttcattgcacaagcatttccagcaggaatttcaccttagcttgtgtgtccctgcagtcaaatgcaagggtgatctttgcctgttgagattatatattgacaaactgtgccgccttgtgaccacattgcttacttaggctatagcattgtttttatgcactcaaattaaaaaagtaaaccatattctccctgaacttaagctccgaagtagagaaaaatcagaactaatttgaaggtttaagaagttcagtgttggctgggtgcagtggctcacgcctgtaatctcagcattttgggaggcaaggcaggtggatgcctgaggtcaggagtttgagatcagtctggctaacatagtgaaacgctatctctactaaaaatacaaaaatgaggctggttgtggtggcgcacgcctgtagtcccggttgatcaggaggctgaggcaggggaatcgcttgaacccgggaggtggaggttgcagtgagctgagatcatgccactgcactccagtctgggtgatagagcaagactctgtctctgaaaagaaaataaaaaataagaaattcaatgtttacttcttggacaggagtgctattttgccattttgtatatgactggtaacatgcaattcagtatagagagtaagtctgaaaaatgatttgattttaaaatgccatctgcaagtatgggagaattttcttatgtaatttgtagctgccctttcgtaagacttacaaaccaccttaattatctttcagaaaatcacggacagctgttttgttgttattattgttgttttgagacaaagtctcgctctgtctccaaagctggaatgtagtggtgtgaactcggctcactgcaaccgtctgagtagctgagactacaggcacactaccattcctcccagctaattttttatatttttagtagagacaggttttcgccatgttggccagactggtctcgaactcctagcttcgagtgatcctcccgcctcagcctcccaaagtgttgggattaacggacagctgttttaatgtccagctgctttgtgtgattgtgccactcattcagcagtatttgaataccagcagagggctgggcactattctcaaggtgcatggctttgtctgttacttgggctatgttgtggaatttcactttgtacacacatcaaggaaaggggctgagatttgggccttttaagagctattaaagtaacttgttggcctaggaaagaagactcagttgacttaaagatcttcaggttatgcaagaggtttattattcatttaattgatatttctttttttttttatgagacggagtctcgctctgccgcccaggctggagtgcagtggcgcgatctcagctcactgcaagctccgcctcccgggttcacgccattctcctgcctcagcctcccattaattgatatttcaaaaagtatcaaaggatatatgccccagctgtgcagtgttactagtttgctacaccttcccagaggtgtttctttataccattggaagttgtcattttagtatgaattaattacatgttatacgagcatatcaaagggtttgaaacagtgaaagagctaagattaacttggaaataaacattttattttattttactttttgagatggagactagctttgtttcccaggtggtgtgcacctgtagtccttctgcttgggaagctgaagtgggaggtcaagggtgcagtgagctgtgattgcctcactgatctctacatcctgggtgacagagcaaggccctgtctcaaaaaaaaaaagtggtgttactgtgtagttttattttgcatttgccatgtgtttcgttaattgaatatctttttaaagggggccatttgcttcctgttcacaataatttagcttttttgatggaatgaatcatggcatatacaactttattctctttgctgtgccttgtgtatatgtagtaagacttttacttactgctaagtaggaaagtattctttaaagtgaaagcttgaaggcctgtctgaagatacagagcaaaatttcttagaataatgtagttaggtttccttaagcctcattctcttccttcctaattcaaatcttgaatccatctaaagttttttatgactccaagataggttgatcactttgcttgttttaactgaattttatgtatttgtgttatatgcagatcatttattttctttaaaaattgatttggagacaaattcatctttagataacatagttttaaaagttgctcatttcagccgccttttttttctcctaattagttggtgacaaagttcctgctgatataaggttaacttccatcaaatctaccacactaagagttgaccagtcaattctcacaggtaaatatgatatattaagtcattgaatttctgaagaccttcgcatattccatgccaatagagttggctcttgcctcactgtccctttatggtatcccatcttaatcctctctaagatacttatttcttagtgctttagtctcgctccattgcccaggctggagtgcagtggcgtgattgcggctcactgcagcctccgcctctcaggttcaggcagttctcctgtctcagcctcccaagtagctgggactacaggctcctgccaccatgcccagctaatttttgtatttttattagagatggggttttaccttgttggtcaggctggtcttgaactcctgacctcaggtaatccacctgcctcggcctcccaaagtgctgggattacaggcgtgaaccactgcacctggctgccgatacggttttaaaggcatgatttaaaaacaaaacaaaatggctgggcacggtggctcatgcatgtaattccaacactttgggagactgaggcgggcagatggcttgagcccaggagttaaagacgggcctgggcaacatggcaaaaccccgtatctacaaaaaatacaaaaattagccaggcctgtaatcccagctactcaggaggctgggtgaaaagatcacttgtgcctaggtcaaggctacagtgagccatgcttgtgcctctgcactccagcctgggggacagagcaagactctgtctccaaaaaaaagttgtaatttgttcgttaccataggtaaatcttaaggttgaattgttgtctgttttgtggaaagcaaattacttattcgatgtcctttttccaggcaagaaaaatagactccagtgctgtaatttttttcactggaggagtgctaatgttgtatcaatctttacagtatccaaatacacaatgaacaaaagttagcccccataagagatgaaaattgtactacctggaatttgcacaattgtttgaaacattttcccgtttttgtgtgataaaagcacaatctagggtggagggttcatactaactggaagtaagtttgtcagaagaattaactttaaatacaatgctaacttggattaaatagtaaacataaagtctaaaggctctcaagatttatctgattatcaattttgaaaagcagctaatgtcatggagacagttatatgagtaacctggctctattttttttggtattgtttctttataaatagcttacttattaaaattctcattagcaacaacaagctggaggccaattaagccataaaatgttggagaaatggttgggttatatgtgtgaaattctcatagtgtgccctaaagacgtagttgccatttaaaaaaaatttttttttttttgaggcggagtctcgctctgttgcccaggctatagtgtagtgctgtgatctcagctcactgcaacctctgcctcctggattcaagctgttctcctgcctcagccacctgagtgtctgggattataggcgtgcgccaccatgcccagcttatttttgtatttttagtagagacggggtttcactgtgttggtcaggctggtctcgaactcctgatctcatgatccgcctgccttggcctcccaaagtgctgggattacaggcatttaaaaactttttaggctggtcacggtggctcatgcctgtaatttcaggactttgggaggctgcggcagtaggatcacttgtggccaagagtttgagagagcagttatagtctctataatgaaaatctttttttttttttttttaaagacagagttgcactctgtggcccagtggcgcgatctcagctcagtgcagcctctgcttccggggttcaagtaattctcatgcctcagcctccctagtagctgaaattacaggcatgcaccaccacacctggctaattgtatttttagtagagatagggttttgccatgttgtccaggctggtcttgacctcctgacctgaagtgatcgcccgcctcaaacccccaaagtgctgggattacagacataagtcatcacacccagcctataataaaaaactttaaaagtttaaaaaaaaatttaaacttcatagaggttctcgaatattatctttctttcattaagaaatcataatgtagtttttggctaacttgtggaaccaatttttttggtcaaatattgagagtgaagtttgctacctgtaacttaaagtaacatttagagacatattttactcagattgaccctaattatatatctatgacatgatttttaaattgaaatcagctgggcatggtgtctcatgcctgtaatcccagcactttgggaggccgaggtggggggatcacctcaggtcaggagtttgagaccagccttggccaacatagcaaaacctgtctctactaaaaatacaaaaattagctgggcatggtggcacatgcctgtaatcccagctacttgggaggctgaggctggaaaattgcccgggaggcagaggtttcagtaagccaagattgtgccactggactccagcctgggcaacaaagcaagactccgtctcaaaaaaaaaaaaaaagtagttctttatttaccatgcgatctttccagtacacttgctaattgctactccagagcatagccagatgtggcccacacctgtaattccagcactttgaggaggacaagatgagcaaattgtttgagtccacgagttggagaccaccctgggcaacatggtaaaacctcatctctacaaaaaaataccaaaaaaattaacccggcgtggtattgggtgcctgtaatcccagctattcaggaagccaagttgggaagattgcttgagcccaggaagttgaggctgtagtgagttgtgatggtgccattgcaccagcccgggtgatagagcaagacctctgtctcgaaaaaaaaaaaaagtatcagtatatatgttaaagtatttattaaagtatacaacaaatatatgtaaataatacagtcacagtatcagagtataaaatgattactgaaaaataaattaatttgaatagttactccagaaaataatcaatggggattctacttgaaaattcacttttttattttggaattgtgttgatttttatcctgacaccctttgttctggtattaatttccattactaagttttcccagcttacctcctttgaatgaattgggccttttgccaaccttttctcacactaacagtatcccaagagtggtaatgggtgggcatgaatgagaggttctaggttcttggtgtgggtcgcagagatctgttttttctgtctcacaacccgcttaggtgaatctgtctctgtcatcaagcacactgatcccgtccctgacccacgagctgtcaaccaagataaaaagaacatgctgttttctgtaagtactttatgaaatgtgtttttatttacagacatttccaaagcctaatcaaatgttatgtttttcactgccaaccatcactggctatcattctaaaggataatcacacttttcatggtcagtcttaggtgtcagaatatggcagtaacataacgtgtgacttagatgtcttttaattggcaagttttgggggaccaaaaaataatgactagcttatacatcttcaaactcttacctgcaaacatagttgaaaagtagatttgtttggaaaagccttagccaataaagggtattttcaaaatgatgtagatgacagctgctatttgtatgtggttcacaataaaaaggtgcgtgtttagagagagagagaaagcaaacatggcaaaccattaataatggtgagtctaggtgcaaagtatatgaatgttcattttactatttcactttttctattgatgtgaaaaattctttgaatagtgaggaaatgattttaagttggggacatttgtgggtttgtatgagaacctgactactacccatagtaagtaaatagaggtaccctgaaaatagtgaagccatgtccttctcttataacactaggaattaaagtggcatgggagagactgctcacatttgatttctttggtttttggaccctgtcacatgagtaggggttgtcaagatagcccatggggctagttgccgtttctattacagtgagaaaagtaggggccttgagttgttggagccagaagtggagaatgcttagagttgaactatatgagtttgaaaaattgggaacacagaggggttaagagcactgcttgaagatggtctgcaagccgggctcaaatagaaatctaggtgggtcagtacagagctgcctgacataagtaagtagcacatggagcattgcttgttgtcacagttgtatggctggttgcttgaacagtagccagtggaagacctagtagaatgtgtagagaatctgggtgccctagtcaaaaaccagcgtcggtatttaagttgggatgtggtattcatcttgtgaccagttctctacttctgtcctagggtacaaacattgctgctgggaaagctatgggagtggtggtagcaactggagttaacaccgaaattggcaagatccgggatgaaatggtggcaacagaacaggagagaacaccccttcagcaaaaactagatgaatttggggaacagctttccaaagtcatctcccttatttgcattgcagtctggatcataaatattgggcacttcaatgacccggttcatggagggtcctggatcagaggtgctatttactactttaaaattgcagtggccctggctgtagcagccattcctgaaggtctgcctgcagtcatcaccacctgcctggctcttggaactcgcagaatggcaaagaaaaatgccattgttcgaagcctcccgtctgtggaaacccttggttgtacttctgttatctgctcagacaagactggtacacttacaacaaaccagatgtcagtctgcagggtaagaggagtaatttagaatattccgtgtcgtggttctttgttcatcctaccaatatgccttcatgccatcaaaacttttgatttgtaatttcatacatttctgtgggctgtatgtatagcctgagcttaatttctaatatttgagaggatctaatcatttaattcctaaaactttcacaaaatacaggatatctgtatggctgatatacttgtattagatgtaagagaattagagaaattatattttcctttaattaaaaaaaaaaaaagcctgggcgcagtggctcacgcctgtaatcccagcactttgagaggccgaggcgggtggatcacctgaggtccgaagtttgagaccaacctgaccaaaatggtgaaaccctgtctctaccgaaaagacaaaaattagctgagtggtggcgtgcacctgtagtcccagctactcgagaggctgagacaggagaattgcttgaacctgggcagcggaggttgcagtgagccaagatcacaccactgctctcaattctgggcgacaagcaagactccatctcaaagaaaagaaaagaaaaaagacaaggtctcattctgttgcccaggctagtgtgcagtgacacagctgtggctcacttacagcctcaacctcccaggctcaagtcctcccaccccagcctcacaagtagctgcaaccacaagtgcatgccaccatgccccactagtttttttatttttttttgtagaggcaggttctcactatgtcaccaggctggtcttgaattcctgggctcaagtgatcctcctgccttggcctcccaaagagctgggattataagcatgaaccaccacactcagcctcctttctaattttcctgatcctctgtctctaggtgtatgttaatagacaagttctagagaaagctgctagttaacctccctacctgaagtcctaattggtttttctatcacatgttgaatgaagcgtgctttttctcaaaaagtagatagtcatctctctgtattcattagagattggttccaggacctccctcagataccaaactctgcagatgctcaagtctctgaaatgaaatggttcagtacttgcatataaccttgttcatcctccagtatacttgaaaacatctccagattacttacagtacctaacgtaatattataaatgatatgtaaatagttaaactgtgttgtttagggatagttaacctgtgttgtttagggaataatgacaagaaaaaaatgtacatgttcagtacagatgcagttattttttccatctgctgtttagttgaccgtggatgtggaacccacaggtacagagggctgactaaaattgcttttaacttgctttattctgtgtattcatcatatatatttttgtttgtttgtttgttcttgttttgagatggagtttcactcttgttgcccaggctgtagtgcaatggcccgatctcagctcactacaacctccgccttctgggttcaagcaattctcctgcttcagcctcccaagtagctgggattacaggcatgcgcccccacgcccggctaattttttgtatttttagtagagatagggtttctccatgttggtcaggctggtctcgaactcgcgacctcaagtgatccacccgcttttgaaagcctcccaaagtgctgggattataggcgtgagcccccgcgcccggccatcctatattttttgaccatcatttgataaaataaataatttaaacctgctgttagaaaagtaacaactgaataaataatgcaataattatacagctggattattttgtataattcactttccttaggttttgcttaaacaacttggtacaagtctattccaaaaggtacacatgactcatacagagtagacatttgtcacatattttattcggctcattaattagcaagggaatctgtatttgaggaagtgttcaatattagaatattagaatagggattgctaggttagattacaaaactaatgtcttacagggaaacctcatataacatgagcatttatttagtaacacagtgttacattttcctagaatgggcttgttaaataatgcttctgtatgatattgaaagggtgtagttatcttggcctttttgtcaggttttagataattatttttaacatcggaaattgttttataatcagttaagccctgtgaatttttatcttgccaattttaagctcatgatgattttttagatacaggttctccctcccccgcaagctccttgtgaagtccaaacccacatttagaattgacagaactggggtgttccaactttcaaagtggaaagcttctaggtttgtcttaggtttctccaggatattaaggtgtttgagctacttaagttcttattttttggaaccaaaaggttggatgaattggctaaaagtcagttttgtcatactggttgtttcaggaagagaaagggaattttcttatttacgattttgtgtctcacttagcctgaaagctttaattcctcagaatagtctttatgtctgtgaaagtaagccatgtgtaaagccatgtgtaaaattgtaatttttaaaatttcagtttcccagttcactataatttttttttgttcttttctcccttgaatggcttggcttaaaatgttttcttataataaagaaaaagcctgcctgttctgagtgaagctctacctcacaacaggaagctggtgctaattggtattctgcaggaggcttcttgcagtggtattgcataactgcccttgacttaggaagattttcatcctgcatatcctaaatggttgacttgctcacagtcaaaaatgtctaagtacatttagatttagctaatgtagattcagattctgaatgtcttttagaatattttgggctttggtatagactcaaagaatttcacatttttggctgggcacagtggttcacgcctgttatttcagcactttgggaggccgaggcgggcggatcacctgaggtcaggagttcgagaccagcctgactaacatggtgaaacctcgtctctactaatattacaaaaattagctgggcatgttggcaggcgcctataatttctttgggaggctgaggcaggagaatcacttgaacccgggaggcggaggttgcagtgagccgagtcgtgccattgcagtccacccagcctaggcgacagagtgaaactccacctcaaaaaaaaaaaaaagttattttaaaataaagattaactaatttccttattgaatgtgagatgaattgctctgaaaagatgtgtttttaaaacacaacatagctttgttgttgctgttattacggagttttgctctgtcgcccaggctagagtgcagtggcgcaatctcagcccactgcaacctctgcctcccgggttcaagcacttctctccctcaacctcctgagtagctgggattacaggtgcccaccaccacgcccggctaatttgttatatttttagtagagacgggtttcaccatctttgccaggctgatcttgagctcctgtcctcatgatctactcaccttggcctctcagtgctgggattataggcgtgagccaccgtgcccagctcaacgtggcctgtttaacttgagttttacattttttaaattccccttagagaatgatttgatcagattattaattgctcatatttcagagaaagcacgagaaaatatagttttgacatcactttctgtaattttttctttttagaggaggttttacaagttttcatttgcaatgaaaacacaagcctaaatcttacttttccaaactgggcttctgaattataatttgtgaatgcaaatcaagcagtggaaaaattatctttaagaaaatagcttatgtcgctttaaaaaataaaattaatcctttcctaagcatgcttccatctgtattgtctagggaacatcaattcattcagctctgcgggctccttactgtatacatatagttatgcagcttcatagaacatgagctattgccacaataaaaataagtgggaaggagcagagaagcagtttgtcttattttactcgggaaatgtttatgcaactctgaaatgtgagtttattcttcccaagcttttgtgcttagctctaaggcaggactacctaataccactctcacagccagccatttgaaatttgggattctgagcaatctaaagagtaacttgtctctggaactgaccttttgctgaccgggagtcctcataacttggattttgtgtgggttgttgtgtctttggtgccactgctgctcattcattcagcacctcagtgatgctgtttttcatactgttcgattggtcgggggtgtgatgggcgaagcagtctaatataattaagctagttagggtaagggacagtactgctgatgctgagtgagcctcagtgagttttattaaagttgttttcgtaaatgaaagaggttgtttgcctttgtcctaagctaacaaaggtagtttatttgtgtagcattttttaaaaatcccttttaaatactctgatgcgctctccccctacagatgttcattctggacagagtggaaggtgatacttgttcccttaatgagtttaccataactggatcaacttatgcacctattggagaagtgtgagtaaccctcctcctcatttaaaggatctggtgtggcagtttagtatttgtattgatttgcagcatgtctacaaagttaagacagctttctgaatgtggctcaagtcaacacttattactaaagtagtaaatgtttttaaaacaaaaactttgaaagatgaaccaaaggttataatccagtcatctttttgcatcttctgggctccaaactttcaagagggatttgtgtttgttattcactgtagccagtggtggaagaattgaattaagaatttctggtctttttactgattgatttctgataccagagatgcattctctcttttgtttttgtctaatattggctctggcatcaaattgtttggaattttttccagtatgttgtcccagaaattctgttttcattattaaacaattgcgggggggcagggggcgggaggaatcaatagtggcgaccataccctgctctaagagtgttttctctttgggcaggcataaagatgataaaccagtgaattgtcaccagtatgatggtctggtagaattagcaacaatttgtgctctttgtaatgactctgctttggattacaatgaggtaagtctcttcataaattagaaggaatggctgttcctagttcaagggtggggtgggtggaatgaaagtctagcctgccttcctcccttttgaaagtcaagggtgcctgattttgtttcccccttccattcagaacctgatggtggggccagcatgacctcaccaaagaaagctgagagcctttcacatatcctctgtgactgagcattgcagttagttaacttaaagttgtagtatatgtgatgttctttctgttgatagcatacttactataaatgaataaaacccaggatagaaaatgctttcctgaaagcaaaggatatagtttctgtctcaaaggtaagctagtccctgtcagagacagaatgtgaactcttcagaatgataagcagtgacatggaattacattattatgtgaaggcactctttgaattaatagtgtgatcagtggcttcttatatttgggtgaaataataaatactgtgtttgatgtcatcttatatttaagggaaatgaaaaacctacttattagaataagatcacatgcacacctgtactttgagtatgtttttaattatctgggtcacctgtttcagaggaggataaaaatggccttacagtgttgtaatagaggacagattgtgcttttgtggaaaaaaaatattaaagataaatttatctgtgtacttctcccttttttctactttctgtgcctttaaccaatacaggcaaagggtgtgtatgaaaaagttggagaagctacagagactgctctcacttgcctagtagagaagatgaatgtatttgataccgaattgaagggtctttctaaaatagaacgtgcaaatgcctgcaactcagtgagtatttgaacctggtttattgttcatgctgcttatcagtcgtactatatatacttagtgtctgcactgtcctactctcttagaaaactaattataccttatctcctcaaacttacagtatttccttccccatattcactctcaggtaagatgctcttcctgtgtatttgaccaggaaaataaaagcaatcaatagctaatttccttgagcgaccctctgggcccacaggggctgccttctcccatagtgctgtgaacagtgttcttgctcctagcagaagccacctcctcccaacatctttgctgcattattgatttccatctctactagatgttcttcagcatagggggaaataatagtgtctttctatcttgaaactttcctttgaccttatttcccctgtcagctaccacactttcttttcctgttcaattaaaccttttttttttttttttttttgagacagagtttctctctgtcaccagattggagtgccatggcgcgatcttggctcactgcaacctccacctcccaggttcaagcgattctcctgccttagcctccctagtagctgggattacaggcacacgccaccacgcctggctaattttttgtatttttcgtagaaaggggtttcaccatgctagccaggctggtctcgaactcctgacctcaggtgatccgcccacctcggcctcccaaagtgctgggattacaggcatgagccaccgcgcctgggcatcaaacatttcttaactcatttgatgagaccagcataaccaaataccaaaggtcaatgtggtgatggtggtggcagtggcagtggcagtggcagagggcacccacattgttcatgtatacactgaacaaataagtggcctctgagcctttttctgcctgtcagagtctttgagacagggctcattcgaccagcatcactatgacaagggccagtagcaaggatggggagtctccacagtgagttggacctgagtgaggttcctctcaaagagctgctgctccctcctgccaagaccaccatactggacctgtcctgcagtactgcccttagatttctgtggcctcacaagcccggggagcctagacctcagtagaaacactttgcaacggctgctggtgaagaatggccatccattgagtctctagcacctgggtctcctcaaaagactggtccccctgcctgtcacttggctcagcttaagaacttgaagtggaccaggcgcagtggctcacacctgtaatcccaacactttgggaagctgaggcgggagagtcacttgaggcctagagtttaggttgcagcatcactgcacttgagcctgggcaacagagtcagaccccatctcaaaaaaaaattaaggcctgaagtggctaaacttgaaggataactccctttatcttatcctggccaaagtggtagatgattgcttggatgagaagtgatatgcagataagatgttgcaatacacaaagtctgtgtgggtcagtcggtcacgtgggtgccaaggacaggtgggagagaagaagcaagctacagaagcagctcaagaatgggaactgcggaagctgattgtattggaggaaggagtgtgatgctctcagagcagccagggaggagcagaaggagcttagggacgtaagtcaggctctcaaagtctatgtctggttcctgcccccacaaaccaccacccaggaaacatcattcctgagctgtgtggcagcagcagcagctgctccttttatatggcagacagggtgattgcttgttgggcaagagccctcctacactatcttagagtgaataccctctatctgcagtccagggtctgcacagccacatggtcctctaataggtccaccagaccatttgcctgcaaacagcctcatcctcagtgcccactgtctcctagctgtggagcttggattcctatggaattgggttctgctgaacatacctctttttagcatcagacctacctgtctgtcatcaccatggggctgccagtcagtacttttgcagcctctttataggacattgttgtaacttagggttccctggtagaataaggagcgatgggaaggggagaggttctgcctgcctgaaggaacaggtctgggggaggagagaggtaaaactcagccttttctagttgtcatacacagctgtataaaggcaagcctcatttagcaaaatgattagttgtcaccacgtttaatgctttttgtatgtcataagccctttcatcccttcctggataataagggcaaatgaggaggcattgtgtcattggggggtagtacagcctgagttgggagggagcagtatacctgttttcttaataacctcaaatatcaggcattttagtgaccacacaaaatctcagggtgaaaagttctagaccatcatgtccagcctgcagttagggacacctagcccttccatgacctgtatggcgtggtcttccggttagtgtgaggcagcattttgtctcctttatactgtcctgagaaaacaaaactcacactggaattgagactgtctcagctgaaatatagattccttttcagtaaactgatgcacaattcacaaatagcagtctcaaagccatgaaggccttggaccactcctttggcttcttccctctacccatgtgtcttccatgaacccgaagcagtccaggcttattcactctgccagtaagcaaggagttggatcctggcagagccacgctgcctgtgatctattagttggtgtaactaaaaatctgaggcagcctgaaaacagcttcacagattgagggtttgagtcgtttgattctagacctctgactactccactgagtgatgggaaacaagtcatgtaatggggctgaaccagcactggctcactagccagtgaccacacaagtacgggcaatactgtcatccttgtgtctccctgctccagagctcccttgtcccatctttttcacatcccttggccaagggatcggaaacagctgtcatgctgctcattcactaaggagttccaaacacaagctctttgcctcccttcccacttgagacagcaggaacccatgtgtagtttagaagcagagagagcaggtccagcattttggccccatggcttgtttggtgaggtctgtggttcttggccagcctagtactgaaagggatttccctcccccactcccagcccaagacctcttacctgggtaggtccacgccttcctcagaatcattgcgtgttcctttagtcatcccagtgccattggcgcaaatgcttaattgaaactaaacacacgtgtgattgagatgatacagaatctagcgtagcactcatacccattcctttgctgcctgagacggttcagtggctggcaggccagcaggatcgctgcagggccctgagccccatctagtcagttcatcagccttcagtcctcccgtagcttcctaggttagatgctgatgttcttggggatttctatgatgatttttaaatgtgtgtcagtgggagcaaatataattaactcaccacattaaccaaattaaggtggaaaaaacaataaggtcacctcagtaggtgcatatgatgaaacgcatcttatcacaccaaactaagactataaaagtgtgtctttaacgctgacagtgtgtttacacagagaccatgctaacataacagaattctcaccatttctatgcagtattatactggcattcctggtctgtgtaataggcaagaaaagtacaaaaactggaagagaaggggtatctttagttgtaggtaacgatataaagccaaaggtttattctcagtcttcgtcttcctattttgttggtgctgtcactcgctccctctttgaagcacctcttcacttggcttccacgatcccatacttgctctccctccctggcctctcattcgaggtctttgtagctgggtctttcacaaggcaccaggaggtgaaggctccatagtcctcagccatttctgtctatagttactcccatgatctcttctggtctcattactataatcagtagccactagctatctaaaactacttagaatacctaaaaacacttccttagatgccctagccatattcacttaaagtgcttatccatcacgtgtgacagccacatgaacagtggccacagagcattgccatctttcacagagttctggtggacagctctgcttggggccatctcttcacctccaacgttccctagtttaagtcagtgtcattatactgaatggtattccttgtctcccttcagccaatgcttttgttttttgagatggagtttgctctttcgtccagggtggagtgaagtggcgcaatctcatctcactggaatctctgcccccctggctttaagcagttctcctgcctcggcctcctgagtagctgggattacaggtgcctgccaccacacctagctaatttttgtagacagggtttcaccatgttggccaggctggtcatgaactgctgacctcaggtgatccactgcacccgaccaccttcagccaattcttgacaactggagcttgagaccctccgttgtcttctgttttacttgtcttaaaagccaaatgccccataatgacttttgaggtcttaatgacctgcttctaccatcctctgccattacctgcctcaccttttgctcatgtaaactctattccagccacgttggcactcctttaccattccaggacttgccaggttgcacttccgttctctgcctggtgggtcttcaccaccacccactgggttcacacacatcttttcaggccccatggggccatctttattcaaatgtcaccgccttctggccactttatgtaacagttcatatgtatgtatgcaaattttctatcccccttccctttttctctatagcacttgtgttacttttgcatcttagtctgtctctcccaaaataggggacaagtttcatgagggcaaaaacctgtctgttttgtttattgctatattcctagcatctgtcatgtaataggtgtgcttactgcttgttaggtaaaaaagttcagaaattgccacccagtagtatccatatttgttccctttgtaggtcattaaacagctgatgaaaaaggaattcactctagagttttcacgtgacagaaagtcaatgtcggtttactgtacaccaaataaaccaagcaggacatcaatgagcaagatgtttgtgaaggcaagtatggcagattgcaattgagatgttcttgccagggttaagatcccggtgaaccaataaaacaaaattgtttatctaaatctgtaacatttccagggtgctcctgaaggtgtcattgacaggtgcacccacattcgagttggaagtactaaggttcctatgacctctggagtcaaacagaagatcatgtctgtcattcgagagtggggtagtggcagcgacacactgcgatgcctggccctggccactcatgacaacccactgagaagagaagaaatgcaccttgaggactctgccaactttattaaatatgaggttagctaatgaaaagtttctttgtccacaccctgcacgattcattgtgtttaaacagtactccttcaagcaaaaggtcaaacagttctcacttttgccaagaaagaggtgtggttatttgtttttctgcctgccagctgtgtcacccttaaaatttgctgcttcaaacatacatagttaataatttcataaaagtgttattttcaaagtagaatattttcaaagtagaataatcaagatgagcttaagcttgtaaaccccattttgcctctcatctaaatcatgattttttttaaattggtgacatttctagaatattcattagttactgaaggtcaaaagatccaagttggagattacttccacttttctactcagagtagaattcttttatatcaaggatgtgacatcctaaagctatgaacaaaatgaagaagctttggtactgtgggctcagaatagcacaagagttaaagaatggtttgataacgggtgtagtggtatttttttttctcataagaaaatgcaaaaaccgccaggcacggtggctcaaatgcctgtaatctcagcactttgggaggccgaggctggcagatcacctggggttgggggtttgagaccagcctgaccaacatggagaaaccacatctctactaaaaatacaaaattagccaggtgtggtggcgcatacctgtagtcccagctaccctggaggctgaggcagaagagtctcttgaacctgggaggcggaggtcgcagtgagctgagattgcgccatggcactccagcctgggcaacaagagcgaaactccgcctcaaaaaaaaaaaaagaaaaaaaatgcagaaacctgtctcaatgtttaactgggcatttttcaaactaggggacaaaaactagaacttgccacttttatttaaagtgatgctcttattttagaccaatctgaccttcgttggctgcgtgggcatgctggatcctccgagaatcgaggtggcctcctccgtgaagctgtgccggcaagcaggcatccgggtcatcatgatcactggggacaacaagggcactgctgtggccatctgtcgccgcatcggcatcttcgggcaggatgaggacgtgacgtcaaaagctttcacaggccgggagtttgatgaactcaacccctccgcccagcgagacgcctgcctgaacgcccgctgttttgctcgagttgaaccctcccacaagtctaaaatcgtagaatttcttcagtcttttgatgagattacagctatggtgagcatgtttgaacatgtacaggtgactcaggctacacaagcacatagtagcctctaattttgaccactgaatttttttgtcatagctccctaatttggaatttgtcatgatttgggtcttttctctagaattcggtgaatcagtggttagcatgttgtgtgctacttgcagggaagatcctagagtcgtttaaaacccagaagggccttccagatcagtcccagaggaacaatctggtgatctagtctcttttttaaatgagacgtgtttttattgtaagttttctgaaaattgaggatgtaatcagtcagttgtttggatcaccctgcttttaagttctttaagagctggctattgatgaagcatttccagtattcttcccctcacctgattttcacccagatacattatgttaaatttactttcttctcttttaaaaaaaaatcttagttttgaaacatactataagtgtactctcctctcccccagaggtaactgaagttggaatttagcaaaaatattaaaaacatgggagtgctgtttttgtgtctgtagacagtattatttttgcatgcttttgaaggcatattttttggccgagtgcagtggctcatgcctgtaaccccaacacttgggaggccgaggcaggtgaatcacttggggtcaggagttcaagaccagcctggccaacatggtgaaaccccgtctgtactaaaaatacaaaaaattgctgggtgtggtggtgggcgcctgtaatcccagctactcgggagattgaggcaggagaatcgcttgaacccaggaggcgtgcagtgagccgagactgcgccactgcactacagcctgggcgacagagcgggactccatctcagaaaaataaaaatttgcatatttttgcaatctgcatctttctacttgaaatttatccatgtggatacaagtgcttcctcttgactgccacataggttgtgtttttgtttttagtaagataatacagataaatttgaagtcccctttgtcccacttcggtaaacttatttggtaattttacatttcctaggtaaaatgtgttttgtgacaccaacttatgaaacaaaaattctaaaactctttgccaagagacctacggctctattcattttcctcctgcttcccattcagtgggcttttgcctaggggtatgaatgtggcatgccagttggctgacccaaccattgctttccctttcagactggcgatggcgtgaacgatgctcctgctctgaagaaagccgagattggcattgctatgggctctggcactgcggtggctaaaaccgcctctgagatggtcctggcggatgacaacttctccaccattgtggctgccgttgaggaggggcgggcaatctacaacaacatgaaacagttcatccgctacctcatctcgtccaacgtcggggaagttgtctggtaggtctctgtgacagcatcacttactgtacgcctttatctaaatgggtcatggagcccagttctcgcagtttgctctccagattgcagcagctttggtctttgtgcctgagttggaagaggggagtgggcaagacagaaatgccttatggaagcagtggtgctttggccctcgggagggttgtctgcagctgccccaatgtgcaaagaatcctctttaacgtgagactgagctaacattaaccaggtagtcacatgaaattcttgccctccaaaagttggctttatctcagtcagcttaataatttttttatttttatttatttttttgagacagtctcgctgtcgcccaggcttcgggcagtggcacgatctcagctcactgtcccctccacctcctgggttcaagcctcccgaacagctgggattacaggcatgcgccaccactccctgccatttttttgtgttttagtagaaatgaggtttcaccatgttgcccaggctggtctcttaactgctgagctcagccagtctgcccaccttggcttcccaaagtgctgggattacaggcataagccaccgcacctggcctcagtcatctgaatttaagtaataaactaagtaaaattgagctttaattcaaaattgggtataagtattttacagattacctgaagttgttgtcatttatttttctggaggagggcgggttgatgatgctctttaaatagtggccagaagtcatttgggctctctttgtcttcttttcttgattggaaacagtattttcctgacagcagcccttggatttcccgaggctttgattcctgttcagctgctctgggtcaatctggtgacagatggcctgcctgccactgcactggggttcaaccctcctgatctggacatcatgaataaacctccccggaacccaaaggaaccattgatcagcgggtggctctttttccgttacttggctattggctgtgagtacaatttttttatattactgatttttaaacaaaatgtttgtgagctgaaattttgtaaattcatcccttaaaagcgtgttttttcttctatccccgtatagggtagcaaaagacagagatgccctcttacagttcgatgaactatacatccaatttaccagagtcctttcacagttagttccagttttagcatcctgcccttacttgggcttttctgaatgagcaattaaacatcagggttttcagattgagccctctgtgcaaagggataagaatgattcacgctaggttctgccttccaagagttcataggtgggatttaaatagataattgtcaccaagttataaaatttagtccctgtttccataagagaagggttgcgcagtggctggtcccttttatatataaatcatctctttagccctcatcttcctcaccccgggttcttccccatttcatagattgggaaagtgaggtgaaatcacttccctgggatcccataggaaggcattgtgttttcataatatattcacatgacttcaaattcaaaaagcacacaatggcatagaatggaaagggtttgggccagtcacttccctctggcgttgaggtgctcatgtaccctgtgcccttccggagagattccagcatgctgtgcacacctgcatgttgacccttgtcttgccttcttcctgcttgtcagatccttccatatccggacatgcgtagtgcctcatccttgcagccagcggccttcatgctccactgtaattcgtgggttagtgggtatatgcacttgttgtttttgatgctaccacatggggatatttgcctcgtctgaactctgtgtattctctgctgcaccttgttgcttctttgcaataaacttcctgaactcaaagctaatactggggggaatcccagaagctgctgagggcagggccatgctgctcagtgttccaccctagctcctgacagcatttccctagaaaactgctgctgggcctctaatggagcaaataaatctgtgtacaactaggcagcaatagtttgtccaaaagtcctggtgtaatctagtccctcaaactgtgcagccttacatggagtacacacacacttgcagccttgaagtactacccactgaggggagaaggcacggcaaggggaaaggttggcacaggatggagcaagtgctttttctcacacattctggaggaaaagttatccagttcttctgttctagaaacacccctgtccttcagaaaccagggtctagttgctctggctaccaggcgtgagcaggtggtggtagcaccacaggccccggttaccatcactgtcccatgtctttgatcttcgtccttgtggggactggcctgcatggcctcggtggcagcgagccctgcagaggcaagtgcatcagcatcactgtgtttgttcccaggttacgtcggcgctgctaccgtgggtgctgctgcatggtggttcattgctgctgacggtggtccaagagtgtccttctaccagctggtactcagtcacctttctttctgtaccttacatgagaagtgttgtgaggccttgacctttctgtggtttcggtatctatcaaatcatcttaagactcagacaataaacagttacatctaagatgattctgaaggaccagggcttctccgagaaattggggtaaacctcttggctggctctgcattcaggctggtctgtgctaggcttggtatggggttggagcctggacttgggaaatatactgggctgataggaatttgattggattttcttgcagagtcatttcctacagtgtaaagaggacaacccggactttgaaggcgtggattgtgcaatctttgaatccccatacccgatgacaatggcgctctctgttctagtaactatagaaatgtgtaacgccctcaacaggttagtgcaccttcacggcaggctgaggcgagcatggtgactgccagggcaccggggaattgtgtgtagtcacggttgattgaggatcacaggacagttcttcccttcccaaaagaaaggagaacaggcaataccagttttaaaagcatgagctgtcgtcacctccaggaagtagtgggagtgcttagccctgtgtttcttaggagctcttccttaaaagaaaccgtgggggccaaaaataggaactttggtacccctgtatgccagcacccacagggaaggaacctcaccctttcacacagacaaatggtaccatccagttaagcccgtgacaaaaatggaaatttctaaatagcccaagtctccagggcaattgggaacagctttgaacccactaagatggggtctgctatgccaaaacatagatacagaattcacagtttgtcctgcattaggacattctcttcaactttgccactgtagaaagtggaggtaggtcagcggatggtgccacattaacagccgccttactgaagtgtagtccaacagggtcttactgccactgtgacacgtgccttgccttgggggtgcgtttccccacctctccttgctctgcagcttgtccgaaaaccagtccttgctgaggatgcccccctgggagaacatctggctcgtgggctccatctgcctgtccatgtcactccacttcctgatcctctatgtcgaacccttgccagtaagtggttgggtggggcttgggaccagccacctccttccaggggaggctggaggcgtgacacgtcttccctgtgtgtcagctcatcttccagatcacaccgctgaacgtgacccagtggctgatggtgctgaaaatctccttgcccgtgattctcatggatgagacgctcaagtttgtggcccgcaactacctggaacctggtaaagagtgtgtgcagcctgccaccaaatcctgctcgttctcggcatgcaccgatgggatttcctggccgtttgtgctgctcataatgcccctggtgatctgggtctatagcacagacactaactttagcgatatgttctggtcttgactgacagttttccataaagaagatgtttaacttaatcaattaatttttttattgtttaaagcaactgtctatttctgctgaattttcacatgaacatactggctggtgatggaggtttcatactctagattttgttttgctttttctgactccagtggggcaagattttccttttttatacacataattaaagtgtccattgacatgtacagagaactaacactattttatgcaaatatttttttgtagatgaaaaagcatgtacagtgttctgtttaatactcatccttgtataaaaaaaatagttgagccagcagacattgtcagcaaattaattggcagcagattttaggaaatgaatgtgtgtggttttttttctaaaactaaatagcatgtattgtgtcttttgcatgatgatccggatttaatttgatatcacagtctaatttttattcataagccaatttttctgcactgagcagagtcttgctacctcagtcagtattgttttggtttgctacttccctcacccactttggcctccgttcaccccaccccaccccacctctccccaccttacccccgccccgcttggcttcttctttaggattgtgatggttcgttctgtttacatcagttttaacgagaggtatgcctgtactcgcttgtgcagaaaacattgttccagattcaatcgactgggtttatgtcccttcacatagtttttaaggttatttatttaaatgtctaatgtattttattgtaacagacattgttttgccaacattgcctatttcagtggcacgtcatctagttttaaaaaaataaaacattttaaatggacagagaaaaataactgtcttgtctttaactcgtaagtggcttacctgggactaacagacatgtccaactttctctccagttcttagctcagaactttagttgtactctgcttgaggggaagaaggctcctgctctgctgtgtaggtagtcataggaattgtattcttaatgtacaggcactaattgtcatctgtgatgtacattttatgcaagtttctgctggcctggtatagagaacataagggcaagtgtgtatgtgtgtgtatgtgtgtgttttgtaaaatctgtaaatagcacatgaccaaatgaacatattgtatagaactatttttatttgaatgtggcactaaccaccaccaccgttactacgatcaatgtttgcgcatgttcgagatgagtctcaccaacagtgtgtaagtcattaacagtcctaactgtggtgttttcctccaatgccttccaacatccatcaactaacgtgagtattttcttcctgggatttggatgctttagcctaaaggtgactgccaccaagtgagataactgtatgtcactaacttataagccgcctccatggcagatgctgctgtgctccctgatgccctgtgagcaccggggttgcctgtggcgcctgccatgtgactcgggcgcagcatcagctggctggaggtgtggctttcatagacctccacaggctgcctaggacaagatgaccaggagggcccaagccagacaaaagccggagtggggagagaggcatttcagccagaccaacaggctgaaggagctgtgcagactattgctaaaatgagggttcgcagctgccaggagtcatcccagaacattgctacttatttattaaaaagctaaaaactagtgaaagcaagtaactgaaccagtgaactctgggtatcgataggttcgtcttaaataggccacttccccactcccccacccccccttgcttggtcttgtccttggtggctaagacttagctctgcaggggatgttaaagcacagttagtaggacgtggctctgcacagcccaaaaaccagcttactccttagccagggtgtgaggcctcgactatattcttcaaaatgtacttaggctctggttactgggatggccagtagatgtaatgcagatggttggagtttggggagggttaggaggcatcaagcaggacaaggtgctgctgagttcagagggcccacgttcaagggatggaggtggaacctggagaccgactcttaaaagcacagtccgtggttgggtgtggtggctcatgcctgtaagtaagtctcagccctttggaggccacagcagaaggattgcttgagcccaggtactcaaaccagcctgggcaacagagtgaggccctgtcaaaaaaaaatcagccttactgtgaagcctccaaggctgctcgcaggcagctgtggctctcgggaagggaggctgctttgcccagcagggaacatttggggcagggggtaaattttgccagtttgagcatcatgaggtgtaacaagaaatgggttgaatgggccaaatgcaaggagtgcatctctgggctgcaaactgacttgagtgctgcactattgctattccgtgcaaacaaaactcagcttttcctgactcagttccttgacttagtggcctttacaaaaaaagttgagtagtgtgtggcctgctgtcgcacagcccctagttagcttcatggtttctcagcttcagacccctccagcccacagaggagcccatggagggacccacttcccttggtccagacagctgggagtgggttaggcccactgctgttttgagcagggccacttgctccatttcactgaaggctttgctgggtgaaaacacttcagcatctcctcctcaggtcaacccataaagaccaggtccagcaccgtggtcttggcacatccctggcctcaggccctcacctaacagtgaggcagcagctgcccagccccgcaatgtgcctgctgtcaggcagctcttgcctgaaacttacttccacattctttcctgatgggcaggtggctgaaggcccagccatcagtgtcgcttgttgccaccccgtgcctcccttggcctctctgagctttgcccagaagaccaacaatcatacataccctaactgggacaccactctgcagaatgcagatgatccattctggaggaagctgtcccttgagctcagtgagctcccaggcaagcagggcatctggccgacttccctcacaacagctgctcccacatcccctcggactggagcttcagccctgactgaggtgggcagacctaagacctgagaccacaagattagctcagtgtctaccaagcatctagccactgtccagggccagagcataccacgtctgcagtgcctgtgagcagagccagcagttgccctgtgactgtaaccaccaaattgtccaaacacccgctgcagttagcaagaagggtaggcttcaccctcctttactgaggagaatgatgcggaggagtttcctctccagggctaggcaaggcaggcgagcagccagaagccgggtgcccacagggcagggacaggaaggctgtgctgctactggctgctcacttctccatcaacctcaccctctgcaccactaaccaagaccttgtcctcttgcctgtctcgctgctttcacagctgcaacgattgtgtctgcctcatggggttttcctccagagcctttattctgtagccagacgacacgaggagtctgtgtcactgagccagtgcttctagatgctaccctgtgtgggcggcacctcagggacagtaaatcagaaatgctggtcttgaaaccttgaaaagatcaagctgaatgttccttttcatctgtcgctgttgatcttcatctatttaaataggtattctaacgtttcctctctgtatttcatgaagctgatttcctctctctttccttttcagcaatactggagtaaccgcttcctaaaccattttgcagaaatgtaagggtgttcggttgcgtgcatgtgcgtttttagcaacacatctaccaaccctgtgcatgactgatgttggggaaaaagaaaagtaaaaaacttcccaactcactttgtgttatgtggaggaaatgtgtattaccaatggggttgttagcttttaaatcaaaatactgattacagatgtacaatttagcttaatcagaaagcctctccagagaagtttggtttctttgctgcaagaggaatgaggctctgtaaccttatctaagaacttggaagccgtcagccaagtcgccacatttctctgcaaaatgtcatagcttatataaatgtacagtattcaattgtaatgcatgccttcggttgtaagtagccagatccctctccagtgacattggaacatgctactttttaattggccctgtacagtttgcttatttataaattcattaaaaacactacaggtgttgaatggttaaaatgtaggcctccagttcattttcagttattttctgagtgtgcagacagctatttcgcactgtattaaatgtaacttatttaatgaaatcagaagcagtagacagatgttggtgcaatacaaatattgtgatgcatttatcttaataaaatgctaaatgtcaatttatcactgcgcatgtttgactttagactgtaaatagagatcagtttgtttctttctgtgctggtaacaatgagcgtcgcacagacatggtttcaggtaaataaatctattctatgat

SEQ ID NO: 37692 - DNA, 55959 bp, Homo sapiens
taggggaggtgcctcatccggagcgggccgccaacggtccggccccgtccgcacagacgctcctgtcggcggcgcccgggagcggctcggctgcccgatgcttccgccccggctgccgcgggccgggctgtacgcttagtgcccggctcaggccccctgaagcgcccgcgggggtgagagcggcctccggccccgcggagacggagcggcttgaggacgaggcggcggccgcggggaggaggatgggggctaaccagttagtggtgctcaacgtgtacgacatggtgagtgcggcccctggcggccccgagccctggcccaggccggcttcctctcgcccgtggggctcggaccccggccccaggcgcttcctgcctggcgtctccgcctccagcctagttctcgggggaagccgggggtgaaggagggagtattgttattttttaatcctcgcactcgtcgacgctccggtgaacccagtcagcccgagggttttggccaaagctcgggtgggcttgaacctctcccatccgctcagcttggacccgaccccggctctgggcccgaccccttggccgacgtgcagtgtcctttcggcaaagcttccgttgcgtttccaaccccacttgccggcccccggggctgccccgggacccccgtcccgaccgcctgcgctcccagctcctctgcttctgccgaactgtccgtctctctccatggctacgtcttcagaaactcccaagcccctctaagtccagaaggtcacagctttcgggtgcctgtgctagaatctcttcaaaggtgaacaggagccaacacaccctttccttgtgtgttaaaggcaacctcgttaaaatatgaatgaggctaacatttctcaagaaaatagcccagctgaattatttagagatcctggtggtgctcctttcctacactctgaagaccactttccaggtgatgcaacaggtgacgtgaccacgggagagggaagggaagaagttgtttattgtatcatctaactttggagtatggcaagcacgcagaatcgagtccaagaactggtttgcctgatttttgcagtgaaatgcccccagaaaaaagcacccggtagagaattgtcgttgcagttagatgcatgtttgggtgtgtttgcttgctttgttctgtagaatgggtttttgttctgtagactggattagtacctctgactgcagtgcttaaaattccttgtaagttgactgacaaatgaaaaattgcccgtcgttatttttgttggcttaaagatgcaggagagcagaaatactacaggccaagagtcttatacagttctaaactttgtattcccttgtattatttataagtttctaaatttacagtgttattatatcttgggtagagtgggatttctcatgccatatctgggaattgtgtcagaagggtgtaggaactgcctgccacttgagatgagtcctctgttgaattctgatgtgagcctggagatgaaaggagatgagttaacatgctgagaaaagtggaacaggacagaaaaagttgaagaggagaataagccaaacaaaagatcctagaaaaccatggcactttgtaagttctgtggcctgtgtcactggttgagaaataattctctggatttaaactttttgtgttcagctgaacacctttatctttcaagactcttaactgcccttttactttctctgtgcacatccccctaatctgaatttggtttgttttttattcatgagggctattactgtctttcagaatatattctgctcttgagatcacagtgtgccttttctcctagattattaaacaaacccgtatttaaattaggagtatacagtggccagaagccatggtttcagagcctaaaagaatttgtgagaatagaggaagagagttttaccttttatatgaaaacgaaaatgcatgttttggcatatagtgggcttctttacacttgaggcattctgtgatacaggaaaatctgcaaattgtggtcgattgggaaaagctagagatggtattcagtattttcgaagggaggactgttctgaacgatgttaaaatattgactaatgagcgagatcttattcttcacatcaagtttgtaaaataggtagttagagaagcagcagacaggggagagagtaagtgatctgcctaaacaactaaaaatacaatctagaatttgtagaccaaaatctgattcactatcttctctactaattcctgcacttatgtctttatattgcttttgcctgtgaacaggagatgaagcatatgaatgtttatcggaatgataaatagttgaattattagacttttaataaacttggtcttatatgttcttttgagggctttgagtgttttatgtcactaattcagcaacctaccattacttattatttttgacctggtagaagccacaaggatgagttaactgtcctttcttctttaaggaatttagagtattgtagaggagatacacaacagtggcaacaattcaagacagaatagcatggttttgataagagcagacaaggatgcaaaggaggagactatgtagttgtaggatcagggaatgctgaaaaatcaaaggtatgaaacttgaagaatgggtagcatccacaaggacagagaacaattgacgtgaacaaaatggcaggaatagggaaagcgcaggtgggatttgggaactatcagctggtccagtataactagagtagagcataaatgaaaggagacaaaactgaaagtttgattagaacttctttagtcagatgtgttgtgggcttgggtgaagggctgagggggctccttgagccagcagaaccatttaaggttttcatggaggggaacagtgtgatcagttgtttagattgagatacaaattttggtctgttatactaatttttctcaagtcagttttggtttttgaaatatttttgtttgatgccaagggtaaattccttttatctttggtaattcttcctattcatcagagatgctttggatgagggttgctgttgtctgtataggcctagtacatcagctgtctggttccaactctgtaaatatgaaaatcaaccttagggatgcccttataatcatggttatagggacctcttgccatgtgtccttgtgtctctttgttagattgtcacccgttccagttctgattgtatttttctattttctagattgggctgctgcggatcatttcttttcttccataactctgccgtatgcatgaaaataattctattgggggtcaccagtattaacttccttctcatggaagaagagtgtgatcctcagaaggttacttaattatgcatagtgttcctattgcttgctgccttatcagtgattatgttcctctgtgtactttggagtaatctaccaccaataaaaacgtcctggagctactttctgagtcgtgggaatgagcttgttcacgtattcctaattgactggcacacatagcaaagcaggtgactcagattagtttcaaatactgagacaaatctctggtgtagtcattttaagtcttcatttttcatagatccagattttgtgcttttcaggttatcttgactaatgaatttttataaaataaaaatatgcaggtatttgataatgtttgcaaattcattgtgttaacaagtttctaccagttttatttatttattttatttatttgttttctcactctgtcacccaggctggagtgcagtggtgcgatctcggctcacagcaacctctgcctccccagttcaagtgattctcccgcctcagcctgccaagtagctgggattacaggcacctgccatcatgcccggctaatttttgtatttttgtagaggtgggtttcaccatgttggctaggcttttctcaaattcctgtcctcaagtgatccgcccgcctcagcgtcccaaagttctgggattataggcatgagccactgtgcccagccagtaccaattttattataaagtagtacctatacatcttcaaagtctttaaagaatagaaaagaaccactttctaggacacttcaaataaggacatttttgtctggactccgttcttttgacgcctgtctccattagactcctccaacagggtgtcaggtcaggcaggtgtgatagatccgatttctcatacatctgcagatctaattcagactttttgaacaagttccagaatcacacatcccacctaaatggttccttcgtatctcaaatcaacatgtccaggaacaaacttcttccctttcctcctgtccacagcgcacattcttcctcttgccccatgccactgcccaaaaagccaccacttttgttgtagtttcccaaaccggaaacctgggagtaaacttaaattcttctttattataaacccttcacagtcagtcagctggccctgtctctttgttttagtttggttgattctgtctgaaagcaacagagagcttgagagtcagtggcttaagctggaaggatacttaagtccagagataaacaggccctggattagttcagcagctcagctgtgccatcaagaaccaggactttccatccttttactctaccatcctcagcacgttggctgttgcccttggttcgtcctctcataattgtaaagtaactgccataagcaccaaatagtatcctcagtcagcagtatgtgaaggaagatggaagaagatagggtcattttctacatgcacctctgttcttttaatagaaaggaaaaacttaccagagccccactccttccccgaagagattatctagaattggctcgtgtgcaactgtgatgaagctgagtaagtggatatctggtgtttctaacctttatggtgagttgtgggtgaggaaggcaaaaagttggaaatggcagtttgatgggaacctatgatgtctgtcacatattttactttctggatattatttaaatcggttactttatccccatttccactaatgcttctcaagttcaggccctcatctctattcatataatagcctccttacgagtttcagtctctagtattacttcattttaatccttcctccattctgttaccaaagtaacctttctgaaacataaccaggataaagtgtaatgcactttatgatgtggcccctggctgacagttaaaggtccatttccctcttctatataacagtctttattctcacacagtgaaattttttagctgtccaaacaggctatatcacatccccatatctttatgcatgcccatccttctgtctggagtggcattgtccagcattgatcacctgcaacctcctgcttgctccttctggctgtagcttagtctttattcctgagacttgagtgaactcctatgccctagttgtgcttcgtgcctgtctccattactgcgtatactatcccgtgcatcccaccagactgtgagttctccgatagcgccatactatgaccagtgtctagaacagggcctgtcactagatggtgttctagaaatatccgctcaatgagtggggctttagctggtttttattaggagagttgccagtaacttaaatggcatgaaaagatcatgtgatcttcctctttgtgccaaatgcctatttctggtgtttttttcttgtacctttgcttaagtgcattgctagattttagctttgattgttggactagggtgtccagatgaaggggaggggaggattataggaatgggacagaaaaaaatcaaatagttttctttgacaaaacttaaaatactatgggactagactgaggaaatgtttttaataagtttatttcttgaaattggatcttaattactctttggaagataatctttccgaaaacattgtcagttcctgaattttaacataaattaactagttaataggaataataggagctggtcatccatctttttttttttttttaaacggtaaggaatttaccttaatttacttgtatcaatatgcttcttgggcaaatagtgacccatgagtctagctaagcaaaaggacagttgtacatctgccctcctacattatttatggcattgtcctcttttcttttttaggggggaagggggtgggggaagctagtatgtatgagaaaagaattcagtttccatacatatgtacatttgttttctattgcagcaataacaagttgccaaaaacttagtagtttaaaacaacacaaatttatcatctcacacttatgtaaatcagaagaccaggtgggttagcccagttcctctgctatagtcttcacaagcccaagatcaaggtgttaggctctgggggcaaatctgcttccaagctcattcagattgttaacagaattcagttgcttatatttgtaggtctgaggtcccattccttcctgctgtcagctgggatcctctctcagttgcttcaagtgtcatgcagtcctccatcttcagaccggcaatggtgtgtggaatccttatgcttcaaatatctctgacttcactttcctccacatctgtcctacctccagccacagaaagttttctgtttttaagaggccaggtaattgagacccacccagatattccaggataatttcctgatattgaggtccataatttcaatgacatctgcaaagtctctttgctatgtaacatgttcacaggttctgggaacattctggggagtcattctgccacagtgccatctatgaaaggtgttttgtaaacccaaaaatgttcagttaaaaattgtttcatcatagcagtcactcgacttggcatagaataaatattgacctagtaacttaagctggaaaatttgaagtatttgaaaaatacaactcagatgccagtagggtccaagcgtattggtgactaaaaccccttcagacttgcagtggcataccgttccagtgtatatcagttccatggtcacatttataatggtggataaagttaacaaaacatttgaaacttgtaaatcagatactttaaaaataccagagagcctactatttagatgaattctttgttttatggatttttctttttttgttgttgttttgttgttgttgttgttgttttgagacagaggtcgcccaggttggagtgcagcagcgccatctctgctcactgcaacctccgcctcctgggttcaagcaattttcctgcctcagcctccagagtagctaggactacaggcgtgcgccaccatgcccagctagtttttttgtatttttagtagaggcagggtttcaccatgttggccacactggtctcagtctcctgacctcatgatccacctgcctcggccgcccaaagtgctgggattataggcgtgagccaccgcacccggtcggatttttcttaagatgggatgtacttacactttccgtttgttgactgtcgaattctctacaagattatttgaattccaaagcaacattattgtgtaaatgtcagccagttggttcataaaatgtaaagtgagaaactgccaaaataatcttaaactgtaagaaaggcaaaaataataataaaaggacaatgggatgcatgaaaataattttgttttagtttatctggaatgtattttggtatagatgtgacagtaacttaaaaacaataaattaaaaatcaactaattggccccacattatttgaaataagtctttcctctctaaattgtgatgtcatccttaatcataatactaaattcttacccatacggaattgttgattctagccttattaccacactgttttaattattatactttcacgttatatttggaatctgattaggccagtttccctttactattattccaaagctttattggccttcatttccttttctaggagtactttgtaaggctcgctgaaaaaaattccataggtttttgttttgttttaattgtgttaaaatacacataacataaaatttacgtttttaactatacaatctactgtgttaggtatattcacatttttgtgcaaccagtcttcagaacttttttatcttgcaaaactgagactctatacccactaaacaacaactccccatttctccctcccctcagtccctggtaatcatcattctgctttctgtctctgtgcatttgactagataacctcatttaagtgaaataatacagtatttattttgtgactggcttatttcacttagcatagtcctcagggtttatctatgttgcagcatgtatcagaatttccttcctttttaaggctgagtaatattccactgtgtatgtatatgccacagaaatcaagctaattttctttttttttattattatactttaagttctagggtacatgtgcacaatgtgcaggtttgttacatatgtatacatgtgccgtgttggtgtgctgcacccattaactcatcattcacattaggtatatctcctaatgctatccctccccgctccccccaccccaccacaggccccagtgtgtgatgttccccttcctgtgtccaagtgttctccttgttcaattcccacctatgagtgagaacatgcggtgtttggttttttgtccttgtgatagtttgctgagaatgatggtttccagcttcatccatgtccctacaaaggacatgaactcatcattttttatggctgcatagtattccatgatgtgtatgtgccacattttcttaatccagtctatcattgatggacatttgggttggttccaagtctttgctattgtgaatagtgccgcagtaaacatacgtgtgcatgtgtctttatagcagcatgatttataatcctttgggtacatacccagtaatgggatggctgggtcaaatggtatttctagttctagatccctgaggaattgccacactgacttccacaatggttgaactagtttacagtcccacaacagtgtaaaagtgttcctatttctccacatcctctccagcacctgttgtttcctgacttcttaatgatcgccattctaactggtgtgagaaggtatctcattgtggttttgatttgcatttctctgatggccagtgatgagcattttttcatgtgtcttttggctgcataaatgtcttcttttgagaagtgtctgttcatgtcctttgcccacttgttgatggggttgtttgtttttttctaaatcaagctaattttcagtgtcattagacacaggttacttccatcctttggctgttatgaataatggtgtgtgaacatgggtttataaaaataaaaatgtctattcaagtcctgctttcgatttttttggatatatacccagaagtccatagatttttttaattgggcttgcactaaacttataaattaacttgggaagaactgacatcttttctatcatattcttccctccacccccattgatgaaaacaggatgttttttgttttttgaaatttttatccagaaaatagttaaataatgccaaactcatctatctaaactgtctattaaacagaataaagctaataaaatatatatgagatagtaagtggtaattagtgctaaagaggaaagtaaagcaaagaaggggagggacagtgtaagtcaggatggtatagttaccggttactgcagtttcaaagagagtggtcaagaaaggcctcactaagaaggcattcctgaaaggtgaagtataccatgtagaaaggagaaagtgttccagacagagggtaagcaaacatcaaggctgtaaatcgggccacatgctacctgttaagtaaatgtacagcaagaaacaagagaagtttttaaggaattgttgatttaagttctcaggtagattcagtaggatcattgaaaatagaacaagcagtaccaccagaaagggaaaaatctgggattaggatagattccacaaaaatgaaaagcaccatttcctaatttttaactagaaagggagttagattgggaactaaagagaaaacaacaagatttagaaagtcagaaattcaagtagaagggtcaaaaggatcaagtgataggcaaaactttttaaaagttaggaccattcaaccaaagcctggtttaacttgcagtttttttttttccttttttttgacatggagtctcgctctgtcgcccaggctggcatccgtctcggctcagtgcaagctccgcctcctgggttcacgccattcttctgcctcagtcttctgagtagctgggactacaggcgcctgccaccacgcccggctaattttttgtatttttagtagagacggggtttcaccatgttagccaggatggtctcgatctcctgacctcgtgatccgcccacctcagcctcccaaagtgctgggattacaggcgtgagccaccgcacctggctgcaaattttaagaataaagtaaaaaatcctacaaatacacaaaggcaaaaaagttacacgggaacaaaatcaggctaatttcagacttctctttgcttataccaaaggctgaataataaagtagagcattatctacagagtattaaaagggaaaagatttatgtctgaatactatagcttctccagttgtcattcatgtacaaaaggacatagacaatatgtagatacctttctgggggttaaaaaattattcaagaacttggccgggcacggtggctcacgcctgtaatcccagcactttgggaggccaaggtggacggatcatgaggtcaggagatcgagaccatcctggctaacacggtgaaaccccatctctgctaaaaatacaaaaaattagccaggcgtggtggcgggcgcctgtagtcccagctgctcgggaggctgaggcaggagaatggcgtgaacctgggaggcggaggttgcagtgagccgagattgcgccactgcacgccagcctgggcgacagagtgagactccgtctcaggaaaaaaaaaaaaaaaaaaaaaaaattatttaagaacttaacaatggggtggttacactaaaaggaaaggccatggccatcaatactcatttaacatagctaaatcttataactgtggttaaaaacagggccagtgtccagaattactctttgaagagaacaagcatgatgatttttaaaaattaagttttcaggttatgttgaacaaaccttgggtgagagagaagaggtaaaagcttgtagcagccctatatagaaggacgtgtgttgtaaatatacttaattcttgttttggaagattatatttgagtgtatgtgttaatttttttcattaagatgtattattgggagaaaatcaaacctacagggaaaagagcaacgaagacgtaatccatatggtgtaatagaaaaaacagagaaaagttcaatatgaaatgaagtcaaggccaggcactgtggctcaggcctgtaatcccagcactttgagaggctgaggtgggtggtagtgggaccttatctctacaaaaaataaataaattagccaggcccatgcctgtgattccagctacttaagggactgagatgggaggattgcctcagcccagaaggtcgaggctgcagtaagccatgattgtgccactgcactcagtctgggcaacagagcaagaccctgtctcaaaaataaatacaaataggaccaagcatataagttatgaaatgacagtaaataaattaaaatcccctattaagcttggtaagtgtatttataagtgtcctttgccttacagaaattttgttctatgtggtcaaaactgttggtcttttataacctttcatcttccagtccttccctagatttttccttgcaaaaaatgatagaaataatctacatgtttgttcccaagtggaatgccagttatcccaatgctgtttattgaataatccatgcttccccatgttaatttgtggcacatactatgtttatgttgtactaaattatcatggatatttaggtctgtttgaagactgtctgtgctattcatttctgcctcttcctgcaccattattagatgttgaattatactagtctcttccagcaagttttgatatcagttttgatattgaatcttccgatattaatacctgattttttttttttagtgttttcagtatgccactatactaagccatttccttatattattatccctttttaagttgatgaaactgaggcctagttgaaaagcaagctcagagtcacgccatagtggtagagcacagtcttgaacaagagctcttaacactaaaatctgcgctcctaactgtcatgctgtatttctttttcctcatctcatcccctccataacccagaaatatgctgattctctttttgtttgtcctcatcttacacccctccctgaactaacttctgcactctgtggcactcatggatatacagtgatctaaaaactgccctgcctcctaaatcttttctgtgactatttctgtcatagttaatgctatgtgtcgacttgagtagaccatggtacccagttttagtcagacaccagtctagatgttgctgctaaggtgctttttagatgtaacaattttatagattttgagtaaagaaattacccttcaaaatatggatgggcttcatccagtcagttgaaggccttaaaagaaaaactaagttccccaaggaagaacgaattttggctccagacaagctgcaacatcacctcttccctgaatctgcatcctgcagacctactctgaagatttcagatctatcaagccccacagttgtgtgagccagttccttaaaataatcacttctttgctcccctcttcatctgggctattctgcagtctactgttacagtcactccctctgtcatacttgtctccgtagttaaaatcagctcaccatctacaccgcggcagctgaatagggctagagaaaaacaaccatagtgacagatctcactttacaattgtgaccacaaaccccaagagggccctaaatactgtctagcagtgcttccttatttctctggtcagttgacattcccactctccgagacaactacaatatgtcatactttctccccattccctactctcagcttattttcagagattacctcacagcttatttcactgaagagaaaagaaaaggcagttttctcatccttccaccaccactgttttaccatatgtagtctgcgttctctctgatcatatggaatgaattgtccatgtctctatctgagatgaaaccttccgctgtgtactagaacccatcctctctcctatctatacaaggacttctctttcagaattgtcaccactcttttctgcctcatcagtttttttttactttctactctatcactccaatcagtgaatgaatatgctatattttatagtccccattcattcaaactgaggagaattagtgatatactttaatatttatctctattaaccatcaaccatattgtatcgtgttctcaagctgaaggtttgtctttttaaatgaacttctttagaaatatattacttttaagcctaacaaataagtgaacaagaactgttttaatcagtctcattcattctgacctgttgctcttttatctgtgggtatcaaacaataatacagcaataaggattttttaagtttcccactctgtagtgaccctgagggcagacgcagtgtctatattagttcctttttaaagacataactgaaactgggaacaaaaagaggtttaattggacttacagttccatgtggctcgggaggcctcagaatcatggcgggtggcaaaaggcacttgttacgtggtggcagcaagagaaaaatgaggaagaagcagaagtggaaatgcctgataaacccatcagatctcgtgattcttattcactatcacgagaatagcatggtaaagactggcccccatgattcaattacctccccctgggtccctcccacaatacatgggaattctgggagatacaatacaagttgagatttggctggggacatagccaaaccatatcattccacccctggtccctccaaatctcatgtcctcacatttcaaaaccaatcataccttcttagcagtcccctaaagtcttaactcatttcagcattaacccaaaagtccacagtccaaagtctcatctgagacaaggcaagtcccttcctatgagcctgtaaaatcaaaagcaagctagctacttcctagatataatggggatacaggtattggataaatacagccattccaaatgggagaaattggccaaaacagaggggttaaagggcccatgcaagtccaaaatccagtggggcagtcaaattttacagctgcaaaatgttctcctttgactccgggtctcacatccaggtcacgctgatgaaagaggtgggttaaaatgactcacatgatccttacaatgatattgtatgctaggtattattactattcccattttagagaggcacagataagttaactaactttcccaaggccacacagctaaaaagggggtaggatacaaatccatgcatcctgattccaggttgtaccacaaactgcattacactgcctcttgctataacagaagcaggcttgaccaaggaggaaaaggtcaaatacagcctcttgctgccccctcctcagtcctaacttttcttcagtcctgactcttactctgaactagtgcaatggtttagggctctcacctgtcacctgacaggctagggagatccattaggatagcagagagaagcaggcctccagaggtgaccagccagtgagagggctgaaagacacaagccattgctggtgctgaagcgtagtcactcattgtgtgatcttggttaaattacttggctgaacatccctgacataatttacgtattttacatggactatttcattatgaaagaaaaagctgacagtacattttagagtgacatccacaaaatgaggtattgactatatgtatacatttgttgttttaacacttatcaaattgtgattatttacatacttaagagttccttatggacaaggattgtgaattaatcatctttgtatccccactgtctagcaaagttctggacacagcagaagaggtatacctatgttttgttcaatcaaagttgctttgtttatagatctgctggtatgctgtctttttaaaatgagatttaaactgacatacaatttaggggggtctttctagaatagtgtttctcaatttttatcttggattcaatgcattagtaccaacaagacctcataaggtagtttaacagtgtaaacttacatcaaagacagtaattagcccacgatctccactagtcacaactgatatggggctttttaaaaactcaaaaattgaaatgtcttcttttccctgagcacccttttttgagaaataagtcaaacacttgcttcaattcactcaacctctaacatgaacactgattctagtttttgaggagaaatggttattcttatacttatccagattatttaatactatcttttatggaagtcaggcccaggccctaagtggttatattaagtgttttaagttacagaaaaaagagatggcatttgtcaatgttactttcaagcaggaagcataaaattttattaaactgatgaggggcaaatcattgacaaaaatgaagtttaatgaacgttctctatctgaagaataacatgacagtaatatagcacaatcaattcgtttctgtaaacaatactttaaaataatgaatgaaaatatttaggccagttttttccattgaggcaagattgagcccaaaagtaactgtacttatttttgtagttattgccttcccccatattttaagaggataatttttctgcaatttttttctcttcccttttatcatattaatactttagaatgcttcttaaaaatattttgaaaggcccttttttgtgagacagggtcttactttgacacccagtctagagtgcagtggcatagtcatggctcactgcaggctttgacctcccaacctccaacaaacctcccacgtcagccccctgagtagctgggactatgcaccgccacacccggctaattgtttaatttttttgtagagatagggtctcactatgtggcccaggctggtcttgaactcctgggcttaagtgattgtcccaccttggcctcccaaagtgctgggattacaggcatgagccaccgtgcctggccagaaaacctgtttttattaaacttgtacattttactttcttcttttcagaatcttaataagaaaacctttttattcttgcttaaaaaaagaaactagactggccagttgctctggctcacacctgtaatctcagcactttgggaggccgaggtgggcggatcacctgaggtcaggagttcgagactagcctgaccaatatggagaaaccccatcactactaaaaatacaaaattagctgggcgtggtggcatatgcctgtaatcctagctatttgggaggctgaggcaggagaattgcctgaacccgggaggcagaggttgcggtgagccaagatcgcaccattacactccagtctggacaacaggagcgaaactccatctcaaaaaaagaaaaaaagaaactagacttcagtgacactggatggtgtcagaggaggtaagtgtgtattagtattagtggtcattccttggccaccttctgtgtaattactatctccatggacttaagcaagtacagggctgtaaggtcctagcaccaaagtaagatgtggttctccagccctctgctcatgtacttcactaatatataggcatcctttaaaactactgtcttacttgaagaagcctttcactgagacctatacttctcaagaatataaataattcttttttttttttgatagggagtttcgctcttgttcctaggctggagtgcgatggcacaatcttggctcactgcaacctctgcctcctgggttcaagtgattctcctgtcccagcctccggaatagctgggattacaggcacatgccaccacacccagctaatttttgtatttttagtagagatggggtttcatcatattggtcaggctggtcttgaactcctgaccgcaagtgatccacctgcctcggcctcccacagtgctgggattacaggcatgtgccaccacacccggcagaatataaataattcttgtaggagtctttaaatagaatcaaattaactctaccattgtttgctattcattttggtgagtcactactcttggtaatttgacatcaactcccaaaaattcttgaaaattttgacactgtacagataaccagaactcgtctatttacacatgcatacaatcttccccaatatgtagaacaaaatttgagggaaggatcttattgccaataaatacgcgttctggctacaactaacactcataataatctttatgggacaagcactcttctaagtactttatacatactaatttatttattcttcataacagtcctctgaggtagattgtatttgttatccccattttgtaagtaaggacgtcaagggacagagaggtaagtaactatctttcccaaagccatacaactagcaaatagtggacttcaaccaagacattctggctccaggattctgaattagaatcaaacactttttgagacagattgagtaccttaaaaagttatcaaatacatatgaacaaaccaaggcaaagcacataggtctcccaactcagtctaattgccgccttcactacagtccaaatgcttcaatttgtgttagttacaatacttggataatcttttttaaattcaagcagtaatctctgagattaatgaaaatataatagaagaaacgctcttggaatctaaactggaactagggggacattgtgggctttctagtttgatcctaagggaaagagatccttggattaaactgaccaaatgatatcttcggtacaaatggtttacataggtagttgacattgggatgttgtggtaactcttctactgtttcgcggtttaagagatactattttgtggtagcatctggctgctttactgttttcctttggtatgttaggaagggtttgagaagaattaaactgtaaactaactttcaaatgaaaacgtctgattgttcgtgtaatctccgagggatgatctagttgtcagcactgggcactgggtaagcttgaatatatagccaccttaagtagatgtggttcgaatgttctgtgccatattcctcccttgtacagcaccacttttgtgtgctaacctttttctgcaaggccggcccccagtgtcattatatgtaactcttcatcccaccttcggcagctgcctgagagcaatagttctttaactagtctgctgaatgttaatactaactgtactcttatacttgaaccaagctctagaaataaaagttgtcttcccccagctcaaataaaaagccaacttctagggctttatttggataaaaatgtcgtggattatccatttttctcaagtatgtgtttttaaacttttggcgtctgctactattgagacgacaaaatcaatgaaggcttatccagcagaaatcttgctaacatccagttatatctagttcaccagcttgttttgtttgtcttttatggatacatgttattggctatgattttgttttgcatgtttataatattttctgttagaaaaatagcttctagtttgtaaaatgaggttaaacatatcaatattttatggtatcctacaaaagcatgaatttcctcatagcaattttgagaaattctcttgacctgtgtagggagatttttactgaagagatgctatgtgacataagttttgacagtagtaaaataatttttaaatgtaatgacaaaagataaaaccaagttacatgatttggatgtttgtcccctccaaatctcatattgaaatgtgacctccaggccaggtgcagtggctcatgcctgtaatacccaacactttgggagtctgaggtaggaggatctcttgaggccaggagtttgagatcagcctgggcaacatagcaagactccatctcttaaaaaaagaaatgttggaggtggatcctagtgggaggtcttggaatcatgggggcagatcgctcatgaatgacttagggccatccctttgctgatgagtgagttctcactcagttcatgggagatctggttgtttaaaagagccgggacctccccatttctccatctctcttgctgctgctctcgccatgtgacgtgcctgctctccttttgttttccaccatgattggaagcttcctgagaccctcgccaaaaacagatgctggagccatgcttgtacagcctgcagaactgtgagcaaattaaacctcctttataaattacccagtctcaggtattactttatagcaacacaaaaacggactaacacaccaggttagagaagcgttgagaaacactactattgatttcaaaaattaatagcagttggccacgcgtggtggctcatgcctgtaaccctagcactttgggaggccaaggcgggcggatcacgaggtcaggagtccgagaccagcctggacaacatggtgaaaccccatctctactgaaaatacaaaaattagccaggcatggtggcatatgcctgtaatcccagctactctggaggctgagacaggagaatcgcttgaactcgggaagtagaggttgcagtgagccaagatcgccccattgcactccagcctgggtgacagcgagactctgtctgtaataataataataataataataatagcagttatttcagcatgaataactgccagcagtaaatcattattgtaggggagtaggatagtttcacaactgaaatcattccgtaaaaggctcagttctcatatgcttttttgttttggtttggttttttttacagttatctcactaaatattcacttaaaatagacatcatccatattgtctgcatagctttggcaggactttgaggcagaaggacttgataaggcatactgaccttgaattaaatttgcatcttccacaggcagcctgcccagttgtaaagattgagccttccaggcgtgttctctaataatagatctaggaagccctaacaggagcagaagcatttggagggcatctctttctctaaccaactctccctggaagggcttaccctcttttcctctgaatctattaagaaaaaacgtcacaccaaagaaaaacatctaatttattcgcttcataatgtatattctaaacatttattcagaaatgtgctactgttcatatgtgaagtggctgaccaaaatacatatttagaattgttttcttctgctcttgatatattccttttttatatcctgttttccttgtgactaaaagcagatgtttttagaaggcagctggctagaattaggaatgcagcctgtaatttaagaagtaacctatttaaaggtttttgattgggtatagagagttcaagaaactaattggactgtcttgtgttactagaaaatgttttatggtagctagtattttttttcactttttttccattgagagttccattcccataacttatatatttcactgatagtaaactttattggaccatgtctaataataaaaacagggaaatggaaactttttgtgaatttcttggttcacattttgctaacagaggaaaaactttgttataatgccgaattattctttaaggagcaaagtatgttctgtatctaaaggaatgtttatcctcgggggctcaaggcatgtacagaagagtttttgtttaggtttgccaactaaaacatggtatactcttctgtcatttgggacaagttaatagatttactttacttctgtctctttttttttttttttttttttttgagacggagtcttgctctgttgcccaggctggagtacagtggtgcgatctcggctcattacaacctccgcctcccaggttcaagtaattctcctgcctcagcctcccaagtagctggaactacaggcgtccgccaccacgcccagctaattttgttttgtaatttttgtagaaacggggtttcaccatattggtcaggctggtctcgaactcctcacctcaggtgatccacccgcctctgctcccaaagtggctacaggcgtgagctactgcacccggccgatttactttacttctattcataacggtcttttttttttttaacagcctttttgagatactgttcatatactagatgaactatataaaatgtacacccatttaaaatgtacaattcagtgaattttagtatattcacagttgtgaagccatcattaccacagtcaattttaggatattttcatcaccctagagagaagcccatacccattagcaatcacttcccatatcttcccaaacttccagtcatagaaccacgaatctactttccgtctgtgtagcctattctgggcatttcatataaatggaatcatgtaatatgtggtcttttgtgattggcttctttcacctggcataatgttttcaaggttcattcctgtggtagcatgcatcaaatacctcattcctttttactgagaaatcatattgcgtttcatggataataccacattttatttatccagtaatcagttgataaacatgtagttgtttctactttttggctattacaagtaatgctgccgtgaacattaattacaagtttttatgtggctatatattttcatttctcttgggcatatgcctagaaataaaattgctaggtcatatggtaactttaggtttaacttttggaggaactgccaaactgttttccaaggcagctgtaacatgatacattcccaccagtaatgtattcgagttctaatttctccacatcctaacacttgttattatctgtctttttgattatagtcatctgagtaggtgtgacatgatagataatggtggttttaatttgcgtatcttcttagaagaaatacttttttttagatcctttgcccattttttagtagggttatgtgtctcgttgagttctaagagttcttatatgtattctacatataagtcccttgtcggtatatgacttgccaaaattttctcccaggctgtggtttcccttttcactttcttgatagtgttcttcaaagcactaaagttttaaattctgctttcatcaatttttttcttttgttgcttttgcttttggtgtcatatctatgaagccattgcgtaatccaagatcatgaagatatgcttctcttccaagagtttataatttaagctcttgcatttaggtctttgatccattaaattaatttttatatatggcatgaggtagaagaccagcttcattcatttgcatgtggatttccagttgtctcagttctatttgttgaaaagactcttcttttcccactgaattgtcttggcacctttgttaaagatcagttggccatcattataggggcttatttctgaactctgaattctgtttcattgatctgtatgtctatctttatgccagtaatacactgtcttgattactgtagctctgtgctaaatgttgaaatcaggaagtctgagtcctataactttttcaagattgttttagctattctaggtctcttgaatttccatatgaatttttaaatttgtcaatttctgcaaaaaatggcagctgagattttgacaagaatggcagtgaatcttcaggtcaacttgggagagtattaccatcctaacagtattaaatcttccagttcacaagcgtggaatgtctttccatttatttaggtcttctttaatttttttcaacaatgttttgtagttttcagatacagtttatgaacttcttaaatgtatccataagtttattttttatgtaactgtaaatggaattttcttaatttcattttttgagtgcttattgctagtgtatagaaatacaatcaattttttttttgagacagagtcttgctctgtctcccaggctggagtgcagtggcgcgatctcagctcactgcaagctccacctccctggttcaggccattctcctgcctcagcctcccgagcagctgaaactacaggtgcctgccaccacacccggctcattttttgtattttcagtagagacagggtttcaccgtgctagccagggtggtctcaatctcctgacctccgtgatccgcccgcctcagcctcccaaagtgctgggattacaggtgtgagccaccgcgcctggcctacaatcgatttttatatattgatcttgtaccctgcaatgtttttaacttatctattagttttagtaattttttagtggattccttatgattttcctgtatataatatcatatcatctgcaaaatgagataattttacttctttttttccagtttgaatgcctttaatttttccttcttcagtaattgccctggctggaatctccagcacagtgtttaacagaagtggcaagagcagacactcttatcttattttttattttaaagggaaagcattcagtctttcaccgttaagtatgatattagctgtgaggtttttcatagatgttctttatcagcttagggaaatttccatctattcctagtttattgaatagattttaaaaatatatacaatgtatattttatatattgtataaaatatatattatatatattttatatatatatatcatgaaagggtattggattttgtccagtgcttttctttgtctattgggatgatcatggggattttgtcctttatatggtatattacattaattttttttttttttttttaagattaagcccaccttccattccagggataaatcccactgggtcatgttatataatccttgagtctgttttcataatagatattagtctctgtttcttgtgatgtctttgttttggtatcaggtttatctggcctcatagaatgagttgggaagtgttcccctttcttctgtattttggaagagcttctgaagaattggtattgattcttgtttaatttagtagaatttgccagtgaagtcccctggtcctgggcttttctttgtgggtagtgtttaaattactagttcattcttttctcattagaggttatttagattttctgtatcttcttgagtcagttttggtagcttgtgaatttgtccatttcatctcagttatataatttgttggcatacagttgttcttagtcttccttggaatccttttcatttccattaggttggtagagatgtctcttcatagatttttaaccagtaaatagatcgctactttaactttacaaagaaattaactcttcaacttctgggggtcctttctgaggatagaaaatataaggaaatgtgaaaaacaaagaactactgagttcatcattattattgctaacaatgaataagcaacgtcaacattaatttttgccttgcacagaatattgaaacagagccttcaaaaaaataacagtaatgagtctgggcacagtactgggcatggctcacacctgtaatcccagcacttgtggaggccaaggtgggaggattgcttgaggccaggagttcaagacaagcttgggcaacatagcgagaccctgcatccacaaaaataaaagttaaaaaattagcctggcatggtggtgcatgcctctagtcccagtttctcaggcggctgagttaggaggattgcttcagcccaggggtttgaggaggcagtgagctatgatcgtaccactgcactccagcctaggcgacagagtgagaccctgtctctaaaaaaataacagtaataatgatgatgatgttaggagtgaggggtggacttacactgtttaatactgtccaaaggaatatatctctaggtttagaaatcattttcctagcaacttgtgggctttgtataatcttgagcaggaacagttgacctgatagttcaactttctatctgagagtggaggtaacagtaccacttgcaaagcaagcagatactcattttcattgtactgtctcagcatttctttagaaactttatttaggccacatctcattatagtgaattccaaactactgaccacatttgtggatggaatatttctcttgcttttaagtttctttttacagttttcccctttataaaatgtgtcaaaatatacctttattttttagaatgtaaaatcttgaatacaaggaattttcagactgaagaagtatagtactcaggcaacatataggagttctaagcatggaatccccaagcatagaagaaattattttcatttgtgaaaaggcagagaataaaagatttctgagtttaggatgcccactctgataagttcattctcatcctaattctttaccaaaagtcaacattcgggcataactctttttcatgaatatctttcccattttttaataaaacctttgggttcctgttatggaaatttacaataaatcactttcagaaggctatttactgctcaactgaagagattgttaaaattaagtgatattgaacataaaatggaaatgttccatttactaagcatttaaaaccttttgattattgtagccaaaccattatgtatacatctctttttggataatattctatattttgaaaaagaagctgtgctgcaagaagagaatagcccactttaaaatagagccgcctgcatccggaacagaaaccttttggtgctgtcgttaaggaaatcaacagtatacagaccaaattattggttgcaaactgtataaacaatgggatttctcaattggaaaaggcaatttaagtcctagaagttggctgccaaggaaaccactacgtggagaaagcctaacaaaatttttatgtgaactggcgtgataccttgcagtattttccactctttttctctttttttctttttttttgagacagggtctcactcagtcgctcaggctggagtgcagtgtcacaatcacagctcactgaagcctcgacctcctgggctcaggtaatcaatcctcccatgtcagcctcctgggtagctgggactacaggcacgcaccaccacttccagctaactttttgtattttgtagaaatggggtttcaccatgttgcccaggctggtctttttctgtgaaaagggggagaaagtaagaggatagcaagaaacttagaaatgcatctcttgtaaggaggcgaggactagattattctctttagttcccccaaattttttattgtgaaattttttaaaccttcccaaaaagttgaaggaagagtacaatctgtatatacccttcattcagatgtaccagtttttaaccttttgctacatttactttctctcacacccgtcctacactctgtcacacacagatcacatagaaagtaagtcacaaacatagcagttcatccctaaatactttagtatgtatttcccaagaagacattttctggcttggcgtgttggctcacgcctgtaatcccagcactttgggaggccaaggagggtggatcacttgaggccaggagtttgagaccaatctggccaacatgccaaaaccccatctctactaaaaatacaaaaattatccaggtatttcagcacaagcctgtaatcccccttgcatggctgaggcacaagaatcgctcgaacctgggaggtggaggttgcagtgagcccagattgcgccactgcactccatcctgggtgacagagtgagagactctatctcaaaaaaaaaaaaaaaaaaaaaaaaaagacattttctacctaaccatagtgctgttatcacacccaagaagtttttaattgatgtagtattattgaatatatagtctatattcatgttttccccaattgttccaataatggttctttttagccttttttttttttttttaaacaaaaaatctaggatccagtcgaggttcattcacttcctttaattgccgtaagagtagcccacccttcctctgccttcttttgactttgctaacactgatatttttttaaaaaccaagccatccatggccaggcacagtggctcatgtctgtaaccccagcactttgggaggccaaggcaagtggattgcttgagcctaggagttcgagaccagcctggacaacatgatgaaaccctgtctgtataaaaaatagctgggcatggtggcatgtgcctggagtcccagctactcaggaaactgaggtgggagaatggcttgagccctgcctgcagtgaaccgagatcaggccactgcactccagcctgggcaacagagccaaaccctgtctcaaaaaaaaaaaaagaccaggccagttttcttgtagaatgtctcatagtccagacttacctgatttttccttatggttgtcttctggtttaacacatttgacaggaaaactaacaaagcaaatgtagcttttgtatttcgtcacatccaaaggcacataatatcaattggtccaactattaatgatgctcagttcaatcacttagtattgataaggtgatatacaccatatttttccattgcaaagatatcttttttctttgttatttaggaaaaatagtgggggttggcaagtgacattggtgcaacaaatggggagaaatggcaggggagaaggaggtgatactttgagacattgtgtatatcattcttaaacagcctttcttctaatggttttatcatccatgatctttgcctgactcaactggtggcaacaaaatggtgattgcctaattttgccctttcgtctacttgtactagctggctggcttctattaaaaaaagagctttcctccttttactttttttttttttttttaagtattaccatggactctgagatagtctttttattcaatatgctatagtccattatcattattctttttgatgttcaccttttcccatggttgactaatgaaaactgctttaggccagcttctctataatcttgacatgtggccatcattctttgagcaagtctcaccttacacatttttgccctaactttgaatcaaccatttctccagagtcctgattccttttaggaagagaaaccaagatctggacagtatgttcattgcttctacttcagtgggcaagctaggtaataatatatattctttatgagtttatacagatgcttcccgttacgatccagtaccacgggcttcttccattccatttcctcttctgtgttttttatctccctctactaccctgacaactctggttcccaccatcagtatatgtactcacttgctctctactagagcatagcagtccccaacctttttggcatcagggactagtttcgtggaagatgattttgccatggacctggggcgggggagggaggatggtttcaagatgaaactgttccacctcagatcatcaggcatttgttagattctcataaggaacgcacaacctagatctcttgcatccacagctgcccacctcttggtacatacacgtcctgtagtacatacaaatagttttggaattacaccagtaccactatgaacaacacgtctcagtttgagatttctttgcacttcattttgtccttagtatatatctcagtaagggtatatagacagaatactgtattcagaagttaatttcttttttattatctgtgtgattatcaatttgatacacaactaggttcatttgtttttgtttgacttcggttttgaggtgtacttctgtttccagaattggttccttccggtgggttcttggtctcactgacttcaagaatgaagccgcagaccctcgtggtgagtgttaagttcttaaagatggtgtgtctggagtttgttccttcagatgttcagatgtgtccagagtttcttccttccagtgggttcgtggtctcgctgacttcaggaatgaagctgcagacccttgtggtcagtgttacagctcataaaggtagtgcagacccaaagagtgagcagcagcaagatttactgtgaagagcaaaagaacaaagcttccacagcgtggaaggggacctgagcaggttgtggctgctggcttgggtggccagcttttagtcccttatttggccacacccgcatcccactgattggtccattttacagagtgctgattggtctgttttttacagagcgctgatgggtgcatttttacagagtgctgattggtgcatttacaatcctctagctagacagaaaagttctccaagtccccacctgacccaggaagtccagctggcttcacttctcacttctttttctatttcaaagtttaactttgtgaaaaacatttacatcgttcaaatgtcaaaactatatatgaaaagatatcccaggaagtctcctatctctttccctttcatccacctctggtaggtaactattttcataattttctggttttttcttctttttcttttttgtaaaaaaatagatatttgcatatgacagggatcttacacaaactttttctgtaaataaccagatagtaaatattttggttatctatcacactcaactctgccattgtggcataaaagccacgcagacaatttgcaaacaaatgagcgtggctgtgttccaataaaacgttatttgcaaagacaggcggggggccagattggtctgcaggagttgtttgctggctgtaagatgtagatacagacattctcatacaaaagcatgtatatagtgtgttgtcaaaaaaaaaaaaaaaactcagtgatatttgttaaagcacagtaaggcaaactcttttcaagaccattgtgataggtagaggggccatggcaatgggattttgcagtggagtagagaaactgtgttcaactccaaacacagcatgggcaaatgggaatttgcagccagggagcagggtggagggtcagtggatggaaaatttctaagaggaaacattagggatccaggggggttctggctaaaccaacctaacacatttcctagtgaagatctggcatcaccagggggatggtggaggatgaggaacctgaccagatatggaggtgatcagatagcaagggttgggggttcttgctgaactgaattagcaagattctttgctaaaacctgattttacaagtacgtgtacacatgggcctaggagaaggttcaggagtctaagtctttgccatatattattacttttttctttttttgagacagagtctcgctctgtcgcccaggctggagtgcagtggcgtgatctcggctcactgcaagctccgcctcccaggttcatgccattctcctgcctcagcctcctgagtagctgggactacaagtgcccgccatcacacccggctaattttttgtattttcagtagagacagggtttcaccatgttagccagggtggtcttgatctcctgaccttgtgatccgcccacctcagcctcccaaagtgctgggattacaggcgtgagccaccgcgcccagccttttgccatatattactttgcaacttgcttttgtttccctaacaaatatatcctggaaattacttcctcttcctcttagttccttaagagcatcacacctgccccaacactttttgaatttttttttagagacagggtctcactttgttgccctggctggagtgcagtggtgtgatcatagctcactgcaacctcaaactcccgggctcagttctcccacctcagcctcccaagtagctaggaccacgggtacctggctaatttttttttttttttaagagattgggtctccctgtgttgcctaggggggtcttgaactcctggcctcaagctgtcctcccgcctcaacctcccaaagtactggaattacaggtgtgagccaccacactgagcccttcccctctttttatggctaaagagtattccattatatagatatatcatagtttatgtaactaggaccctataaatgaacatttaggctgttgtcaacattttactaacataaataatactgcagttaatagtcttatgcttatggttttttatatgtgcaacctattcttttactatagtataaagattcaaataaataaaaacctgttaaactaagataatagcattttactttaaaataacatttttaactataaaagtaatactctttatcaaatttagaagaacaaacaatcctgaatgtatggagctaaaactgaaagtattgcattttagtcctccactcccaccctagccacgtgtactcctctcggccaaattgttaacagttgaacacaggtgcttcagacctttcttttgttgcaattggtggtagtttgattttgtcatcccatacttaacatgtaagtatatcctcaggctaacttatttttcaaaaatgtgatcatgctacacatattatgacttgatctttttattttatgtggtttttaaatatctatcgagttacctcattcttttttcttttttaaaaaaaaaatctcagctaattttcccaagtcaaccttattctttttttgattgatagtttataatatgaatgtaccataattagccatttctctattgatatttagacttcagtttttcagtacttgtagacaactacagttaatatcctgggacatggctttgcatatgtactagtatttctatagaatagattccagaaggtgaaatggttaagtcactttcattgattttcacaagtatactcatatctgaacttttgctgcccaaactctgggattaaatagatttgggtaaatgttttgaagaatccttactgtatgtaatcttactactctccttccaaaatcaaattgattcacataaaaaaatgtagccttcgtttcctaacttgccatccaaattctggctctccaaaatcaggaactcaaaaaattccgatcaagagggatacttatattctcatatgaatctttgttatatccacacagattctctctttttgcatattatttatctttttatcttgtttttatgtagttttataaaataaaaagttgtacatttttatgtagaatatctgttgatattttcctctgtaaattctaggattttactttacttaggttgtcttttcccacctaaaatttttaaaactctattcccttctatccatatatagttatttttagacacactagaatttttatacatgaaatttatgcataatcaattttgtcaacatgcttttagtaagtcatactttgtcattaattttaaatatctcctttatcatatatcaaattcttatatatacaagggtctgtaccaggatctgttcctgcaacaatgccatattgttttaatgaatatttcaatttctagatgggaaaattccttgttttcatatatttatttatgattgcttaattcttcttccaggtacgttttattttatttttatccacgctcggccccaggtacattttagaaaaaaacacaactgacttgttcatttatgcttcttccagcaatgcgtgagaatgtgtgtaggtctgagaaagactggctaggggtctggagccaaggttaagacttgaataaacctagaacaattaaagataaattatctgtcccctaacctgggagacatccaataggtttgtaacacttttgagtgttacctaagtgttttgtttagtgagctcttaactcatttacctttttctcagtttaaccccctccacttcacctttttaacccctttcacagtcatttcctgtaatttcttatcatataacctatgtacatcctcttccctcttcctggcatttctgtccatccccatgggccccatggcccagttttcttactgggaaatctgatttgttcctaaagactcagttcagatattacttttctgggaggtttttattcatgctaatggtaagaagtaagaatgttgttctaacctttgtgcattgtttattcttatattattaccattatcaaactttgagctgaatcaggacacatgatacatgccgtaaatgtttgttgaaaaagaataaaatatttctgctttcagggagctcaccaaagaataagaagaaaagcttaggataggagaaaaatagatatgaaagcacactctgtgtgtgtgtgtgtatgtgtgtgtgtgtgtgtgtaagtcactaacagcagagctcttatataatctctccccccaccgccccacaaactgatcaagcttttaattgtattgcttcccctagaagccttagataatgtgcttatactcaaatcgcgacaattattttgacccaggaaggcattccagatgtggtacaggcaaaggcacagagccacagagacaggaccactggatcgttatcatgggagtttcagagtgaaagactggggagcagtcacttctgtagcgcggagttgggttgtaaatgaacaggtattctgaatcttttctttctttttttctcagtattggatgaacgaatatacctcatccattggaattggagtttttcattcaggaattgaagtctatggcagaggtacgtgtacacacagtctaaatatactctctgaagattttgtactttaaaagagttgcaaaatcataactataggtctctctttttttaaccacttgcatatgttattacagaaagtagaagaaaatctccccatattcatttatactgcgttttggaaaaatgcccaaagtagaatgtatttggggagaaagtactcaaaatacaagaatatacatttgcttcattcactttatcttttattctaaatactatgttttaaaaaatattttccttttgtgattgtcataaaatgacagtttgttttgttctcatatatattggagctcctaagaaaccttgcatttcgaaaatagcatgataaaaacaataattttggtcggaaaggttggtgctagaaagtgtcagacttgaaataccaatttcctgagggaatttcagtaataaatttggtttgtagacctatacgtcttataaaatctataagtttttgaagtctaaaaacattgctgagcaaatcctgccatgattacatctaatcatgccctttgtcattaactcagcccttttcattctccttattaaaaccctttattaggataaacatgtcaggagtcactcaaaccaagcagctgtgttttcaacagtttttttccactgtgctaattcctactcttgatgcaagataatctacccctgatcaagttgtaactaatagtaatggtctgcgtaagacagatcacattgctgatttcattcaatgtatcattttgaattataaactaaccctatagcagaaatgcctttgttcgcttcagctaggcagtctttgtgacctcttaagaatatattattgcagtttactgagggttacccctgaacactatacaccagttttaaccaatacaaagaaaagactcatttacttaaatgtgtcagtatggtggttatactcttttttatattccattttacctgcttccaggtgaagtttagcatattaaatgttggctataaaaatctgccatttaagctctattttacttgaaagtctgcatctaccaaataatcccaggaaatactgaggggctcttgctggaagtttcatgcttgggagtattgctgtgggtgggatcatagtctgtggggttactcttttggctgatttggcttttgccaaatttgcatgtgtatttcttgaatttgtgtgatgtgttactgttcttaaaatgccatcaagttttgaaccacatgatcatggtgggttaggtaagggcaggtgccatcttctccatttttcagctgaagaaactgaggcccaaacctgctggaagtcatcatgctaataattaactcaaacttgaacccaaatgttcttgtatgctagtccgtggctctattatctccctaatcattgctccccttcataaaattatttagtaataattagaaacatgtttcaaaacatgttcatgtaaatttagtaaagctagaatcaaatattaatatattcctgaaaattagtgattgctttttaaataaaagaatgggtctgtgactttccgtactataattgagaaagttaagaatccaaatataatcttatcccttccaacctgataatctacaatattttgtaaaattttgtcactaaaaaactttaaaaattatgtttcaaaatagccactttatttctcaaactacatcattgctttttttgaacaggtctgaattaaaagtaaatttagtatctgcctgttctttcctgtgctttgttctaagaccttttaaggtatatttttaaagtgatgaagttgatttaagcatggtttggaattctttaaatttgtctactaagacttagccactgaaatatctaagtgaaataacagaaaattacaggaattttttatctaaaattattctccattttgttctccagagtttgtatctgatgtacattttgtattggatgtacagtcaaaaaatagtttatcctagctaaaagacttgctgtggtgattggatgggagggtggatgggtatgtgtgttaatttggcagtttatttttttcttacatgaagagaattgagtagtgttttaggtttggtaatgttccaccctactcaaagataaaccaatagtctttatcccagaaaccatgaaactcactgttactagacagtttctccagtaagatatgtgtttgaaattggatcactttaacttagaaagtggcaaaacactgaactgaccacctgcctagactggcatgatatagacaggcagagagaactgtatatacctctgtgtgttgatcactctcttcctgccatgataagaaagggaaatatggcaggcaagaatatctttgagtgtcttctgttatttgagtttcgggtcttttgtgacaactgtttatacgagtaatagctaagtgagatatttgtgaaagcattttataaactgaaaaatatttagatggtgtcactgttatcctcaattattaaagctaattcagcattctggttaaattttatgtgatacatactaaaaatcatgagttttctcttttcagaatttgcttatggtggccatccttaccccttttctggaatatttgaaatttccccaggaaatgcttctgaactaggagaaacatttaaatttaagtaagtagggaggataatttttattacactgtcttaggtgccatagcttgttttcaggtatacagaattcattctgtaaatcaaaacaaacccaagaagttaaaaatgtctctttgttttaattgctgacattttatataactcaagtttgcctcaggaaactcatttcttttccttttttttttgagatggagtctcactctgtctcccaggctggagagaagtggcgtgatctcagctcactgcagcgtccgccttctaggttcaagcgattctcctgcctcaggctcccaagtagctgggattacaggcgtgcaccacgacgtccggctaatttttgtatttttagtagagatggagtttcgccatgttggccaggctagtcttgaactcctgacctcaggtgatccacctgcctcggcctcccaaagtgctgggattacaggcgtgagccaccacgcccagcccaggaaactcctttctaatgatttcttcccctcaatctcctgtttgaaaggagaaaaagttttattgtgacctacctagcaaattaaaaatgtctttattgtcccaatgaaagggacactttacacgtttgaaataattaaacagttgattagcgtagaatccattgttaaggtacatgtattacatgtaatgataaacctaaaatatatggatgtaagtgttcactggagtcttacgagtaataaaaagcagtgagaatataattttttttatttatactttaagttctagggtacatgtgcacaacgtgcaggtttgttacataggtatccatgtgtcatgttggtttgcagcacccatgatctcatcatttacattaggtatttctcctaatgctatccctcccccaggctcccaccccgcgacaggccctggtgtgtgatgttccccgccctgtgtccaagtgttctcatcgttcagttcccacctatgagtgagaacatacggtgtttggttttctgtccttgtgatagtttgctgagaatgagaatataaatgttaataataaaattttcattccttaattgaggtttgtatttaaagtgatatttagggccgggtgcagtggctcatgcctgtaatcccagcactttgggaggccaaggcaggcggatcacctgaggtcaggagttcgagatcagcctgggcaacacggtgaaaccccgtctctactaaaaatataaaattagccaggcatggtggtacatgcctgtaatcccagctactcgggaggctgaggcaggagaattgcttgaacctgggaggcagaggatgcggtgagctgaggtcgcgccattgcactccagcctgggcaacaagagtaaatctccgtctcaccaaaaaaaaaaaaaaaaagtgatatttagaatgtgagtttcaaggagctttaaacttctgggcctataatagatggcttgccaagtgaaaaagagacagtgaaatgaggttccaacattaaacttcagtagagagctacacattaagccctctactaagttcatagttctcttagcctatcactgaattgaaagattttcgcacgtaagtgctatgataccatcctgaatccactccttcgggctctcttttggcaagactacttgataaaaggattttctaagtattttcaggttccttggatgccttttatctgactaaaattccactttctcttggataatgtctgtcgcctttccaaggtagtagtttggagtccttttaatttttgtttgtttagagatggagtcttgctctgtcaccctggctggagtacagtggtacgatctcggctcactgcaacctctgcctcctgcgttcaagcgattcttccgcctcagcctcccaagtagctgggattacaggcacctgccatcatgcccgactaatttttgtattgttttagagacgggggtttcaccgtgttggccaggctggtctcgaactcctgacctcaggtgatctgcccacctcggcctcccaaagtgctgggattacaggcgtgagccgccatacccggccagggtccttctttttaaaaaacgtttagtcagatttgacagtttgtctcattgcagcacagtgacagataacttaaaagtttgtttctaggtgacattatggccagcccttaaatggcaagtgaaattacgcaggaatatttgcagcatggatctggttccctaataatataactgctaatacaatagttgtgaaaataactgtaatattacatgttacataaggacatatatttcataaagaaaatgacttgtgcttttgtagtattcataggtaatatacttaagagtttattgcagaaaagtagaaactaaaataggacttttaaagtatcttgtttcacttttagtcttgttatattaaccctgatttgttatgtcgatcataatattcctggaaataagcaagtatttaaacatgctttttataaatatttgacacaactatgtccttatttttctttctcttttttttctttttgttctttaagagaagctgttgttttagggagcacggacttcctagaagatgatatagaaaaaattgtagaagaactgggaaaagaatacaaaggcaatgcttatcatttaatgcataaaaactgcaatcatttttcttcagctttatcagaggtaagctaaattttatcctaaaagttcttcaaataaatatttgctatcccactatacttgatatcccactatattcgatcttgattcacttcttttccgattttttgtgttgtatgaaatatggtattgtatttcaatcttgtatgaatgacctttccagagttggtaacttgagagtccgcagttttaaatggtaattctattcattactttgcagtgggtagagagtaagtacaaataatggtcccttcttactctattttattataacctgaaactttcactttaaaaaagtaaatgcctagaaacttctgcttcttagccactaaggtttctctttggctgaatttttttttctggctcttattaataagtaattcgtgtcttccatcttgaaattttcttctgctaacataacacataggcacttacttgccttctcaattcttgaatcccaagcagaagatcaaaactaggtcaaaattaaagaactataaaaagaaaatggaggaaagaaattagaaagattataaagtaaggtctagggaattggcacttgaagcagcttcccagctttctgattcttagcagatggttacagtggcagcgtccaggtgccacagaaactgtgaagggtgtaaaggagagaacgagctgctgcttcagtggcctcctctgcagaaatgcttcgctccttggccctttttacttccctcatggcttctacaatacagctttcagacaactctcacagactgttaccatgctactcaaagtgtgtttcatggaccagcagcatcagcatctcctagtaatttgtgagatatgtattatctctgccccaccagagatacactgaatgcaaatcttcactttaacaagatccccagatgactcatatgaacgtgaaggttcaagaaacactctagtctagcggatgcatcagtaccgtagaagtgacctagtcagtcttcaggcagggggaaggtagttctgagctttcttgaccccaggcattacatttgtatggaatgctttcaaagatctgttgagtgctaaaattagtggagaaatagacagcatcctaatccactctatttttcagacaaggaaacagaccccaattgggaaaatgacttatcaaagaagattgtcatagagaattcagactagaccggacttcttactccagtgcttattatattttaccattacttcctctggttctaattcatcctgtccttcaaaaacattaagaacgttattgagcatctataccaccacatcagccctggtctaaccccaaaaccattttgcatttggggcccaaagagcaattctggatgtccctggagccatctttttaggccacagtttttatgcttttccccatatgagtgctgaattgtttgttcttttttttttttgagatgcagttttgctctttgtcacccaggctggagtgcagtgggaccatcttggctcaccacaacctctgcctcccaggttcaagcgattctcctgcctcagcctcccgagtagctgggactataggcacccgccaccacgcctggctaatttcgtatttttagtagaggcagggtttctccatgttggttaggctggtctcgaactcctgacctcaagtgatccgcccgcctcagcctcccaaagtgctgggattacaggcgtgagccacggcgcccagcctaacgctgaattgttaagctggaagacccagaagttaagtgacttgacccaaggttacctagcctgttggtggcagtgctggaactagaattctggatagtgagggataaggagctattataataaaatatggtatatattccattaaatggaaataccagctcttgccgattgtgaaatgtaaaagctacctttggaatttgaaatgatagatgcaactcccatataacgaagacaagcaaattaatattaggcactctaatgaagtttagtaaaactggtatgcttttatatctttgacaacatagtgtggggacgtatgtcataagcagttgcaaataagcaaaatcatcactatattaataattgattgttgatatatgtacttttctgttaaattgttcttaaaaattctaagaattatcatttaacaccgtaatgttatcagttccgatgcttcctctacagcagggattagcaaactactatagcctggcctttgaaccaacaccagcgtgtcatctgtccttgtacagcctgcaggctaaaatggtttttacattctttttaaggactgaaaaaagccaaaagagtattatatggtgacatgtataaattatgtaaagttcaaactttagtattcataaaatttttttttttaaaccggaacatctattgcattactcatcgttgaaattcttaagatgaactggatgctgcagcagctgccctcttgggtttaggtggtgttccttcacggaatctgtgcctgaatctgcggtctacaatttttaggtgcctcattcgaccagtcccagtggtattttgtcttttagccttggcactgccgttatactttctcttgcgcttggcggggtagccacatttgccacaggtcaacttctgaaggtggtaggccttagagccacagcagtggcacgtgtgcgtcttattgcgacgctttccaaacgatgatgttgccttcgtcaccttgcttctgtggctaagaccagagagattcattaagttttattagaacacagccatgcttatttgtttacctgtttccttgactgctttccggctgcagtggcagagttgagtagctgcagcaaagatttatggcctataaagcccaaaatatttattgtttgacctttaacagaaaaagtttgccagcctctactctgcaagataggtcccttcgaattgggtgctaagtggcttaaacattgaggaaacgttatcttacaaaacaagtccagaataaggcaggctccattccaatgtggtcagtgtctcaactgtgagtgtcatagggatgtaaggtctttattcatttctctaagctgccatccttgggatgttggccccaccggcaggccagctccctttatggtttcagatagaggcaacaattttaacacaaccaccagagaaagaccatgtctctctccctttggaaacagtggaactctttctggaactcccttttccctacccttccaaaagcagccatgttttacagccagaattgtgtcagatgcctaattatgaacctctcactagcaaaaggactggcattaccattactaaatgccactcgtctaatctaaatgtctttttaaaattaatattttcggccaggcatggtggctcacacctgtaatcccagcactttgggaggccaaggtcgggggatcacaaggtcaagagatcaagaccatcctggccaacatgttgaaacctcatctctaactaaaaatataaaaattagctgggcgtggtggcgggcacctgtaatcccagctactcaggaggctgaggcaggagaatcacttgaacccaggaggcagaggttgcagtgagcagagatggtgctgttgcactccatcctgggcaacaggagcaaaactccatctgaaaaaaataagtaaaattactattttcagtagaaaattcaaaacatataaaagtagaataatataatgagcccctatataactgtaacttagataccactccagccccaaattgttttgaaacaaatcccagatttcatttagagacagggtcttgctgttgccccggctggggtgcagtaatgtgatcatagttcattgcagctgggaactcaggctcaagtgagcctcctgcctcagcctcccaagtagctggagctacaggtacatgccactatgtacagcttttgtattttttgtgaagatggagttgcattatattgcccaggctggtctggaactcctggactcaagcaatcctcccacctcagcctcccaaaatcctgggattacctgcatgagccactgcacctggcctaatttcaattataaatatttcactctgtatctctaaaagataaagattctttttaacataaccacatgatgtcatcactcctaaaattaactcctaaaattatgttatcactccacaaattaacactatttcttaatattatccaaataaacaacgttcagatttccccagttgtcataattttttaacggttagtttgaatccaaatctaaacaaaagttcatacagctggtcaccctgagatacattccccatagaaaaggcaagatagctgggcacagtggctcacgcctgtaatcccagtactttgggaggctgaggcgggtaggttgcttgagcacacaagttcaagacgagcttgggcaacatggcaaaaccccatctacaaaaaatacaaaaattagctaggcacggtggtgtgtgcctgtagtcccagctgcttgggaggctgaggtaggaggatggcttaagcccaggaggcagaggttgcagtgaaccaagatggtaccactgcactccagcctgggtgatagggcaagatagatgctttcttcccccctttacttgttttcaaaaaacaagttggttcctatacagaagagttaactaccatcataggcctaaaactgctgtccttagaaaggcctgcctgcaggattggtcctgagctggcatctgcgagcttggacttctgtaaggttctcatcattcccagaactgagaagagtggctccctttgcctaacctgtttgtacaactaatttggtttatgctgaaaacctgctttccctctgggactctgggattttggcagaggacgcctgcatgaccagcccccaatagaagtctcgggttctgagtctgtaatgatcttccctggtagacatttcatatatgttgtcacagaccattgctggggggattaagcatgcacatcctacctgactctattaggagaggatccttaaagcttgtgcctgctttcctctggactttgccccaagtatattttccttttgctgattttgttttgtacctttttgttgtaataagtcatagtcatgagtatgctatgctgattcctgagtcctagcaaatcaccaaaacggggcggttgtggagacctttgactcacagaaatataacagaaggactggcaaggcacggtggctcatgcctgtaatcccagcattttgggaggttgaggcgggcagatcacttgaggtcaggagtttgagaccagcctggccaacttggtgaaaccccgtctctaccaaaaaatgtaaaaaattagcctggtgtgtggcacacacctgtaatcccagctactcaggaggtggaagttacaatgagctgagatcgtgccactgcactccaacctgggtgacagagggagcctctgtctcaaaaaaaaaaaaaaaaaggactgagaaaagaaaggatgaaatgggtagaggtatggaaaacctttgatgtctggatggctgtggagttatccatgatatgaaatagcagctgagctgttgcctgttatgaaaggtaaaagttacctgtcgaatttcaaatgatagatccaactccaggagaactgactcactagatcacctggctacttttggccatgctggttacagtgaggagaaaaaagaagtgtagcccaggtaataccttcagtttttgttctctcctcccggaagaaagaaaaaaggcccaaaaattcccaaagatgagctttggttgggccaaaaatgttaaacatttatggcactctttcctcacaagtaggaggaaaaaaggttgaatcagttctcagggctggagcaaagtaaaaaagggcagaggacatccttcagttgttagcctacctgcacgccctcaaccccattccagatagggtctcctccgcaactgtaatattaaaccttttgctaaatttactgcaaggggtcgaatacatctgcagtgaggaaggtgccgggccagggtggggtagcgggggcagttaatggccttgtattttgcagttattacatctatggatatacgatagaagttgatgtaaaatgttttatgcttgtaatgtcgcagatgcgagggggattagctcagtaaggcaatgctgcaaagaagttgttagtgggacgcagcttccttgctttttgctgctgtaggatagacggaaatttaaatcgtttgttgaaagcaaaatatgtctcacagccgatgatatttactatgatttttgcccattggagcctctggaaaaaggaagacatacacttctaaacatttttaaagcagtttttaattgcaagtgagctcatataaaatcagatgtctgaccctagaggctggtgattttctagcctgatgtgcataattttgagtgggtcttagaaagcacttaggaaagctttgctttttgcttggccttggaaacatgactggcccttcagcatctcagctttactgctgccaaagaaaagtctctggcatattttggaatcctgaattcatagatcctagttgcttggacttgacgcttgagctaaaacttgacattgcctcctacacactatttcagtctcagcacaagctgtgttaaactgaaagagatacaggctcagggaagacgacttctatttggggatcaaggcagattcaggatacccctctgtggggctcttcactataaaaaatggatgttgatggaactacgtggattatcacaggtgtccatgggaaccggcttctctggtgggaccatacgaagtcgaactgctgatctgttctgtatttctgatacagggactgattacattcctaacttgtgattactgacaaaagctacatgttgaggggaaagcatatcactaggactgtgacccctgtgcctacccatcttactctctacctcttaggaaagtttcactgtgtttacttgggacttctggactagctgccgtttgcaacagtggacttaccagtttgccactactctgctacctttctactggtgcacacaccttagtaaggcagtttgattactaaatgcagctgtctccagaaatggaatgatgctataggccacttactaaatgaatgatcaggaggaaagcagtgagtggctctctaaaaccattttgaaatattttgaaaattcaggatttaattctgaccagttctgaaaatggcatgtctttctggttacattatataaaaatattttctggccaggtgcggtggctcatgcctgtaatcccaacgctttaggaggcccaggcaggcagatcacgaggtcaagagatcgagaccatcctggccaacaggatgtacaacaggatgtactaaaaatacagaaattagccgggcatggtggcgcggacctgtagtcccagctactcgggaggctgaggcaggagaattccttgaatacaggagggggaggttgcagggagccgagattgtgccactgcactccagcctagcaacagagtgagactgtctcaaaaaaaaaaaaaaaaaaaaaaaaaaaaaaaaaaaaaattctgtgaaaacttttgtcccgctttaatatatcccttccagacaaaaggtctggatgagagtagaggacaattttttaaatgcgaagctatgactgctaaatgggacatactgattttgtaacaacaacaaaaaacaaaccctggcacctagggaatctcaaaggaggcaaagactgatcatctttgtttttcaatactgcctttccgctcttccctaaaaacttccatgctacctttttaagatgctgcaagcactttgaattcaaacagcctgctgagcctgtgctcaaacctatgagagcagggagtggcctcagctcctgcacttcccacacggaacacctccagatgtcatccacagtcgtgaggctgataacctgatgtcatggaccaacatggaactgactgtcttcaggtagtccctctgaaacaaaaactcaaactaagttttcaggctggagtggaaacctgttttcctctacactttaccccatgcaccttttcgcttgccaattttgtttcataccctttcgctgtggtaagtcctacctgtgaatacagctatatgctatgtcctatgagtcctctaaaatcatcaaacctcgaggtggaaaaactgggtcttgggcatccctgacacagttccctagtattctctaagtggttttttctccccacaaaatagtttttgttttgaaaatttagcatcgtgaatatctcctccccagatttaaaagtattttcgtttcggatcagtgtaatgactgtttttgtcccatctttgatgcatgggagcctcttcaagttggctcataagtcttttgatttgtccctagtaatcttctacagcgttttgttatctggtatgacaagatattccaggctcatctacatattttctacctcagaactgtttccttctaatagcaaatatttagaaacttttatctgggcattcaggttgctcactactactgaattgataattgtttctagctcctcacccccaccagtagatgaaactaggacttttttacaggttcatagtgacgtttctactacaaatctgggctacagaatttttacttaacctcatcaatgagatagctacattttatctttcccatgtcagaaatctaaattctcagcaacaagaaacataattgctcatttgttttactcctctatacctaaaacagctgtagaataatagtgttaccataagcaccaccaatatgagtatagaaggttaaggttttttgttgttctttcatctttagattgtgacttaatagatacagtaaaattcatgtgttttacagttaattggaatttatttctatgtggttatgatatttagctgaggagatttccaagcaaagtgtagaaggtgcagcctgccttgttgcttatagtaaaatgtgagaacaacaatagagggaagaactattaaagcacaagaaggaatcaacatttaatgatttaggaaatttttcagcctatctagattgcaaaagatgcgaaattaggagcttcactattaggaaaggatgctacagagaaagccaagggcatgactggaccaccttcccctccacccccccccccccccccccgcccttttaactgctgaagaaattaaatatgtgactcgtggatcatctcaaccatctcgacagaaaccaagaatggagatgggattattcaggaacgatctgtggaggaacatcttttctaatggagtcaatcccatgacatacgcaagagatccacaatgtttggagaatggtatattagcagaaacactgccagcttggactgaaagagacagagaggggacaaaattaaagaagatgctttgactgtcaaaattctataggcaggtaactggccggagaaaaaggatgattcagaggatagaatctccagatggcagagccaagggccatagaagattattcccaggccttgaaacctaatgttggagtccagaattgtttgggactagtaactcctttcttccttccattttctcccttttggaacgggaatgtctataaattttattctctgcctgttccactattatattttgggagcatcctatatatgcttttctccattttgcttttttcactaatagtatatcctggagtacattctgtaacagtatatagaaatattcctcacttctttttttagctgaatagtcttccttgtgtggatgtaccataatttattcaacctgttaatggcacttggttaattttagtcttttgctgttacaaaaagtgttgtaatgaataaccctgtacatacatctttttatttttaccactatatgtgtacgcttgattttctagaagagggattgctggattggagcttaaatgcaaaatttcattttgctatataaaccaaatactatttgatcactagccacctaagaaatacattttgcattgtgacccagtttacacacacacaggcatgtaactaagatgtgtcatggttacctcgctacctccaatctgttttgttttaaaaattcaggtagcaatgctaagtgacctactaatgggtcatgactcaaagttttaaaaacattggcttggctgggcacggtggctcacgcctgtaatcccgacactttgggaggctgaggcaggcagatcacctgaggtcaggagtttgagaccagcctggccaacatggtgaaacgccgtctctactaaaaatacaaaagttagccaggtgtggtggtgcatgcctatgatcccatctactcgggaggctgaggcaagaggatcgcctgaacctggcaggtggagattgcagcgagcccagattgtgccactgcactccagcctcagtaacagaccaagactccatctcaaaaaataaataaataaataaataaatggcttgaccaaggattggtacacttttatttgaaagagccagataataaatattttaggcttgtggactattcatagtcccaactctgcctctgccattgtagcctaagaggtataggggatacataaaccaatagacacggctgtgtttcagtaaaactatctacaaaaccaagtggctatagataggactctgttgtaggctaatcaagccacaccctcaggggttggaatgaagtcagcttcacctgtagcacatggatatatggaggagggtagattactgaatgaaattaggacttgggaaggagaatgagggaaatggctgttgaataggcaacagtcgctatcacattaactaaatagtcttagtcatgacttacatgattaacctctaaataggcagatagccctaatatgtcccaggtgtaaagtacaatgtaatatttgtttgccagcgcttttttttttttttttggtgagacgaagtcttgctctgtcacccaggctggagtgcagtggcacgatctcagctcactgccacctctgcctcctgggttcaagcaattctcctgcctcagcctcctgagtagctgtgattacaggtgtgtgccaccacacctggctaatttttgtatttttagtagagatgaggtttcactatgttggccaggctggtctcgaactgctgacctcaagtgatccacctacctctgcctcccaaagtgctgggattacaggcataagataccacctcacctgcccggcctgtttggcagtgtttttaagagcagatgtagttcatatacattcttttttgtttgttttgtttttgagatggaatctcactttgtcatccaggctgtagtgcagtggcacagtcttggctctctgcagcttcaacctcctgggcccaggcaatccccctgccctagcctcccaagtagctgaggctacaggcacacaccaccatacccagcaaatttgtgtgtgtgtaaacaaggtcttactatgttgcccagggtggtcttgaactcctggtctcaagtaatcctcctgccttggacttccaaagtacagagattacaggcatgagccaccatgcctggcctcatgtacacttttttttttttttttgagacagagtcttgctctgttgccccggctggagtgcagtggtgcgatctcggctcactgcaagctccgcctcccagattcacgccattctcctgcctcagcctcccgagtagctgggactacaggtgcccgccaccacgcctagctaattttttgtatgtttagtagagatggggtttcactgtgttagccaggatggtctcgatctcctgacctcatgatctgcccgcctcggcctcccaaagtgctgggaattacaggtgtgagccaccgcgctgggccgaaatatttttaagtgtctacctctctgtactcacaggcagtgtgataggtgcttggtaatcaaaagtggttagcacatgctaccttccctcaagtgagaccatctgactttccctatagttaagatagagacatactatttaaaataaatgtaataagcattaagaggtagggctaaacttttagggagaaaaggtacacgttgtataattataggtgccaacttattaaattttagctaatttttagacataaggtactgtgaaacccctttccaaagttattacctaagatatgcaaatatctaagatggtacttggagatcacatgatcataatctttggtataattggaggcaaaaacaacaaagtggcagtggggcatgaacggcagcccagtccattgtctgcacaagagaaaaaggataataaagaataaagttaggggcacagaatagacccagttcttactatttgaaataggagcggggggaagggttcaagagtcctaaggacagtataaggacaggaagtgggcaactatagaagcagcagatcatcagcgggcagggattcctcctggcacttgtattctatcccgctagtgtcttcagactgaagcatggccaggcttccatgccttgtctgactctaggcctacttctgcagaggagtcacagagccaggtcgtcatctgggaaaacactttgtgtgtgtgtgagacggagtctcactctgttgcctaggctggagtgcagtggcgtgatgtcagctcactgcaacctccgcctcccgggttcaggtgattctcctgccccagcctcccgagtatctgggaatacaggtgtgcaccaccatgcccggctaattttttgtatttttggtagagacagggtttcaccatactggccaggctggtctcgaactcctgacctcgtaattcaccggcctcagcctcccaaagtgctggtattacaggtgtgagccaccgcgcctggcccacacttttttaatttgagacactcttatcacccaggctgttttttctggaccaggatgagccccttgaaacaagtgggtcagggagagaagtaaaggggtaaaatgtagaccaggagaaatggagtgatagacactggagaaaaggggaaagtcaaaaagaatctgtgaaaaagaagaattcacaaataggaaaatatccaagattgactcttccaattgcctggggcttctattactctaataatatattgtattaacaagcgtcttctgtgtgttcaaagtacttttcagtgtgtctcacagcagttgcagagatcaaagaaaggagccaagtgaaattagcttgatttcacagatatgaaaagtaagcaacttgacaaggttctttagaaaggaaggaatggagccaacagtagggagcccaggtcctgagtaaagagctgcttgttatcaaaagcctggagtgacaccactgaaggctagtctgccgtggcttctctgtacgccgcccccctcctcccaccctccactccctggcagtggaccaggtaatcttaacctctcttacctaatacagaactctttctcttctgtagattctttgtgggaaagagattcctcgctggatcaatcgacttgcctacttcagctcctgtataccctttctacagagttgcctcccgaaggagtggctcacgcccgcagccctgcagtctagtgtcagccaagaactccaggatgaactggaggaagcagaggatgctgccgcatccgcttccgtggcaagcactgcagcaggctccagacccgggcgccacactaaactataaatgtctccaaagtcacacattcagaactgtctctggcagtcgaatatcactagagaaaagtaaacagagaagcatcctttagatattttgtatgcaaagatggctctcccccaaatcccagtttttcagctcaggattatatttgtaatcaaaaaaaaaaaatcacttggcgcaggagggagaactttgtaagaagctgccctctgttttttttatccactcgtaaatctggatttatttcttctgttttatacaagctctgttaagttatgtttacagtatcttgtatcgctgtttacaaatcttgcatggactcctgccacagtgaaagaagaaaatcttcatgtcttcaaaaattaggcaggtaatctttgtatacttctgacaattgccagatctatggcataaataggcacacaaaaaggtacttaaacagttatagtcaccatcacctgcttcagaatggtcttttagatttgtgtttgttttgttaaagttgttggcaccaggatgcagagaatcagactggcctgaggtgaaggagcacacagccctgagggcttggaaccctgggtccagttcctcttcacacccccttccactctgagtagcacatctccccaggtgcccatggaacacctgctttcatcccaaatatccgtccacctaggcggggtggtatgttcttacgtctctctgactttgatgccactcattctatagtttagctggttttcgttcaagatattcttggtagtaactgacaagtatgttgcacatgtattgggggaggcgcttcatttttattttaatacacatgtatttcctccttgcacaggattttgatggtgtgggaatatcctaagtggtagccttccaagtagcagtgagttgacattcagctgcttttaactattcaggctaccttttatactaaaccttgaaaactagaatctaatgtctaccccaaaaaagtagttctttgatattttatactttttatgtaccatgtcagaaagagtatgttggcgtttgtcatgggactcatttcacataatagaatgcctagtctcattgaccaatcgttaaaaaatcatatttgtgtgtcttaagattcatatttatatgttctctcaaatgtatgtctcttacgtaacatactctaagaatgaaactgtcaccacaggtaaatccttgttagcaaggaatctgtctgctccagtctactcctagtttgatccttggatgtaagaaccaagtcattacatgtcaaattcaatttttctgccttaagaatgaatgtccttcataaaatattggatgcagtgtaacactatccaaggcagtgacttcagctttatatacatataaaatatagttagttttaaaattattgacatttatttaaacttttagattggattgtttgctattgctctgtgtgaggatacataatctttcagtaaactgtatttttaacttttccataagctgattttggttcattttatcaacgtaagcacaccctgttcatagggaaaataaaccttgggttataagcattagcctgaggacaatgaagccacttaacctaatttatgctttcgactgttctgtttccagagaggaaagcctttacaaattactctcagttctttaggggcagaaggcttgtttcaagaggtttgacagaagaaaggaatatatgaacttaatgagatgtcgacttggttcaggtctaaaaatgagggcaaaacactaaggctctagcagtgacttgttcactaaaaagagagagtcctgtccccagacggttagtacaaagccttggatacagtttgcttgtaatatttttaataatgtgaggagtacagtgttttctaattcattcaagtatatatgatttaaacctgggctactgacacacacacagtagccattagttagactcttcttagtgaatatcaggaacatcccatctgtgcttaaccagaatccagcaagtcagcacacaagtgattttattgttattttgttgtatttacttgcatttgttgtatttactttcatctgcagcatttggagtttaaaaataatgtaaagggttctagtagaaatagtgtcctaaggccaattacctaccatactaacaatcagcagataaaattctggacgtgagattccttataatctaattatacctgaggttgagcaagaaatgtcttcctttagaaaatctcattcaagtcaggttcttctctacagttcaaaattgagaatggatttaattaactagcatttagccagctttttcttgcccttggagaaaaagaatcattctcaacctgataatctgttaagaaaaatcccatatgaacaatctggtcattaacatacatatgatacggagtctctttgttgtcaccaagtgaacatacttctcatggtgggttggacagtaatacatgttagagggtcagaagcttctggtttctgctgtttgctttaaatacccttggggtttttttttaaacccttacaaggggagcatcagctttggaaagtgtgactctgtaggagtgtagaaggcagtggtgtatgatcttagcctcgtcctgatgcctgaatccagccagctgttgctctgacccacagcaatagagcaagttacccatcaccagcatttgtacagagcagggaattctggttttagtccattggtagcattgtgtgtatgaggagattcaacaccacagacagctgcaggactcgatatccatggcttctttccatcacaaaacgggtagaaacacattcactgcttcagggttctaatctgtgtgtctccttatgactccatttctgtaagctactctgtaactttgatatatgctgtattttctttctttaaaagatttagatgttttttcagcaagctagccatacaaccattgtatctctttctcttcagtatggtttagagcccagatcagttagtaggctttcgttgtcttctctttcaatacatgtacatctttactgtttgaaaagtgttacagctgtcaaagaatcttcatggacctgaagataatttcttgtgaagttgaatgcaagtgtactgtcattcatagtgtttatatcaaaataccaggaatcttcacttttgctaccttgatatagcattgggctatcatgttacaacattgaaatacattgatttattaaaaaatacttttataag

SEQ ID NO: 37693 - DNA, 130504 bp, Homo sapiens
cactgagcggctgcggcgcggcttccatcctcccgccctcctgacgcggccggagcgcagccctgaggcccagggtaagtgagggcggaggcgcgggacgggggcgggaggctctcgggacggcagcgtccagggtccggggtcgcgtagccgcagccgcgggcgtacagggcccgctcgccggccggcctcgggcgtcgcgtggggaccaggccgtggcggctgtcgtgagcgaccccgggcgggcgaccgggctgagggctcacgggcccgggtctttcgagtcgtagcgcccgtcccccgcaggtcgcgcgatccgcgcccatttctcgtggccccccgggctcctgggctgggggcgtggccgagggcagctcggcgcggcggcgttgcgggaaccgggggactccggcccgcgcctcctggttctcggggctgagggggtggctcttgctcctggcgcttgcgtgggcttccctcggggtcacggacgcgacgctgagatgcggggatgggacgtccagaaccactttcctgaggcgcgacggggcgaattcactcagaacttaaggaccccgcgtcccgggcgtcccggaacgcgccgccacaggggttacagtgaggtccgaatccgctccttctcggcgtagacctgcccggtcctccacggcggagccttagtaattgccgctgcctccccgggggcgcctctcgtcacacacctgcggcccacgggcttctgctcagctgtcgctgtgtcagtgacagaaaagtaacgtatcccagtgctttattagtaattactttctgagacggggtctcgctctgttgcccaggttggcgtgcagtggcgcgatgacggctcactagagcctcgacctcccgagtggttgggaccaaaggcttgggccaccatgcccggctcactttttattttgttttgttattttcttttgagaaagagtctctctctgtcacccaggctggagtgcagtggcgcgatctcggctcactgcaacctccgcctcccaggttcaagcgattctcctgcctcagcctcccgagtagctgggactacaggcgcctgccaccacgcctggctattttttttttttttttttttttttggatttttagtagagacggggtttcatcatgttggtccggctggtctggaactcctgacctcgtgatccgcccccttggcctcccaaagtgctgggactgaaggcatgagtcaccgcgcctggccagttttttgtgtgttttagtagagacggggtttcactgtgttgcctaggctggtctcgaactcctgagctcaggcagtccgcccacctcgccctcgcaaagtgttaggattacaggcatgagccaccatgcccggccaattttttattatttgagttggggtcttgctgtgttgctcaggctggtctcgaactcctgacctcaaacaatcctaccgccttggcctcctagtgctgggactgtaggcgtgagctaccgcgccgggacacgtggaagtgttaatagggcttctctctgggttcgtggatgagttgtattcttttttacttatttgtgttgtcattttctttagcagaatatgtgcaataaaataatttctgtaattattctttttattgtttttttgtagacagagtctcactctgtctcccaggctggagtgcagtggcgcgatctcggctcactgcaacctctgcctgccagactcaagtgattctcctgcctcagcatcccgagtagctgggattacaggtgcctgccatcatgcccagctaatttttttgtattgtttgtttgttttgagacggagttttgttcttgttgcccaggctggagtgcaatggcatgatctcggctcactgcaacctccgcctcccgggttcaagcgattctcttgcctcagcttcccaagtagctgggattacaggtgcctgccaccacacctgcctactttttttttttttttaatttttagtagagagggggtttcaacatgttggccaggctggtcttgaactcctgacctcaggtgatctgcccgcctcggcctcccctttgctgggattacaggcatggtgagccactgcacctggcctttttttttgtatttttagtagaaaaatggggtttcaccccccatctctactaaaaatacaaaaaattaatcgggcgtggtggtgggtgcctgtagtcccagctactcgggaggctgaggcaggagaatggggtgaacctgggaggcggagcttgcagtgagcggagattgcgccactgcactccagcctgggcgacagagcgagactctgtctcaaaaaaaaaaaaaaaaaaaaaaagaaaaagaaatagggtttcaccatgttggccaggctggtctcaaactcctgatctcagtgatccacccacttcggcctcccaaagtgctgggattacaggtgtgagccaccgcgcccggccccaatagcttgtttttgtttttgtttttgttgtggagacagggtcttgctctgtcacccaggctggagtgcagtggcatgatcatagctttactgcagctgtgacttcttgagctcaagtgatctcctcccaggtaactgggactataggtgtgtggcaccacgccgtgctaatttttgattttttgtagagacactatctcactgtgttgcccaggcttgtcttgaattcttggactcaagacatcctctggtctcagtctcccaccgtgttggaattacaggtttgagacactgttcccagcctgtttctttttattgttgaggagtactccttggtgtgaacgtaccggtttgtctgttgcccgctgatggaccatttggattgtttccagttctttgttttccatctttttttttaataagggtaacacatgaacagttcacattgaaagatatccaaacaacacagaaatacatagagctcgttaagagttcctttgccctttctccccattcatcagctccccacagctaccaaatttggaattcatttttctgggtttctttccatacatcagaacatgcattctcagtgagggcgatatctccaacaagggagtgaaaattagttattggaagaagggtgaaaaaacttaggcattacagtgatttgtggcctcccgaagatcccagttcctgaacagatgtacagtgtggtatatctgtgtacagctgtagtattaaaattccatggggaggcaattaggagagaaacttatacagatgttccttagcggggccgtggaaaaataaagatcaagaaacaacagtagaatgatggattggggatttataaccttattatttggtgtttgatgaagcacttcttcagtttttcttgaacttctctcacaagctgaaatagatcccacctgttctagtataggagctttggttcataaggttaaggacccactactacctccatgatttaaaatccttggaattgtagcctgttaaatggaagggacattggagacattgaggggaggctttcctgttgatccaccattacagcaccctgacaggtcagttctctgtagtaacatacagtgtgataagccctagacaattttcaaattcagtttagcccacttggtatcattcggaatttatatatttcaggaactagtatggtacttctgtaatgtgccctttggtgggagaataatgaaggttttgttagcatatagatcttgggttagtagcttttaatttgttacgtgacatctagtgttatcatcttatattgaaagtattttttgtaacatttattatgaaaaatttcaaagatacacagagattgaaagaattttgtggttggctgggtggggtggctcacgcctgtaatccaagcactttgggaggctgaggcaggtggatcatatgagatcaggagtttgagaccaccctggccaacgtggtgaaactccgtctgtactaaaaatacaaaaattagccggttgtggtggctcacacctgtagtcccagctactcaggaggctgaggcatgagaatcgcttgagcccaggagacagaggttgcagtgagctgagattgcgccgcagcactcgagtttaggtgactgagtgagactctgtcttaaaaaacaagagaaaattttacggtgaacactagtatacctgccacttagtttccattaaacattttaccatacctgcttcatcatacctttttatccatttgtcttaaaattaaaaaaaaaaaaaccaacacatttcaaaatgtgtgtgtgtcagcgtctctgtagagagttgaattaaaattaggggccaggccaggtgtggtggctcatgcctgtaatcccagcactttgggagattaaggcaggagaattgtttgagccccagtagttcgagaccagcctggggaatatgttgaaaccctgtctatacaaaaaaatacaaaaatttggctgggcgcagtggctcgtgcctgtaatcccagcactttgggaggtcgaaacaggtggatcacttgaggttaggagttggagaccagtctggccaacatagtgaaaccctgtctctattaaaaatacaaaaattggccgggcgtggtggtgtacgcctgtaatcccagctactcaggaggctgaggcaggagaatcgcttgaacccgggaggcggagggcgcagtgagccgaaatcacgccagtgcactccagcctgggtgatagagtgagactccatctcagaaaaaaaaaaaaaaaaaaaaaatgggcgtggtggtgtgtgcctatagtcccagctatttgggaggctgaggtgggaggattgcttgtggccaggagtttaagactagcataggcaacatggtgaaacctcgtctgtacaaaaaatacaaaaattagctggctgtggtggcgtgtaagtcccagctactcaggaggctgaagtgggaggtttgcttgaacctggaaggcagaggttacagtgggccaggattgtgccactatactgcagcctgggtgacagagtgagaccttatgtcaaaaaaagagaaaaaattaggagtaaaaattgagttaaaattagaaacttagtcgttaaaaatttttaaagttgtttagccaccattggtagctttgctatccattaggatacctgtactatgtttttgagaagtgttattttagataaacagtttctttgcattatagttgattgtctttgtttctctaatgtggctataacatcactgaggtcaggaaccatttaataaaattgaagtataatttacatatggtaaaagtttatgctttttttttgagacggagtttcgctcttgttgcccaagctggagtgcaatggtgtgatcttggcttactgcaacctccgcctcctgggttcaagcaattctcttgcctcagcctcccgagtagctgggattacaggtgcgcaccaccatgcccggctaattttgtattattggtagggatggggtttctccacgttggtcaggctggtcttgaactccggacctcaggtgatccacccgcctcagcctcccaaagtgttgggattacgggcgtgagccagcgtgctcatccaagtttatgctttttagtgtatggttgaattttttttcttagtccatttaatgttgccatctgtgtactttttgtttttttgagacagaatctcgctctgttgcccaggctggagtgtagtggtgtgatcttggctcattgcatcctccacctcccaggttcaagggattcttcttcctcagcctcccgagtagctgtgattacaggaacatgcaaccatgcccagctaatttttgtatttttagtagagacgggggtttcaccatgttggccaggctgttctcgaactcctgacctcaggtgatccgcccgcctcggcctcccaaagtgctgggattacaggcatgagtcactgcacccagcccatctgtgtacttttgagagacacattccatcttgtaaccattatcacaaatcaagctgtagctacggttctttacttccccatttcctcatgcatctctctagtcagctccatctccgccttcagcccctgtcaggttctgttctagtctctgtccccaccattctccttgtccggaatgtcatgccagtgacccacgcagccctcggcctctgttacttggcatcttgcacctgagactcaactgtgttgtgggtgtgtcagtggtttgttccttggcgttgctgggttgtgtctgttgtatggctgtatcatggtttgatgtgtctgctcatcaggggaaggtcagttttaatattctgatacgtttcagtgggtccttttctgtatgtttaacttagtgattgtgttatgcaattggtaacctgcttttttcacttaatgtatctggaaattttggttttattacttattttccatctagaacttcaacattggaaatttctgattatgctttttaattttttttgttattctacagtgagtattgtttatgtacagttttttaggttggtaggttaatttccttcgggtagatttctagaagtagggttactaggccaaaggttttggggtcacatgggttcattccactttcctactgctgtatgcagtctactcctacagggcgttttttgggttctgaacccatttgaaatcttttctacaccttcccaaattgcttctgtaattccctttagcaggattagtggagtgccagttgtctgatttaatgtcttggctaagtggatctagggaaatatttattttagtctgtattcctctttttagtagcaaggttggtcattttcctctaagctggttaagtacatgcttttctccttttgtgaactgtctttttttgtccttttttttttttttttttttaggagtctcactcctttgcccaggctggagtgcagtggcaagcccttggctcactgcaacctccacctcctgggttcaagcaattctcctgcctcagcctcccaagtagctgggattacaggcatgtgccaccacgcccggctaattttttgtatttaatagagacagggttttaccatattggtcaggctggtctcaaagtcctgacctcaggtgatccacccacctcagcctcccaaagtgctgggattacaggcatgagccactatgcccagcctctttttgtctttaattaatttttctactgggattttaatgtttttcttaccgatttgtatgagtgctttttatggtattggtaatagctttttgtcgtacctagttcaaatattctttccaagataatttggttttagattttgatgatttactttttgagttttaaacatttaaaaattatcttcaaatctttctattttttcagttacaactttattatttttaaggttaggaaattgaatttccttcagagatttagtaaatactcacttttgtgttcggttttttaatgttttggttttttttttttcctgtcacctaccagaaggaacgttttgatttttctttctttctttttttttttttacattaaatgtaaaacttggaaagttagcttataaaaatgctttatttatttatttatttatttatttgcttgtttgagacagttttggttttgttgcccaggctggagtgcaatggctcagtctcggctcactgcaacctccgcctctcaggttcaagcgattcttctgcctcagcctcccaagtagctgggattacagacgtgtgctaccacgcccagctaatttttgtatttttagtagaaatggggtttcaccatgttggttaggctggtgtcgaactcctgacctccagtgatccgcctatcttggcctcccaaagtgctgggattacaggcatgagccaccagaccccaccatgtaatttattttgatgtatggtttgtgatgagagtttaagttgaatttctcaatgcattaatttgtttttatgacataactttaaaattcctaacccttacctttcccctggttttctgaattactatatgtgagagagtttctttctagccctcattttctcttactgatctcctttgacactctgggaatgtattgtaaggaaataatcccgaatatactctacctatgttaatttagcttttgtgccagtttcacactaatctcctatcataatgtttgtttagtaagatcaggaacagaagcttgttttgaaagtaataagcattgttaactgcccccacctggagctcctgtcccctgcacccactctgatgggctctctgccgggtggtgggaggggcatgctcttgggtgtctctgtggccttgctcttcccttaagatctgtttgttgcagcctgcgtgctgtcttctgactccatcttcagaaactaaccatctgatcaaagcatgcctttctgctgctagtttaaatatgcactttttaaatgtttgttaggaatatgcttgtgcatttataaattctgtagtctttgatttcatatatacatgtatttcagccaggtacccaagacttagaagagccttatacgttttgtaacttctttttttggagatggaatcttgttcttcattgcagcatcgatttcctgggctcaggcggtctcctttggcctcctgagtagctgagactaaggctgctacattgccaccatggctggctaatttttgtatttttcttgtagagatggggtctcactatgttgcctaggctggtcttgtacacctgacctcaagtgatcctcctgtctcagcctccccaggtgctggcattacaggtgtgagccaccatgcctggccattttttatcttctgtagattcatggtttttaaaaatccgttgtccattttctcacagagataagcagtgatgtccttgcgatgaacaaggggtcttgtttgtcttggagtaagcaagaagaagctccctgatagctgtccagccagggttgaggtgaaggcacctcaagaagacaggggcacctgggtgtgtccagcaggactggagaagtctgaatggtggcacccaggtcaagctggcttctgtggcaggcctaagtgtgaactggaacattgcggagtggtgtggctcctcacccactggctcagtgctaaactgtgccaccaagagtccatctgcttcccttgaaaacttgaatgagatttttgctcctttatgacagaagttagctattaaatagattgaagcagcagctgcccccttgatgtgggacagtgtccaacctctcctcttggaacgctggcactgatttgggtgccaggtgccactcaccattgcgtttgcacccttgcttctcttaggggagaaagagcgaccacagtggggaacagacggggctgcagtggtggggctcactgcttatctttagtcctcctttcccctgtagatactggagtctgtagcccaggtctgaccctgtctcaccacaggattacccttgtctgctccatcctctgcttcatcctgtcctgaaacctgactttcctcagtggccccttctgctcctcccctgctgtttctcatccacttgtgctcagcagcgtttgggttacagctcctttgagattgtggtacagcctcccagagagtttgcaaagccagaaaggcaactcaccccagagtgagagccaggtcctggccatctccttctctctcccttgagaccttctcacagtttcttctcttcgtgtgttcttagggagaatgttgagatctgaggctgttccctaccttccactccaggacttggtgtcatgttttctcctagctcctggcacaggctggcagcctccccagggcaaggactgtcttacccgtgtctgtctctactctcctgcagtagccccgggcctgacacacaaatggggctctgtgtctttgaattggatttacaagaggagagtttgcagttgaggtagtcctggaggttgataagaactactggctggggagggctgggtatttgcttctggcgaggtggtgctgcacaccctcattcagcaagggtcacagaatgcctcctgggctctgggcagctgggagcagggagttgtccctccatagggagagacgggcggaagccggaaagtccacagcgtgaatgttggcttcagaccttgctcttctgcctgctggctgcgtggccttgaacagctcacagatactcctgtagctcagtctcctagtccttcaaatggggtgtgagtagtacctaccccacagggcggccatgaggatttgagggatggcctggtctctccaagcgcccacacaagttagctgttgaggtcagcgatgatcggtatgttcctccctcagtaggtggtttagattacccacccactcccgtgtggcccaccctgggcacagcagtgactgaggacacatttctccagctgtgccatattgaatgtgagtcagctctgtcgtttgaatcagatgcggtgggaatgtactttcaaagtgtcttttcagtgctgttaagtgtcaataaaacagttatgtgtgccttcaagtgacttgattttaattttaatttttaggagaacgacacattggatacagaagggaggtgatcatgcaccatggcactggcccccagaacgtccagcatcagctgcagaggtccagggcctgccctggcagcgagggtgaggagcagccggcccaccccaacccacccccgtcccccgcagctcccttcgctccctcagcaagcccgtcggcaccccagtctcccagttatcaaatacagcagctgatgaataggagccctgcaaccgggcagaacgtgaacatcaccctgcagagcgtgggccctgtcgtcgggggaaaccagcagatcacactggccccactgccgctccccagccccacctctccaggcttccagttcagcgctcagcctcggcggtttgagcatgggtctccatcatacattcaggtcacgtcccccttgtcccagcaggtccagacccagagtcccacgcagcccagtccggggccggggcaggccttgcagaatgtgcgtgcaggtgcccctggccctgggctgggcctctgcagcagcagccctacagggggcttcgtggatgccagcgtgctggtgaggcagatcagcttgagcccctccagtggtggacactttgtgtttcaggatgggtcagggctcacccagatcgcccagggagcccaggttcagctccagcacccgggtacgcccatcacagtccgagagcggagaccctcccagccccacacacagtcagggggcaccatccaccacctgggaccccagagccctgcagccgcgggtggggccggcctgcagcccctggccagcccaagccacatcaccacggctaacttgccaccgcagatcagcagcatcatccagggccagctggttcagcagcagcaggtgctgcaggggccgccgctgccccggcccctgggcttcgagaggacacccggcgtgctgctccccggggctgggggcgcagcggggtttgggatgacgtccccacccccgcccaccagcccttccaggactgccgtgcccccaggcctttccagcctcccactcacgtctgtggggaacacgggaatgaagaaggttcccaagaagttagaggagattcccccagcctctccggagatggcacagatgaggaagcagtgcctggactatcattaccaggagatgcaggctctgaaggaggtcttcaaggagtatttgattgaactgtttttcttgcaacactttcaagggaacatgatggatttcttagctttcaagaagaaacattatgccccattacaagcatatcttaggcagaatgatttggacattgaagaagaggaggaggaggaggaagaggaggaagaaaaatctgaggttatcaatgacgaggtaagaaacaggagttaatttgtttagtacaaatcttctagatgatcagagtctatgcgacaatgaattaagtaataatttattgagcctgcggtatttctaaggtatttctaaggtgttggggcaaggatttgacccataagtaaaagtgaagaatgtgtttggcctccttcatgggaaggaagagctgttgagcgcagaagtgtgtcaggaggaagggacggagctgcgctatgatgagtgcgtcttcaacacccagtgttttcattgagcaccaaggattcatctcaggttcagagaactcagcaagcgtgtccagtttttttccccttgtatctgggtgtgtggtttgttggctgacgctgacagctgtcaccagccaaacgtgtgaaagcccagcaccctttgtctggttttccaagtttcacattttactcgtatagatctccttaaaaacaccatcagcatggttttcaaacagatttaagtcactagctttttataataaccagccataagtcactagatgtatgtatatgggaccttcatcattaaaatagttattatggcaaaaaactgtttgagaagttattcaatttttagatgtagtctcaagatttgagatcatactttaaactcatttttacaaatacctattaagtgatatttaagagtgactcttttttagagagtatactttttgggtgcctggaatggcacataataaaccccctacctgagatttcttagtaccatggtgagtctgagacttcctgaaaaccagggtgagagtgaattggactgtgacacactgtattttgtgcctttgtgttgtgtagtgtatactatgttggtggagcttattttgttttatgatacagttaaaataatttaaatctttgtcagctcttctgcaaagaaatctgcttttgctgaacaaaagctagtctctttgctcaagcagtccttactggtatctatggatgtatttgtgtggctttgccattttgtgttttcttttaacaccttttccaggatggaccatatttgtttttcaacaggtttatatgattattttgaggatttcacctctattgtcctgaaatagtaaaattcatttctgttacgtttgtataccaatgttgtctgtaagctcaatcccccttacctgtgcttagaaagaaaaacaaattcgtttttccaacttcctgctgaaaaagacctttgccattctgaccctacatataacagagtggctattctgcaaatttcctagggagttggtagggctttgttacttgaagtctgtctgccatatgcatttttaaagtttgaagttgcagaatctaaagatattgcactttgacttaaattggagtttctgcaaggtttgcagtttgagttaggttgttgtgctataaatctgtcagttcagtatcctttcacaggaattgatgcaaaaacattccatttttaaaccccaaatgtcagtgagctatcagcaataaaattctaacaaaattttgagcagttgtaaaaattatgttgcctttttttctcaaaatatttcctctcaggtaaaggttgtgacaggaaaggatgggcagactgggactcccgttgctatagcaacccagcttccgccaaaggtttctgctgctttttcatcccagcagcaaccatttcaggtacttttcgatggttctcaaatgtagtctcatcccaaacttttccttcatccagatattttaaccttcgatatactacttgctcttcagcattttttttccagagcccatttcttatttttcaacagtaaaaaatcttcctgcgtatacaattataaaattaaattgcatgagttaatgatgacacagatcttagtgcattactttctttcgtatacttgtaatgcggtagtagctttagcatgcatgtcatctaatagtcctgttgaatgtatgctcaggattccttgtgtgctgtgttttcaatgttggttctttcttgtgtcctttattttgagaacagtgcaaaacagaataagaaaaaaaagattcaagtagatgataaattggtattttccatagctagaggaaatgctgaagtgaaatacacttctgaaatcatcaggaccacaggcttctaaacggatattaagtgaatgcaaactgattatttttaattttttgcaaattcactcagtgttaaattagtaatgccaataatttaaaaacacaggtcactcacgcctgtaatcccagcactttgggagactgaggtgcatggatcacctgaggtcaggaattcgagaccagcctagccaacagggtgaaatgctgtccctactaaaactatgaaaattagctgggcatggtggtgcatgcctataatcccggctactcaggaggctgaggcaggagaattgcttgaacctgggaggcggaggttgcagtgagccgagattgtgtcactgcactccagcctgggcagtagagcaggactccgtctcaaaaacaaacaaacaaacaaacaaaaaccaaacaaaccatcaaatttctactagctttggaatagatagtgttgggttgtgaaagcagtttcatccttgggatttttgttgttactttaaattttgatttaatttcaaatgtacataatagttgcaattaattattttaaaaaccccttatatcctttaccaaatttatcagttgtttttgccccatttgcattattttcattctcatatatatacacatatctaaaacatcatatcctattcttttatctgtaaatacttcagcatgtattagataagaatgtttccttacctaatcacagtacagtgataaatatcaggaaattgtacagtagtacaataatacattctaatccatagtttatattcaaatttcatctcttgtctcaaggatgtccttcatagtgtttctttccccctagtccagtatcaagttgtcatgcctctctggcctttttaatctgggttggtttcttagtctttcatgaccttggctttggcctgggcctgggcgttaaaaagtacagaccaattattttgtacagtgtcctttgatgtgggattgtctgatgttttcttgtgtcctctttggatcatgtatttttgagaagattgctatagaagtaatgatatgtccgtttcaatgtgtcttatcagaagggtgtgatgtcactttgtcctataactagtaatgttaactctgaccacttcgttaaggtggtttctaccaggcctgtccagtggaaatttatttatttttccttttttaaatgatgagtaatttgggggaagatactttgagactatgtaaatatcctgaatctccttaaacttttacccactagttctagcatctgttggtgagtcttgcctgaatcagttattactataaagaatccatgctgggttttctaactccatcattctgtctacatttattagaatcagtaggctgtaatatatcactatcagtatttatttgcttatgtttgtttaaacttatttaatgtacattcagtaaaatgcactgttttttagtctgtacttgtgaattttgacgaatccattgagttgtgtaaccaccaccacagtcaagcaacagaagctccatcacctcccaaaatgttccctcatcaacccttcacgcctcccttgacctttgttctccatcgctaatgattttgccttttccagaatgaatatctatggaatcctagtctgggttgcttttcagtctggcttctttcacttaagataatgcatttcagattcatctactttgttttatttaccattaatttgttctttttattgctgagtgctattccattgtgtgaatgtgccccagtttgtttatccatttaccctttaaagaatatttgggttgtttccagttttcagaatttgggaataaagctgctacaaatgttcacatacagtttttcatgtcaacataggtattcatttcatttggataaatgcctaggagtcaaagagtctctctgaaagtattctggtttgggtggctggctggctgatttcaaaaaaaaaaaaaaagaaaaactaggaatcagatttctgggtatgttgaactttattaagaacccgtccggccgggtgcagtggcacacacctgtaatcccagcactttgggatgctgaggcgggaggattgcttgaggccagaaatttaagaccaacctgggccaggcactgtggttcacgcctgaaatcccagcactttgggaggccaaggtggaggatcacttgaggctgggaatttaagaccagcctggactaggcatgatggctcatgcctgtagtcccagcactttgggaggcctacatgggtggattacctgaggtcagtagagaccagcttggccaacgtggtgaaaccctgtctctgctaaaattgcaaaaatcagctgggcatggtggcacacgcctgtaattccagcttctcaggaggcacgagaattgcttgaacccaggaggcggaggttgcaatgagctgagacagcgccactgcacaccagcctgggccacagagtgataccctacctcaaaaaaaaaaaaaaaaaaaaaaaaagaccaccctgtctctactaaaaattaaaaaattaggccgggcgtggtagctcatgcctgtaatcccagcactttcggaggctgaggcaggcagatcacctgaggtcaggagtttgagaccagcctggccaacatggtgaaactccatctctactaaaaataccacaattagccgggcatggtggcgggcacctgtaatcccagctacttgggaggctgaggcaggagaatcacttgaacttgggaggtggaggttacagtgagccgagttcaccccattgcactccagcctgggtgacaagagtgagacttgtctcaaaaaaaaaaaaaaaaaaaaaacctatgtgtagtgatacacacctgtagtagtcccagctacttggaggctgaggtggaaggattgcttgagtcctggagttcgagggtgcagtgagtcgtggacatgccagtgcactccatcctgggccacagggccacatagtgagaccctgtctcaaaaaaataaaaaggtggctaggtgcggtggctcatgcctgtaattccagcactttgggaggccgaaggggggcggatcacttgaggtcaggagttcgagaccagcctggccaacgtagtgaaaccccgtctctactaaaaatgcaaaaatcagctgggcgtggtagtgggcgcctgtaatcccaactactcgggaggctgaggtaggagaattgcttgaacccaggagatggaggttgcagtgagctgagatcatgccactgcactccagcctgggtgacagagcaagactctgactcaaaaaaataaataaataaataaaaaggctgggcacagtggctcatgcctgtaatcccagcactttgggaggccgaggctggcagatcagttgaggccaggagttcgagaccagcctgaccaacatagtgaaaccccatctctacttaaaaaaaaaaaaaattagccaggcgtagtggcgtgccgctgtagtcccagctacttgggagtctgaggcaggaaaatctcttgaacctgggaggcggaggttgcagtgagccaagatggcaccactgcactctagcctgggcgacagagtgagactctgtctcaaaaagaaaaaaaaaaaaagattcaaagaaacttccaaactttctcaaagtgcctgtaccattttgtgttcccagtagcaatgtatgatagttctcttcgttttgcttcttctctagtacttgttattgtcagttttcttttttaatcattccaggtctagtttattttaatttggatgtctctgaagactaataaagttgagcattttttcatttgctgttcgtatatctttgacaaagtatctgttcatgtctcacccattttttcagagttattactgcatttgaaaattcttcacataatatggacatgttttttgtcagctacatgttttgcaagtattttttcctgtctttggcttgtttttttcttctcttaagactatctttttcagaacaaaagttttaaattttgtggaagtacaatttatcgtttttttcttttatggatttgcttttgatgccatatctaagagctctgctcaatccagggtcagaaagatgttcttctgtgttgtctcgtagaagttttatagttttacttttagatctatgatttattttgcgtaaaattttgtgtaacatggcaaatataagaaatttgcatgtgaatgttcagttgttccatgccatttcttgaacagacgatctatgtatgttgagttgacttgcacctttgccaaagatgagttgatacttttatggttctgtttctggattctcttctcttcccgtctctttatgtgtttttctctgccagtgtcacactattgtgattactatagctttatgtaagttttgaagtcaagtagtgtgagttctccaagtttgttctcctttttcaaaattattttggtcattctggttcctttccctttttgtatacattttagaatgagcttgttgatatctacaaaacatcttgctgggattttgattagaattgtgttgcgtccattgacctgtttagggaggagtgatatcttaacaatatgagtcttccagtccatgaatatggtgtatctctccatttatttcagtattctttgatttctttcatcaacattttgtaactttcagcataccatatattttcttaggtttatacctcagtattccaattttggggggtattataagtagtacttaaaaaaatttccagctgtttattgtaagtatataggtatacagttgattatttgaacctacattctgcaaccttgctaaactcatttattagttttaggagcttttttgtagattccatgggattctctacatagagaatcatgtctgcaaatagagcaggattttttttctttttcaatctgtatgctttttatttctttacttttcttttttttttttatcgtattggcaagggcacccagtatgatctccttcctgatctagggggaaggcagttagtcttccacctttaagtaagatgttaactgtagattttgcagatgttctttatcaaggtaataaaattcccttttactcctagtatatcatgaattgatgttgaattttgtcaaatacatctattgacagtgatatgtggtttttcttctttagtctgtaaaaatggtaaattatattaaattgaggcatactttaaaaacagaacacacagatcttcagtgttaacagtttgcagagttttgacaagtacatacacccatgtaacccatacaatggtcaacatgtccatttctatcactccatgaagttgcctgatgctccttgccagtcatttactgcccagcccccctcctggtggttctgttattatttattttgatgctcaggttatctgtgattggccaattggagcctcttcaagctggctgtagtatacttccgacatacctctcttacttccggaggacttccttcttttctggcacaaactgttgaaagtgcaccttgtatatatatatatattctttgatccagccccggaatcagccatttcgacaaagagcctggttcctttcggtggggaatagtaatttgattctgctatttagatactcattgtaatgggttttatacaattgaagataactcttggtcgggcacggtggctcacgcctgtaatcccagcactttgggaggcagaggcgggcagatcacctgaagtcaggagtaagagaccatcctggccaacatggtgaaacagtgtactaaaaaacacaaaaaaatgagctgggtgtggtgatgtgcgtctgtagtcccaactactcaggaagctgaggcacaagaattgcttgaactcgggaggcagaggttgcagtgagccaagatggtgccactgcactcccttgggtgacagagcaaaactctgtctccaccgcctccgccccgccaagaaaaagaagataactcttaagttggagattatcagaaaatttgttagtgggacatctttactgctaatgcctggaggaatagaatatattaatgcatttatagaccacactgataagtatctgcattagaacagtaggacaataggccaggagtgcctatcaacacgaaaaagagatgcagtgtttacagtacaaattaaactgctcagaattcctgttccatgcaccagattgccagaagttaaactggagagaatccgttgatgtagagctgtaggattctcatctgcttttgatgagagtggagcttggtctagttatttggaaacgttttgcatcatctggaaaaggtgagcagagagcatactctgacccagcacgatgctctagagagactcttgtgtttgtgcaccaggacacatgtgcagtaatgttcctcgcagcattgtttttggcagccccaaattggaaagaaccagattgtccattggccacagaatggatgggctgtgtcctagaggagtactaatagagcacccagtgcaaagcagagagccctgccatcgtgcacattgatgcgcaggtgtaagcaaagctgagagggtttagacacacacccacaggtggtgacactgtgaggaaacttttttttcttttggtttttgctttattgagatataattggcaaataaaattttataaagtgtacaaagcgatttggtataaggatagtgaggtgattaccgcaatcaaattaattaacagttacccttgttttgttttgtttggtgagaatggctaagatctactctttcagcaagttccaagtatacagtgcaatattattaattacaggctgggcgctttggctcacacctgcagtcccagcacttggagaggccgaggctgtagggtcacttgagaccgcgtattcaagaccagcctgcacaacataggacagcatctctacaaaaaaattaaaaaattagccaggtgtggcatgtgttctgtagtcccagctattcattcagaaggctgaggcgggaagatcgcttgagcccaggaggttgaggctgcagtgagctgtgattgtgccactacactccaggctgggctgtagagcaataccctgtctcttaaaaaaaaaagattccacgtgtaagtgatactgtacagcatttatctttctctggcttatttcagttagcattatgccctctaggttcattcatgttgttgtaaatggcaggatttccttgctttttgttaccaaatagtattccatgtgtatatactatattatctgttcatctgttgctgggcacttaggttgttttcatagcttggctgttgtgaacagtgctgcagtgaacacaggagtgcagatacctcttcaagacacggatttcctttcctttggctgtgcacccagaagtggggttgctggatcatatgttcattctatttttaattttttgaggaaccttcatactgatttccataatggctgtaatagtttacattctcaccaacagtgcacaagggttctttagggaaatgtttaacagacattttgggtagtaagtgtagaagcgggtgtatggagtttttaaggtatgggtaaaattttttttttttttgtcttccagtataatctcaagagccaaaatgtttatttcttaaggcatgtgatgagtatgtagggatcgctttattattactgctttaaattgtatgtatgtatttttccactttcctcctccacatcgtattatgaaaattccaaacaagttgaatggattgtttagtgaaagatatcttactgtttaaattctatgattaattttactgtgctttggaagtcttacatatattttataatttcttttgtatgtgtgatgtatttcctaattaaaaattccttgtaagacggaaagaggaaaaccaaggagcctccattttgagttacagacttgcggcaggtgacagtggatgtctaagaaaatagaaaagagttaaaatggaaacatccattgctttaggaaaaaattcagcgtgagttttattactttctttttctttttctttttctttttttttttttaaacagagtctcgctctgtcgcccaggctggagtgcagtggcgcgatctcggttcaccgcaagctccgcctcctgggttcacgccattctcctgcctcagcctccggagtagctgagactacaggcccctgcgaccacgcccggcgaattttttgttatttttagtagagacggggcttcaccatgttagccaggatggtctcgatctcctgacctcgtgatccgccctcctcggcctcccaaagtgctgggattacaggcgtgagccaccgcacctggccgagttttattactaatagccaattgtgtaatttttattttgaccagtgaaactctagaaataaattcagaatttgttattacatatgtactaatttctgtttcgaaaagatttttaggtgatactgagtgcaggggtgttgcatataaaatacagacaggcacgcatttatttataaaaagataaaaagaaccgttctaagcagaaatttttcatcattttcctgttagagaaaatgaataattcgccataattttatcaccctaacacaaccttttttttttttttttttttttttgtgacggagtctcgctctgttgtccaggctggagtgcagtggcgcgatctcgactcactacagcctctgcctcccaggctcaaacgattctcctgtctcagcttcctgaatagctaagattacaggcgtgtaccaccacacccagctaatttttgtatttttagtagaggcgggattttaccatgtcggccaggctggtctcgaactcctgacctcaagtgatccacctgccttggcctcccaaagtgctgggattacaggcatgagccaccatgcctgactgattttttaaatgttatgttgcatatataccagttgaaacaaatgaatttatacttttttgttttgttatttcatttaacaaataattattttattgacttctaataattctgtttttaactgctgttactgcttcattattttcaggacctgtaattcatctaaccactttctagttttaggttatgtctgttctatttagaaaaactcttaggagtgacactagtgaatcaggagagcgtaagtctcttcgtggtgcccaccgtatactcactttgtgtttagctaaaagtgctgctagactgtggccccagttttattatggctttgcaagccctgttaaccattctaaaaagagtttaaactttgggaggctacggtgggcagatcacttgaggccaggagtttgagaccagcctggccaacatggcaaaaccccatctctaccaaaaataccaaaaatttgccgggtgtggtggcgtgttcccgtactcccagctacttgagaggctgaggcaggagaatcacttgaacccaggaggcagaggctacagtgagccaagattgtgccgctgcactccagcctgggcagcggagcaagactctgtctcaaaaaaaataagacagagtttcaggatgagttttattatttgcagccaattgtaggatttttataataaactaatctatgccagttaaactccagaaataaatccagagtgctcagcattgcgtgtatttctctttgtttccagaaggttttgtggttgtgttgagtgcagctatagtataaaaaatactactaatattattatggttatttatgtcttataaaaacctcctgattggagcatttttttcagtgattatgatgttagagaaaatgagtaattatttatggttttgtgatcctaacccaactgttgtttcttacgttactttacgtatgtgtttgtattttttttttttttttttgagacagagtcttgctccgttgccaggctgaacacgatctcagctcaccacaacctctgcctcctgggttgaagcgattctcccacctcagcctcccgagtagctgggactacaggcgtgtgccaccatgcccagctaatttttgtatttttagtagagatggggtttcaccacgttggccagcatggtctcgaactcctgacctcaggtaatccgcctacctcagcctcccaaagtgctgggattacaggcgtgagccaccgcgcctggccagttttttaatttttttgtagaaatggaggtctcactttgttgcctgggctggtcttgaactcttgggctcaagcagtcctcccgcctcggcctcccaaaatgctggaattacaggcatgagccactacacctggcttcatagtttatttctttgtttatttaaatagggcagaaattttccttttggtagctgccaactactattggtcttaatttctaccttcagaataccatcaatctgtccttttaggtggcagatgttctgtgagctttcttctgctgtgttttccatggataagctctgttttggtattgtctctcctaaatgggcacccagaattaaattcccttcagagtgttttttctttgtgagaaattctcttttttaaagaattgtcataatggtttttgatcaaaatcaaggttgcattttaaagacaagagtatcttctgtaatcccagcactttgggaggccgaggcgggcggatcacgaggtcaggaattcaaaaccagcctggtcaacatagtgaaaccccatctgtacttaaaaatacaaaaaattagccgggcttggtggcaggcgcctgtaattccagctactcgggaggctgagtcaggagaattgcttgaacccgggaggcagaggttgcattgagcagggcttgtgccactgtactccatcctgggcgacagagagactccatctcaaaaaaaaaaaaaaaaaaaaaagaccagagtatctttaccaataataccttcatggagacagaataaggtaaaactaaaaataattctgaaaaccaaggctgagtgtgccgtgcctggaggagttcctgtgtcttctgcagaacccaggggcagcaggacccgtgtgtcctgagtcctctgggaagcaggctgagtgtcagccacagccggggagcagtcaacagggcgcacagtcctccctgtcagtgcttcttgagcagaagtttctcattttaatgaagtccagtttatccgtgtgttcatgtagatatccagttttctagcaccgtttgttgaaaagactgtctgttccccattggattgccttagaggctttggaacactgtgtgagcgtgggtctgattcttggtgcgcagctcagttcttcttatctgtgtgttggtccttacgccagcgctgcactgcactgtcctggttcctggagtcttggggcgtgtcttgaagtcaggtccttcacttggttcttctctctcaataatcttttttcaggctcactgatttttaaatttttttttctttttctttttttgagatagggtctcactctgtcacccaggctggagtgtggtggcgttctttcggctcactgcaacctcagcctccagggctgaagtgatcctcccatcccagcttcccaagtagctgggagtacaggcctgtgccaccatacctagctaatttttgtatttttgtagagatgaattttcgccacgttggtcaggctggtcttgaactcctgacctcaagtgatctgtgtaccttaggttcccaaatggctggaaatacagcataagccactgcgcctggtcaatttaaaattttttgtttgttttttggagatggggtctcattatattgcccaggctgattttgaactcctgacctcaagcagtcctcttgccttgacctcccaaagtgctgggattataggcatgagtcaccatgccccgactgattttttcacatctccacactgatgttacgcctatccaatgaatttttttttatttcggatgttgtatttttcacttctagtatctccatttcgctctttattttaatagtttctgttttgtcaagatttcttcttgtcttttattgcagtatatttttctttatgaccttgggcatacatattaaggtcactttaatatccttgcctgcttattctagtacgtgggtcatcttgaggttggtgtctgagtatggctcgtgttttttgtttgtattttggagtaattttgtttgtattttggagtaagtttgaattggattttgtacaattgtgcatgatatgtagaaaccctgggttctgttatattcttctgaaacgtatttattttctttaacacttaacttgattgaattaaaaatgcacactctggctgggtgtggtggctcacgcctgtaatgccagcactttgggaggctgaggcgggtggatcacaaggtcaggagtttgagaccagcctggccaatatggtgaaaccctgtctctactaaaaatacaaaaattagccgggcatggtggcgcacctgtagtcccagcttctcaggaggctgaggcaggagaatcgcttgaacccaggaggtggaggttgcagtgaggcgagatcgtaccattgcactccagcctgggcgacagagcgagactctgtctcaaaaaaacaaaaaacaaaaacgccaaacagcaacaaaaaacctgcatactctttctcctttgtggcaggaggcacctgaaaactcagttcagtacttgggccttctcttggattctgtttttgtgtacatggtttaggtggaggttagggagagaatgtggggcctcctccttttccatctgtctcttgctctttgtcctcttgttcaagccagtgagatgctatgtgtctttaggtttgagccgttccatagagcacagactggggctgccctcatgccaaatgccatgaaactggaaaccttaccgtgttctattcccttcttgcgaatatcacttcccttcctgtatcactggcctaccttttcatatttttttgtatttcatctagagtttatggttacctggattatgttttttgtttttgtttttgtttttgtttttttgagacggagtctcgctctttcacccaggttggagtgcagtagtgcagtctcggctcactgcaagctctgcctcccgggttcacgccattttcctgcttcagcctcccgagtagctgggactacaggcacccgtcaccgcgtctgactaatttttttttttttttgtatttttagtagagacggagtttcaccatggtctcgatctcctgcccttgtgatccacccacctcggcctcccaaagtgctgggattacaggcgtgagccaccatgcccggccttgttacctggattatgtttgaccggataggaagtacttggccattactggacacggagccctttatcaagttttttttttttttaattaaaaaatactcttttctttggttgtattggtcatacatgttcattatagaacatttgggaaatttagaaacgcacacacacacaaatcatgtcacctgtaatgctgccccagaggtaaccactgccaggccattgttttcaaaacattctttcctttctttcctccctctctttgtccattccctctgtccctttcatcttctttccttttccatcttggttaaatgtaaacggcagtgccttcctgctacatatgctgtattgtggctgatttttccttttagtaactcttcctaagcctttccccgtgtgagtacagagtctgtggcatggctggtggtggctgtgtggtggcccttgtgtggcagttggttcaaacagctccctgtcactgaacagttgctttgtttaggtatctgtaacttttgcgtttaaaatgtctcactaagtagagtgaatataattgagtgatttaaggaataatttagcaactagtaattaagtccttagcatttactttaatggcaaggatggtgaccagatggaaaagggttagggttaagtctgtgctaaccaagagttggctagtttctgtctttgtaaaataacatgccaatagcttcccatgtaaacttttaaaaaacatgattttttacgagcagttttaggttcacagcagaattgagaggaaggaacaagagatttttaaacataccccattgctcccccgcccatgtgcacagcctcctttgtatccgtgtcccccaccagacggtgcatttgttgcacttggtgaaaccttcagtgccatgtcattagcatagtactgtagtttcaccgccctagaaatgtcccgtgctcacctattcacctcctcccctctgctttgcacctggcaaccactcatctttttgtctctatagttttgccttttccaagacatcacagagttaggatcatgtagcatgtcgccttttcagattggcttctttcattttttgttttttttaaagatggggtctcttactttgttgcccaggctggaatgcagagtgcagtggcacagtcctagatcactgcagcttcaaactcttgggctcaagactcctgagtagctaggactacaggcatgtgtcaccatgcctggctaacattttaatttttatttttttgtagagacaggatcttgctgtgttgcccaggctggttttgaactgctgacctcaagcgatcctcccacctcagccttccaaagtgttgggattaaggcataagccaccacacctggtgatggctttttttcactttaaacattttaaataacatctgtctatttatatctctatatatctcacatatttatatctcatgtagggtgctaactataaaaatatccttttaaagctctaagttggctgggtgcggtggctcacacctgtaatcccagcactttgggaggccgaggcaggcggatcatgaggtcaggagatcaagaccatcctggctaatgcggtgaaaccccgtctctactaaaaattcaaaaaaactagccaggcgtggtggcaggcgcctgtagtcccagctactcgggaggctgaggcaggagaatggcttgaacctgggaggcagaggttgcactgagatcccgccactacactccagcctgggtgacagagcgagactccgtctcaaaaaaaaaaaaaaaagatctaaattaattagatagttattaattggggttttagtgtcattttccagtagaaaggcaatttcacctttttattattcggtgtttttggatgtgaagttatgctgggcagtgtgactgatgagtcggctgagatttgtctcagaactgaaactcatgtttcccagcattagcccttttgttgtttcccaaggactgtaggtttgcattgatttgaaattccattaaaaccagaataatatgtcttttacaagtcttttttcccccagaggtaagttagaactttaaattgtttattatacataaatatacattacacatgtatatttaaagacacggggtagataacattcctgttattagaaaggaaggaggtcgatgtttgggataattatgataatttgagtttattcttgtaatggccttcagtgatcaaaatctcattttttcatcttttttcccagcagcaagccctcgcagggagcctggtagcaggggccggaagcacagtagagacggacctgtttaagaggcagcaggcgatgccctccacaggtatggcaggtacgtcggcacggctagcgtggcctcgggaatgcccccctctccttgggctgccgaggtacagttgccatgagtttctgaagagcagttgctaaacttggtttcttcctactttgaaaattaacctgtcttacagtgattatcagctgaacaatatttacgtgaatttttctgtgtcctgaagtgaggaatttttcagttgagcaggtgtattccgtgttggttttctgtatgcatttgtaggctcttgagtcatcacggtgtgattaaacacaaaatcatctgctttccaaagttgtcatatttttaagctgattttttcaaatgataaacttaatacatttttatataaaagacttcaacagttcagtagggtataacttaagtctatgtctggcttggtacctgcccactccccagccacagcagtaaccactgttaatgtttcccatattctctctcacagaccttcctctcttcatacacaagcattgttacatatgtgatactttgaaaaagttgagatgcgatcatatataagttgttatgtctaagaatattaactgaagaggccatctctccaggtcataacctctctcagtgctccatgctgttccgtcttggggatggttggttctttatcagtcagatccttgtcagtgttcatctgttagtgccaccttgtgtctgttacagtgagctaaggattgaacatgtagtctcatggtttttttttcctacatgtttatcagtctatccatctgcttattttttgaggtagggtctggttcacccgggctggagtgcactggcatcatcatggctcactgcagcctctacctcccaggcttgagcaaatctcatgcctcagcctcctgagtagctgggactacaggcgcgtgccaccactcccagctaaatgcaaaaattgttgcattttaggtacagttgtggtcccactatgttgcccaggctggtctcaaactcctgggctcaagtcttcttgcctcagcctcccaaagtgctgggattataagcgtgagccaccgcgcccaactgtctgtcaatatatctaaaggaaaaacgcctagaaatgaaattgctagatcaaagcgcagatgtagttaagtaataatggtgctcaattgcccaccaaaaggacagggccagttttcactgccatcaacaatttctggttctttcacattttgatcgttttattaggtataagtcatttaatcctcattgatctgatgggtgaaacattccttgttctgatatgggtttctttagttttgagcacgctgtgcagcctcattccctgtgtgctgggcatttgtgagtctgctccactgcccgctctccatgctctcgtccgtgtacttgtgatgctcctcatgtgtgcctgtgctttctgagtgctaagcaagcccacctctgcccgtcacacacgttgcagtgttgcctctcaggttgttgcttgtccttggccttttcatgatgctttttcttatatcggcaacattttaatgagaaattgtatttatcagccttatgttttatggcttctggattttagttcatgtatagaaaggcctcccttttccaagatgataaaaacacacatgtttttttctactacttctctggttttatttttacatcaaactgcaccttttttgaaaattattctagagcagtctaagaggcctcgccttgaagtgggtcaccaaggggtagttttccagcacccaggggcggacgcaggcgttcctctccagcaactaatgccgaccgcacaaggtaaggcccagcagcagagccagctccccgctcaggagcaggcagcacactgcggttccagaaaccagcaccagactcagacttgggcagtggaggtagcgtgtttgcagtggggtgcctgaaattgagatacttctctgagtcccagtcgatatcatatgcaaagcccctggagacatattcttgccacactaatgggagccacacgtcgcattgtcatagtgtctttcaacaatttttactcctatgtttttcctaattgctgctgttgtaggggtgccctgtggtgatctggtgcttgttttgcttgatgctgacttgcaaaggtcaagcgcctctctttccttttgtgtgtgctcggttgtggccaacttctcgtgtgagtgtggtgggtcttggacaagcactggggtgttagacgtgtctccttgtgactcattggtagaagctgccacacttgggaatcagtgcttttggcacttttcttattttgcaggaggaatgccccccacgccgcaggccgcgcagctcgctggacagaggcagagtcagcagcagtatgacccctccacggggcctcccgtgcagaacgctgccagcttgcacaccccactgccgcagctgcccgggaggctgcccccagccggtgttcccactgcagccctctcctctgcgctgcagtttgcacagcagccgcaagtggtagaggcccagacacagctccaaatcccggtgaagactcagcagcccaatgttcccatccctgcaccgcccagcagccaactccccatccctccctcgcagcctgcacagctggccctccacgttcccacacctggaaaggtgcaggtgcaggcctctcagctttcctccctgccacaggtatgagaaaagatagaggaaaaaaagaaaatggtttgcaggatttgctggctacctgtgtgttagacagagtgtcacaccacactgtaatttgtgtattttctcttagcagcttgctcccccaatttagaacaattactcaattcagtacttgcaatacagttttatttggctctatgatattatctttattaaagtaatagagaactgggctgggtttggtgactcacgcctgtaatcccagcctttgggaggctgaggcgggtggattacctgagctcaggagttcgagaccaacctggccaacatggcgaaaccctgtctctactaaaaatacaaaaattagccaggcgtggtggcaagtgcctgtagtccaagctacttcaaaggcttaggcaggagaatcacttgaacctgggaggtgaaggttgcactgagctgagatcacaccattgcactccagcctgggtgacagagtgagactctgtctcaaaaaaaaaaaaaaaataataataataatagacaactgttattattgtcactcttagtaccaggggtccctccttactcacccatatgttgtgtgaagggcatggtgtcagttatcccttatgatctgcctagcaaccctcaggtaggtggcagcgacccattctaccagtgtggagacacatactcagaggttctggggctggccccaggttacatggcgatgaagtgatgagcggggcttgaccctagctccatgtgagtgcaaaaccatgttggacaccacccaccagacgtgctccctggacgcctgctttgctgcttttgggatgctatatgctctgcaaatgtgtgtaaggtgttactgatccagcttgatacacatgtgtaaggcgttactgatgcagcttgatacacatttcaggtagttaaaatgcccctcctcctccactgattaattttacccagtgtgtttttgggatgtccacagtaaactggtttcggttcctaaggaatagcgaaatgccacagcctcggtgccagccgtcaacagggcactgacagggaggccggggaggactctcagcccccttggttctccactgtttgatgcacatcagggcgtggggagcccactgcagagagtcttcccttccttttgccttctccctcactaacaaaggaatttcctaggtgggctttaagttcagggtttttgtttgtttgttttgaaacagggtctggctctgtcacccaggctggaatgcagtgacacgatctctgctcactgcagcctctacttcctgggcttagatgatcctcctgtccctgccccctgagtagctgggactacaggcgcacaccactacacctggctgatttttgtattgttgtagagatgggatttcgccatgctgcccaagctacaagtgctttttctttttttttttttagacggagtttcgctcttgttacccaggctggagtgcagtggcccgatctcggctcaccacaacctctgcctcctgggttcaagcgattctcctgcctcagctcccgagtagctgggattataggcatgttgccaccatgccggctaattttgtgtttttagtaaagacgaggtttctccatgggttaggctggtcttgaactcctgacctcaggtgatccgctggctttggccttccaaagtgctgggattacaggcgtgagtcaccgcacccggcctacaggttctttatgtttgagatttatggcaaagtcttaagtatataacgatgaaataatagtaacaataatagctatctcttattcaccacttgtgaggtgtggtgtcaagcactgtgatgagcgatttattggcattgtttatttcctttacctgacaaccttatgaggtagaatctttactatctccattttatagattaaaaaaaccagaggccagaaaagccagcaactgggggggctgtagttgggagccttttgtgcaagtctgcagggaagccttgtacacccactttgagaaaggcgacacatgccagggcagctgagctcttctaggccttacattgcttgctttaggtttttgtggaaatgattctattttgaacacttcctcacatcgagccacatactgacttaaagcagctccgtggtttttcttagatttaatttacctgcctgtgttactgaaaaactcagctgtggaaaatggttttattttattttatcttttttttttttgagtcagagtctcactctgtccctcagggtggagcgcagtggcacgatctccgctcactgcaacctctgcctcctgggttcaaaccattctcctgcctcagcctcccgagtagctgggactacaggcatgcgccaccacgccctactaggttttttttttttccagcagagaaatgatttatttcacaatttagctctctaaataactttatattctctccttaagaacaacagtagaggaaatcatttactgatcattttacaatgcacataatatcttatgcatgcttaggcaactgtttttttttttttactttttagtagagatgggcttttgccatgttggccaggctggtctgaaactcctaacctcaactaatccacccaccttgggctcccaaaatgctgggattacaggcgtgagccgccacacccagcctggaaaatgattttaaagaagcgctttacaaagtctgtaggaacctgttacttctaggttagccagggttggcacactttctcagtcaagggccagggagtaaatgttccagctttgcgagctgttcagtttctgtggcagaagtgaagacacagccgctcacggacagcacgtaagtggatgtggctgtgctgtaataaagcttcatttccaaacgcctgtggccagccgggagacggcgctgccgaggtgaagaaagcagacccacgtcgtgggacgggcgctcagagagagtgtgctctagcggttctgtctcccttcagcttttgaacgggctaaatcttgtgtgagccttcactcagcccaccttccctgctctctgtgaatttaagtcacagagtcgcagcagttctctgtgactttaagtctgtcgttgaggtggtgcgaagaggaggacttttctttttttgagacggagttttgctcttgttccccatgctggagtagaatggcgcaatctcagctcaccacaacctccgcctcttgggtttaagcaattctcctgcttcagcctcccgagtagctgggattaataggcatgtgccaccatgcccggctaattttgtatttttagtagagacgaggtttctccatgttggtcaggctggtcttgaactcctgacctcaggtgatccgcccacctcggcctctgaaagtgctggtattataggcgtgagccactgcgcctggcctgaggaggattttttaacccttttagcctgtctgccatgagagaggcacactgaatttgtattttattttattttatattttgttgagatagggtcttgcttcgttgcccaggctggagtacagtggcacaaacatgactcactgcagtctcaacctcccaggctcaagcagtcctcccacctcagcctcccatgtagctgcgaccaaaggtgcacaccaccacacctggctaatttttaaatttttttgtagagatggggtctttctttgtcaaagcccaggctcatctcaaactcctgggctcaagcagtcctcccacttcagcctcccaaagtgttgggattactggcatgagccactgggcatggcctaaagatagttcataatgaaaactcctatttggttttgtggaagtgggaggatgtattatttgtggacacgttagtgttgggctgtggatacgatgtgatttgtctgcttgcatcgtggagcggaaggtgctggcagtgcgcgtctctggtgctgtgggcgctcaggtatttggcaccgtgggctgccccgacatcttttcttcaccttgctccacttgtgccctgcccttacagatggtagcatcgacaaggctccctgtggaccctgccccgccctgcccacggcctctgcccacctcttctacctcgtccctcgcgcctgtgagtggctccggcccaggaccctcccctgctcgatcctctccagtaaatagaccttcctcagccaccaataaggcactatctccagtcacttcccggaccccaggggtggtggcatctgcccccaccaaaccacagagtcctgctcagaatgccacctcgtcccaagacagttctcaggatacgctgacagaacaaataactctggtaagcatgcttaagaaagttgtaaaatgtactccagttggtgaagcacatttagttttaattgtcaagaatgtgatggcgtaaaaccgaatgcctggtcaattcagcatggcttgggaatcagtagacacaagatgaaaaccaagggttagccttttctgttggaagcagactcatgggggcagtctgcgtttttgtgataaagcctgcagtcttgggctgctttcatatgggcagtagacgagggtgggagaggtcacgtgtagcagttaggcggagagggacaagcttgagcgctggggccctgcaggctgtgaggtccctgcagccaccagtctgcagccctgtgtttgagagtcactgcccagcccttagcacttactttgggttggatgactaagcatttattttgttcaacttcattaggggaattaaaagaaatgtgtatcaaaatagagtgtcataaaccccatgttccccattatttgattttatcacagtgatcagtatgcagctagtctcatttcatttatcccactcctttccagattatctagaagcaaattccagacatcctatggtttcccatgtaaacactttggtagaaacatgaggttttaaagttttagtctgttttatagagctggggcaggactattgctccagcttcttctaaggctcctggaagggtcacatgctcctagacctctcctagaaccactttgacctttgtgttcgaatcttacctttgatattaaactgggaccttgtgctttctctctttcttagtgcctgactgagccttttgcatagtagggcttcaaatttctggggtctgagttggtggaacacactcatcacatgccgaccccaccatcccccatgtatcatctacaggagaaccaggtgcatcagcgcattgcggagctgaggaaagcaggtctgtggtcccagaggcgtctgccaaagctgcaggaggccccacgccccaagtcccactgggactatctgctggaggagatgcagtggatggccacagactttgcccaggagaggaggtggaaggtggctgctgcgaagaaggtgggttggaatgcgtggagctgctgtgctgtgtgcgttggtgggggcttgagtttgcagtggtgtaagtggtggggaggtctccagacccactttttttttttttttttttttttttcccccagacagggtcttgctctgttgtccaggctggaatgtccagctaattttgtgttttttgccacattacccagactggtcttgaatcctgggctcaagtgattgctcgcctcggcctcctggagtgctgggattgcaggcgtgaaccactgtgcctggcagattcactctagaggccttaacctgtgaagtctgggaaggatacttccctgttgtttggagaataactgtgctgtgtaattaagtctctgaggtggtgtcttcagagcccagcatgcgttgttgggatcaagcctgtgctcagtgctcacccactaagcaatgatgtggatttagcttcattttgttgcctggctttgcctggcagttggagttaggatacctgcagtgccacaggttcaggctggtggctggggctgttcagggagctgagaggctaagagttagaaggcacctggtatcagtcaagggacagcaaggggctgtcctaggctttcctgcctggccacacggcctcctgcccttcctcctgggcttctagtctagctttctctttaattttggctgagaatttatttttctcctaactgttgccaaagcaggcgcagagtccttggaagactctggaggccctactgctaacactagaaaagtgagaacaagtggtagatttctagaaaccccaggcctcagtgggaagcagctgtgctttcactgtgtgaacagccgtggcccttctttatcctcctcattactgtgtcgctgcctctgtttcttgggccctagggtctttgttcatattttctgtactcttaacgctatggccttgtgttccatcccttgccctgtccactccgtacccagaattttcccccttgctgtcttcatgtagggtaggcagagagaagctgagaccacagggtgagaaccgtggggttctgagggtcaagggtctcaagtcagattcataagcattccagaaaaacccagattcttccttaaaccagcctttccacaaagaagatagtcctgaacatggtggacaccaggctggatagggcaggaggccagacgtgtagatgccaggctggacatgtggatgctgggctggatgggtgggggctggccgatgggctagagtgggagctggtggggttggctgaagagcagtgcagcacctacagggcacaggccagggccatctctcaacagctgagtgatgcatctgcagccaggcctgcccttccccgtgcctcctgcctctcgctggggtagacagggagaggctgcagagcagcccaccccgatcagggcctgtgttgacgacagtgagccccgttggaggccgagtgggaacacggcgtgtgcgcagagtcctggcggtagttgagtgcatttccatccctagaacgggcgtgggggtgacagccattgtgctctcagggctccaaaggttttctcatcttaattctctccacccatttgaggttctgttggtgggtatgtgaagtgtctaaacttttggaaagcagtttgacaatttaaagcaaaagctttaaaaatgtgaattatcgcagcccaataatttctataactggtgcagcattcatgaaatgagatgccgacccatgtttattgaatggagagatgttaatcatctattaaatgggaaaagaagattatagcacaatgtggtattctagttttgaggaaaataatgtgtatttggtgaaaagtataaaaacactttctagaaaagtcaagctaaatattgatggtggtttttgcttatagtcatgtttctcctaatccaccctaagagcatacgaggatgtatatgacagtgaattgtatgtaattttagtctgagaagatttaaaaaaagttacatatccttttttttccagcatgacatagagtacaacatacaattcttgcacttttattcaccagctcgttagaactgtggtgcgccatcacgaggagaagcagctccgtgaagaaagggggaagaaggaagagcagagcagactgaggcggatagccgcctccacggcccgggagatagagtgcttttggtcgaatattgaacaggcgagtgctgccgttgtcatggggtcgtaagaatcagtctgtcggagctggtgaggccacttcccgagaccagagctcgggcaccttgcttaggaagctttcgagcaccagagtcagcaacgtgtgcactctcctgggctgttgcttgttggcctttgaatgagctgctcgtgcctccgtctgtcttgcacaggggatgcacctcagctgtggctgccctctgaggtgcttcatgccgtggaggggctctgggcattgtttcagggttagcgtgagtcaccaccacggttacttctagagcggtcgctcgctcacttgctttccttttttgaaattttaattcttacctcaccacctaatagaacctgggcaggatgtagttagtatgaaataaatgaaaaagcaccaaactgacgaggctggaaaacactgttttcagactctgcttatgtgctttagtgttttgtatgcagaacgtctgtaattcccatccttagtaatgtgcttattcatttaatcctttgcatttaggttgtggaaataaaactacgagtagaattagaagaaaaaaggaagaaggccttaaatttacagaaagtttccaggagaggtaggaccctttaaaaaaaggctcaccacgcttgggtggtattttgttcggattcttttctcagcaggcagtctcctggcgctgtggcttcccacagaggacatctgctcatcagccagctgcctgattgttacatttctctttgtgtggccatcctagttttatgcttcagtgcttttgagatgtgctagtgtgagtcagcacccccaagttgataaactctgggacacagaactggggttcagtccctggacagtgagtgaggagcttcctgaggtgtttgccatgcaggaggatccttgggtgcctggctgggtgacgccttcctttgatgtttcttcggcagctgcctccgctcgttatgtgccactccacttaggatgtgcacggcaccagtggcagcagcattcactgtttcctttgcctctgaggacacccccaggagggtgggcattgtgttcccccattattgatgaggaacccgaggctgagaggtggctgctgctgaaagtcatagagccacaagttagtaaaaaccactgccctgcgtgatgatgatgaggaggcagaactcacgcgtccttcctttccctgcacgtgggtggaggcagcaggaccctgcctggaaagcagagacgccctcgccaagcatggggggccttgggaacgaactgtgctccttgtctctctagggaaagaattgagacctaaaggatttgacgcattacaggaaagttctctggtaagtttggggttgttactgtgctgtgtgagaaggagtagaagcagctccagtagagtgggccttttcattcttatccagaggaatttgtaggctgtgactattacttcctttcttttcttttttttttttttttgttttagagacagagtcttgctctgtcgcccaggctggagtgaagtggcacgatctcagctcactgcaacctctgcctcccaggttcaagcaattctcctgcctcagcctcccgagtagctaggactataggcgcacgccaccacacctggctaattttttttttttgtattttagtagagatggggtttcaccgtgttgcccaggctggtctcaaactcctgagctcaggcattctgtccgccttggcctcccaaagtgctaggattacaggcgtgagctaccgtgccccgcctattactccctttcattatagactcagtctactttgaaaataaactggtgctttatagccttagtctcacgtggggtgttaatttggcagtgacagctgaacacagtgagcattgatcatgtcctcgctcccccgctgccctgccccgaccccaaatggaggctgagggcagcctagcaggcttgccccggggctcccccaacctgtcccatggacactgctgtcttggtttcccattctgagtgtttggatctcatgcttgtggtttttctttcttttctttcaggattcaggaatgtctggaagaaaaagaaaagctagcatatctttgactgatgacgaaggtctgttccccctcagcactatctttgtcatctccagggctgctgatgagatgacacagagctgcagcgacttggggtttagtcttgtcatcttcagctggttggaaagctcaacctttgtatttatccagatgtctctcagtgtatagagtactttttgtatctctagaggacttgggatgttttctggagcaacatggtcgtatctgctttttgaggtttggaaacttgggtgcatcttggagagtgttggggccccatgctcctgtggcacagggccaagcctgtttctgtccttgagaggtggccctggtatgtcctctggtagacccatggttgccagccattgggatttcaggagaaactcatgtgaattttagatgttggagaaacctggttcagatgagaacagatacctgagcactcagtgtgtgagctggggacagcccacggccatgacctatttccaaacccatgtggattgagtacagaagtcctcaggagcagactggatttttagagacagagtggggagcaggagtagagaggttggagaaactttcttgggcgtttgtgtggcggttcctgtcaggtgccaggtaaggcctgcagtttctccttcggctctttgatcagcatcagtgtggttttattggcttggtttggtgaagtgtgttaacttttccaaatttttgaagattgatctttgctatgtgttgatttttatttggaagtcaacagggagtttggccagattgttggcatgaaactggcagtattcagttctgctgcgtatgacagaaacaaaacaacagtgtggcagatgagtgaggagcctgagggcacatggcccaggactggcacagcattgtggtggcattttcaggcccctcccaagcgattctcttgcctcagcctcctgagtagctgagactacaggtgcggactactacgcagctaatttttgtatttttagtagagatggggtttcaccatgttggccaggctggtctcaaactcctgacctcaggtaatccacccgcctcagcctcccaaagtgctaggattacaggtgtgagccaccacacctggcctggtgctgaattctagatagtaccatcctgcactggggatggattgaactctggcctttcagacaacaagagaagcacaacagagtacagtaggtttgtgtctttcttgttacctggaaaggattaggtcatttcttcatgaggaacaccttttctctggcctgcactctggtagctgcggtcggctttatgtagattgacctctccgctttccttattttctcacattctcaggagcacatttgtgtacagtcatgtgtttcttaacaacggggatatattctgagagatgcgttgctggacaattttgttgttatgtgaacgtacaaagtactcacccaaacctagatggtgcagcctgtgcctccggctacaaacctgcacacaggtgactctcctgaatcctgtgggtaattggaatatagtggtatttgtgcatgtaaacatatcttgacacaggaaaggtaatgtaaagatacggtattacagtcttacagggtcccattgcatatgcggtccattgttggcagaaacggcattatgtggtgctcaactgtattgaaacagacttttatttgacttctgtttaatgcctaaagatgtcttagggtaactcagagaaggccaaattaaccacccgaggtcgtctttacttttcttttccaaaattccaccctggaaaccaagtgatcagaaggcagaaggaatggcagaaggcgtttccaagaggaggggatggccaggcctgtcgtgagccaccagggtgtcgagtacagtcaggaaaggcagcacctggaggcccagcgacttgtgtggttggggtcaggtgcctaggccttcttggtgggcagtgggggtcttgtagtgaagaaatgaggaagagttttgatggtaggaagggagagatgttatgttagattgtgagagaagaaaagttgagagccagctgagaggagagatggtgcaggccccctgcaggcccccaggtggggagagggtccgtggacagagggagtttggctgtggggatgctggtagctgctcttttctctgccaggagccaagatctctatggcgagtgaggcgtgaggttcagggctggagggctgaagagagcggagtgggcttgggttggtgattgtggaggacaggagagtcaaggagagtgttaggctgatgtggctgggcctcgtgagatgggcgatgatgacttcacggtgatcccagatggcatgcctgtgggctttccacagtggggctctgcaggaaggtaggagggttgacagcattccgtatgttggcctgaagaaggtctgccatgtgtggaaaaaccagggctgtcattcacagcctgaagtggaaggggaaatacacttccagtttcctgcccatttaattaaatttaacctgagaagtttaaaagctcagtttcaatttctgtaatagctatgcaaaataatttcgaagccttatagtgtgtaatgagtaacagacactcaagtggtgttgcctctcagtgacacttgctgataaccattttagtggacgatgaagaggaaacaattgaagaggaggaagcaaatgaaggcgttgtggaccaccaaacagaactttctaatttagccaaggaaggtaggctgttgctaccttattaaacattcagtaagtaaaaagaaacatttaaaacatgtgagatgtgaataataatatattgagtaacaacagcagcagtgcctgttttatggaaaacagtccctgtgtgcctcctgctgctctctctcctgacctggaggtcctggccctcctgggttgtgtgtcggacactgccctgactgtctttcttccctgccacctgcgtgtgtctccctgaatgtaccgttcatcttgagtgtgtgagaacttcatatgaatgaatccaccacagcttgactgaatgtgccgttcatcctgagtgtgtgagaacttcatgtgaatgaatcccaccacagcttgactgaatgtaccgttcatcttgagtgtgtgagaacttcataccaacgaatcccaccacagcttgactgaatgtaccgttcatcctgagtgtgtgagaacttcatgtgaatgaatccaccacagcttgactgaatgtaccgttcatcttgagtgtgtgagaacttcatgtgaatgaatcccaccacagcttgactgaatgtaccgttcatcttgagtgtgtgagaacttcatgtgaatgaatcccaccacagcttgactgaatgtaccgttcatcctgagtgtgtgagaacttcacgtgaatgaatccaccacagcttgactgaatgtgccgttcatcctgagtgtgtgagaacttcacgtgaatgaatccaccacagcttgactgaatgtgccgttcatcctgagtgtgtgagaacttcatgtgaacgaatcccaccacagcttgactgaatgtaccgttcatcttgagtgtgtgagaacttcatgtgaacgaatcccaccgcagcttgactgaatgtgccgttcatcctgagtgtgtgagaacttcatacgaacgaatcccaccacagcttgactgaatgtaccgttcatcctgagtgtgtgagaacttcatacgaacgaatcccaccacagcttgactgaatgtaccgttcatcctgagtgtgtgagaacttcatacgaacgaatccaccacagtttgatgggcttgctctctctactcagcctggatgtcctgagtttcagccacagtgttaggtgttgctatcagtgtctttgccaggcagtattctttttgtaaatatgtgaccgactcttttttgtgctgttggtggccattcacctggttccctgtgtttgctgtgagcattctcctattccccaggcacgtgtgcatgagtggcttgcctgtgctcaggggcaggagagtaactgttgtttagagtgggggtgccaagctccacatctcaggaaggaactcttttttttttttttttgagatggagtctcgctgtcacccaggctggagtgcagtggcgtgatctcggctcactgcaagctctgcctcctgggtttacgccattctcctgcctcagcctcctgagtagctgggactacagccgcccgccaccacgcccggctaattttttgtatttttagtagagatggggtttcaccatgttagccaggatgttctgcatctcctgacctcatgatccacccgcctcagcctcccgaagtgctgggattacaggcttgagccaccgcgcccagcctaagaaggaactctttttaaaaacaattacatatatatatctttagttttattgccattctttaattgctgtaacacatctcaagaactcttgatattgtctgccactctgggggtaaaaagtagtatctccttgtggctttaatttgcacttttgtgataactgatgaagtgaagcatcttttcgtgtttcttcctttgttcattttggcttattttggtgttttctttccttattgacttgttggtgatggtctttatatattctggacatgaattcttggtcagttctgtgttgcagtgacattttcccagttggtggtgtgtcttttcactctttgcagtacctttcgatgaaaggcgttcttaatttcagcatacagcaagtcctcatttaatgttgtcaataagttcctggaaactgcaactttaagtgaaatgacgttacattaatgttgttttattatagccatgaggaaaaaaaaattggttttgttatacagttgacccttgaacaatgtggggattaggagtgccaacccgcccccaccacctgcactgttgaaaatttgcatatagcttttgactccttcaaaacttactaatagcctactgttgactggaagccttatcaataacatgaaacagtcgatgaacacatattttatgtggtttttttctttttctttttttttttttgagacagagtctcactctgacacctaggctggagtgagtggcggatcacagctcattgcagccttgacttcttgggctcagacgatccttccacctcaggctcccaagtagctgggactatagtgcgcgctaccacgcccagctgatttttgtgttttttgtagatacgggatttcaggctagtctcaaactcctgggctcaagcgagcctcccatcttggcttcacaaagtgctgggtttacaggtgtgagccatcgtgcctggcctattttgtatgttatgtgtatttaatattacgtactgtattcttacaacaaagtaagctggagaaaagaaaatgttgttaaaaaataaggaagagaaaatacatttactatttattaagtggaagcgaataattataaaggtcttcatcctcgtcatcttcacgttgagtaggatgaggagggagtgggggagggggaggggaaggggttggtcctgctgtggataaaatctgcatggaagaggaccctcacagttccaacccaagttgtccaccgatcagctatacgtcattttgctcaaagttacaatttctaagaaccaacctattgatgatgtttagtgaggacttactgtagttgaatttgtcaatcttgttcacaaagatatatcatctaaaatttttctgcttttactcttaggttgtgaaatgagtgcagtttcctttttttccccaaaatgcatatttggaaagccatattgaaaagcctatcttttccccactgatcttaagtgccagctcagacgtaaaacaggtttccttctatgcatggctctttctgggatctttattcttttattggcaaatttgtaccagtctgtactgataccacactgtctttcttactatagctttataatagttcttgatgtctggttaggtaagttcttctgccttgctctgtgttaggaggatcttgtctatttggggactatttcagaaacatgctagaatcagctcatcaagtttcacagaaaaacctattgggagttttgattagaatttaattgcattaatggatgttttgtgagaattgctgtctttatgaagttcagcctttccagtctatgatcaaaatatagttctccccttcacttaggtcttcctaaatagctttccataaaatttcatgattgtgtctcttttgttagatttaattctaggtactatatatttttaaaagttgtgctaaatggtatattttctaaaattatattttaaatatattgctggtatgtgtcagtacagttgattttatttctcttatactcagcaacttttctgaactctgtttgttaattctttgtatacagtcttgtatacaaagactttgtatacagtcttgtatacaaagactttgtatacagtcttgtatacaaagactttgtatacagtcttgtatacaaagactttgtatacagtcttgtatacaaagactttgtatacagtcttgtatacaaagactttgtatacagtcttgtatacaaagactttgtatacagtcttgtatacaaagactttgtatacagtcttgtatacaaagactttgtatacagtcttgtatacaaagtctttgtatacagtcttgtatacaaagtctttgtatacttctctgaagagtttttcctttataatccttgttccttttatactactttttcttgccgttttgtgctaggtaggactttcagtaaagtgttgagttcgtgctagtggtggacaacattggcttgttcttgctttgaaagagagcactttcagtagaaaggcagattattagagttttgagtcataactgcatggttcaaacctaatgtttgttgcctactgaccccacggcctcggtcaggttgtctgagctctccgtggtgtttttctcagttgtaaatgggataaccagtgttcttctgaggatttgcagtgcgtggaagccttggcctgacgtgtcctacggtgtgctcttcactgctgctctcaggatgactatgatgatacctttaatgtttcataaatggacatagtgtatagggttcttgtagatatttttataagattagtgaagtttgtatctattcttcagtgtttatgttgtaggtgggtattgcatgctttgtttgtttgttttgacagtcttgctctgtcgcccaggctggagtgcagtggcacgatctcagctcactgcaacctccgcctcctgggttcaagcgattctcctgcctcagcctcctgagtagctgggattataggcaccagccaccatgcctggctattttttatatttttagtagagatagggttttaccgtgttgcccaggctggtctccaactcctgacctcaggtgatctgcccacctgagcctcccaaagtgctggggttacaggctgagccaccgtgcctggccctcatacattaaattgaggaatatgactttttcttttcttcatagtcaattatgatagtcaaattttctaggaatttctttatttcatctacattttaaaatttattggcatacattgtcaataatttctccttacagtgtttccgatcttggctgtgtttgtatgtatgtcccttctttctcctaatactgtgtatttatgcctgttttcttgatagtcttgtcaaaagtttgtcagattctttttttttttttttaatctggcgcctgtatattgttttctgttttgtttctgctcgtagtatttcttttttaaaaacatctttttctgagtttttaacttggatgactagcttcctaattttcatcagctcattaatataaacatttaagggtctgaatttttccgtaatactgctttagctgaatatcatatttattattcagttttaaatattttctgatttcccctgtatatatattttattgacccatgagttatttagaaggatgtttcttaatttccaaacaatacagggttttcaatatatatttttattattattctacattaattgcattttgatcagacagaagatgtatgggattctcactgacctggattttgttgaggtaggttttgaatggaccagtttataaacattccatacatgctttaaaacaacatgcattcatcaggttatggtacaattctctctctcagtccaccaggtagaacttgttgattgcattatccagttcttatccttactgatttttgtcttcttgctctatcaattactgagagaagtatgttaaaatgttccattatgataatgagtacctatttctccttaagtttctgtcagttttcattttatgtattttgagactatgttagtatgtgcatatataggtttagaattgttatcctattacgtcatcagttttacttgattctagataattttatcacatctgtgttctattttatgaattctcttttaagctcttcctagtcttttgttaacccattgattaagtgttaaattccagttaccagtttgttttaagacattcccaatggttttttagaaaacctacatgaaattttaaaattatctcttgctctgtattcagactttcagtcatctcttttatttcttcaaatatgaaattttataatctctgcctaataattgcatgggtgatgtttttgcaggtctgattctgctgtcgtttatgaatcctggtttctgctgatggtacattgtttcctagcgtactttgtgatttttgacaatttattggtgtagggaccagccccacagggtcggtgggtttcttcccaccgtgtgtggagacgagagattgtggaaataaagacacgagacaaagagataaaagaaaagacagctgggcccaggggaccactcccaccaagacgcggagactggtagtggccccgaatgtctggctgcgctattatttattggatacaaagcaaaaggggcagggtaaatagtgtgagtcatctccaatgataggtagggtcacgtgggttacgtgtccactggacagggggccctcccctgcctggcagccgaggcagagagagagagacagcttacgccattatttctgcatatcagagacttttagtactttcactaattttgctactgttatctaaaaggcagagccacgtgtacaggatggaacatgaaagcagactaggagtgtgaccactgaagcacagcatcacagggagacggttaggcctccggataactgtgcgtgggcctgactgatgtcagggcctccacaagaggtggaggagtagagtcttctctaaactccccacaaggaaagggagactccctttcccggtccgctaagtagcaggtgtttttccttgacactgaggctacaacaggcgtcttcccagatcctggcgttaccgctagacccaggagccctctggtggccctgtccgggcataacagaaggctcgcactcttgtcttctggtcactcctcactatgtctcctcagctcctatctctgtatgggctggcttttcctaggttatgattatagagcgaggattattataatattggaataaagagtaattgctacaaactagtgattaatgatattcgtatataatcatgtctatgatctagatctagtataactcttgttgttttatatattttattacactggaacagctcgtgccctcggtctcttgcctcggcacctggatggcttgccgcccacatattggaacttcattgtggaagttactttaggcctgacagtgaaggagtttcctctagagagagtttctgttaacttctgatctgtgttcttttgtaaagcatgtctcttgtaaacagcatatagttggtcttctctgccctacagtttattctaatgtccctatgtctctaaattggagtgtttagtacatttgtattaaatttaagcctgttctattaataattgggcctagatctatcctaattttaaaatttatcttgtattttctcacctgttctttagtcaatctctttatggttaaagcatcaggcaagtatttacaaattatttcatttcctcttctctgttagctttctgtattcttgttgtaggggctatctgattatggtgcgcattcttgacttactagatatcctattaaattagcgctgtatactctgtggggcagagtttgggagcagccttgctgggtggttgtggcacaggtctcctgtgaagatggttttcagaaggcttgatgtagcaggctggaggatgccattccaggctggttcattctgccagctgatgggctctggttgcatgctgagggcaggctgagtgtcctcctgacctggggctggtgtccgagagcaaatatccatgagggagcaggatagacactgtagtatcttttgtagctgagtcttggaagtcacctacggtcattctcacatatggtggtcacaccggtcaggccaggtcagtgtgggagagaccaggagtgaacaccaggaggtgggttcctggggatcccattgtctttatggtgtcgagctgaatccatgagcagagcctctcattgggtcaaggcttcttcatggtcttcaggaacctcttagagctttcttcacagagatgtggaatttttgaaagtttaattctaagtatatttagctcttcatgtccatgggtttcaaatccatgaatttgatcaactacagatagaaaatatttaccaaaaacaaaacaaagcaaaacagtaaaaaataagaacacagctgggtgtggtggctcacacctgtaatcctggctgcttgggagactgaggcaggatggtcacttgagcccaggagttcaagttcagcctgggcaacatagcaagaccccatctctaaaagaaatattaaaaaaaaaaaaaacagccaaccaaaaaaaccccccaaaccaaataagccaaaataacagtacaacaattacaaaaaagataccaaaaaaatgtgtaacaactatttacatagcattcacattgtattaggtattataagtaacctagagattatttaaaatatatgagaggatgtgtataggttacgtgcaaatatacattactttatataagggacttgagcatccttggattttggtatcgaaaggggccttggaaccaccttctcagggatactgagggacgactgtatttaattttctgtctaaacaggtttttttttcttcgatttcattttctaactcatttccatatgtggaggctgatttctgtgtattgtttgttctgagacaccttacagaattatcttcttactggaagtttccagtggtttggcttgtttttcctacttacatatagcatcatatgctgtagtggtgcatcccagcatttcgctctggaagcatcagacagacaggaaaggtgaagaaccttgttaggaacatcatggacacaccacctgaattccacagccaacacttactttcactgggctccattaggtctatgtccatcaagccagtgtggcaaatatttaacatcctgagcaaatgaattcaaaaagtgttttgctagtcccaagtggacagtgcctttaacatggtccttgtagggtgcttgtccatggcatttgttgttttggctcaacagtctttgacataaaatacagatgcaaacaagctcacatatcacaagtacacagcccaactaaagggttttcccctgttagatctaccactgtgtgaacattctttgaacagaaatctgggttcacatttctgtcattcctctggatagactcactaaaaggggaaatgatgaggttgagggcattggattccaaagcccttcagctttccgtgttgatttccagaaaaatccagccagtttatgccattatcagcagcatgtgggagtatctaattcataataatttcccagtgttatgattttaaggtggttgataatttggtacttaacaaattgtgcactgatttccagggatgattaatgaaaaaacattttattgccctttacacttttatgtatgtaacagcttcatatcctttgcccactgttattggggatttaattaatgtgtggtatttttttttaagcaattagggtgagtgttttataaaaaaagcttaattatgttttattatactttttaacatttttgctttttgtttcttcatttgatattttgtatttttatatatcatcttcatcagttatttcctatcaatggtgttcactttttacatttttatttattagtctatactgttactgttcatttagattatttcagatattttaaatcttttgtgaatacaattgagtttctttcaaagattctcatctttatagagaaaatattttatacttttaaaaatttgcataaatttcaggggtgcaagtacagtgctgtttcctggctgtactgtgtagtggtgaagtctgggtctctggtatgtcatgacccaaatgtgtgttgcacctactaagtaatttctcatcattccccttgcatcccccaacaaaatattttacaccttttatcagtaatgggcaaccattttagtttttagaaaaaacaagtgtgcttttagacaatataatctttttccaaggagtgatctaaagctggaaaaaggaatacatgtgagagggagccccttgcccttcttaccgtggttctcctggctgctgctccttcccaatttaaattacagttgttgttataaagtaacagcccttctgcccgcaaccctctgcagctgagctgcccctcctggacctgatgaagctgtacgaaggcgccttcctgccgagttctcagtggccccggccgaagcctgatggggaggacacaagcggagaggaaggtgcgctcccagcctttggaagaattcagggttaaaagcagaagccggagtacttacaaagacttaaaataagatttagaaaatttcttttagtttgataaaataaaaaattagaaatatttaataagtatctttatattgaatagaattttattaaattccgtgcttttaatttattaacctggcacagttatcggggcacttgatcatgttgtgaaggatgtaaaaatatttttctctagatttataaacatcattgttttatggacctagatatatttattcaggctgtgctgtgtttgttcaacacaccagttttgagtagtttattttacttggtattagactttctaaacagatgcacagagcataccagaaaaggtctgcctttcctgctctcattccagttgttgggacagttagacacctgcatgcgagttggggagtggcccacaggagccttggggaggtcaggccttaccagaccccacgctgccagcaggaccagaggaaggagtggcgggtttggtctcctcccggtttcccacatttgggaaagggttctgcttttttctttcttggtgatagacgggagatccctaaaccctgagacacctacatgtatctctctgtgataccagctcctaattgctatggagacattttccaaaatgccagactatttggggcaaattatactcttggagggctttccagaatggtccttggtttgatagtttcatgagagttctctcccatttatccaggtagcattgttagatattttggattacaaataaaaaattattgcctaattcagtatttaaagtagttggattctataaactttttcctgttttaaaaaaaggtttagatttataaagccttctcagtggccctcacttctctgttttattgtcgttacagatgcagatgactgtccaggcgacagggagagtcgcaaggacttggttctcatcgactcgcttttcatcatggatcagttcaaagctgccgagaggatgaatatcgggaagccaaacgccaaggacattgcggacgtcactgcggtggctgaagccatcctgccgaagggcagtgctcgggtcacaacctcggtgaggcgctaagctttcaagtgtgggatgggcctttgagagacagagcacatagcttagccatgagaaaagcttttcctcttcccagtgaaatggtctatcccaactgcagagttgtcagaaaaagcaattcttcatgtgcctgtagtcccagctactcaggagggtgaggcaagaggattgcttaaggccagatgttcaggcgttcaagaccagcttgggtgacctagcgagactcgatctccaaaagaagcaattcttcctcttcctgttttctgtagatcatttttgtggctttctaattggtttatcatgtgactgttgatttcagttttgagaaaaagtttgggtgattattttgacgagctgtcattcttttatttgttcatcactgcaggtcaagtttaatgctccatctttgttgtatggggctctcagagattatcagaagattggcctggactggctggccaaactttacaggaagaatctcaatggcatattggcagatgaagctgggctgggtaaaacagtgcagatcattgctttttttgcccacctagcttgtaacgaaggtaagagtttgctagtttttttaacaatacctatttgctaggacttacctataggccagtgtgtttgatgggagtgtggggacttggctatcttatctacttctttgctcctatctgttgacctgagcaaattgaggctcagaagtattcattttatgaatgaataaaaaactggttcacagttaacatccagtaacaattagtgaaaatctaataaaatacagagactcgtcaggctatgactgaaccttgtgactccagggtcaggtcactgtgcagtgtgtgggcagcagagcaggtggtccacttcccatgctgcttctagactggcatgaacccgccgttgggctctcagccgtgtggggtggtttgtggcatgcatcttggctcactgtatccttttcatgttatcatgtccatgcctcctctcgtccctcttgctggatttcacctgtcaatggggcagcgtttctgatccactgctcaggttccttagggaatgggcctgggtacactgtgtgggctcagtctctgcatggcagccccaactggctcttcaccctcctgacacttctagctggtacacagcttgtgtaggccctctggcctcctttccagtctttagagtcagctccttgttcactccccttcctctcttggcttttgggtcaagtgcccaccctagtctcctgctctgtgcctagctgcagaggaaggtgtgacttgtgtctctaacacaggacaaggtttcactgttcttgctcttgtaagagaagtgttcagtaaacatcttggaatgtggttcccactatatgttccagacttaaagtaggctttgctattgctgcagagaagaggggatttggccttgtctttacatttgagctttgaacgtaaagctggacacgtttaaattaggagggtcagcttagggaagcgatgaccccatgggtgctctgactgaaggctgtgtggaaagaaatggaacacagtgggcttgtggtgggggtctcagtccaagtagcttaaggagagagaggcagggctgagggtcccttcacctccagcgagggttctttttttttttgagatggagtttcactcttgttgcccaggctggaggtgtaatggcacgatcttggctcactgcaacctccgcctcctgggttcaagcgattctccagcctcagcctcccaagtagctgggattataggcatgcgccaccacacccagctaattttgtatttttagtagagatggggtttctccatgttggtcaggctggtctcgaactcccaacctcaggtgatccgcctgccttgaccttccaaaatgctgggattacaggcgtgagccaccgcacccggcctgagggttcttcttaacagttcccttctaagctgtttgcatagtttgccacagcactgttgttgaatacgtcttccttgccttctgttttgaaaaactcggtgcatctcatgataagtttttaagcataagcagatcaacttctgagcttcatattttcttccattatttgtttctgtctttggcccgtgtcacacagtttagatgtagtgctatagcatacattcatatgcatagttaattcaagatggaaaagctaccttgccttgctactttattatttgggttaaaagagtgttcactgttacaatagtaaaatattggaagtagcctatacattttttttttttttgagacagagtcttgctctttcacccaggccagagtgcactggtgcacccttggctcactgcacgttccgtctcctgggctcaagaggatcgcttgaggcctcctgggcaggaggatcaaggcgatcctcctgcctcagcctcccaagtagctgggactacagacgcttgtcactatgcctggctaatttttttgtatttttggtagagacagggtttcattatgttgcccaggctggtctggaactcctgagctcaagtgatccacccacctcagcctcccaaagtgctgggattacaggcgtgagacaccgtgcccagcctttttttttttttttttttttttaggagctgttgcccaggttggagtgcagtggcatgatcagggctcactacagccctgacttcccaggtgcaagtgatcctcccacctcagcctcctaaggagctacttaggaggctgaggtgggaggatcactgtaactgaacaaaaaactggctaagttttatatttttggcagagatagggttttgccatgttgccaggttggtcttgaactcctgggctcaagagatctgcctgccttggctgcccaaagtggtgggattacaggcatgagccatcgtgcccagcctggaagtagcctatgcttctaaaactaggggattgtgttttgtcagttgaacagatgagtgaatcagtcagcgttcattcatctgctccttacctgatgactgtcacagaccccaggcacttttctaggtcctgaggttgcagccctgctttcaggaaccccacactggtacagatgaaccttgaaatgggctaatgacccagcatagtgacaggagcctggccagctggagcaaggtctcagggagatggggcagtgggggtgggggctgcaagtgcagctggtgtccaggaacagcaccgaggccagtgtgagggtgagagggtaagagggtgtgaggggacggtgggggatgacaacagaaagattgcggtcagccacgatagaggcctatcaggccctgggagctgatgtggctttgccttagtgtgtggtctgcatcagtgcaggtgttggtacaggtgtctgctcaggctagagagcagtggtgtgatcatggctcactgcagcctcagcctcctgggctccagtgatcaaccctcctgcctcagcttcccaaatagctgggaatacaggtgtatgccaccacgcctggctaatttttttttttttttttttttttttggagagatgaggtcttactatgttaccctggctgatctcgaactcctggcctcaaaagatcctcctgccttggcttcccaaagtgctgggattagagagattacagctgtgagccaccgtgcctagccagcttttcttttttatttatttattttttaaatcttgtttttcactgggtgttaaaatatcatctggatttgatttgtgtttacctactctgaggttgtgtcttttttttttttttttgagacggagttttgctctgttgcccaggctggatggattgcagtggcgtgatctcagctcactgcaacctctgcctccgggttcaagtgattctccttcctcagcctcctgagtagctgggattacaggcacacgccaccacgcccagctaatttttgtatttttagtagagacagggtttcaccatattggtcaggccggtcttgaactcctgacctcctgatctgcctccctcagcctctgaaagtgttgtgattacaggtgtgagccactgcatgcagccggttgtgtcttttaaagagtttattgtcctgttatatttttttctttgtgacatttctgttcatatcctttgtttattttctattgggtggttcttttccaggatcagcaggaatgctttgcatattagcagtaatggccatagatggatgtgttgtaaatatttgtttaaagtctgctaagtctgtcttgtaacttggtttatgttacatttatagcacagaagttgaaatttgtatgtattcctctaataatctttaaaaaccttagttttctcgccaggcttggtggctcatgcctctaatcccagcacgttgggaggccgaggtaggcgggtcacctgaggtcaggagtttgagaccagcctggccaacatggtgacaccccgtctctactaaaaatacaaaaattagctgggcatgatggcgtgtgcctgtaatcccagctacacaggaggctgaggcaggagaatcgcttgaacctgggaggcagaggttgcagtgagccgagattgtgccgttggactccagcctgggtgacaagagcaacactccatcttaaaaaaaacaaaatcttagttttctgaagaatgaaatttgaaacaacatattttaggatggtttggatgtgccctgactaaagcttgggaagcagcgatggacacaagcccttggctaacaaaacacagtttagacgcctgctgtgtgggtgcctggcttgtgggaaggacttgagcagggtctggggctctcttagtctgtgagtccactttctgagtgttactcgtttcccctgggatcttggaggggttttctgtggtttgaatgaacactagtgtcttcttgggactgctcgttcaatgtgtgtctactaaggcctcctctggtgcaggcttggtgcttgtgcagcagcgccctgggggccaaggagcagcttctgggcagtgtgctggctccagatgaatgcacttgttcccccccaagtctgcctcagtcgtgcgatggctcatgtgacacatactcatactgatgaagcgtctctggtcagacacagtgctaggtgcctggacatgacagatactttgacgtggaaaattctgttttttgctttgtaggtaattggggcccccatcttgttgttgtgagaagttgtaacatactcaagtgggagcttgaattgaaacgttggtgtcccggactcaaaatcctctcatatattggcagccacagagaactcaaagcaaagagacaggtattttttttttaaacataaaataaagctaaacagaaagccatgttaatttttataaaagacacattaaaaaatgtgaagacatgcttattcatggaattattaaagatcactcattcatgagttaacagacctttatgttgttcccctcgaaagcatagacaataccgcatcggcctggccattccttgtgaggagggccacgcactcgcaggcccaggtgtgcacagatctcagtgtcactgcccagaaagtggggcagtttgctccgaaaatggtattctctgggacagtgcaacactttccccctggaggccctgctggcttccacaggcacagaggagaagctaggtgctcccagctctgaatttaaaacccatagaaccatttccacaacatgcctaatagataacgtttctggaacaaattttaacttattaaagatttttgtctgccctatagtttctagtactaggtcactgaaggtagattcatcacagttttccattgagtagaacgttttggaccattagacatcattgtgttgagtagtgtttactgaaaaagtgagctttcagtagtattttcttttttactattgtagtctgtttttggtgctattgcaaaataccacagactgggtaatttgtaagtatagaaatttatttctcacagttctggaggctgtgaagtccaagatccagatgccagcagatttagtgtctggtgagggcctggtttccgcttcccagatggggccttgctgctgcacattttggaggggacatggcggaagggatggaagggcaaaagggtccaagctggttccctccagccctttcatactgcacaagttcatccttgagagcagggaagtctccacttcttaatactaccaccatgggcattagatttcaacatgagttttggagggaacacattcaagccatagtactatgtctggcttttagtttgtttttaaaaagtgtataatgcagtcagttgcaatacagatgttgacatctcttatttttctgagcacacttccccttgttttgattagatactagaagagctcgccctgcttcaggatcctctgccataatctcagtattttccaaatggtaattgtcagcgcctgcaaaatagcttcttaatttgtcaacgaaactgctttagacccctagaggtagagataaaaacataaacacagccgttttctgtgcggtaatagcaagttatttaaaaaagcaagtaaaattataggtgggaacggagtcactgggtggcaagctttgggaagtgtgtgtcctcaaggtgattttgaaagacagtggagtgtgaaggcactgagctgtcctctctgtgctgcaggagtgggccgaacccaacagcttccacgtctgcatcacgtcctacactcagttcttccggggcctcaccgccttcacacgagtgcgctggaagtgcctggtcattgatgagatgcagcgcgtgaagggcatgaccgagaggcactgggaagcggttttcaccctgcagaggtctgtgtgttacgcgcttgtcattgagtgttctttgctgttgatgtagaagattctcttgaagaaatctgcataattgcagacacaaacaatggcctttgagctagagaattgcttttcatcttcatcccagcacatgggccagagagccccagagctgggtcagtgcagccccccttttcaggcatgtgcacgttgacatttgcggtgtcaaattactgtcccttttctcacacattgtcagagaagatgctgctgcagccagccccgtggctgtagaactccagtgttgtctcttgtcctgtttgcagccaacaacgtctgcttctgatcgactcgccgctgcacaataccttcctggagctctggaccatggtgcacttcctggtcccagggatctccaggccctacctgagctcccctctgagggcccccagtgaagagagccaggattactaccataaagtggtcataaggttacacagggtaggttgggttctgccatttcagttaattaattaaacatgcgtatgccttgttataaacgtgttacagcagcatttttggaaagaaaacagtaaacagtttttattttcaggtgacacagccatttattttgaggagaactaagagagatgtggaaaagcaactaacaaagaaatatgagcatgttttgaagtgtcgcctttctaaccgacaaaaagccttatacgaggacgttatcctgcaacctgggtgagtgtgggctctgggcatgtgccccctttgctgtccctgcctgtgagggaaaacggccctttctgtggcctcagcagaaagctcctttccgcaaggattgggtgtctggagctggagaccgaggcaccctcctgggggcagcaggctctgcagcctcaggtgtttccagctgtttcaggctcatgctggtcctgctgcacttcccgtctcagaagccccactcctgtgtagctgcccacgtgtagggtggtgtcctggtgctgctccctgtgttgcccagagaattctgtgaattttagtttccattcatccgggagggatggtgattgagcagctcgccttcccacagccagctggaggccccaggacttgggtcggctgtggcccaccggaggtggcacgctggtgtctgtggcgcaatgagtcgtgcgttgcatggggtggaatgcgccacgcaatgcacaccatgtgatggccagccgctgtgcctctgtctggcagggacgtgctggtgccagaagctgtgccctttgagttgacacagagtgtggggccccctttgaccctctccgaggtcttcagatgtgcatggttttggtctgtcaggctttccattttcctgagtttagatgaaaaaaacacaaaaaaccctggaaatcaagttttggaggatttgaaatttatctgtgcttagtcatcacacctcactctctgctgggggtgtggccatgaggctttgctgcagggttaccccctaccccgtgccacctcagcctcagcgtccctcacaggcacagtcagacacactggatcaggtgaccccactcttcccccagccacgtgctgatgtgctcccctccttgtggggagatgacatggggaccctgatgaggtgctgtggcgggagcagacgccaggtgatcgtatgagtgcactctggccgtggcacagcagactgtggtttgtggagactaggggtgaggccatgctagccacaccccaccccccgtcctgggtctccctctctgtgcctcatcctctgctctgggtctccttctctgtgcctcatcctctgctctgggtctccctctctgtgcctcatcctctgctctgcagccagagggcgtgcactcatgggctcgccagggttctgtgcatgcgcatgtggagcctgggcaccctcgagaggcaggtgcctgtgaatgcagcatgcttaatcctggtgagtggagatttcaggagggaaggtaagtgtgcatgatgactgtggaatttctcagtcctccacaaatgacacagtacaaccgtcctttctccaagaggcggagcagtggagcagcacttcattccacaccattagtggcgagactctccaagcattgtagaaactttgtatgtgtggacagaaaccgctttgccatgttgctgaagctctggtgtcagatttttcagtagaatactgaaatcagcctatgtcagctttggtaacatactagttgtcatttgagtggagaggactcataactttatgcaggttttgagcgccagcctatcagggaagtcacgttgaccacgccctgcgtacagagaccgtcttagggagtccgacccattgcccttctgtggttgtgcccacacaatatggtggtttgccttcagggttgcagtgtcgtctgaggtgtgagaggctggtggccctgggacctgttgggggaaagcacgtcttattctgctggtcttaggccagctttgtggcatctgctccctgggttaatggcaggagagcgcttggactcctcaagcacattttcctctttctttccgggcctgtgaaatcaagctttagtgcattaggtgtgcgcacgcctcgcccccctggagcacctggtaatcaagtgtttgggcgctgtctggtgcttgacgggatccttgggtggcccaggagcgtcctgtcctggtcagctcccccctcctcttgcagggaccatgccacacccgctgccgtgagggtggcacccatgtttctgtaccacgagctccagagctgccagaccagactccctacctgcccagacccccctgtgcttgtgccggcctctcctggttcctgttagccagggcaagttgcctttctgttaccagccagttcatatgggctttaagctccatcccttctccggaaccatccgtcgtctcagccattctttttgaagcatgtgatttgccctggcccttgtgcatgtaagtccttccctggcctcttttccttcccaccgctgctctctagagccaggctcacaggagctctcctgatgcttgtctccatttttcggtctccactcatttctcagcccccatgcaatgtgctcctcacgcatcaaggcctagctgtgtggggactcaggactccaggcgccgtctctcctgtggagccctcctgctttttttttcttttttttcctttttcttgagatggagtctcgctcttgtcacctaggctggagtgcagtggcacgatctgggctcactgcaacctctgcctcccaggttcaagtgattctcctgcctcagcctctcgagttgctgggattacaggcatgtgccaccacacctggctaattttttttgcatttttagtagagacggggttttaccatgttggccaggctggtctcaaacccctgacctctagtgatccgcccaccttggcctcccaaagtgctgggattgcaggcatgagccaccgcacccggccttggttgggttctgtggtgcgtactgctgtcatggtagcttctgtcacctgcacttgagctgacccttgagctcctcacgtccggcgtggcagaactgagctcgtgttttcccaagcctggctccctccctggtgttcctgttttagggtgtgcgccaccatcgaccaagttgtttgagttggaaatttgccattgctctctcctccctcctcttcccacaagtctgccatctccttcctgagtctctctcccgaccagttacctgtcgtcactatcaccccggtttcctccctcaggccgcctggtgcactgtgctcacaccagagagctactccccaccatggtcccatttcctgcccagccctggtcccagtgtgcgttgtaggtccttctgtctgcccccttcactgggtggtaagccgcacagggcatggacctgggtcctcgtctacccccgctcactgcctgcagggccagtgtaggaccaggcgtcagagctgccgagcgggtgtgtgaggggctttactctgctgcgctcaccctgcccctcactttgctcatcccccttggatgcccccacttctctttcagagcactcggtatgattgtgaatgaagtggagtggctgtctttccgtcagctctggtggggcggatgtcattctcaatggggatggcgaacaagtgcagaggggcctgcctgggatgtggacttgaatggccactctgtctaactcattaagcggacctagaaaatctgctcctgcctgcctttctggagttgggacagtcgatggtgagggtgggactatgtccatgtgccgtttggattgaatgcttcgtgtttctttctccacgggcagcactcaggaggccttgaagagcgggcactttgtcaacgtcctgagcatccttgtgcggctgcagcgcatctgcaaccaccctgggctcgtcgagccccggcacccaggctcttcctacgtggcggggccactggagtatccgtccgcatctctaatcctgaaggcactggagagagatttctggaaggtaagtggaggatccagaaagcggaattactgttggatatcttttctaggcacattatagataaaaccattcttggaaatgggttctcaaccagctcttctgcaattgcaattgcagctccgcgatacatggcaccgtctagcagcactgatggcctgccaccccttgccggagtgttccacctccggaaatttacccgagggagacaggctcacagagtggaaagatgcagagggcaggctttcttggcgttgtgtggattgtgggctgtgagaagtagctgagcatgcacgctcatcagcagagcttcaccaagggtgtggcagcacctgtgtattggcacggaggagggtctgcttgccgagtggccgttagagggggcgcgtctggatgcccacgttagggccctgccatagaaatcagttttgattcttaggtgctttttttgcctcttcatgcagcaagactttttttctttttctctctaggaagcagatctttctatgtttgatctcatcggcttagaaaataaaatcactcgtcacgaggcagagttgctgtctaagaaaaagataccgcggaaactcatggaggaaatctccacttcagcagccccagcagcccgaccagcagcagcaaagctgaaggccagcaggtgcgtgcgacccagaggcagcggggagggttggctcccagggcccccacagctgacccaggtctatgcgtggtgaaaagaaaggctgctaatgtagttaggttatctgctgctcttgggaccttgctggtgtccttggctgtggtatgcctggctctgcagatgccttttaggctgtgtggtgcagtgcaactgcttgcctccctgagcagcaacctccttgatcgtctttgcagcagttttagggtagggtgggtgtcagggctgcatttgacctggtgcctcgtgtggtggaggctggtgtggccgaaccacacatgtgtcgtgagtgtggcaggcagaggactccacccccacggtgatgtcattgtcttaacaagtgacatgtgagtgattctgaagtgatgcttttgcgggtgtcatgaggctgggagggacagacacgttagatgattaaaacgagatataaatgactcatagtctaaatctagcaattggaaatatccaaaatcctatgcttgggttaaaaagaaaggaaaggaaaggaaataggtatttggagatgaaggggccagctctgcagacagtcttgtgatccttgccattccaggagttctgcagtctttcttgttggcacttctgtatttggcttcactggggactttgagtggatcaccgtcccctcatcagtaccagaggtttctgcttagcttgaggactcacgacccagcaggctgctcctcagagagcctgcagccatcagttaaatgaacagcacccattccagtgggtgctagtctgtctttttaaaatggctttttacaaaaaagtttataaaagtttttaatagagacagaggtctccctgtgttgccaggctggtcttgaactcttgggctcaagggaccctcctgccttggtcccccaaagtggtagaattacaggtgtgagaccacacgcccggcctaaaaatggcttttgatggccgtctctgcctgttacattgtataggggttttgaaaatggccaatatagttcccagcttaaagtgggcacagtggctcatgcctgtaatcccagtgctttgggaagccaagctggcgggattgcttgagcccaggagttggagaccagcctgggcaacattgggagaccctgtctctccaaaaaaaaaaatcaaatccaggcgtggtggtgcacacctgtattcctagctacttagaggctgaggcaagaggattgcttgaagccgggagtttgaggcaacagtgaaccatcacttgaacggctgcttgatcagacttttgtcaagttgatgtttctcctcactcccctcagcccttgtgctgtaatagatgcgttgttttctatctacattgatatgattgtgaaagttaaaacagcattcacccttgtattcccaggaatctgggtggatgtaccataccactttggtgtacttagtcttgttagccactgcgcccgggcccggggtgagcttacctagagcagtacttaggcatctttccccttccctctgtaaactgcactctgggtgctggtccctgagctggcttcctatgggcagcggtgaaccccggctccatgaggtggcctgtcctctctgtggtctgatgctctgtatcttcttgcctggaccaatgggcatctaggttgtttcagcctgtgcagtatggccagaagcccgagggtcgcaccgtggctttccccagcactcacccgccccggacggcagcccccaccacggcctctgctgctccacagggcccgcttcgaggacggccgcccatcgccacgttctctgccaatccggaggcaaaaggtagacttcacgtagttgtctgctctccgccttatggaggtttttgtgggacaagttcatggcactttcttctcgcgcctctggatgcggtaattgtccctgagtgggaacaggcaccacccgctggctttctgaaggtgccttgtttagttcttgatgagttttagactttttgatggcttgtaatggatgttttccctattgaagaagcttcactcctaggtgataagtgttgatctgatgctcacagccactgggcaggctgtttctgttgacagaggtgcgtgcgtgcagtcgtctaggagactcctgagaacgtctgctcatattgtattttgtgctgtcacttgaacttaattattcttttgaggaagggtagagtagaaaaggccatcaaaagagttaaaagtagtatttcaccacctggccaaaggggccctccacgccatgtccatccaggttttctgagctaaaaataaatgctcagacctgcattgttgccagcattctctatagaaatatgagtggaagctctgttgatgttttctttgtgtgtttaggaaatagtttctaattgatactaatgtttggttgggctgacttctaacagtttctgtttactctgagaaatgtaccgcgtagcgtactgtagctcgaagtgaagataattatcaacaagtaaaattatatttctctcaccctgtaaactatatggcccctctttttttccttaagaggggacttctcatttgagagacggtgtgaaatgtttattttatttctttaaaattcagtttaaaatattgtattttattaagaacctctaacagctttgcacaaacaaaccttatcgattgcagcagcagcagccccgtttcagacctctcaggcttccgccagtgctccacgacaccagcccgcctcggcctccagcacagccgctagcccggcccatcctgcgaaactgcgggcccagaccacagcacaggcctccaccccaggccagcccccgccccagccccaggccccctcgcacgcggccgggcagagcgcgctgcctcagaggctggtgctcccctcgcaggcccaggcccgcttgcccagtaagtggcctcacctttccaggtttctgccatctctctaccccagaggagttgtgttaagaacacggggatgtaggaggagccttgctgtccactcctttgtctttccccagccccatgcccggtgctgcctctcaccagtgcagctgcctccggcatgagtctagcagggagcgcctctgtggaggccacatccggccttctcctgtctgtgctctctctcctgaccccgccatccagctctgcttttctgctgcactcactcactgctttggtgctgtggacggcacttcccagtgttagccccggccttgttccaccagccacacaggtgcactctgggggagcagatgctcctagagtgacagcgactgcatttgggaaggtcgcttccttgccagtcatgtgaactagctttaggttcctaaaaaacattagctctttttagtctctcgcctgttaccaaatttaaacttgggattgctcaaccaagataacttgtaataatttatgacttaaaaaacacagttattaatttttttaatacagaacattttgctgtgtccagtgggattagtatgttttcaaaccttacatgtaccctattcattctgtggtggaaattatcctgacttaaagtattatgttatttctcaagtgccacctcaactccttttgttgttggtatagccaaattatgtggaggcctttctggaaagatgcagatgggagagggagtgatgcacagagacacttgagttcaaactaattctctttccttacaagtctctctctcccattgcccaaaaataaagaggaattgtcctagttaagtgccctaagggagaaagcagttgcatattttacatcttcatcaaactagacactgtcttgcgtgggatgagagtcatgttggtggttgccagaggagctgttctttgggagatctgtgaagtgagcaaaactgcttttcctgtgggtcggtcctcacctgtgtatggaacaaggaggattgttgagagattgacacttctatgcacaaatctctgtcttctgttttcattttcccctccttgttcacggttattctgtgggcaagatatctctagacatttttctagcctcttactaactattctttttatcatatcactaataattctggcatggatttctcgggaagaacatttagattcaagtatcaaccattgggaaataagtctttaaacctgttgttcagttgtagccggaaggtagtacctttttgagttgggggcaaatgaccacatctgagttatgttttttcaaaaaaagtgttttaagcaacgctaagttttactttttttttttttaaacagtaaatgttatagattgacgcttaccatctaattcaaattagtatgaagctttatatcttaaagctttatttatgtatgtgatttctttatgtatctagaggcattgctagatcttgtagacaccgtggctcacacctgtaggcccagctgcttgggaggctgaggtgggaggatcgcttgaacccaggagtttgaggctgcagtgagctataatcctgctactgccctccagcttgggtgacagccagaccctgtctctcacaaaataaataaaaatacattcttagattttgaagagttatgggtgtaattgaagctagttatttttttatatttgtaaagatataatctctctttgtgagctaaattggacaggtacttttcacatttttaaagttctctaaagtttaggttcatatgtgagtttccaagtgtattacaaatacatttctgctttttttttttttttggagatggagtttcactcttgttgcccagactggggtgcaatggcctgatcttagttcactgcaacctctgcctcccgggttcaagcaattcttctgcctcagcctcgtgtgtagctcggattacaggcgcccaccaccatgcccagctaattttttttttttttttttttttttttttgcatttctagtagagatgggttttcaccctgttgtccaggctggtctcaaactcctgacctcatgtgatccacccacctcagcctcccaaagtgctgggattacaggcatgtgccactgcacccagctgatttctgctatttttgttgtttcggtagaaaagtaaaatgttccttaatagcttcgttaataatatcaatatctgatatctaaaatcccaaccaattatggttaagtaaagttaaccattaaaatctgacattttgttttctctttttaattaaaataattatttttaagaagtggtagaaaacactacctgataaacatttctgtggtgcttcagtttatgatagatggtcattatatacaagaaacgactgtcaatatgacactcccaaattttttccaaaatgatctgaattcaccttttcctctacgtttcaacaggtggagaggtagtgaaaatagctcagctggcatccatcacaggaccacagagccgcgtggctcagccagagacgccggtgacactgcagttccagggcagcaagttcaccctgtcacacagccagctccggcagctcacagcgggccagccgctgcagctgcaaggtaaggataaggatgagagagcactgatgccaaaaatgacaaaagcgcctcaccatgagccctgctgcccacgggcctgccttgtgcatttaagtgtcaggcttttccctgtgtccgatgatgcatctcacctcatgggttcatggaagaccagcgagatgacgttcatcagccaccgggttgcctgcacttgatgcgtgtcagataaacaacaggcactttcgttaccagcatctgcgctttgaagagagtttcgtattttgtagatcaaagtagaaatatttggccaggcgtggtggtgctctcctgtggtccaagctactcaggaggctgaggtgggaagatcacctgagccccagaggttgaaactgcagtgagccgagatcgtgtcactgcactccagcctgggtcacagactgagaccccatctctaagtaatagataagtaacagaaatatttgctgctttctaatataggtgtgagacaaattgtccctaaaacaccacaggattagtaattttatgtatgagaaatcattttcttctatcagcagacttaattttaactcccagacccaaagcccagacctttggtgaagagcagtgtgtttatatagtaactgctctttaaaaaaagtgagggagaggaattgagtggcgccttgtccccgtggtgggatcatttgctccctgtgtttttgtttagggctcaaggaacacccacagcagcccccgcagcctccttcccccaccttcctcgacagcagcctcagcggctaccttcccccaccttcctcgacagcagcctcagcggctaccttccctcaccttcctcgacagcagcctcagcggctgcctccccgccacccccccacagcagccccggtggcaccttcccccaccttccctcaccttccttcaccttccgtgactgcagcctcagcgactgccttcccccagtgctttcctcatgattgctgcctgtggcacttgtcagggtggagggtttcatcatcagtagggtgagcccactgacctccttagagagacacacacgtctcagcagaacaaggcctgccacagagaaacgattcagtctggtttacttcctttttttttttcttaaaacaaaacaaaacaaaacaaaacattttttggcccacagaggctgggtcgcttggtaacatctctgatggccgccggtttattcatagagatgacctgggaaactatcttctccagagtaaaagaagtcagaaagatgtagtcacacaagatccaaagtggcagcctcgttaaacagcagcagaaaagccacaggcatctgggctaaaaacagggttttgttctatttcttcattctccttgactgctgtgatctgggagtggggatgtccgcctcagtacctcgaacagcatggcaggtcctcagcagctgtgtgtcacccaccttccatgagggacagagggtagatggccttttcttgacatggagcaagataccttgtctcttagtgtgtcgtcatccactgtcggtgatgggttgccactttcctcacagtaactgaactttgcattgatttttttgtgtagatttgattttcagtttgtcaacttatttttgtactgtttggaagtgcctggagtgtgtggctgtgatgtacacatgcctgtcattgacacctagtggacctatgattgcaggcagcgtcctccagatcgtgtccgcccccgggcagccctaccttcgagcccctggccctgtggtgatgcagaccgtgtctcaggcgggcgctgtgcacggcgccctgggaagcaagcccccggccggcggtcccagccctgcacccttgaccccacaaggtagggtgctctgagcaggagggagacttggcttggatgcttctttctcttccatctaaggcgagtggaaagcattcatgtgtctttgactgtatctcagaacagcacagtctagtgtgtggccatctctgatttctatagatgtgtcctagtgtcagcctgatttattttctttttcttgtgctttcaaaggtattggttggatataaccagcctccactgtccttaggtttttgttttgtttgtgttctcacaagaaatttggaatcatgagaaatcttgcttgtttgtatatcgccagtgtgctccgtttcccctgggagtgggagtgtgtggccgcccacgcagggtctggttctttgtccggcccgagctgccactcctcatcctgtctcgccacctgcttcacctctgagtccccgctctgtgcctgccttggccccaggtctctctggacatgctctgtcatgatgtggtgtgtcctctggaacccagagacccgtggaggcaggtgggagcctagaggggtgaggctctctccttgggatggagcccttgtcctggtggccgagtggtgtccattcagttccagccccacctttgcatagtgggcagtgatgttgggtgggtcactgccaacctgttaggctctgttagttatcagaggaggctgcaaggctggagtggggaggggccatggcttgttctccagtcctgttagcatcacctagcagcagtcctgcatgccagcatggtcagcagttccactcaccaggttttgccgctacccccagaaccaggcatcttggggattccagaaccagctgctgcacccttctttgcgggctgatgagtcactgtcccgtggaagccctcctcagcttcagaggccccagtaccaactggagtcctggaccctgagggtctgagctcagacacccccacccccaagtgctgagttctgacaacctcagcctctcctcttgtttttccctaaggtgactcttacccctgggccccttttcagcactcagacacctctttgaccacatctttgtaggaaagtctgccgcactaagtggcatggcttctgccttcctgattggccctggctggtagcaggtgtcatgtcaggagcagctccagggaacggatatgaaacgggcactggcttgctctgttgcagttgtgaggactgggtggacttcctgccggggctgggctgctcatggcaggcaagggcctcacagtcatcaggcggtcacctgggctaggaggtggccatgtgctgatggcgatggggtacccagggcctcggaggtgtgctgggatgcttctgggtggctctggagtgcctcccaaaagaaagggataagctgctggctccattcagctccagtcatggcctgcgagccagcatgcttccgtggcaggtctaaagcatttaagtttgagcccatgcacattccaggcatgtgctggtggaggatgaggacttggggacatgccgttgcagaatgactttctgtggagtgtgctggtggagggtgaggttccatggagcatgctggtgtcagatgaaatcctgtgaacttggcgttccttttcacctcttcctttatgcatttgtagttggcgttccgggccgcgtggcggtgaatgccttggctgtaggagaacccggaacggcctccaaaccagcttctcccattggagggccgacccaggtaagcacctgagcttgagaccccggtgcacgtggacaggtagctttccaagagctgctcgttgtgtttggttgtgatatttaaaggctcctgtgaattctcaagtgatgttactgaattcttattttaaaacacacattttctaataaaataaatgaaactggacttacgactgccacaatctttttttgtattttttatgtccttctgcaagtcttcctgggcattagaattgctcacttgtgtcttgagaaatacttcccatcttggcaaagaagagaacgcttgtgctctcggcttcatttccatctctatttcctgtagctctcggcttcatttctatctctatttcctgtaacacaagaccggggatattgaagtggatctcatatgtgggaaatcacgggctgggtggggggttggtgaagacaggaacttgtcattctgtttctcaagtaactgtttttcatcactttttgataaaggaggaaaagaccagactcttgaaagagcgcctggatcagatttatttagtcaacgagcggcgctgttctcaagctccagtctatggcagagacttgctaaggatttgtgccctgcctagccatggaagggtacagtggcgtgggtccctggatggccgtcgtgggaaggaggccgggccagcgcacagttacacttcatcctcagaaagtccaagtgagctgatgttgacgctttgtcggtgtggagagtctctgcaggatgttattgacaggtactgcagacctcgtgaccttttcggtgctctctggctgcattgcaccccggcaagaccccttcttgtctcgtggatgtacatcttactcccatcggcttctccccacgctgtcccttagcggtctgttttgaagttagtctttgaggtcttcagctttgggatcagatggttttgttatctgggtctcagtgccaggtgcggcttctgaaggaagttggcagccctgggggcagagccgcagcactgagctcacactgtgcttggggacagatcactgtgttgctaaggactttctccatttgactctttcaaaaaatgattgcattaaaagagccccatgagtgagtgaacattacatgatgacaaatgtgggcaggagttgatctcagaacgtgctttaatggagagcaaatctgagcaccggtgggcacggtgggcacccggccgctctcaactgagcttgctttcagtagagtgcgttaccctgtttgcatttccactccctgcttggaccccatctccaggctccacttcagacatgttttcttcccttctttgcagctgttgtagttctcagttgtctcctgtctgcagagggcaacctggcttcttcctgtgccttggctcagctcagctttcaggatctacctatttcagttctttcagatcaggaagcagaattaatggaaaaaaagaaaactgggagtgcttctccaaggccgaacaagccacttctggcttctcctggtctgggagtgactatgtcagtgaccttgtgctcctggagtttttctttcgagtactgatttgtctttgtgtactcctccctcattgaacatcatgggtgaccattcgttcagtttgaatacagctgggagtgagtcatagttgatgtccatagcaagggccttctggtgcaggtgacctccacaggttgcaaggtgggccttaggttggctgtgcgatcttcgctctattgtcattgtcctgaaggctccttcaccctgagtctggcccccgtcctggtggcacagtggctatagcagttctagggtccacgagacagtgcacctttgtcccaaagtttccagctgaagacacactagaaagagaatggcttatctctgacctggtgcctgcggcctagggaatccacccccattgatccatcagccctggactgtctgaattagtccccgaggtggtggttattggccaggactggttaggatctgcctcgttgggcccctgcccgtgtgccaacacccacatccccatgtgactgggttgagccctgctgtttcctgggacttggactgtcagaagtctgccccatctttcaggagcccccatgctgggtgaaggtgtgtggctcctggtggtgacaaaacatgctttctgctcctcagggtggcctttgtgattcctccggtggtggcagcacccccgtccctacgggtgccgcggccgccacccctgtacagccacagaatgaggatcttgaggcagggcctgagagagcacgctgcgccgtacttccagcagctgcggcagaccacggctccacgcctgctgcagttccctgagctgaggctggtgcagttcgactcaggtatgcggcagttgggggcgtggcccgtgcgggagctgcaccggccctggatgatgaggcgctcttgatgtgattcgtttcccagggaagttggaagctttagctatcttgcttcagaaattgaaatctgaaggacgtcgggtgctgattttatcacagatgattcttatgttggacattttagagatgttcttgaacttccattacctcacctatgtaagaatcgatgaaaatgccagcagtgagcaacggcaggtgagaagcacattgtttacattgtctctgatgggtcagtcactggtgttgaatgcctaagtgctgtgtaaattcagtggtctcatggcccttctaagtgaaaggggagggacttaatgagcttctgaactttttaaagtctcaatccatccttcgatattttttattaaaagccacgttgttaggtaaatgcagtcttgatgtctcagaataaatgccggtgacctgcaatcatcattaagacgatactggcgtacttcaagaggtggctacagggtaaaaatatgaaaacaattccaaccaatttagaatgaagggaaatacaagttagggtaatatgcccattgtttacttacaagatttgccaaggctgttttgtttcatcaggcacagtgagtcagacactctcatatcctcccgtgaaagcataaactagtatagttctagaaggcagcctggcagtatggatttgaaccttaatagtgatgtatgcttgacctagtaattctgtatttaggaccctttacttacatgacaacaaacacaccacttaagatctgtctacatagttgttgttgaaatgtttatggtaattcacagttgagaacaaagtcagtgttcagcagaagagtgagtgcataaggggttgtccatgggccccgtgccctggcagcttcatgagcagaaactgcccagcatttcacgtggtgtgctaggcccttgtcagcagcatttcagagccagttttagtagcatggcccagtgtcccccagcgcaaaaccaagttgctgccctgtaagtcgcgcagcctgctttatctcacacacacgctcatgtacacgctggagaggcctagaaagaaatagagcaaaaggtgatttaacaagttttcttggtaatattatagcaaattatctgtagaatgcctggaaggaagagagttggtcagtgattaggtttcgtttctggcacagaaatcgttatggaagaaaagtattcaagtcatctcccttcatggtcaacagtgaggttagaggactatccttcacggttttgtttttcctgcttcctcagccttactccagggactttttgttgcctgtaaagtgctctggcattgcctgaggatagatgagaaagcacatatccctccccagtaagacgctgttttcttttggggcctacaagttgagctgacagtaaatgcaaggtggactctaactttttccttcttgtcactcatggctgatgttatttaaactgtgcatgagggtgttggcgatgggtgagcgtaagatgatagtggctgcacagaagagctggaatacagtgcggggaccttggtgttgctttaacatgagcctcgtgttgaatggaatacaaaccaagcagttttgctatgggataatttcttttttgagacagagtcctgctctgtcgccgaggctggagtacagtggcgcaatcttggctcactgcaggctcctcccgggttcacgccattctcctgccacagcctcccaagtagctgggactgcaggcgcctgccaccacgcccagctaattttttgtatttttagtagagacggggtttcgccatgttagccaggatgatctcgatctgctgaccttgtgatccacccacctcggcctcccaaagtgctgggattacaggtgtgagccgccacgcccggcctgctgtgggattatttctaattaataaatgttgaaacgtgtcaaaggtttcccaacattttccaagaatactaactcctgtgttttgtttcatcttaggaactgatgaggagtttcaacagagacaggcggattttttgtgccattctctccactcacagccgtaccacaggtataaaccttgtagaggcggacaccgtcgtgttttatgacaatgacctgaatccagtgatggatgccaaagctcaggagtggtgcgataggatcgggagatgcaaagacatccacatatacaggtgagggcctgcgggggataggatcaggagatgcaaagacatccacatatacaggtgagggcctgcggggatggccgcgtggaaatggagtcaatgagaagctttgcaggagatattggtgcaagaagcactaatgcagaaacaaaaggtagcactaaagacaatgcatgatatctaattttaaactagggtttgttttccttcagacaaacttacatttctgctattttatctatctattccttttatttatactcaacatttgcttgaaattgtaagttagtgatgctgctcacacaagtcatcttgccatcttcagtttttacgtgtggtacctcttgcagagtatctcagtcttaaaagtacgatttagattttgggttgttttaattatgaactataaattatctgttagtaaaatggctattgaaagaatggtcaacacctgtgaaaagaagagaaaagagaattagtttttttttttttttttcttttttttgagatggagtcttactctgtcgctcaggcggtagtgcagtggcacgatcttggctcaccgcgacctctgtctcccgggttcaagcaattcttctgcctcagcctcccgaatagctgggactacaggcgtgcaccaccacgaccggctagtttttgtatttttagtagagacggagttttaccacattggccaggccggtctcgaactcctgacctcgtgatccgcccgccgtggcctcccaaagtgctgggattacaggcatgagccactgtgcccagccaaaatctattattatgtttttgtttgtttgttttttgagacggagtttcgctcttgttagccaggctggagtgcaatggcgtgatcctggttcaccgcaacctccacctcctgggttcaagcgattcttccgcctcagccccccgaggagctgaggttacaggtgcgcgccaccatgccctgctagtttttgtatttttagtagaaacggggtttcaccatgttggccaggctgatcttggaactcccgacctcaggtgatcgcccgccttggcctcccaaagtgctgggattataggtgtgagccaccgcgcctggcctattattatctgtaaagataaaaactataactgtcaaaacacaattgggggaaatggggaaaggttactgtatatttttaaatttctaagtgcttactgttacagtgtaatagtagatttacttcttctgcttattttatgcctggttgtgtgccgagcacatcctgggctcacctctcatggtgacccgtcagttcccagtagggagcctgagactagacaaatatggtccctgcatgaggtctcctaggtggtagctgaccctggaactaaaacccaagtgtgctttaacctctttttttttttttttgagacggtctgttgcccaggctggagtgcagtggcatgatcttggctcactgacgcttctatctcctaggctcaggtaatcctcccggctcagcctcccaagtggctgggactacaggtgtgcagtaccatgcctggctaatgtttgtattttttgcacagacagggttttgctgtgttgcccaggctggtcccaaactcctgggctcaaacagtcagcccgcctcagcctcccaaaatgctgggattacaggcatgagtcactgcacccggccaaccatttgttttttaacaagatggttggtgtcatagtaattcaaatgctgtatttaaattgttttattattatttttcttgctataaatgcattacatgttcctcgagggaaaaaaggagagcctgtaaagaaaaacaaggatcctgcagaggcagcaattattaacattcagttgcacatcttcccagacacgcttctgcttcttgaagaaggctcacactgtgtcttcttttgtaaactttttttttcttttaacagtacattatacatacatttccatggtgatgaatataagtttggtgcatggtttatgttgaatggataagggcttagtgtggaatccattctgcattgttggcccttagcaattactagccagaaattggaaaagtgttgtattctcagtatcaataaagtctcaggcatggccttagcggtgcaggaacagggcatctgaagtgaggcatgaggtggccttgaaggatgcaggatgggctgtgccaagtgtgaagacacactttgttctcgagtgggtagacttcattcatgaacatgtgaagtttctccaaagtaatactaaaatttaatatatttttgtgaaaacgctcctcatgggtgtgaaggttctatgcgtgcacacacacggttgggtaaggtggtgccaatgtgcttgcagtgtggacgtcctgatgaaggccgccatcatgatgctcagtgttgcgggtgggagtgtgccccactatgagccatgggaacccccaaactgcataagggtgctgttggtgtcggggcagatagcccggcacccatggggatttcgcatgttacaaaggttggctgtcgcagtaactggagggcctttctgtcatgaatgtgccgcacaccttgtgctccacgagtgagaggaggggcttggagtgctgctcccacgcctgaccatggcggagtccagagggatgaaggacttgaatgttttcggtggagcagcagtgttagaacactcttgaagagacagtacctgtggccgagagctggaagggaccgcctgacccacacagaccccaaagtcaggggagacaggcacacagctgcagtgagacaggaagccaagcgttgtacagatacggtgagcccagtggacaggcgggtgatagaacagggagatttgccattctcagtgcaagtaaagagttaaatacctcttaaaaatcgagaagatacataaagacccccccttactcttaaataggaagggcctgtgaatatgaacagtccatcccaattggccagaaagtgtgagaggccgctccagctcactggtctggagaaggaaggaccagtttaatgcacgatgagatctctcttctcatgccccggacaggtgagaccttaagggaacgagcctgttcagcctggcactagaaaaggggacgtcctcatgttgatggggatgtgggattgctatctaaggatgtgtgtcgcagctttgtcacatggcacaaagcagtcactggggcacagccatcccacggtgttgagcagccaggtggaaaatgagctcatgtcgagggatttctgtaatacactgcttagggaggacagcaaaatgcagagaagtgggaagtaaggcggacattttccccacacggttgtgcacgaagtgacggtacatggagcatcgtggaagggcacacccaggttcacacacacagcatcgtggaacaacacacccaggttcacacggaacgtcatggaagggcacacccaggttcacacggaacgtcgtggaagggcacacccaggttcacacacacagcatcgtggaacgacacacccaggttcacacagaacgtcatggaagggcacacccaggttcacatggaacgctgtggaagcgcacacccaggttcacatggaacgtcttggaagcacacagccaggttcacacggaacgtcgtggaaggacatacccaggttcacgcggaacatcgtggaaggacacacccaggttcacacggggcattgtggaatgacacacccaggttcacacggaacgtcgtggaagggcacacccaggttcacacggaacgtcgtggaagggcacacccaggttcacacacacagcatcgtggaacgacacacccaggttcacacggaacgtcatggaagggcacacccaggttcacatggaacgctgtggaagcacacacccaggttcacacggaacgtcttagaagcacacagccaggttcacacggaatgtcgtggaaggacacacccgggttcacacggagcattgtggaacacacccaggttcacatggagcatcatggaacaacacacccaggttcacacggaacgtcatggaagcacacagccaggttcacgcggaacgtcatggaaggacacacccaggttcacacggaacgtcgtgggaaggacacacccaggttcgcacggaatgtcgtggaagcacacacccaggttcatacggaacatcgtggaagggcacacacaggttcacatggaacatcgtggaaggacacacccgggttcacacggagcatcgtggaacaacacacccaggttcacatggagcatcatggaacaacacacccaggttcacacggaacgtcgtggaagcacgcacccaggttcacactgacgtggctgctggggcggggggcaggagaggcaggccaccctccctgaagcagccatgaaatatgccagttaggaaaagtgtgcccgcggaagcgcacactgtcacacgtgcagcagcaccttcttgtgaaccaaggtgggtggaaatgccatccccactttttttagtggttctcagggtgattggaatccaggcgatttttgttttgttttgtttcttatgcttttatgtaatcaaataatttatgatgagcatgtagtaatataatcaagaaagagtagattttcatttaaaggccaggaaagtcttcccaggtggtggtttgctgttgatgaagttgtccatccactatttccctttatcacgtatttagttcctttgtttgtgtctgggttcacgtcttcactttccgtgctgttccctatgatggtttctctttaatatttaggatccttttaatttggaattttctgaaaaaaattttgttttcatctctgaaaatcatgctgttaaagttgtttaatgtgagcttttttgaggtttagcatttagcattttacaggcagatgagcctcatgggaaggcaatagactgcatggtctgttctgtgtccccagtgatggaatcttgaggaagccttgtgtccctgcactgggggtccgtctgtccagtggggtgacatctgcagctcacggtcgtaattgaacacctcttgtgggtctggtagtgtaccggggttagaaagagaaaaacgcccataattacatgagaatgaggtgtctcatgagtgttaacaagccagtctgtgaagtgatcagttctgcctgttgggctcagtgaaagcttcagagaagatagatgctggaggtacatctggaaggaccaggtgggacatttccaggttgagactggtgggagaaaaacgggatggcgggtggaaggatgaggtggcacagcgaagagtcttccggaggggcctcctgtcagctctctgggaggcgggagagctaagattggaggggctggctgagagcggcctttggtgccccacgaaggcatgttctgagcaggggtagctggaggagggacgtggattcgttgatcaccatctgcatgctgtgcccacctgttgtcactgtgtttcctggtgactgacttagcatcttacatcttttgtttgcaggcttgtgagtggcaattccattgaagagaaattgttgaaaaatggaactaaagatctgatccgagaagtggctgctcagggaaatgactactccatggctttcttaactcaggtactccttattcaatgagaggcctgaggtgagacccgccatgcggcgcgtggaatcgcatggtgttagtgcacactagcaaggggcttaggtctccagctgaggtcagatgcacacttggaccttgtactggggagtaacacacatctctgtgttcagcgaaccatccaggagctgtttgaagtttattctcccatggatgatgctggcttcccggtcaaagctgaggagtttgtggtgctttctcaggaaccttctgtcacggaaaccattgcacccaaaattgcaagacctttcatagaggtaagaatacattgaatctggctgaagagttgcacggtgggagccggcggaacacctgcaccctcccccagggttctgggtgctcagtccccactcttccctggcctgaagccctcttcccgtccctgcttttggaacctccccactcccttctttctgtcatggggattttgaactgtaaatacaagtgaggggaatggtggcgaaggtcgcggaccacaggcctgtcaccgaagcagtcgctgccgtcttcatctgcactttgccacagtctcagctccttcccctccccatggaaatctatccctgcctcctctggaggctctgcgggcactacccctactcccctctagctggctgtgttggcttctccctgagcagtgcagccatgagtctgcactcaggtgctgagtgtaaggtgctggttgattgcaaagactgagtataagaaagaacacagactatcacgttgatacttttgagtgttgactacatgttgaagtgataatattttggctatcgggttatgtcaatattttactgtttcggtgtgggtagtagaagatagagggcatgtttgggtcctttgatttttcccttttgggggtgctgctgtgtagacatgtcacagacccgtcacggggccgctgttccctccctgtccccgtggcttgcccgccaaagccctgcagccccacgtcctggagatggaggccttcagctgcctttgttctctgagtcccctcctccttcatgtggccctgccactcctccagaacttgttgtggggtccccgtttctgtgcctcttaccttggaaggatttggtatccctgtacatctttcttcctgccctgtttgactgcagcgcatgactgcatgggcttctctgtatgttttttcttttctgtgaaagtgttaaagaccagaccaggcacactacacagcccctcagcacctgtccgccgacacccgagattgagcctcccagcctcatggtgtcagccccctccttgcctgtgctcagcttgttcttaccaactctggtgctgtctcctcttccatttctaaacattactcagttactgaataagtaagaaatacttggggtatgactctcttagtctgtctgtgttgctgtaaaggaatacctgagactgggtgatttattttaaaaaggggtttatttcgctggtgattctgatggcagcagagttcaggattgagcatctgtctggtgagggcctcagacggcttccatggtggtggaaggggaggggggagctgcatgtgcaggccacggagtgagagagggagcaaggggcaggcagcaggctccctttaatagactggccctcacaggacgaacagggtgagacccactcccccagccccagagcgtttctattcctgagggatccacccgtgacccaaacctttgagaatttataatgaaaagccagtctcctgccctgcccccaaccccgccaccaccccgtttctcacatttcttctagagattgcatgtgtatcatttcctttgcacagaaataccttacagattattacatatgaggaggtatggatcaacctcattgtgttttaaggaggtaatacatgcatgaggttgaaaaagaaaaacaacacaaaagcgtagctggggccaggtgtggtggctcaggcctgtaatcccagtactttgggaagccgaggctggaggatggcttgaggccaggagttcaagactggcatgggcatcatagtgggaccccatctctacaagaagaattttgaaaactaggagtgtggtggtgagcacctgtagtcccagctactggggtggctgaggcgggaggatcacttaagcccaggagattgaggctgctgtgagctgtgatcgtgccactgcactccaacctgggtgacagagtgacaccctgtctcaaagataaaatatgcaaaggacctgactctgcatgtctcaaaggaaaacatgtaagtggccgatgtgtagacgaaataatgtccagcatcactaatcatcaggaaaatcaaataaaaaccacaggaggtaccaactggcacctattgggatgactgtcatcaaaacgcaaaagatagcgagtgttggcgaggacatggaggaaaggggcccgttgcactctgtccctgggaacgtcgttggcacagccaccatgggagacggcagggaggttcctcaaaaatgtggaaatagagctcccacctgatccagcaatcccactgctgggtgtatatccaaagagttgaaattagcgtgtaggagaggcgtctgtaccctcgtgttcatcgcagcactgtcccagcagccaggacatggaatcaacccaagtgtccatcagaagtctgtggattttccatattggctgtgttgtttcccagcagcatagtatttcaacacacagattcttttgaaacatacttgttgattgtcttactgtgtgtcaggcactgttataagcagtggggatacagggtcgaaaaaagacaaaaatttcatgaagcttttattctagtaaggagagaggcagaaaccaaacctagtgagtaaagcatgtaatttattcacatgagaagttgtgaagtgctgaatccaggggagaatgtggtcaccacagcagacaggttagtgtggctgagggggtggggagggtgtgaccaggtgaggcctgactgtagggagcccttggaagggtttgagtcaagctgtggcacggggtctggcatcacctaagagagtcgctctgactcctttgttgagactcagttgtagcaaggcaagggggatcctggggaccagttaagagtcccagagcagtaacactggtgagcaaggctggtgaggacaactgggggacatgtgggggcagcaggcgggtctttggaggacagagccagcaggacttgctgcagtgggtgtgtgaggaggatggctgctcctcactggcttgaccggcccctggggacagagaggtaggttagccttggccttttgccagcggagacagatccacgttagcgtgctgtactcgtacctgccgcatgggactgtggctataggattcttctgtcattggcaacgctcatcagaggatttgtgcctgcaaaatggttttaagaaaagtccttgttgacatgcaaaaacaaaacatacagcaagtgtacacattacaaagattccagctggagaaatgttcagtcagtagaagcacctggtagccagcatctggtggaggaggaggatgcggcgggctcctcagaaggcctgtcccccagcggtgctgcctcttgcgaattctgacagcaccgcctgcttctgcactttccatacgtggagcctcttccttcgggtctgccttcttgtgcgtagcagtctgtaactcgttctcattgctgtctagagttctgtctgaatataccgccgtttatcagatctgcagcttgtggacgtgatggagtggttcatttgaattgtgctcctgtggatatttgtatccttgtcttttggtaagcacgtatgtgcaattcaggctgcttatgtttgatttcaggagatgctgtggctgtgccggggatgctcctgccatggggttgttctgggtggtggtgtggaggcaaaattgctggtcctttcactgtagctgcagggcagaatgtgggatagtctcattgtggtttaatttgtggttttgctgttgactgatgagtttgagtgcctcttcatatatttactggcagtttgagtactttttaaagaaatgccaaggcttttcccaattttttttaaattggattttctctatttctttttttttctttttcttttttttttttttaagacggagtcccactcatcgtccaggctgcagtgcagtggtgtgatctcagctcactgcaacctccacctcccaggtcaaagtgatcctccagctcagcttcccaagtagctggaattacaggtgcatgccaccacgcctggctaatttttatatttttaatagagacgtggtttctccatgttggccaggctggtcttgaacctctgacctcaggtgatctgcccgccttggccttccaaagtgctgtgattataggcatgagccaccgtgcccggccagttgtctctgtttcttaatgacttgttggagttctttatgtatcccgataaaaggcctttgtttgatacacttgacatatctttcccattctgtggtttgcctttttaaacgctgtgtattgatgagcagaagttctgagttctaacaccatccagggcccacatctgccgtctttatagtgggtgctttttgtgctctgctgaggagattactctgcccacctgaaggtcaccgggcatcctcctctattttcttctacatgttgcattgttttatgtttgctatttaggtgcaccacctatctggcaataagttctgtgtatcgtgtcaaagtagtgttatatcactttgagggttttgccagattgccctggaaacagattgtaccagtttttaatttgtatcttctaactaaaaaccatacctccatgtcagatgtcttttgcccacatctgctagtaactatagatgtgtgttcctagctgtttcagcagatgaacagtggcatctcgtcattctaacttgtgtatcttgcactgtggtaaagctgtcttgtatgttcatagtcatccatgctacatttcgcggtggacttgctccggctgctgtaacgttgggctgtccgtctgctgtctgtttcctggacagcagcctctgtcctgctgtgtctgtcaggagctgtgggcagtggtgtgcatcgggtctgagatggagcctccttgggcctttcttgttctccaagcttccttggccctgggtgccctggcacgctttgcctgcatcagtgctcagctcttccatggggcctgcctgtccaactcgatagtaaggttagcaaggcccaggaggtttcccactcattttctgtattccctaagtgccttatcattttcacctgtaagaggacctcagggaaggagtggattacctttatggagagtgggtgattatagtggaggcatctccattaactttacatgggatagctctttttcaaactaccctcatttaaaaagtctatcaaggcaatctaaacatagactttcctcaggccctcaagagtattgagtatctggaggaggatgcccagaagtccgcacaggagggggtgctgggaccacacactgatgctctgtcatcagactctgagaacatgccgtgtgatgaagaaccatcccaattagaggagctagctgacttcatggagcaggtttgggcatgttttcctttacaactacatattttaaaaatttgacgcttctataaaatatttattgtttactgcaagaaaaatcactttttgattcaaatgttggttagtggattgtataaggaacttgacttttattaacttgctattaaccctattcaaaaaatatacttttggaacagcttacaccaattgaaaaatatgctttaaattacctggaattattccatacttctattgagcaagaaaaggagagaaacagtgaggtaagagaatcaacttttggtcagtgaaaaaaatttgcaatattttcagagttaagtttgatttgaagtaaatgtgacttcattaaattaaagtcacaaaagccaaaacccacaagtatggaaatgaacttaaaatgaagagagtctcgagaagcccgtagggaccgtggagcttgttcacccccacgtagggaccatggggcttgttctcccctcgtagggaccgtggagcttgttctacccctgtagggaccatggggcttgttctgccctcgatgtctttgactggatttgcagcaggctgctgcttgtgggggtgatgcattgtggagcagtgtgtgtagagaacatgtggctctgagacaacagggaaacctggagcagggactcgggggctgctctgagctgcactcctgatcctgaaagttcttgctgctctccccgtcaggacgcagtgatgactgcagtgagggcatgggagttctggaacctgaagaccctgcaggagagggaggcccggctgcggctggagcaggaggaggcggagctcctgacctacacgcgagaggatgcctacagcatggtacccggcccggggccctcctgccctcttgcccccctgctgaggggcacttgtgcagccatgtttggcttgttcaaagtctgtgtacattgacatgagaaaatgcctaggaatttttacttctcatatcaacacaacctcacttatgttctaaaaacacaattttcttaaaaattgacacttggagattgtcagttagatattgaccagctctgattaaaacatttataagtcttataaatagtcatgttgatcagaacttatttgaaagacttaatgagtatgaaggtacatgatttgtggcttataacatgacactgagacttggtggaagtcagagcttgccgtgttccctacaggagtatgtctacgaagatgtcgatgggcagacagaagtcatgccggtgagtgctgccctctccctttgtgtctgtgtgggcagcttcctgtgagttccacatctcatgggccttcccttctccatgcagctctggaccccacccaccccgccgcaggacgacagcgacatctacctcgactcggtcatgtgtctcatgtatgaagccactcccatcccagaggctaagctgccccctgtgtacgtgaggaaggagcggaagcgacacaaaacagacccctcaggtgcgcatcccgagggcgtcacatgacctgggggggccctggcctgcagaatccctgcatgtcagccactttctgctgtctgcctgtctgctgtctgcctgtctgctgcagggctagcgatcacacgcccatccgctgcctctcaggccatgtgcacaggttatgttgtttccagtgaggaaaccttcgtgtttcattctaattgaccatgaaggcccgaaagcaggtctgtctttggcaggtgctttctgtggcctctttgcccaggcacctccagacttgcctgacctgtttcctttgtcttttgcctgcccgtgtggaatctcctggtttactctcttgctgaagactgcctctctgttcagctgcaggcaggaagaagaagcagcgtcacggggaggcggtcgtccctcctcggtccctgtttgaccgcgcaacaccaggacttctgaaaattcgcagagagggcaaggagcagaagaagaatattctgctgaagcagcaggtgccattcgccaagcccctgccaacttttgccaaacccacagctgagcctggtcaagacaaccccgagtggctcatcagtgaggactgggcgctgctgcaggtaggtgggcgtggtctttgtgccagcggtcatgtgcggtcatttttctaacgcacgtccgtgcatccagctcactgtgatcactttgcagggagtctttggcaagagggaagaccttctgacttagagtgtattcacctgttttacctgaaatctccttctctaggctgtaaagcagttactggagctgcctttgaacctcacaatcgtgtcacctgctcacacacctaattgggatcttgtcagtgacgttgttaactcctgtagccgaatctaccgctcttccaaacagtgccggaatcgctacgagaatgtcatcattccacgagaggaggggaaggtaagcacggtctcgtttgtccttcgaggagagcacaggcaggtgtggtggccgtggcctgcagtttcagctccagtcctgctcttcactgactgggctccttcatccctgtgggtctgcggtgaagtccatctccttgggctcctggtggacccagcgaggtcaggtgtctgcactgtgcctcgcctatggcatgagcagtgatggaggagttcacgttgtgcttgttgggatcatgcttggtgttggcagcaggcctcgtacctgatgttttatctgataccaacatttgcactgccgttgtcatttctaagataatgagggtgtcatctgaatacttggccatatatatatacattttcaagaacgttttggatgaatgaaaagacctctcgcttggttttgatcatggcgtacttaaatgagggtgtcatccaaacacttggtcatatatagatagacattttcaagaaggttttgggtgaatgaaaagataagttgataagctgtctcgctttgttttgatcgtggcgtacttaaagaaaagtctgttactggtacctctgctattctggtaccgaaagactggctggctgcaatggtttgacaagcataatattctctgtttcagggttaactataagtattgcaaatgtttatttacgtgtagtgtagtcaaatcattggtctttcatgtaagaagtcagctgtgtggtttgtagcttgacccccgaagagtccaggcggctggtcagtaacatacaggcatgcgtgtggcatgccttccctcgagctgagtcatccctctctgttctgcatctggctttcttcaggcagctccttcttgctgcttgcctgcctttctcgcctcaggacagcatccagagcccccacaccagcagcgtctgcatgctctactgtgcccacgttgccagtgtccacacccattgggaggtgtgctgcctgacttccagggcacgtgccatgctggcgtgtggggaccaccgcctttcagttcacctcatggagcccatccaaacaggagctgtgggcacatcttcttgcatggaacagggtgggacacatatagtagaggcaggcatccagtacttttattgtatttacttttgttcctaatttgtgagaattaacattttctccatagtagccagatccatcctcaggatgcgaacatcacacttaatttatttctgtacccactctttcagtcatctgtcttttcatttttctaaaaacacttgtctcaaagcatttgtttgttttttttgttaaatgtagaaaagcaagttttcttcgtaataccactttgtggtcccttcaccaataagacttcctggaatcttgcattaattaggttttctgtgttttggaagcatttataataatagccattaccttattatggaaaaaaaattaaagctaaaatattgtattgggggaacctgcccccgatagtcacgtaggttcttttctattttccctaagtgttggccggtctgagaagtaaagggaaagagtacaaaaaagagaaattttaaagctgggtgtctgggggagacatcacatgtcggcaggttccgtgatgccccctgagcagtaaaaccagcaagcttttatgagtgatttcaaaaggggagggagtgtatgaatagggtgtgggtcacagagatcacatgcttcacaaggtaatagaatatcacaaggtaaatggaggcagggcgagatcacaggaccacaggaccagggcgaaattaaaattgttaatgaagtttcgggcaggcactgtcattgataacatcttatcaggaaacagggtttgagagcagacaaccagtctgaccaaaatttattaggcaggaatttcctcatcctgataagcctgggagggctacaggagactggggcttatttcatccctacagctgtgaccgtaaaagacagctgcccccaaagcggccatttcagaggcctaccctcagagacgcattctctttctcaggatgttccttgctgagaaaaagaattcaacgaattcagcaatatttctcgcatttgcttttgaaagaagagaaatacggctctgttccgcctggctcaccggcagtcagagtttaaggttatctctcttgttccctgaacattgctgttattctgttctttttttgaggtgcccagatttcatattgttcaaacacacatgctctacaaacaatttgtgcagttaacaaaatcatcacagggtcctgaggcgacatacatccccctcagcttacaaagatgatgggattaagagattaaagacaggcctaggaaatcacaagggtattgactggggaagtgataagtgtccatgaaatcttcacaatttatgtttagagattgcagtaaagacaggcgtaagaaattataaaagtattaatttggggaactagtaaatgtccatgaaatattcacaatccacgttcttctgccatggcttcggccagtccctctgttcggggtccctgacttcctgcaacaatattgtcttcttttatagctgatttatgaagctaatccaaagaaaaaggcaaaaatatttgtaaagtttgagagtgattttttttttttttttttttagacgggaatttcactgttgtcacctaggctggagtgcagtggcacgatctcggctcactgcaacctctgcctctcaggttcaagtgattctcctgcctcagcctcccgagtagctgggattacaggtgcatgccaccatacccagctaatttttgtatttttagtagaggcatgtcctctactgctagaggaatgccctaaatttcaccaggttggccaggctagtctcgatctcctgacctcagataatctacccacctcggcctcccaaagtgttgggattacaggcatgaaccaccagccctggctgtgggtgatgttctgaataagttggagcactttgttaagagcctgtgcacagaaacatagagtaagattcagtcttaacctgtattttaggaatcaacagaaacctgagacctagaattttctccagggcctctcattctgtacatagaggacatgcctctttgcattagaggaccccatggtgacttgccgagccccctaaaggacatcctgagcctccatgaccctcactccctgtggaagcccatgatagtgacagtggtcggatgtgtgcgtgagtgggacagccccacctctcaaagcctgcgggggctccagcaagccatgcggggcggggcattcatgcctggttagagcctgcacaggagttccattaccagacacacggtctttccatctctgacttggctcagttgagccatccagtgtcatgtgtgataggcctggtattagtcttatgcaccccttctccctgcttccctttgcttactcttaggataataggtaggaggagaatgcttccctgtatggtacagtgttccggaagcagactgctgtggccttgcatgttggtttctagttctggttgtccttggtgttgccttcagaatttaaggcattcctctagcagtggaggacacatgtgcacacagacatgtatacatgtacctgcacagacacacccatacctgggcctgtgctgctgtgtcatgtgagagtcttggttttcgccttggcacactctctttgaccagggtttagaggagcatgggggaagagccctgggtgaggaaggaggtgcttgagccctggtcttgacttgtcgctacctctgtgaccttgcacagacagcattcctgggacagctgttcacttcacaggataaggagttgctttaaaattctgcaggattctaagatgtcttgggagcacatagcccacaattgagtggcccattgtttagctgtgccatttatgaaggaaagactgccagccataagcactgctagagaccccaagaatgtactttgagacaccactgggcatgcgccagcctcactgtccaccgtgggcagatgacagtgttgtccgtggcagtccgcgctgccccttggtgttagcgggtgaaggctcacagcccgctccacacagtcacctgccatgtgaccttgggcactttgcacacctgttttgttccctctccctcttggggtgattatggggcttacgtgagagaacacctggaaaggattagcatggactggagagtgtcacagcagtcggccgcgacagccacttaatgccgctgctgttgggttatgcctgaacttggaaagaaggcccaggaaaaggaagtttgtgttcagccatggggagtttagcctcagattcccacccagtgagccctgtgtcccacgcagccgtctgtccatgctgcctaattcagatgcactctcgtcaatttcattgcagagtaaaaacaaccgtcctctccgtacgagccagatctatgcccaggatgagaatgccacacacacccagctgtacacgagccactttgacttaatgaaaatgactgctggcaagaggagtcccccaatcaaacctctgtatgtttcctgagtgctcattttatgttcattatgactgagtagattgcgtgaagcttggttttgatgtgtttttaacatacccttcttcagatatttcctttatttaataattgctgtctcactgtctatacttcaggcttggcatgaatccctttcagaagaaccccaagcacgcgtctgtgttggcagaaaggtatttctctattcgtgacacatttgttactgtttggaaggatttcattccagtgtcatctaagttcagtgagttcagcaaatcgttgtgcacttagcgtgttcaggcatcagctggacgtggcagtgcgcagaacctgcaggagagaggtgcttttcctgccgtgggctagggtatgcataggacggcccctgccctgtctctgtgttacagggattgtccttgctggccctcagtggggaaagacgctgacagatgtgatgagtgtgccagggccatgtggccaaccacaaggggctttcttcctcacaccccacctctcaggcactgattttgttcgccatatcttaagaacacaccacatttaggggtgtgtgtacctgccctgaagttatacaggggaaaagaggaatgaatgaatggatgggtacagaagtgggtagatgcaagaaagtaaatggggtaatggatggtggaaccccagtgtggaaccttactgccaggcacatgggtgtctgtagcgtttctgactgtcggactctttccataaaatgttggaaaggaggtctgctgggatgaaatgatgtgcatctggtttaggcactgttgtctgtaggctccaaccctacagggtcggtgggtttctccccgtgtgcggagacgagagagcgtagaaataaagacacaagacagagataaaagacagctgggactgggggaccactactaccaagacatggagaccagtagtggccccaaatgccaggctgcactgatatttattggatacaagactcaggcaggacaaggagtgtgagccatctccagtgataggtaaggccacgtggatcacatggccactggacagggggcccttccctgcctggcagccgaggtagagagagaaggagagaaacatcttacattattatttctgcttatcggagacttttagtactttcactaatttgctgctgctaactaaacggcagagccaggtgtacaagatggaacatgaaggcagactaggagtgtgaccactgaagcacagcatcacagggagacggttaggcctccggataactgcgggcgggcctgactaatgtcaggccctccacaagaggtggaggagtagagttttctctaaactcccctggggaaagggagactccctttcccggtccactaagtagtgggtgtttttccttgacactaatgctactgctagaccacggtccgcttggcagtgggtgtcttcccagacgctggcgttaccgctagacccaggagccctctggtggccctgtccgggcataacagaaggcttgcacgcttgtcttctggtcacttctcactgtgtcctctcagctcctatctctgtatggcctggcttttcctaggttatgattatagagcgaggattattataatattggaataaagagtaattgctaccaactaatgattaatgatattcatagataatcatatctaagatctatatctggtataactattcttgttttatattttattatactggaacagctcgtgtccttggtctcttgcctcggcacctgagtggcttgccgcccacagttgtcacacagtggcggatttgggaggcttcctcgttctgtggccccctttccgcacagtagtggagtgatccttgtcagaaggagttggctcagggcccatctccgcaaacccccaggactccctactgcccacgctctgagtcgcctggccctggctttcagccccttggtgctccctgagtgtgctggcagccgcgccccagcccttcacttaactgccctcgtgagatgttttcagagcgcactgttgagaattgcagccccgccctgctgttttcctccatagcagccagtacgtcttcagacccactgcacattttacctgtttgtcgtctgatgtgagtgctgtgatcgctgggactctagcgtctgggagcacagacccatcatttgattgatgttgtcgattaaatgaagagttaattcaccctactaatatttatggaccgcgggcctgcgcggcgtggagcctgggcattctcgggggagcgagagaggcacagtcccgccctccctttacctccctggagaggaactcgagggcatcctcacagaaggaacagacagagattttcccaagtacagtgcagacacatgaggtgggctgtgcgtttgggggctgccacaagtacgctggggacgtgttcggagatacttttcctggagagtgggagagctcggcctcaaggaagaggactcagcgccaggctgaggatgaggtctaggtggctcgatctcctgcagggcacattgggcaccttgctttacgccctcatctcttgggctggagctgccccagcacctggcagcatggtgtttctagggtacgtggtacttgtctgtcttaaaacttgcctgtatgtttttaacctttgcgtctgtctttcagtggaatcaactatgacaagccgctgcctcccatccaggtggcatctctccgtgcagagcgaatcgcaaaagagaaaaaggtcagcgccctgggcccttctgcttgagtgggaaaatgtggtgactgtgacttcatccagggggtatgcaggccgagtctgcccctccagtggctcctcttccttcctggcccctcaggctctggctgatcagcagaaggcacagcagccggccgtggcccagccacccccgccccagccgcagcccccaccacccccgcagcagccaccgccaccgctgccacaaccacaggcagcgggcagccagccgccagcagggccaccagctgtccagccccaaccccagccacagccccagacccagccacagcctgtgcaggccccagcgaaggcgcagcccgcaatcacgacggggggcagtgcagccgtactggtgagcaggggcctcctcccgggcttcccctctacgggaagtcacccacacctgcacttgattcaagtgctttctgttgaaacgaagacttgttgccagttctagcacatttccagcttgtagaccttcctctgaagaaatgggaaaaggcttagtctcatcccagaggaattgtgtgttttcacctggattctgccatttctctcctccagggcttttgtgggcttagtggctttattggatttggcaggtagaggcagctccttttagtggaggtggttgggaagtttgtaattgcctgggttttgtaaaacatacctgtgacgcattcacttcctgacttcctacacacttagagagcaggtactgcctgtgtcggtgtctcaaagcatgcccatgtgtgctcccccacacaggtcagtctttaatgcctgttgtagaaaagctgtaaagcacacaagaagcattgtgaaaagaaaggcagggtgcggagctgcggactgtggccatgcacaccacgctctggtgtatctctgtactgtgtgcgtccgtgtgccacacagacgctgaaatcatatgcgcagaatcacacctgcagagaataggagctgtgccaaattggggaaacccacactttggactaccaggcaggcataaaaatatttttgttacatagaaccatttcctgcagtagtttttagaaaattgtttgctgtagtggaatttttatatgtactcaggcaacttcattcctcatttattcaaaagggatctttgtgaatacttacttggtgcaaggtgggcaagatgggcagtgcccacattctggagccacgtcctacaggggagggaggcagccaaagggatcattttaaatgctggcgggaggagtcagggtggcacaatgcaggactggcttgttaggaaacacctttctgaggacttggcatttgagctaaggcctgaatgacaaggagttggtcataagaagaacaaaacagcaagtacagaggccctgagcttggctgatatgggggccagaaagctcagtgtggctggactcaggtggtgagggacagagggtggatgaatggagtggagggacggaggagtggagggacagtggggtgagggtggagggacagtgggatggagggtccctggggtggagggacaatgggataggggtggagggacagcaggtagacagagggtgggggcaccgccaggtggaatgagctggggaggatgggacaggtggctgtgtgaatgtcgtggagtttggatttgattctgaatgaagtggaagcctttggaggatttatgcaggggagagcctgacgtgaaattcaaatggattttttttttttaaataggcaggaaccattaaaacatcagttactgggacgagcatgcccactggtaagacaaatacagagatgctgaaatgtggaccccatttctcctggcgctgttgccttatgcccgcctgtctccgcaggtgccgtgagtggaaatgtgatcgtgaacaccatcgcaggggtcccagctgccaccttccagtccatcaacaagcgcctggcgtcgccagtggctcctggggccttgactgtgagttgcgcttcacctgggttgtgcaccttgactgcattctgccgaaattatttgcttgtctgttaattcttcttcttctttttaagtattccattggtgaaaaactgtctagtttgaatttcataaaataagtagctgatcagtatgttgatttcagaaacattcagctgtttaggggatggtttccattctgtatgagggatgaaaatgaggtggggtatgtgtgtgtgtgtgtggtgtaggggtgtgtgtgtgtgtgtgtgaggtgtaggggtgtgtgtgaggtgtaggtgtgtgtgtgtgaggtgtaggggtgtgtgtgaggtgtaggggttgtgtgtgtgaggtgtaggggtgtgtgtgaggtgtaggggtatgtgtggtataggggtgtgtgtgaggtgtaggggttgtgtgtgtgaggtgtaggggtgtgtgtgaggtgtaggggtatgtgtgtgaggtgtaggggggcgtgtgtgaagtgtaggggtgtgtgtgtgtgtgaagtgtaggggtgtgtgtgtgaagtgtaggagggtatgtgtgtgtgtgtgtgtgaactgtcccctccctgtaggatgattttagataggaggtaggcgggatgtgagggtccgctgctgattctattgccgcaggtgccccccatgtgcttgtcactgtgcccatgtggggaagctaagagatgacagccctcttgggggcgtggttttgggggaggggacacggcatcacacgagggcatggctgggtgtgtgcaaggagcaggtgggcatgggaggagcgggcagtttctacggaacgtggagaccccaggtgtgggaagcggtaggtgcagcccacccaggtggagaggaggcacctaggcaaaggtgcagagccatgtggtgccctgggaccacctgcttctcttgggtgtttcatcatcagaaccaaacacaagtgagaataaggagctcagatttgtatctcgattttccaaatagttcacagacccaggggcaacataccctgaatgagaagaaacgatgcttcaaagtcagtgctttggcaagtagaatgtagtctctcttgggttttgaaaagcatctttcctgtgaagatgtcgttgctgtagtagcctagatgatggagcattggcaggatagatgtgtagatgatggaattggatagagagtccagaaatagacccctccccaacacaacacacgcacacacacacacacacacacattttcagttgacctcagtaaaagtgccaagggaattcagtggtgaacagactgtcttgtcagcaaacggtgctgtaacagttgggcagccatgtgcaaaacaatgagccttggcccgtaactcacacggagtatgaaaggcactccaggtggatcacaggcctgcatgtaaaagcaaaaactacactgtaagccaaaacagtagcatttctaggagaaaatctgtgctactttggtttaggcagagatttcttaggataccagaagcctgtgaatcctgaagaaaagttaatacgttaggcgtcatcaaaattaaggacttctgctccttgagaaatagtaagaaaacgaaaagcatagactgggagaaaatataaagattcttcaactcagtagtaagaaaacaagcaactgtataaaatgggcagaagatgcagcagtcacttcaccaagaagctagaagaataacagataaatacctgaaaaggtgtgcaacgccatgagtcatcaggggaatgcagatttttacaaccacagtgatacaccaccatgtgcctgggagagtggcttcagaaacagaaggctggcagtcatggaagcagcgaggaccctctcacaaggttgtgggaatgcagagtccacagtcgcttcctaaaacagtttcttataaaaccaagcctactcttaccatgcagcttcgcagttctgctgctaggtacttccccaagagaagtgaaaacgccagaacaagaaccctcaacaccaatgtttatagtggctttattcaggattgctcaaaaagaaaacagcctaaatgcccttcagctggtgaatgggctgataaaccatggtacattcatacagcccagtcctaccaagcaatacaaaagaatgaatgcccgagacatacatctccatggaggactctcagatgcattttgcagctaagtgaacagtttcagaaagcttcatatgctgtatgactccgtttcaataacagaaaacagatgaatgattgccagatgcgggaggggctccactacggagaggaattcgagaacgttgggagtggtggggtcatggcagtagctacgtgatgataatgtgtccgtcagaattcgtagaaccatatattgtactctgtaaattacccttcaataaatccctctaaaacactcttaagcagtagaatatatatacacacagtttttctagtatgtgactttaagattatttcacttttctttctgctttgcagtaaacaacttcaggctctgtcactgcagtagatagcagaagctgttaggcctgaggcgtttggaacatcccgtatgaccaataccactgtttctatgagggtaccaagccagaatcactgcatttagcgttttattttgaaaaagacctgttctttgtggtattttaaaatgtaaagcatttcattcacgacatatttttgagtggctcttaatggacaagacattcttcctggcactgtgggcccaagacacagtgtgctttcatgggggccttgtagtgctgtggctggaacatgagagaggtgcagatagcagtggtggacatgtgtgattgtactcgggggactcagagaaggctttcaggagaaagtgatgttgggcttcaggaggacaggaagtacgtcatccacagaactggcccttctgaatgcagggccagtcttgtgagcggagggtctgaggggaagggaatggcgtgcatggagaatggcatgttgttctgtttgaatggaacacaaaagatattaacagagaaacagtggttccctgcctttaaaaagtttttattgagtggcttctgtgtgcttggcactttgtaatattgaggctagattgtactgggctttggatattgggctaaagattggatttttttttttttttttttgagacagagtctctccctgtcacccaggctaaagtgcagtggtgcgatctcggctcactgcaacctccgcctcctgggttcaggttattctgcctcagcctcctgagtagctgggattacaggtgcccgccaccgtacctggctaatttttgtatttttggtagagacggggtttcaccatcttggcctggctggtcttgaactcctgatctcgtgatccacccacctcagcctcccaaagtgctggggttacaggcgtgagccaccgcgcccagcctagactatggattttattcaccaggcagtggggagcccttaacggtcttagagcagagagaagttctaggaaaattaacgtgctcctacgtatgtagaattgattagagtagaagaggctaaggagaaaaacgatttcttcctttttttttttttttgcgacagcatcttgctgttgctctggctggagtgcaggggtacaatcacagctcactgcagcctcacactcacaggctgaagcaatcctcccacctcagcttcctgaatagttgggatgcgaaaactgtttaaggagtccagaaaaggatgacttctgtttctggtaacaagatgagttaagttatttttataccacctcttaatgaaaagaactgaagttattggataaaaatttttaaagcttcaaggaattgacaagaataattaattatcaggcccaaatctaagggagggaagaaactcagagaaagaaataggattcactgaagtcatgtttgccttgaaaataaatttcagcttgtggaatgagggaacttgaattcaagtccaaggctgggccaaggtggagaatctaaaaaggaaactattgatacaccgaggtagggccccaggtggctaaacctttagagcaggagtgaaccagaagcagaatccatctgcccttggccttcaggggtcaaaagaagagtagcccttggattgagtagtggagcatggtggggacggcccccgagaggttgaaaccacagggtagtttgcagctcaagtcgatattaccttaaaagtgtctcccgcactccctcacatcaagtgaagtctacctgcttcagtgggcatgttcctgggcagctgacctggagcaaatgcagattctctctggaggattgtgctttcttgacttctgagaatctccacaaatagttttctagtataatacagtacaatacaatagaatacaaaataactaaacagagaagagaaggcattatgagtgagaatcagcggaatgacagacactggataggcctgtaaagatgtgcgatattgggattatcaggtttagattttaaaggttaggctttcaggctgggcgtggtgtctcaacgcctgtaatcccagcatcttgggaggccaaggcgggcggatcacgaggtcaggagataagagaccattctggctaacacggtgaaaccccgtgtctacagaaaatacaaaaaaaaaaaaatcagccaggtgtggtggcacgcgtgtgtagtcccagctactcgggaggctgaggcaggagaattgcttgaacccgggaggcggaggttgcagtgagccaagatcacaccattgctctccagcctgggtgacagagcgagactccgttaaaaaaaaaaaaaagttatgctttctattttaaggaaatagaagattgagagtatctgaatatctgtaagcaggaaactatgtttagaaagtatatagagaacttttagaaaagtctgattaccaaaactgggggaaacaacccaaacttaagaatgggcttaatatcacacaattgaggagaaaatgagggaagtggaggcaaaaatcagaagacatcctacacacaacatgggatgacaagatgacacatggaggacatggtgacagggcctgataggtagtcactgactatcagacagaaaattgagcagagtcaatatttgaagacagaatagtttttgagaacttactaatgacactgatgcgtatatgtagaaagtctaatcccagtcaaggatgagaaaaaggaaccacgtctgcataatgctagtgaccaagaggtctttcaagcagccataggaaaagacagattgccttcagaggtggagcggctcacttgtcagcagcagcagtgaggccgggagccagcgggggtcgttgtcgtgccagggaaagaaagttgctgccagcctagggctctgcatctcttggagatatcttaaagaacaagggaggccgggtgtggtggcccacacctataatcccagcactttgggaggccgaggcgggcagatctgaggttgggagttccagaccagcctgaccaacatggagaaaccccatctctaccaaaattacaaaattagctgggcgtggtggcacatgcctgtaatgccagctattcaggaggctgaggcaggagaattgcttgaacctgggaggcagaggttgcggtgagccaagattgcgccattgcagtgcagcctgggcaacgagagcaagactccgtctcaaaaaaaaaaaaaaacaaaaaacaaaacaaaacaaaaaaaaacaagggcaaaataaagacattttcaactttggaccttcactgaatgatatgctttaagcagaagaaaggtgttcccagctggaagtggtaacaaggtagactcatggatgaacgcaggagctcactggggttagaaagaggaaataaatacacaggacaataacatgcaagctggggaaggggcagaggggctgaaatgtgcacagatctcgttactgtttaggaaaagcatggagtatttagactttggcaagcatccgtggtaattccagaccagccaccagaagaatgagagcagagcgagttgctcccaactgtggcagggacattggtgaggaaagagtcatctgagaggaggcaaggaaggagatgaaaagaaacatacagcagctgggtggaatggaaaacatggagtaacacgctagatttccatccaaatgcgtaagcaatgagacataaaaggatcaagagaaactaaaaatacactgcacttcggaaccaagggagctggcagaggtcagctggagggacactgcagaggtggcatgattgcgtttgccttccagtttatggtgggacaaggaaggacggtgaggcaaggtgggatagggtgaggggaccactctggctgccacttctgcctgcgggccagagtggactgcagggcacagtgaggatgctctgaattttaggcaagatgaaggtaagatgccacaagaccccacgcacatggtgagacactcagggctgtagtttcagcacagatggggacagtggtagagagccaggactgtgggctgtgtgtttgtgggtagcatgggtgcctcaaggacagtcgttacgttcctggggaccaagaggtctttgtgcggagagggagggacaggacggcctttccagcatgtgcacgggcgtgccgccatctgaagcgtgtttctgtgggtgatgtgatctgctgggagaaaccattgctcagggcacttgcttgtgaatttacacatgaaatcagcagttttcaaaagactgaactctagcgtgtgtttcacttgtttcgcctctgaagttgggtgctcttgtcttccctgctctgagtgtgaacagccctgagtgctgtgtgaaatatttgatgaggtcctctgtttgccttttctagacgccgggaggctctgctcccgcccaggtggtgcacacccagcccccgccacgggcagtcggctccccagccacggcgacccctgacctggtgtccatggcaacgactcagggtgttcgagcggtcacttctgtgacagcctcggccgtggtcactaccaacctgaccccagtgcagaccccggcacggtctttggtgccccaagtgtcccaaggtaaagccaggctgggagctttctctgccacacgtctgctctggcgcgtgtgagggctcagctgctgcttgctgtctgagaatgaggatctgaaggtgggcgagtatccctgtccagacctaatgagcaaacctcttcatagccacaggagttcagctccctggaaaaaccatcacacctgcacatttccagcttctcaggcagcagcagcagcagcagcaacaacagcagcagcagcagcagcagcagcagcagcagcagcagcagcaacagcagcagcagcaacagacgacgacgacctctcaggtgcaagttccacagatccagggccaggcccagtccccagcacagatcaaagctgtgggcaagctgacgccggtgagcatttcccagaggaccatgaacgtgtgcgtcttgcggtcagtcagcccagcgtctgtgagacggtgcctgcttgcatggtgcagtccagagtgtattttgcaaacgtctagcactgcctttatgtaggacgcgtgcttcgttttattggtctaaaatttcccatgtcataacactttgatcatgccttagagaagtcttacagcttattcagagcactttggagacattaacacccagcgtgcaaatgcgtcttcttgcttaggcgtcttgtgccttgtgttcagcatcagtctctaggcccgcttggtgtggttctggaccagagaaagtgctggtgagaagatattcctcagcagtgttgggagagcaggcgatggaccctgggtttgtttcgatgtggttcacgtgcggtactgtttctcaaaggtggtcattggagtactgatgtacctgatttttgctaacctctgtaccagctttgctgttctttatgtaaatatattcattttcaaaggaaatgttgggccggacacagtggctcacgcctataatcccagcactttgggaggccaaggcgggcagagcatttaaggtcaggagttcgagaccagcctggtcaacatggcaaatccccgtctctactagaaatacaaaaattagccggacgtggtggcgggtgcctgtaatcccagctgaggcccaagaatcgcttgaacctggaaggcagaggttgcagtgagccgagattgtgccactgcactccagcctgggcaacagaacaagactgtgtctcaaaggaaaaaaaaaggaaatgttatgtcctaccataaatgaaaaatcattaatacttgtcatagaaagtaaccagagacacatacggaataaagacaagacaatattttgaagtttcagctcactgttgggcctgccggagtgcttgagtctgggcctctccgtggtctggaagggaggaagtgggctgcaggagacgcacactcagctgagggcccctcctggggctgtcgggagggctgtcggtggaatttagacattgagcttatcctgttcctgtcacaccagccatccctcgagggctgcatggccatatgtggctgtggctaccaccctgggcagcccccgcctagcccacttgtatcctgcgggacgtgccactggacagtgctgaattagaatgctgtgctcaagagtcccaggcccagcagaggcaactgtcagggagtcagagccgggctttgacccccccggcccacagccacacaggtaccttgtcacctgccccggttcaaccactgatgacccccccccggcccacagccacacaggtgccttgtcacctgccccggttcaaccactgatgaccccccggcctacagccacacaggtgccttgtcacctgccccggttcaaccactgagacaccagtgccgtcaacatcaaggctgccacccagccttggctgccaggagctctgtgtgccagctgtttgcctgtctccttcgttcctcactctgccctctcccaaatccatttcaaaaccagttcacttccagcatttcaaaagagacttgatagtcatgatcaactcagtataggttttcttaaaaaattttttcttaaaatgttttttgaacttcaaataagtttggttggtgctacagatttaaatcgacttgtttgtgaggataatagaattctttttgctatgaacttatcagtcagaatccgtgtttgtagttttcaccgacgaatgcacatttttaataaatgaacacctggaagatactgggcagcccatggaaggcggtctggatgctgcacggtagcaggtgtctgctttggtatttaatgggcagtagaggggtggcttaggaacaagatgtctacttaaagaatggagcacagttaatgttgaagagaagatactttgcttgtattttaggaacacctcatcaaaatgcagaagcagaaactgcagatgcccccgcagcccccaccgccacaggcccagtctgcgcccccgcagccaacagcccaagtgcaagtgcagacctcgcagccgccgcagcagcagagcccccagctcacgacggtcacggccccaaggcctggtgccctgctgacgggcaccaccgtggccaacctccaggtggcccggctcgtaagtgtcagtttctgtttgttttccaaaagcagcatctttttatgttttaacacagctgttgcgcttgctcaggtgcgtgtcacgtgttacaggagtgagtgtgagacgggttcttttccccgagaacttagtaccccttggacagaggacgggactcaccactcgtggaacattaacacagcagcagctcccagagcccatccaggcatcaccaagcttctcagggcttgaattgaggggggtggagagtgagcgaggtgagatgcagcctgcgtggcttccctgtgctgctgagggaccctgcagggaccaaggcctgtgtggctggagcagagggcgctgtgcatgtaagccgtaggcatgggcaggtggcggtctctgaagctgctctcaggtgaccgctgtaggcagggagagcatttggagatttcagaagggactagcatcaggcgcaagtgctgtctgggaagactggctctcagcaggtgccagcgtcccggggcaggcagcgtcactgcaccgtgactagagctcagctaggggtactggtgacagctgccctgttggaggctcaccctgagctagactttgcccttcgttctcttgtgtctttcacctggcccagtgctcatggactgccccaggcagggataagggtcttactattaattccattttacaggttaagaaactgaggcatgtaggctaagttcccacccaaatcccacaaccaatcagctgcaactcaagctaggatttggggacccaggtgctcaggctaagctgtgtgggtgctggacccccactttgggtcttccctgggaggggctagccctccacagcagagtgagtagaagtggataaaaaactacagaagggtgcttggtttcattcatgttcacaaaaatgcaaattcactgagaagggtggtaacacctagtggtagccagggtaccgggttcttgttggacaggaatcagtggcctctttttggagaggattttggtaattacgctatgaaaatgtgcacgcttatttaactaaacacccccttatgtcctgcagagataactgaacatttacaaagtgatgaatgtacaagcttgtttgcttcatgagtgttagaggaaattaaatgtccattactaagaatttcattaagtaaatgatgtatcatccaaacaatggaatattaagcaattttgaaagtggttttttgtaaagagaagagaaacagatttcaaaatatttataattcatgtcatttttgcacactttcacggtgagccacacagatatgaacagtggctgaaggctaaataccagttttaatattcagatatgagtagtttgaggagtgtgggtaatttttactttgtattttcttatgtaatcttagtctctatacatacaaaaatggaagtacttccatttaccattttttaaatggtaacttaagagaaaatgcgggacgggaggctgaggcagtcattttgaagtgagggacaggctgatgtcgagtgctcgctgaaggaacaggaagtgaaaagccttctgtgggaaaaacgggacaggatgcggttactggttcaggagatggagggaagtgaaggtgatgtcccgtgagatcactgacatctgaacgcagcagcatgtgtgatgagcctgcaggtcttgcgggagcttcagaagcgcgggctgacctgtgacttgacatttccctgcggcgtgcagatctctcagttttcctttcctgttgggccactttaaactttgttgatctttgtaaattttctcatggcatgacctcttgtggagaagtatttggaaagacataccgtgtcctgaatttctctggactctcccattatttctactgtttagacccgggttcccacttctcagctgcaggcgcaagggcagatgcagacccaggcaccccagccagcccaggtggccttggcgaagcctccggtggtgtccgtcccggcagctgtggtctcctcaccgggagtcaccaccctgcccatgaacgtcgcggggatcagcgtggcgatcggtcagccacagaaggcagcaggtgcccgccccagcacaccctcccgtcctgggcttgagcctggtttcacaggcctctctggtggcagtggtcgccagcgacccgtgttctttcctcacacccacccacttgagcgtgccatcacgtgttctagcacaaacgtgccttggcgctttccaggcgcaaggctgggtcctcaattgaactgttaacattctgaaatttccgtcttaatttaagtgtaatttgtgaacccagaaacattttaatgtagttaagggatggcttacttgtctccatagagtttcatagtttgttattttctgtagaggtgagtcagttggaacagagcttggcgtgagcctcaagctcttttcccagtgtgctgactaaggggcttttgctgcctgcaggacagaccgtggtggcccagcccgtgcacatgcagcagctgctgaagctgaagcagcaggccgtccagcagcagaaggccatccagccccaggctgcacagggcccggcagccgtccagcagaaggtaccggggctaggggattctcacttctgggtctatgccaagccaaagctggctgctggaggagagggtcctaagcagacaaatccccatgtggcggctcacgcttttcagagggtggcttcaagggctggaggtgctagtgtggtcatccctgttggtttttccttcctttaaaaggtgaatgctgtgtgtgatgtgacaagtgaggctgaggtcttggcagggggatggagggggtatagtctgtgaggatggctgggtgccaggtaagaagcctgcatggcattgggacagacacagggggtgcaattgcatgatgggggccagtgggctcagggaagcagacgcagctcacaccacaggacccgcctggactcctgctggaggacagggatgccgtacagtctggaccccagacagggaatgtggcctctgtgcatgttggtggtgaaaggggagataaacacgccagggcccgacgtggatgggggcgcagcagggcactgggctccaagggcgtctacagtctcagccagctccctgagacgatacctgtgcctctcagcagccagtgctgtgttgaaggacgtgagggggacacggtggtgagacagctctgcctccagggacttctgctcgtggtggctcatcggtggcacccagcccaagtcccgggcttcggatggctggtgtgggccctcagaccccacgttctgttggcactgctgtctggctagagctagaaggcgggctctgatgggaagccacatggctgtgtggggagctgccctgttccctgagcgctgtgctggacccctgcaggcacctggtgcttatcctcaagacggaggatgttgtcttgaggaaactgaggctcagagaaaaggacttgcccagatcacagggccagtaaaaggcagctggctgactccagcaggcccagggttctttgtgccacaccacctggacactggctgtgctgtgagccgctgctacctcctgcagaagaccagtgcccaggggccctatgggtgaagccctgctggtgtgcagcaatggcatgctctgtggggagctggaagcagagctgtcctttggaacccagagggagagggagtgagcactgaggggacacaaagccgggaggcgcagggtgtctgggtagtgccaccagctccgccgtggccgggttccaaagaccagcctgcatccccacttggcacgaccgctgcagggaagtgcatgtcctttgggtcgggatggtcacctgcatttatttacctctggaagaaggagacagtgctgggacttacctcctgggcctggtcagcagtccctgggtgcgtcatggtggtccatgggcagacgtggccatgctgatgcacaggtgggtgtggtccctcaggcttgagctgtgcttgagggagcagtggagggctgcagctgaagtgctgggctgtgtgttcctacgattggacaaaacatccttagatgttaaaaacccctatttacccataagcatggctgataaagcagatacgtaaacgtcagatgtacacaatatgatctgcaaaaatggtgcataccagtttgttaccccgtgtactaaatattttctttatgtctgccaagtttttacattggatttgagagattgtgatcgctttcagtcacctaagtagcagccccgtgcaggtgtgacaagggtgtcagggtgccccaccagcccgactattcagggagcagtgtcccgggtggggtgggctgcaggcaacggccaggcctcctggaggagaagctggcggccatgccgcatgggcagaggtaggcctggaggcagcggcagggatgggacagggggcaggagatgtgggtatgcacagggttggtctgggaggtaggctggaaaggggctgggttctgccatagggcccagagcgggcaggcgtcccgggagtcttgagcgcggcatggtctctgcggccctaatttcgcagtctctccccagatcaccgcacagcagatcaccacccctggcgcgcagcagaaggttgcctacgccgcgcagccggcccttaagacccagtttcttaccacacccatctcccaggcccagaaactggccggggcccagcaagtgcagacccagatccaggtgagcggggaacagggtgagggcccgagtgtcaggagtgggtgcccggcctttggattgtgtgtctcgcgggctttgcgagctcccagcccttgcggctgcactgggtggtgcactggagggaagtgttgtctcctggcctcaggtttcaacccctctggctcctgggaaggctcctctctgccggggcctgttccagctgtcgccagctttgccttcatgttctggacgtcgatctccagctctgtggggtacagctgccctctcccagttccaggctcctcttctcccttcctggtgtcttttttaaaaatatattttattttattttttgatattttttgatatttcttgttcatcaagttctacctggtgtctttgggagaactgagttcctgatttcatgtgtgcagtgtgccctcccgtcttcctctctgcctagagcttttatgtcctgcttcctcccagagcttatggagttacctccctgcatccttctctaagagcgggggagtggtaccttcttagctggtcttccaccctcctggagttggtttttgggtatgagatagaaacaggaattcagttagagcaggggagttttaccttctcagctagtcttacatcctctgggaattggtttttgggtctgagatagaaacaggaattcaatttgatgtgctctatgaataccctattttcagccccatttatttaaaagcccaattctgtcatccatcgatccacagtgccgcctccacctgagatcctgtggggaagttcagggcttcttgtctcagaggccatgctggtcccacggcgctctcgctatgagcggcagtgacacttggtgtctggagggcgagtccccctaccacacccttccttgggtgtagcgtgcctattcttggctctttccacttctgtgttaattttagttagcttagttcatacactacaatcaaaactgctgaaagtttttattagaattgcattgattctgtagctgttcaggggagagttgacatctttacagtctttccttcagattcaccaatatgatgcatcttttgttacttaagtcttttttaatgccttttaatgaagttttctaatattttgtgaaagtgttatagattatgttagttttattcttaagcaatcagtattttttgatgcttttgtaaatggtatgcttttaatttccattttctgtctctggctgttgtacatttttgtacattagttttttattctggccgccttgctagattctggttatttgaataatttatcttaggatttggttttgttttgttgcatttccttcgtatacagttgtatcacctgtaaatcatgacgatctacttctcccatcttaaacccttgctttctcctgccttactgtgctggctgggacctgcagcacagtggtgaatgtcagagtccgtatttcactgtgaagtagggtgtttgctgtgtttttgtcagagtaagaaaattctgttcttttctactttgcttgaagtttctgttcctctttgttacggtgctttttgtcttgtttaaagcccatgtgtatgaactccctccctcccttacacatctcctttagcctcaaagctttaagtcctgtctcggtgcgaatgatacccagattcatgtctgtagccacttactgtcctgagttccagattcttcatcctacctgcctttgacagatccatggagatgtctgatccctcaggcctcaggtgtgtacgcctgacctgctcctaccagaggcttccggctcaggaagggcagctgtccctgcagacctttagcctacttgagaaacccctacagtcatccatacaggtccagcccattggcaggcagctgtgtgtgcttgacttccagaagagacctggagcagccgcttcctgttgctactgtcagctcctcctccgcacccttccctggttgttgccatctctcctgcttcctttttgccatccgtcccccaggaatactttgtggttgtgtgggtgggtcgggggtgtgggggtgtggatgtcttctgcagagccctgctgcccacggctcctggcctgtgcacccctctgcacttgctcctctgcacctgtgcccctaccagcgctgctcacagtctcccttcctgctcagcttttctgctctctgtttctgtattatcaccttcaacaaatactataagtactttgttcaggtgattttgtctcctccaataaagcaagccccatgagtacaggtgtgtccgagggctgttagtacagtggacagatggactgttgtagtgggttatagtcattgaatcttgtgatgttcaatcattgtgttctggggtgactcactgggtcctgtggtagttgtcattgtgcatggatgagttcaattactgctcttgtgtgtgtgacctcacggcatcggggcagctcagcctcgttcgtgcgctctgcctgccttgtcaggtctgtttctgagacgcgctcctgcttgtgttgcccagggtggcctcgaactcctgaactcaagcagttctccctcctcagcctccggagggcccgggaccgcaggtgtgtgccacgatgccgggcttttgccagggtttttacttcctttcctttcttttattttgctattcattttctaacttgttaagatggagtaccacctgagcttatttcacaaattttattatttggttttccttcagtcctaaatgtttttgaatttccattttgatttcttatttactgcctgggttctttttagaagtgtttcttaatttccaggtgaggttttccagttactttttattattgacttaaaaataaatcttcattgtattgtcagagaatgaggtctcaatgatttcagtctttgaaatttgttgaaacttgctatctagtccagaatacagtcagttttaaaaaatggtctgtgtccttccagagcagtcttcaggatgggttcacttgtgagatgattttgttgtaactgggtcaagtttactgtgtgtgtcatttcggtcttctgtgtgtcctgccaatcacttgtgttactagttattgagaaggcgtgtttagatgtcccattctgagtatgcctttatctgtttcttcttacctttctctctggttttgctttatatcttagaaggcttttcattagccacatttaagtttaaagttttgaattttgttattttgaaatgactcttactgtcttcagtaatatctctggtcttgaagcctattctcctcacatgagtaaagcaccaccctcctgttggaagtttttggtctgtgtttttccttccttgttttcagccattctctgtgtgtccctcgtcacctcctgtgagcagctcgcgggcaggtccggtgctgttgtgaggtcaggctttccatctctgactcttacctgaaacacgtgtccacttgtctgtatataaggttgggtatatttgaatttctggcttctcttttgtttggactctgtttgtcttgcttgttctgttttttctttcctcccttccttgccttcttttgggccaccttctctttttttttttttttttatcaattctcccctctgccagtgaaaaattatatattttctttctgttctttaagtggttaccctaaaatctccatgtgcacacttctgtatcagagtatgaagttaacgatggcctccaccctcttctccagcaatgatcttatcacacagtagctcagtttattcatctcaaatgctgctgttagtgtgcgttttaattctgtcccttttccttttttttttttttgacacagtcttgctccatcgcctaggctggagtgcagtggcgcgatcttggctcactgcaacttccgcctcctgtgttcaagcgagtctcctgcctcagcctcctgagtagctgggattacaggcacatgccaccaggcccagctaatttttgtatttttagtagagatgggtttcaccatgttggccaggctagtctcgaactcctgacctcgtgatgcacctgccttggcctcccaaagtgttgggattataggcgtgagccaccatgcccagccataattctgtcctttttcatctttgactttttatgtggaattactttccttccacttgacccatcctttggaatttcctttagtgcttgaaaatgcctgtgtgtcactcttgttcctgagagacagttttgcttagtacagaattccggattggcattgttttttggggtttttttttttttttttttttttttttgagacggaggctcactctcccatgctggagtgcagtggcatgatcttggctcactgcaacttctgtctcccacattcaagagattctcccgcctcagcctcccgagtagctgggactacaggcacacaccaccatgcccagctaatttttatatttttagtagaggtggggtttcaccatgttggccagactggtctcgaacacctgacctcaggtgatccacctgcctcggcctcccaaagtgctgggattacaggcatgagccaccgcgcccggtcggcattgttttctgagtgcattcacggtatcatttcctcactgtggctgcttttgttgttgaagaggagccggtgtctgtccagcgtttctctcttccagggtcacctgtctcttccccaccgactgcctgttattgagacgttgtctttgtctttgttgttttgggtcacctctctcccccaccgtctgcctgttactgagacgttgtctttgtctttgttgttctgggtcacctctctcccccactgtctgcctgttatcgagacgttgtctttgtctttgttgttttgcagtttcattccaatgctccagcttcttgaatctcgggcagtctctctcatgtctttaggaaataagcagccactgtttgtttacgtgttgcccctgtcctgcttcctctgccctccaggtctctcagcagcttttgtattttctgtgtctttgtctcgtcgtactatattctgagtcatgtctttcgctctgtctcctcagtcactcatttttcccttggttaagtcaaatctgcttcaaagcttgtctgttgaatttttatcttgatgatttattattttattttcagaagttcccaaataatgcctggtctttgtttatagtctcttgtttccaggcctcgcagagtgagtgaggtgtttttctggatctggtgatttccctgtctgaaatgtgctgcatctgcggggacccctcgcagcctggggcaaaggtggagttttgcttccgcgggcaccttcaggtgccacaggaacactgcttggtgtgtggctcaggctttcactcagctctcaggtgttacccacctggcctctgaatctgtgtctcctcctctctcctccccggcactgaggcttagggcaggtgcttttcttacagatgccactggaggaaggggatgctttctttgcagcctttgggtacctttgtgggtacagtgtctccctccaggatggcagctggcagtagcacggggctcttttgcaagctccccaccgagaactggcctatacctggtgtctggtcagctgtgtcctgtgcgaccctggagatcacggggtgcgtctccatgtggccagcgatcccgggcagaggttgtgcagcttttctgctccgtgactcgtgatgcccgcctgtgcttaggtttggagactggcagttcctgactctttgcaggtttcttggtacatttaagatttcttgctagtgctttatttaagacgtctcaggattttcagtgctgtgccaagtaagtcctggaccattgtggtcttgagatgggccctggagcaccggctgcatctttgtttcccagcagttccacagggggcgctcagggcacttatcttagtgaattttatttataattgtttaagtgacagtaaactagtaaatgccttctgattgattttaattttagtaaggactaacatttatttcgacctttgttcatgtgtgagtaaatcatgtaatttcacatatttcgcagaataatcttgggaaatattattttcatccgttttctgtaagtaacaggacccagcaagagaccagggtccgtgagggccttgtgcagggagggcccttgaaatcagggcccccagcagctgcccacgctggagcctctcttgtgttctgggtgcacgccatgacggtgctgataggacacacaggtggcccagagcctcttactacgtcaagacagcgggagatgcatgcagtagcaagtgcacagaaagtgggcactgggtggaaagtgttgctttataaatagccagatctcaatcatgactaagaagaatgtagaaaaatgataaaattaccagcctcaaaaccttggtgcgtcaccgggttccccacttcagctggctgccctagctgcactgtacagctcattactggaacgtcgtccaggcctgtcatatgcagagcccttgggactcacaagacgctcaaatacttaccatcctcagtctgattctttcatataaacttgcagtcgtttttgtgaaaagaaaaaatgtgtctgaaatatgagaccaaaaataagcttaaatgatgagtgatggcaaattggggaggcagtcagttgactcaccatgcagtggaacgacttgctctctcactgctgcaggtgggcacactacgagaattgctcttctgtgtcacctggtcattgtgttttttgcattaactgaggacagaaagggaggaaaaatctctttttgtgcacatactcctttgaattgtatgtttggctttttttgttttgtcaaaggttgcaaaacttcctcaagttgttcaacagcaaacacccgtggccagcatccagcaagttgcctctgcttcccagcaggtaggacgcatagacaaagtggaaacctcacatttcccaggtcagagaatgggttgttttcatctgaggtcatgattagggaatcacttttgatttttgtgatacacacaaaaacattaacttcaggggaaaaactagatacacttaataatgagaagagtgaacaagcgtttagaggttgtgtcagccatactgagggagcctcaccttgggctcattcccaggacccttcattcactgatcatcgcgggtgtgtcctgcaagtcgcagacactgccctgtggttttagggaggcacaggcctcaggcaagcaggctccgctcggggcccgcccttgagcagaggcgctgtgggcacagtggccttgcctcccacagaagcccttcaggcgctttcactgttgtcactgatgctccacaatatgactctttagcacagtgctttaaatgtaaagcggtgctttaaactttctaaattttgtttaaagtcacactggcatatagatttcaagaaaccaaactctattaaaagctttactacaacaacaaaatcagtccctgacccagctctcacccttttcccaagaggcatctggtgttagtctaaaagcaaccatcttttaattttccacttgtgtttaattggaaaccagaggtcatactgttgtgtgactggtcattcttccgtgtcataaaagcatagtcagtgaagtttctcgagtcctccccatcccaaagaacgtccattttcctgtccctggactgagtttcctgggcaatgtgtgttttctgactctctcggctcaggcttctccacagactgtggcgctcacgcaggcgacggcggccgggcagcaggtgcagatgatccctgcagtgaccgcgactgcccaggtggttcagcagaaactcattcagcagcaggtggtgaccacggcgtcggccccgctccagactccaggcgctcccaacccagcccaggtgcccgccagctccgacagcccaagccagcagcccaagttacagatgagggtccctgctgtcaggctaaagacacctactaagcctccgtgccagtagtcagggcagcagggctgcctctcatctaaagcaaaactaccttcctcacagaaaacgctttattagtgaaccttgggaccatgtcacgcaagagattcagcactgggaaagatataattgaaacaaaatagtgtaatcattttattaaaatgcatcccacactgcaggacaaatggtccttatggagtgccgcgttctctgtactacgtggctcatggaaaaagtgacaacatggcttcctctaaatcatttcacctttcagtccccacccgcacccgtcccctagagccatagtactgtgttctgaaagccatttagaatttctttgtgagcatgtagtgctttgcacgccacagaagccgtctgccgtgtgtgaggagcatacaatggactttctaaagataaggcgtgggcttccacagtgtctgccagagtttagttctttataccttactgaaaaatgcctcgtggtcttcgcagaggggaaggcctgtctaaagtcaatcatccgagatgggttttccattccaaagaaaggcaatatggttccttccttccctcctaaaatatgacttaacttttaagagaaatgttctgacacccacctaaacacacaaggcacgttcctggcctgtgttcaagggaaatgatcagtcattgcattgttattccaaagagcagccaacagtggcctcccccaggccctaccctgcaatgggattcgctttcatttaatggaaacttctgggactgatgcccaactcagtgcactcaagacgcatctccagttttcgggggaagctggtatttgacatagtgtgttaaacagctcctgagaacctttgggacactctgccatggctggcgtgaggcccagaggaccacgcagaggcaatggtagtacagatgtcacagctgagggtacgatgaggcctgggctcagtgagccaggacgaatgtgacagacaccccttgctgccacagtcagccctttgacgaaggtgggctggtgattctggaagtattggctatagcggtgggcccagtcaactcttccttgtggacttacgacagcagattttctctaggataagcttgtgtggttctgccagtgaagcagagaaccacctgtgctgttgtggaaggcgtgccgttgagggggaaaacgaagcccagtatttgctactgtttttcctttttttactatgacaggaaaataaatgcaattttagtggaattgattgacagtgtctccttactttgaagttttcaccaaagcaaaaaggtccatatccaatagtatcctttgtgctgtggcttgattttggcctattttacattatttggtccaggaaattaggttatattaggttttttgtatactaaaaatcagttatggcacaataaagattttctgtttttaaattgtatttcatctgcttcctccccattctctcactttaagtgacattgaggaaggtattctgtcccacaggtttctgtggacagcgatacagcaggagtcagtgaaatcaactggggagctcacttgagctcttgataagaaatgtggagaaaagtaaaaaccaagctttgaagaaacagaagaaattaatcttttagttagttgaacataccaaagcagaggactggaatctgtttgttctaaccaacccgttctccctggcttggcacgtgccgtgagagcgcagcttgccggagggagggccgctgtgtgcgcctcacatctggctcccagtggaaacttttactcctcctcatccgcagatgtgatagaactgaagtatctaggaattctgcctttgtcatttgttttaatttgtgtgccctgttcattttttttgtctttcccaaatcttggtagtctccttatagttgaagataaaatgttgagtgcacttattttagaatatcctagacataactgtctaagtaaaagcgctctattaatctaaaacactacaagagaatttaacaccatctctcaaatgcttttttggagagcttaatgggattctgaatatttgcaatgtggagtttccgccccgatctcacgtcagtgagggtctcctgtctctcaagtgtgtttcctttggctgttccctaatacaaaacacggacatatttttactcgtagcactcaatttagtaacttctagatgctaccgttgacctgagttaaattcatttagtcgtgtacgtaaaaactctccttttagtgtgttattttcttggccttcccttttaaaggttaaagtttctaacctaagaattaagtacgcgttcaggaagctgttgtctaggccttccccttgtgaatctgggttcattccaatacggcaagtaagagttggaaactttgagaacacagactataaaggcagcagcccgaacactgtcagactctaattggcgaccctgggaaacagttgccctgctattctttaaagaaagacgtttattctgatgataaaaacagttagccagactgtttttaaagcacctggcgggaagcagaaggttggatccaagcccttgttcagatttggtgcctgataagacaggggtttctctttttgtgacctttattattattattttgttaactgttgtaaccagttagctgttgtgttttaagatagaaaggaacaagactaaaattgtaaatactttgtaaacatcagcatttgtacttgaatagtaggattttaaagggcattgatagcataccaaacaaaaggcaaaataaagtgacctttttatatatttttt

SEQ ID NO: 37694 - DNA, 38956 bp, Homo sapiens
agaggtgctgacgtttgcgccgcgcacgactatgtccgccatgttagtgtctgacgcaggcgccattacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtggcgccaagttcagtttcgacagggatatgcatccgggagagaatttttcagcccccgcccccactggcatgtgagaggaggaactcgctgttgccctgtgtcttccccagtgcgttctataaccagcctcatttttttttttagcaataggccggatgtcctaagcgaccggcattcaaagcccggtgcattttagtctcatcaggagtcaggcgtgtcacgagatttttccgcggtagctgctcagctctgactcgtgagcggcgcacaattggctaagaatgggtttagcattttggcgctcccccccggcgctcctggaaacactgcgtggcaccccgtaccactgtcacattataaacgtgctaaggcttgggtgtctcggctggggagcagtcaggcagcgcccagggcgggagggaatcagactagattctcgccgcggagacccagggccgcgcggaccaatggggcagggaagccgtcgtagggcggggcagtgaggggcggtgccgcgctggtcccgcgccggtcccggtgggccgacttccggcgagcgggcaagcgggaaccaggtggccacccggtgtcggtgcgtaaaccccctccgcttttacacggagcgcgcttaggctttggtttggggatttaagatcgcgaactgagtgaaaccatagaaactgatttgtagaaattttcctgttgtttgtaaatgcggtgggtgggggttggccatgtgcttttcacttgctactgttagctggtttctatttgctcttttacttttcctgttttctaagatgtcaaggcctttttgtgtctttatacatttttaggacataaccctaaattggtgtactttctctttatgcacccgttgtctctggcagattacttggttaattttgtagttggtttctactttattctccatatcctctgatacggctttatttgcctgtcttattctgcttatgttacccattctgaggaatgaggcccaaggttagtgaagtcccccaaggtcttcctgctagtatggggcagcgtctctacccaggccaaggcgctgtgtgagactcaggagcccaggcgtcctcaccactgggtagtaaggctattttcagtgatccactagagtaaacagaattttcccacactactgctatattcaaactaaagatgtaacatttgctctagatttaaagatctgtttatttctggccggatgtgatgtaatcccagcacttgggaggccaaggtgggttgaccattggaggtcaggagttcgagaccagcctggccaacgtagtgaaaccccgtcgctactaaaaatacaaaaattcgcctggcgtggcggcgcacgcccgtaatcccagctacttgggaggctgtgaggcaagagaatcgcttgaacccgggaggcggaggttgtagtgagctgagatcacaccactgccctccagcctgggcgacagagagagactgtctaaacaaataaataaataaataaaataaaaaatctgtttatttcagatacacatggcaagtaaaatgtgttttcccgttacactaaagtagctgttccttccgagactgtaatttaacagggtttttttttttcctttctcaaattttcaatgatcatcgtttcacttgttgagagaatctgaagcaaaattgcttctgttaggctccaccccctcttacctgtgtgacctccagcaagttatttacctatctgggcctccttgtcttatctgcaaattggtgatagtaatagtatctccctcataggattctttcatgacaagcattttaaatagtaccctgcccaaggttaagtgctcaaaaaaatgttagttttgtatattgtcagcttacatttttcttaaaatatgtaatcccaacatcatcaaaataagttttcaattttctttttcctgttaccagtttgtcttgtggtaagtaaatgtaacaagttaacatttactactgctgagtgccagattgtacttatttataaatgtcatttcagttaatctcctaggttacactgctgttgtatccatccttctaagtctcaggtgccagaactaaagtgaaatgagttggaatttgatttttgccttctctaccaatattctagcatattgcgctatttgaattaggagtcagcaaactatggcccacataccaaatccttctgctgcctgcttttgtacagctcaccaaatatgaatgattgagaaaaagaacaggaaataaatgaggtttttgtgacatgtgaaaattttatgaaattcaaattatagtatccgtacataaagttttattgaaagcgagtcacgtttatttgttacaaacctttgatggtttcctgctacttaaagtactgataggcaacagtgatctctgacccactgcctgtttatgggtccattaaatttttctggacattggcacattgattcatcttcgtattatctttggttgctttcctgctaaggtggccgagtcgagtagttttgacagaactatgtggccctttttgtgtaaagtttgcttaccccagttttcagtatatcctttaatttatgataacctaattatctgtaagatttcaaggtttaaaaattgatattttataatacattttgagtctaaaacaagattcatttcataactaaggcatgatgattattaaatctttttgaagtgaagcccagagaagggagattatcacataaggagctgagagtcatcgtttgactccttaacctagctctctaggccagcctgccttctttttgaaatacctcccttatgcttatgacgacagtcatatttctcaaattatgaatcccagtttttcaaaaatgaatcattggatgaaaatgtcatttgtatgagtacaaatgattacttaaattatatttacaaatctggatttcttttttttttttgagatggtcttgctctgtttcccaggctagagtgtagtgacgtgatcctggctcactgcgatctcctcctaccaggttcaagcaattctcctgccttggcctcctgagtacctgggattacaggcacccgccaccatgcctggctaatttttgtattttagtagagatgaggttttgccatgttggccaaggctggtctcaaactcctgacctcaagtgatccacctgcctcggcctcccaaaatgctgggggtacaggcatgagccactgtgcccgtccctgggtttctaaaatgtgcatcctaagatataaactgtggttttctttctgcaggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccggtaatcatgttttaaagtggggagtaatagttattatttgttattaatggtatgctgtcaaccatatctgtactttatgttaataaagataggctgggcacagtggctaatgcctgtaatcccagcactttgggaggccgagatatgcggatcatgaggtcaggagatggagaccatcctggctaacatggtgaaaccccgtctttactaaaaatacaaaaaattagccgggcgtggtggcgggtgcctgtagtcccagctactcgggaggctgaggcaggagaatggcttgaacccagggggtggagcttgtagtaagctgacatcatgccactgcactccagcctgggcgacagaatgagactccatctcaaaataaaataaaatatagactactattcagggttgagtgctttccttgaccttaaaatttatttggtaatttgaatgcttgccaatatgttataaacttaaggtaacctattgttcagaatatggcatttccttatcttaaactgttttaaacctgataaaacacatccattggaaaagtagtaagtgcctaatacagattaaaggcattttgttgtgtatttttgtaaatggaaagtttagtattgctattaaatacaacttgcggccacgtgcagtggctcacgcttacaatcccagcactttgggaagccaaggcagaaggatctcttgagcccagcagtttgagactagccagggcaatgtagtgagacccgatctctacaaaaaaaaaatacaaaaattagccaggcatggtggtgcacatctgtagtgccagctacttgggcaacagagtaagatgagaacctgtctcacaaaacaaagtttttaacagttgttactctaatagatctcaacccttatctctctctgactttttttttttttttttttttgagacagagtctcactctcacccatactggagtgcagtagcgtgatctcagctcactgcaacctctggctcctgagttaaagcgattcttctgcctcagcctcccgagtagctggtactacaggtgcatgccgccacacccagctaattttttgtttttttagtagagaccgggtttcactatgttggtcaggctggtctcaaactcctgacctcaggtgatctgcccgcctcagcctcccaaagtgctgggattacaggcatgagccaccgtgcccagcctccacccttatctctcaattggcaaaaatgaaaaaatggtcagttcatatactacattaagcttgtcagtggcttcagaaactcctcagtattctaataatactcagaataaaactcaaattccttaccatgcctttcaaagccctttgtgcagtctgtcttctgcctgctcttccagcctgatcttttatatccctttttctcttttcactataccctatccatgctgtcctaccaatttcccaagcagaagcttgctgctttggactttatatttgttcccaccccttactatgactgtctcctcattattcagagctccacttaaatgttagcctccttaattatatctctcctacagtttcttactaaaagcaagtgtccatccccatttcatttgtttatgatcatgaatgtctgtgtttatttttacttcactattgtctgtcttctatgttcttttcctccactagaatataatctctagtagaatgtaagctccatgagggcaaggaacttgtctgtcttgttttgcatggtgtgcacagtgcttagttccctatgtggcacataatatttatggaaagaagagcatggacccaacaagccacaaactgggagaagatagtggcatgtatataagaccaaaaggaataatacaaattagcaaatacctccttttctgggatcttaattctacgggtgagatatttgtttattagagaactaggacagtttatctgcgattgaggtcatacaggcaagcccatcaaaatctcttaagatcatcatgagactactacaagtagtcttgtaagactactaaagagacctcttcctcttgttgccctctgctatactgatatagttgacgctgctcagcctagttgtgttcagaaccactaacccacagtgcgtggtactccatcctaatcacattcaggcagttgctgcagattgaggaccctaccttttctggacttggaccctatacagtagtcaccagcctatccacaattttactttccacagtttcagttacccacagtcagctgtagtccaaaatattaaatggaaaatttcagaaataattcataaattttacattgcacaccagtctagcatagcatgatgaaattttgtgccgtccaacctgagacgtgaatctttttgtccagcatatccatgttgttacttactagccctgttggttatcagattgactatcatattatctcagtgcatgtgttcaggtaaccctgttttacttaataatggccccaaagctgatgctggcatatagttataattgttctattttagtattagtgatagttaatctcttactgtgcctaatttgtaaattaaactttatcataggtgtttatgtataggaaaaaacatactatatatatagcgttcagcactgtggtttcaggcatccactagggatcttagaatgtgtcctctaaggataaagagggacaactgtacatcacaaatatcacttcttgtactctgtaccaatggcagagtgattgcacacttcagctgacttaacgaatggtggtccaggcacagtgaagcaggagagcccctatggagccaaaccatgttcagtatgtggttgatcctaccactagttacttagaactccacagaagaaaatttacctgacttgcaggttggagaagacaggttcctcttaaaagcgtcattgagttcttaacttaaacagctctgccccaaagagatccctcctgacccaacccaaaatagcctctcaattcacttcatatcaaatttgcttaatttgttcatatttgctgtttttttgtttgtatgtttattacccagcgttcctacagcgtattgtaaacatgttaagtatagggaccctgcttgtgttgataaatttttttttttttgagacagagtttcgttcttgttatctacccaggctggagtgcagtggtgcgatcttggctcactgcaacctccgcctccccagttcaagcgattctcctgtctcagcctcctgagtagttgggattacaggtgcatgcccccacacccagctactttttgtatttttagtagagacggggtttcatcatattgttcaggctggtctcgaactcctgaccttaggtgatccacccacctcggcctcccaaagtgctgggattacaggcgtgagccaccgcgccccgccgtgttgacatcttaataccagtgctgaggacagtacttagcacatagtggattttcagtacaattgattgattgacattaaaagaccaatttctgagtatatcttacgttttttgtttaatatacagtcaatattagtgacgtgaacaatatcatggaggtgatactttatggctctttgggaagtttattggtgttttcatctgtctacaatgataacggagaactgagctctgttggttagcctaatgcactctcctctgaatttcacatgttgaaactgtcatctctgccaatataagaaaaccaacagataacaagcatactaaagtatagaacttagtttttttagtgagacacttagtttacttaagtggaatgtttttgtaaatgcagtggtttttttttttttttttctgtttacagccatctcaatcagtgaccacactgcccttgctcaattctgcaaagagaagaaaattgaatttgtagttgttggaccagaagcacctctggctgctggtaaagtttgtttctgtttattgttacagtatattcagtgcaaacagaagcttagggatcatctaatccaattcattttacagatgagaatttgtaatattatcttggaaaaagagcttccactctcgaaatttatggagtctagattttttttcccaagcatcagttatatgatgagttagagatcaaatttgcagccatggaaaacattttatatgtctttattctgctgtattctggtgtgtgtttaataatccatatatgcaaatataacaacttttgatagatttgaataacatgttaatagcattttatctctatccagtagacaacatgaaaaagttagttatcctctgccaccagtcatctgccttgtctagatgtagatatagtctgatactaattcgtcttcaggctgaaaagcccctggggagaccttggttcacctaaggctactgttttcatcaatagggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgaggtaggtaaatggttgtctgtgaaggacagttgtttagttttgatatttaaatacacaggtcagtggccaggcacagtagctcacctgtaatcccagcactttgggaggccaaggcaggtgaatcacttgagctcaggagttagagaccagcctgggtaccatggtaaaaccctgtctctacaaaaaatacagaaaaaaaaaagccgggcatgatggtgtgcacctgtagtcccagctcctctaaaggccaaggtgggaggatcacttgaacccaggaggcggaggctgcactgagccaagattgtgccactgcactgcagcctgggtgacagagtgagaccctgtctcaaaaaaattaaataaatatacaggtcacttctgtgttgaaaatgtaatgctaggtctttaggctgtctcaagatgtagtaagataattaaggaaaaaactttctcaataaatattatgtgggttgtcgttttccagaaccaaaataaaatgggatcctatgcatacagagtttatatgatcttgtggccttgcaggaagatgacatttttaataaaatctgagtagttcctcaggggaaaaatacacttggttctgcagttgtgcgctcttcacagccatgtttttggtttttggttccccgccccccaccaccaccccccaacctgagacggggcctctctctgtcacccaggctggagtgcagtggcgtgatcttggctcacagcagcctctgcttcctggactcaagtgatcctcccacctcagcctcccaagtagctgggacaataggcacacaccactactcccagctagtttttatattttttgtagagacggagttttaccatgtttcccaggccggtctcaaactcttaagctcaagagatccgcctctctctgcctcccaaagtgctgggattacaggcatgagccgtaacactaggcctcacggtcagattgacaaacgcagtggcatcttacaacataaagaacattgattttttttgtcataaataattaaccagagtgagtaatcatcacttggtcatctgccaccactattgccattttattttatttatttatttatttatttttatttttatttatttatttatttttttttttttgagtctcgttctttcacccaggccggactgcagtggcgctatctctatctcggctcactgcaagctccgcctcccaggttcatgccattctgctgcttcagcctcccgagtagctgggaatacaggcgcccaccaccactccaggctaattttttgtatttttagaagagacggggtttcactgtgttagccaggatggtctcgatctcctgacctcgtgatccgcccgcctcggcctcccaaagtgctgggattacaggcgtgagccaccgcgcctggccactattgcaattttaaatttcaaaattaaacatcctttgttctctattatgtggaaagcattgagcaattaatgagtgttagtagacacatgcatttgccctttttttgttggcacttctgcttcctggttatgttttcctttcagttgtgtcagtttcatttttttttcattcatatcctaaagagtttcttaaacactgaatattattatttcctagcagccagatgccttgagcaagtaacagttttgttacttactttgggtaagtctccttccagacccccaggcccacttgataatttcatatgtgtactcccagaaatggtctgtgtatgcttactgttgttatacagccgcattttctacctgaatgagagtactatttgctactttgtatcttagagattatgccatatctactctatacatctacttattcttccaaagatattgcctatgtaatctcatgataaatgaaaaaagcaaaattgtaggtactgtatgattggaactacaaaggaatacgtaggggaaaaaatcctggtgggaagtacatcaaaatgtgttggaatgataattaatttttttctttctgcttttcagtcattgctatagcatatcgttacaaaatcccacagcattttaaaatcttgagttgtaatggtttattggatgttgacgattactctgtctttacagtgcagacttccctgctttggttgtgaaggccagtggtcttgcagctggaaaaggggtgattgttgcaaagagcaaagaagaggcctgcaaagctgtacaagagatcatgcaggtaggctgggtcttctgaaaaaatttacttttctattcatactgaataaataccgttttaagtttaaaaaatgttcctcacaataaggaaaatctattttgcaaacatatgggtaagttattttttataatcccatgtattataatccatctctataaaatagttatggatttacactgtaaattaaaccatgattgtattattttgaagtaaattgtaacatcctttgttgtctgccactgaaagaaaatcctcagactctagaacatataaataaattatcaagccatccatgaggacaaaagtatttgtcccacatgtcccgggtctaagagaagtaaattaatgaatgaatatgccttgtctttcgtgatcgatctttgttgttgtgggttttctgtccttgtagaagtctactttcacaagcatgctttagtatagttattacagccaaacatgtataattataatcggaagtaaggattaagtggcgataatgaaaacatctgtttttcccataccttatttgaaactggatcaccaaatcttcaggagaatattagaggtgtgtttattccgtctgtaccagtgttagctacactattgccacattaaaaataggaaacatttatatgttccctttgagtctttctgaaagggaaagaaaaattacagtactcactggttcataatacaaatgctggataatgctaaaagtcaactaagtatcaaaaacttaccaagcctctttttttaaaaaaaaaaaaaaaaaaaatcttacaatcaggagaaagcctttggggcagctggagaaacaattgtcattgaagaacttcttgacggagaagaggtgtcggtatgtatattcatctttttggcttttgtagtgtataagaagctgtcatctgacctgtgtaccccagaaaagacttgatatactctggttgcttcatctaaaaacataaacccagcagttacaaaggaatttgtatacttttattgttgggggtgcaaatgaaaaaataatcgatcctctgttagtcatccctagtgtgttagtgggggcacttggacttacacactattgaggttctggattaattcaagcattcatgctttttctttcatatacagtttattgcacaataaataaagtcaccttaaaccaagttttaatgcctggaagcttaaagtgggggaaaggttgaaatcttttactttgagagtagcttgattttttctgacttccctcaaaaattacaaatccttcagaagttgagtacattatgattcttgatgtatgtagcttaatgttattgacgtttcggttcatttctctgcaaaaaaaaaaacaaacttttcctcaaagaagaattaagggacatatagtttgcctcactaaatttttttttttagtttttgacagttaacataaatggactattttgttttctttatagtgtctgtgtttcactgatggcaagactgtggcccccatgcccccagcacaggaccataagcgattactggagggagatggtggccctaacacagggggaatgggagcctattgtccagcccctcaggtacttcccgaagactctgctgaagtcttgtagtagtttggttttctcagagaactcttagatgatactttctattttgttttgttttctgtttgtttgttgctatgaattatgttactaatcagcaattaaatgaggagtatcttttctggtctctaaaactaacttttcctaaaagccttttttgaagaactaaaataagccaatctaaagtatagtatgggttgaatagatcctcctattccctcctctctgcagccaatttttaacacatgggagcctgtcgtggtcttggattcatctttggatatccgtggttcagcacaaaagtgttgtctgtgtgtatctgtgtgtgtgtgtgatatgaattgagaaccaagtcacatcagaatttctagtgtgcgtgtgatatgaattgagaaccaagtcagatcagaatttcttgtgtgtgtgtgatatgaattgagaaccaagtcagatcagaatttgttctgatctttctacttcataacagacaacacgtttccaaacaatttcggcacagtttttgtttttgttgttgttttttgagacggagtctcgctctgttaccaggctggggtgcagtggcacgatcttggctcactacatcctccacctcctgggttcaagtgattctcctgcctcagcctcacaagtagctgggactacaggcacaggccaccacgccaggctaatttttgtatttttagtagagatggggtttcaccatgttggccagtatggtctggatctcttgacccgtgatctgcccacctcggcctcccaaagtgctgggattacaggcgtgagctaccatgcctggccttctgcacagttttttttaggaatttgtgctgttggcatataagtaggttaacaatccgaaaactcacctattcttttcattgaagatagtcataatgtttgtgctaatgtagtgcccctttacatatttttcttgcttaaaagattaaaaataggccaggcgcagtggctcatgcctgtaatcccagcactttgggaggccgaggcaggtggataacctgaggtcgggagtttgagaccagcctggccaacatggagaaaccccgtctctactgaaaatacaaaaattagctgggcgcgatggcacatgcctgtagtcccagtcccagctacttgggaagctaaggtaagagaatcacttgaacccgggaggcggaggttgtggtgagccaagattgcgccattgcactccagcctggacaacaaaagtgaaacttcacctcaaaaaaaaaaaaaaaaaaagattaaacataaacttcattttttttaaaagacttcataagtgtaggccaggcacagtggttcacacctgtaatccaaacacttgtattaaaactaccatttggtaatagtgtattctaagaactatatctgggtctaatttttacaattaaattcataaacccagaatcttacatatatagacttatgaaatatgcagcgtatactgggaagagtacaaagaagccttagggtaggagagaacttgtttcatttctattacgtttcgggaagttatttttggctagttcttttaagagtgtattttttgaaaatcataaagctaaaatacctacttgacagagtcattgtgaggattgagaaagtttaaatctttcaagttcaaagtgttcagcatgtttcaggtagtaaaaaaatgagttatcctcatcatccccttctgttgtcccatgtaatactacttagactttttaagttacctgttacatttaactgtttctgcacgttctccaggtttctaatgatctattactaaaaattaaagatactgttcttcagaggacagtggatggcatgcagcaagagggtactccatatacaggtaggcccacccacattactatggaagccacctatagagtaactttctacttttgataaaacttattttccattcccttttttttttttttttaccactttttaatggaccattttttaaatgtttatgatttttccaaaactttgattattagaagtttatgtagtagattttatatttgtaatacagtgtcttcatcatagattttctttctctcttttttttttttttcttttttaatgaaggtattctctatgctggaataatgctgaccaagaatggcccaaaagttctagagtttaattgccgttttggtgatccagagtgccaagtgggtaaaaatatcaaagtattacttggtagaagatatgtggtattttaatcttggaatttatcagcctggaagtaattacctttgggaaattcatgcaagttctgctagtacaccagtgaataaaatgtttaaggaaaactaaaatttatcccacctgccatgtggattatgtttttccaggtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacaggtgagtgtcagggagcaagaggttggagtacaacgtgacaagtgccagcaccacagcagacccccctctcacactaaggcttgctctcgataagagtgtgaagccatcagaaacctttcagagggtcttaaccatgttgcttattggatatgtgtgttcaaatatccgcaattactgtattcagagaaccgttgatttcccttcctgtgcaaggaagacataagtggcagaaccacatctcccgagtgtcacccagtgcagccttccacttccacctgcctagagccagggtaataatgagattctctgagagtcagaggaacattagtacaaagtatatcaataagatatattttagaggtgaggactctgaattatcacaaatgcatacagttttgtgtggtttgacccccagtttacagtgcaccccatagtcacttggatggcaaaattcaaacagtttcaaagtttatccttctcttttttttctctctctctttatataaagtaggtgaaacatctcgttaaatgatgttaaatctaagttccagtgccgtaagtccaaaggcagacctctgtgacccctagcagcctatagtttggccactctccgtgctccagtagtgtatttggggggtttcctttttttttcgagatagactctagctctgtcacccaggctggattgcagtggcacgatctcggctcactgtaacctcctcctgggttcaagcgattcttctgactcagcctcccaagtaactggattacaggtgtatgctaccaggcccagctaatttctgtatttttagtagagatggggtttcaccatgttggcccggctggtctcgaactcctgacctcaagtgatccgcctacctcatcctcctcaagtattgggattacaggtctgagccaccatgcccagcctccagtagtgtatttaattcaacaaccccataaactgtcttgcccagacaccaagtccattgccttatgaatcccacgcatggcagctaggcaggcagttaagaattgattccttttgaatatggacaaagaaagaaatgggccagaaccaagatcccttgcattggtaaaatttccctaagattgaagtaacaagtgtataatagttctgccaaagcaatattgagttttaccagtactggcaggcagagtagccattcagaatcactaaatggctttgtgttgtaaaaacactcagggaagatgtatattaacaaactaccaaataggatgctaacaaaagaaatagagacggaaaaagaagaccaccaggagatgaaagaatggttttctaaaaattaagaaaaagtgttatctttacataaactgtcccctttggtcactttagaatttagaatatatagtctaataatgttttaactataaagctgtatctgagagtttaaaaataattcaaaatacagtgaaggggcaggaatttggggctgaccccaaaacttaatttaagccaagtttgtcttaaaatcatacaagtgttataatagtgaaaagattacttatgttttgcattgtactgatcatattggttatactgaaaagaaagaaacttaagtctcatgatctggttaaaaaaaaaaaatcgaaaaagaaaaaaagaagcagctttaattgaataactgtgatgaaaagaagttcctttacaggccaggcacggtggctcacacctgtaatcctaacacttggggaggccgaagcgggcagatcacttgaggtcaggagttcgagaccagcctggccaacatggtgaaaccccgtctccactaaaaatacaaaaacaattagccaaatgtggtggtgcatgcctataatcctagctactcaggaggctgaggtggcaggatggcttgaacccaggaggtagaggttgcagtgagccgaggtcgcacaactgcacactccagcctaggtgacagagcaagactctgtcccaaaaagaaaaggaagttcccggctgggcgcagtggctcatgactaatcccagcactttgggaggcccaggcaggcagatcgcaaggtcaggagatcgagaccatcctggctaacacggtgaaaccctgtctctactaaaaatacaaaaaattagccgggcatggtggtgggcacctgtagtcccagctactcaggaggctgaggcaggagaatggcgtgaacctgggaggaggagcttgcagtgagccaagattgcaccactgcacaccagcctgggcgacagagcgagactctgtctcaaaaaaaaaaaaaaaaaaggaagttcccttactcttaaggaaaagattaatgtgatcagatgcaggatttttgtttctttcctcattaaacaattgcttttataatgagatttacgataacacaagaatttaggttgtcatcctaaaatagcagacagttcttaggagaaaggtctaattactattacattgcattaaaacctatctgggaggccaaggcgggcagatcaggaggtcaagaccatcctggccaacattttcaaaccccgtctctactaaaaatacaaaaattagctgggtgtggtggcacattcctgtagtcccagctactcctgaggttgaggcaagagaattgcttgaacccaggaggcagaggttgcagtgagcggagatcacaccactactagcttggcaacagagtgagactccgtctcaaaaaataaaagaagacctgtctgatagggaaggttcttttaagtgagagaaagatctttaattttatgtatttatttatttggagacagggtctctgttgctgggtttggagcagtggtgcgatcacacctcactgcagcctcaaactcccaaattcaagtgatcctcccacctcagctggtgtgtgccgccacacttggctattattatttatttatttatttatttatgtagaggcgaggtcttgctctgttgcccaggctggtctcgaactcatggactcaagcagtccttgcctcagcctcccaaagtgctggaattataagcatgagccaccgcacctagccaagttaaaaaaaaaaaaaaagaaacttgtggaaatcgtaaatcacttcacggtgtgaaatactgttgctatttgaaatcatatgtcaaatatgctctcttctagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggtaaaactctaagcaagttagctgtagtgccatttcagaaactggcctaaatggctatgtagaacatttcattaaccctataagtcattcagtattcttttctctctgtgggagtgatacagtcttggtttgtattttgtttgaatcaaaactggttatagcaatactcaaatggaaaaaacttcatgatagcgtaagtttggaaagtttagcaaaatcacagtggtactgatttttatttgttttctattttttttattttatatttttaatttttttaacagggtcttcctctctcgcccaagttctcatgcctcagcctcccaaatagctgggactacaggcacaggccaccacacctggctaatttttttgtattttttgtggagatggggtttcaccatgttgccaaggccagtctgaaatcctgggctcaagtgatcctcctgctttggcctcccaaaatgctgggattataggcatgagccgctgcacttggcctgatactgatttttattccttgcgttatcacatagtgttgtatttgaaacatagttcatggttttatcaaagaactgaagatgagaatactggtcatctaactttgtaatttgatttgattatactgtaaagtttgacagtctcattttatcactgcgtttgtatctattactaaaatgtattttttgacctcttactgattcattgttggtatgtacaaactgttgacttgtaaaatcaataaagtcttagttggaaatgtgggtgttttgatttctttttttttttttttttttttttgagacagaattttgctcttgtcgcccaggctggagtgcagtggcatgatctcgcctcactgcaacctccacctcccgggttcaagtgattccccttcctcagcctcctgagtagctgggattacaggtgcctgccaccgtgcccagctaatttttgtgtttttggtagacatggggtttcaccatgttggccgggctggtctcgaactcctgacctcaggtgatctgcctgcctcagcctcaccaagtactgggattacaggcgtgagccaccgtgcccggcctgatttcttaaaaatatatcacatttgctattgttcgtgaagttcatttacggataatgaataaattttaagacaaaatttttttaccaacgtaattcaagctatactgttaccaagaggcaggtttttttaaagtttaaacacagattttccaagaatcaagaacatcaaaataccaggctaaaaatttatttttcatttaaaaatgactagattccattgaaatgacctatttcaagggactgcaatctcaattctagtctgaattatttaagttataaagatgaaaaaatggaaatgccacagtgttagttgctactggagaaaaggttttttaacatcagtctttgttttctatctgagagtgacccagagctgctggctttatttgagttaactgccaatgcactcaactgtattctggcagcttttttgttttttgtttttgtatgctttttttaaagacacttctataaaaacacatatttcttcatgtatcactgcatcccagcaggccagagttctcatttttgcaagtcaagactacaaaatctgcagtgtcattcaaaaatttgatctctaaatgtactgctccgacttgtgggtcctatacagaaggaaatgatgcactgagtatctttacctggttttgcttttgtcatagtgtttactgtcctcagctattaggaaacagatacagttatatattactgaaattaagaactcagtttaattatttagggatacttgtgtacggtttttacaaatctaattttcacttttttgacttgattaggcattcctctcttgttcataccaaaattgaactgagaaaagttgcagcaaaatgtcagtatatctacttttaaacagatggttgccagggtctggggtagtggggaatggggagttatttaactgggacagacgttcagttttacaagataaaggattatggagatggatgatggtgccgggtgcacagcattataattgtattcaatactattgaactgttcacttaaaaatggttaagatgctgaattttatgttgtgtatattctaccttaataaaaaatcatttaaaagaatcagtatatttagcagcctgtgagaagtacttgtagaagaaataggtgattgagttagaatagcggttctcagggatgatgtaatcaagtcaactggggagatggttcaaactcatttcaattcccagagcctgccctagaccagttaaatcagaatctgtatagatgtggcccaggcactgactttaaaaaaatttaagcactttagggtatgtgaaaatcacttgggatatcttctgctttaaataatattttaagattaaaataattttccctgacgtttaggtgatgacttgtttttaattctttaggagtttgacttacaaggaatctggagtagatatcgcagctggaaatatgctggtcaagaaaattcagcctttagcaaaagccacttccagatcaggtcagtgatcctatactttgctaattcattaactttgatatacattgtgaatggatttgggttttatatttaacaggaatattttccaaagcaatgcttggttactgtaagttttgccctgcttaagccaaacccagtcttctgctttcttttctttaatattaaagtatttctcatctgtcatgttaaactcaaaaggatatgtatgctcctttactttttttttttttttttttgagacaagagtcttgcccaggctggagtgcaatggcaccatctcggctcactgcaacctctgcatcctgatttcaagcgattctcctgcctcagtctcccaagtaattgggattataggcacccaccatcatgcctggctaatttttgtatttttgtagagacatgatttcaccatgttggccaagctggtcttgaactcctgacctcaggcaatctgcccacctcagcctcccaaagtgctgggattataggcatgagccaccatgtctggctggtcctttagtatttaattacttcctttttttttttttttttttttgagacaaagtctggctctgtcgcccaggctggagtgcagtggtgccatttcggctagctgcaagctctgcctcctgcattcacgccattctcctgcctcagcctcccgagtagctgggactacaggtgcccgccaccacgcccagctaatttttttgtatttttagtagagacggggtttcactgtgttaaccaggatggtctcgatctcctgaccttgtgatccacccgcctcggcctcccaaagtgctgggattacaggggtgagccaccacgcccagccttaattactttcttaatcaattctttgagcacatggtgcaatctctcatactcaggaagggcatctcttgtttcagccattcttatgaacaagtggtatgtatatacatgtttaacctattaacatgttacatgttaatctattaaatgattacattctcccagttgatttgattatgtcatctctgagaacagctgttccaatcatctatttcttccagaagtacatctcacaggccgctaaatatactggtttttttaaactagtagacatttaaataattacatgtttaatctattaaaatgtagcaagtaattaatttcctctccaacaggctgtaaagttgatcttggaggttttgctggtctttttgatttaaaagcagctggtttcaaagatccccttctggcctctggaacagatggcgttggaactaaactaaaggtaatcagacacctttgtgaataaaggccttttaggaaagatgaggaaatttatatcaaatatgtatttttcttctcttgacatatatgagctaaaaaggaccatgccaaataaccatgtaaaatggctaaaatatctgcacatttctaataacaaattattatttagattatatttggatggaagggtactttagaggataaaaggggatgcttttagaccaagtagcttgtcagaatttcgtgttcttttgtttttaggtgttaagagcagctaatcaaatggataagatacaattttgaacttattccctaatgtggatgtttatattgttcttacatagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggtatgatcagccattttaatcaataacatgtcattcttctttttgtgttttagccctatgtaaaaatgtgatcagtgccaatgtagctagcaagagagactgtatatcacaagatgcatatatgtgatatgcacaaatgaaatataggtaaaactacctgaattaaatttagagcctgctaccttcaaagccctcctcaggggtttgtcctctagacccgtactcccaaactgtcaggcaggccttatctttcttcccaatttttggccaccttttaacatccccatcagtctcagtagcctcctcaacaaacaggtctaggagttatttcctccttattgaccccacggtacaggcagatgggttcctggcattccggatcttaactaaagccaaattttcccatagagtgacataaataataatatacgcccaagttttatagaagtatctttatacatgaaatgtttgagcaaaatgaatctgtaggttgatcaaggaacaaaataacctctttttttaatttaaaaaaaaaaaaaagggaatctctctctgtcacccaggttggagtgcagtggttcaatcacagctcactgcagccttgacctcctgggttcaagggatcctcctgcttcagcctcccaagtagttgggaactacaggcatgtgtcaccaacccagctaatttttgtactttttgtagagatagggttttgccatgttgcccaggctggtcttgaattgctgggctcaagctatcttcccatcacagcctcccaaagacactgcctctttttttttttttttttttaaacagagtcttgctctgtcacgcagtctggagtgcagtggcgcaatcttggctcactgcaagctctgcctcctgggttcacaccattctcctgcctcagcctcccgagtagctgggactacaggtgcccgccaccacacccggctaattttttctatttttcagtagagatggggtttcaccgtgttagccaggatggtctcaatctcctgatctcgtgatctgcctgcctcggcctcccaaagtgctgggattacaggcatgagccaccgtgcccggccagaaactgcctcttttatatgaccatttaaaccagaaattgtgccatcttgcatctgcacatgtgtgcatctaatctcagctggtctacccaggaccccttgagcaccaaccctagtcctccacatgacccttttccacgctgacaagatgaaagaaacaaccaaattgcaggcacaattgcgtaatgatggaaaagaaacagaaagaaggtggttcagctacagcagatgataaaaacttcagttctccttaagaagttaagggtaaacaatatctctggtattgaaggggtgagtatgtttacaaatgaagaccagagatccactttaacaacctaaaatgctggtagcatttctctggggcagtgaacactttcaccattacaggccatgctgagacaacgcagctgatagaaatgctaccagcatcttaaaccagcttggtgcagacaatctgactagtttaaggagaccgactgaagctctgcccaaatagtctgtggatggaaaagcactgcttgctaatggaggggatggtgatgaagttctagatcttgtaaggagttttgatgaggctattaagaatgaggcaaactgaattgagtcaacttctgaagaagaaaaaatatgaagtaactaggagctgctattttacattatgactgctttctgaaattgtttatggatctgataaaatttagatctctaatattttaagccccattcctgttggacactgcagctcttttcagtttttgcttatacacaatttcttcttttttttttttctttttgagatggagtcttgctctgtgacccaggctggagtgcagtggcacaatctcggctcgctgcaacccccacctcccaggttcaagcaattctcctgcctcatcctcccaagtagctgggattacaggcataagccaccacacctggttaatttttgtgtttttagtagagacagagtttcgccatgttggccgggatagtctcgaactcctgacctgatccacctgcctcggcctcccaaagtgctgggattacaggcgtgagccacgatgcccagcccacaatttattctttgtagctaattaagctaaagaagcctgggaataaagtttgaaacaaacaaaaattgcctttcaaccaccgtttagaacacagtttcttatttggagtctgcctataccttatatcttgacatgatataattgtaagtaaaatgctatactttttaagctagggtatttggaattgggcagtcccagttaagtcacttctttaaggctgtatcatcacctgaaaaatggactgattataaagatcaaatacatatgaaagcagttttgaaactaaacagctatagaaatgatgttatattcaactgagcattcattctgtgcaagcagtggtgtttggcggctgcatatatacttgtagaggtgctacctaatctcaccctttgtggaaacaagtgctatttctcctgaaatcatgcttggtggaaagttctgttagacagctggtagagtacattttcttaaatatttgcaggacatagccatgtgttagttgttcatgttaagagtagcctgtgccactgtttcctagacagatttataaatactctgatttctttgttcttgtcttatcccaccaggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggtaaactccctcatgtttaaactgtcctgcttggaaatgcctgagcaagcatttagtggttttagtctctgattacttagagctaaaagggaatgaattaccttggtttgctacttggtcattattgtagagctggtgtcattctccaggttgatttttatgttttggttttctattcataggctaagtttttgtcttctctcttcaacatgcaggggacttacttctcacgcctaccagaatctacagccattcactgttacctgtcctacgttcaggacatgtcaaagcctttgcccatattactggtggaggattactagagaacatccccagagtcctccctgagaaacttggggtagatttaggtaagatcactaaaacgaacttctgttcagaaaattgctgaggaaaaaaatgcattgtgcgagaaaactatgggtagttaatgtacacatgattacacatggaaaattcttaatcattgggggttttgggagggaaaaactcgacccttttctatctctttttgcttcattatctgtatttataagacataaaatattgtcatgtaattggcttacataaagttgaagtactcgataagtaggtcctccaaggggattggtaacttcaagctctattaagatggagccctacacaccaggaaaggaaatgttagctattaagtaatccatattcgagataaaaggacctaaaccaaggcatagagaagggaggcacattggagaatcattttatgcttagaagtaaaaagaagtctcaggtttctagttaagcaggtgagtaggcggtaacatcattaacataggaagaagagtaagtttggaatagaaggtttttaaatcttcagtgtgtttattccaaggtgactgtgagcagaagttgaagtcatgctgaagataaattgggtgattatttgcacgtagtaatagttatagccaagagaatgagggagaccaaaaggttgtttctcaaagtagagtgactgaaaagaacagtccaaagtagtgggtaaaccatgtaaaagtattatcatcaaaccaacatgggatttttttcttttcttttttttttttttttttttttagacagagtctcactctgtagcccaggctggagtatagtggcgcaatctcagctcactgcaaactctgcctcctgggttcaagcgattatcctgcctcagcctcccaagtagctaggattacaggcacccgccaccatgcccggctaatttttgtatttttagtagagacagggtttcaccttgttggccaggctggtttcgaattcctgacctcaagtgatccgcccgcctcagcctcccaaagtactgggattacaggcatgagccaccgcgcccggccccaaggtaggattttaacgtgacactggtccgcagtgtcaggtacagcacaaagatctagaataagcactagaaaaagaccagtgtattttagagttaggtcaaaagtcagtttgctggacatagataccacccactagattgttgtggcagagttgtggagacagtgggtagagatttctgtttgaagaaacatactggtaaaagggaagtggaataattttatgcatgcagcaaaagtgagggacagagtcctccctccctgtgttcttttttgttttttgtttttcgtttttttttttttttttttttttgagttggagtcttgctctgtcgccaggctggagtcgccagactggagtgcagtggcgcaatcgcagctcactgcaacctccgcctcctggattcaactgattctcctgcctcagcctcccaagtagctgggactacaggtgcccgccaccatgcccggctaatttttgtatttttagtagacacggggtttcaccgtgttggccaggatggtctcaatctcttgacctcatgatccacccgccttggcctcccaaagtgctgggattacaggcatgagccactgtgcccagcccctcccttccttgtttttgtaaaataaagtcagagaaacttttccagctatagtcaactaatacacattgatttgaaggagtagaaactgagggagtttacataaaataacttctctgtgaagtattagtgagatgatcaggcctggggtgggagcttgaagagaggagtggataaagcagtcaaggtcaaacaggagtgagacagtgagcaggactgaaggcacaggtgaaggtgaagctgctcatgtagtttttctcccagagcaaaagcatgtatatagctttgaagcaagaacagaaaaaaaatagattagttaggttgatccagctgaactaagcaggtattggggtcattcattggggagaagcagtcagagtgatagaggtgagtagatatggtgagctaacccaagagtcagagcgtatgtgaagctcggagagaactgaagagtcagaggtaggttgtgtggaagtgaggaaatcggcaagggaagctgggagagtggtcagatgggatttcagcctagtcagggaagcaaaacagacaggccaggctaggctgagtgggagtctcttccaggtccatggactgagcatattaaggagttgaaggattcataggagggtgaaactagtggttcaagacattccttgggtagaaatgctttctggtgagcatatataagaaccttaataagtagttcattcatcatccttttcaaatagttaaaaaacagtggcctgctgatgaatggggaaaggaggcaggactgatttgtgcatttgccagtttttgtggtataaatactcccatcatagctgctttaaaaatggctgtttaacagtctctacaagctggctctagcacaccactagttaaaaacaacatagtagtcacctcattaagaaactgaaagtgatatagccatattcctgaaagcagttatagtttgagttacacaaatgtctgtattccaataaaagccattgcacaattccttgcatcagcctctaaagtttcttccaggaatcatactttgacaacagatttaagtaaggacttctgggggtttttttgtttgttttttattgagacagagtatcactctgtcgccccaactggagttccgtggtgcgatcacagctcactattgccccaacgtcctgggttcaagtgattctccgacctcagcctcctaagtagctgggaccacaggtaacacgccaccacacttagctattttttgtatttttagtagagacggggtttcaccacattgcccaggctgatcttaaactccttggctcagagcaatctgcccatctcagcctcccaaagcgctgggattactggcatgagctaccacacctggccaggacttttcaacattaaaattacaacttacattattcatgaagtacttgttcatttatagaagctagactcttagtctgccagtgttttttcctataaatattttgtaaaacttcactaaaacaagatcataatttggtaatctgctacttgccctgccattaaatatgtcatcactatctccttgtcttagtagcatcatttttgataacaagtattccattttacagatgtaccactatttagttttaagttgctatttacttttaactattgagagcatagtgaacaatgtagttactaaatctgaggtcaactattaagaatggacatttcccagctactataaatggaattgaatctaagagtcatagacatgtgattcatttttatttttatttatttttatttttttagacagagtctcaccctgtcgcccaggctggagtacagtagtgcgatctcagctcactgcaacctccacctcccgggttcaagtgattctcctgcctcagcctcccgagtagctgggattacagatgtgcgtctccacgcccagctaatttttgtattttcagtagagatggggtttcatcatgttggccaggctggtgtcgaactcctgacttcgtgatctgcgggcctcggcctcctaaagtgctgagattacaggcctgagccactgcacccgcctcatttttaaaattgtatcaacttcaggctgggcatggtggctcacccctgtaattccagcacttcgggaggctgaggtggatggatcccctgaggtcaggagttcaagaccagcctggccagcatgatgaaaccctgtctctactaaaaatacacacacacacacacacacacacacacacacagagacacacacacacacacacaaataaccaagtgtggtagcacatgcctataatcccagctactcgggaggctgaggcatgagaatagcttgaacccaggaggcggaggttgcagtgagtcgagatcacgccattgcactccagcctaaacgacagagagatactctgtctcaaaaaaaaaaaaattgtatcaactccaaagtattaaaaaactgattatcagctgagcatgatggctcatgcctataatcccagcgctttgggaggctgaggcagaagaagcccaggaggtcaaaactagactgggcaacatggtaagaccctgtctctccaaaaaaaaaattttttaaatagccaggcatggtgtcgcatgcctgtagtcccagctactcaggaggatgaagtgagaagatcacttgagcctgggacatcaaggctacagtgagccgtgttcatgccactgcactccagcctgggcaacagagccagatcctgtctcaaagaaaaaaaaaattatccaataaataaatcaaataaataggcagaactgatagtaaaccttattatttaataaaaagctgagttcacattggcttccctttcttaagagcatcataaataatttaattcagtatagtttttttaaaaaatcagatcccataatcgtagattccaaagaactatccagattctttttaaattcagaaatgttgtgtgtgtgtatatagacctttacctaaaaatttttattagagatttttgttgtattatttgtgataagagagaatgtattcttttttttttttttttttttttcaatttgagtcggagtctcactctgtccaccaggctagagtgcagtggtaccatctcggcccactgcaacctccacctcccaggtttaagtgattctcctgcctcagcctcccgagtagctgggactacaggtgtgcgccaccacgcccagctaattattgtatttttagtagagaatgggtttcaccatcttggccagggtggtctcgatctcctgacctcgtgatccgcccacctcagcctctcaaagtgttgggattacaggcatgtaatccaaagtgttgggattctcacgcccggccgagagaatgtattcttatagcagacctaggaagtctaaattttaaaaagaatgagagggagagggtgttgatccgccttccattaacataacttttcttgaggagtgtatgcattttctctaaatatgtagataagccatctagttttgcattgtactttgggtgcattttggtcatcacaaagactcagccaaacattcacaaaaggatggtatactggcctttgctggaattcagctactagctcatctgatccattagggaatgtctaagggtctagttagttaatgtagcacaaaacctcactcatttgtgagtactggccaagtgtgtcaacaaaaaaatgttcttaatgtctaaggtacaaatggatccccaaataaaaagttctcagaggccaatttatagttttaccctacataaaatagcagagcctgattataatttccacatctttgaatatgtgcatacttttgtactttgtgtgagaaggtaggaaaatcaaacaattcgtgtctatttttttcagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggtacttgctccttactcatttttagatatataattttagctgtataattttagctatacctcagccttgcctcacaagctttctgcccaccttttagtgcagccatcgctatggcaactatctttacacagatgtaacatgacagcacccaccccagcgataccacgtatctcttcatttctgcctcagaactaagcattcatgcatgcacagccacaccccacaggatcgcttcccaaagtaatctccctacacacaagacctcatggctctgctgtcactcagctcgattcaaggaatagcgagcaagcaccctgacaagtactgtatcagtcaggactctgcgagaagtgctagaacttggcagaggggcagaaaatccactcagattcactaacaaagacgtcacatgcttgctttggcaggacacatactaaaattggaacgatacagagaagattcacaaaaataaaaaatagaaaaaaaaaatgtcagaccttgttgactttacctgtatctgcctttctttcctctattgtgtaggattcattttcaagcgggttctccaaatgccggaaagataacatccttcagctcacattacaataagaaagagagacccagccgggcgtggtggctcacgcctgtaatcccagcactttgggaggccgaagcgggtggatcacgaggtcaggagatcaagaccatcctggctaactcagtgaaaccccgtctctactaataaatacaaaacattagccgggcgtggtggcgggcgcctgtagtcccagctactcgggaggctgaggcaggagaatggcgtgaacctaggaggcggaacttgcagtgagccgagatcgcgccactgcactccagcctgggcaacagagcgagactccatctcaaaaagaaaaaaaagagagaccctctttttcttaacatcgcatatcaagcctttaaatggctttgctaggtcacatgcttatccccgagaccaggagatcatggcactactgtgggtggtctcgctaggaagatttggggagtaggggcagaatactggcaggcagtcatatatatccaccgtgcacttcaagatagtgatgtgatctgcagcttttagttgaagtaattacatatgttcaccttttggaagtttttatgaaagagtagtgttaagtgatacaaatgtgttgttcattttagtccttgcattatcttattttcaggataaaacataccctaaagttttcataaaatatttttctttccattattcttgttaattcacaattgttctttacttatttatggatatgtttgaaatgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggtgagatgtggcttccccttcactgtagagctgttgactgcccttcctttcctccccgcactcttgtgagattgtaaggttactctcggcagagtctagggactggggggaatcatgagggttgtctttgtcttttcagcattcttagtctttccacttttcttaggaatttgagacagctcccaaagaaaaaagtaaaggatgtcagaaagctggttaaagagaaaccagaaaagatagaagctacagctcattttgtatcatagctttgttgttgaaaagtctgaaaacagttgaggaatttttattgttatcttattaattagaagaagtttatgtttaacctttatggatagaggggtaaagtaataagagtattgtattctctcagatggatgtagcctgatttttttccctctattgtaagtaacactgctatgaacattcttgcaaatattcagtatgttcttaaatgcatatgtgatttttttttatttgatggccaagatcatagtgattctttttgagacagtcttgctatgttgcccaggctagagtacagtagctattcacagatgcagtcatagtacactgcagcttccagctctggcctcaagcaatccttccgccttattagccccccgagtagctgggactgcaggcatgcagcaccacaaccagctctgatacttcttcaggattcattcccagaagtttaattgctttacaggtcgatcttaaggttttaatgtactttaggcccaagttgataataaagcaaagaagctattgtaagatgcagccataaaaaagaataaaaccacatcatttgcagcaatatggatggaactggaggccattatcctgagtgaactgcctcagaaacagaaaaccagatattgcatgttctcacttatgagtgggagctaaacagtgggtacatgtggacataaagatggaaacaatagggccgggtgctgtggctcacgcctgtaatcctagcactttgggaggctgaggcgggcggatcacaaggtcaagagatcgagaccatcctggccaacatggtgaaaccctgtctccactaaaaatacaaaaattagctgggcatggtggcacacgtctgtagtccagctactctggaggctgagacaggagaattgcttgaaccctggagacagaggttgcaatgagctgagattgcaccactgtactccagcctggagacagagcaagactccatctcaaaaaaaaaaaaaaaaaaaaagatggaaacaatagatacaaaacagggaagtgtgggagaagaggtgagggttgaaaatttttctatcaggtataatgttcactatgtaggtaataggtacactagaagcccagtccccaccattatacaacattcccatgtaataaacaagcgtgtgtacccccgaatctaaaattttttttttttaaagaaactattgtaagagtcatagcatagtggtttgttcttgagagggtcagtttttcttgcttaattaagcagcttatttctcatcagtcagttttaacataatgttatactgtttctactacaatgctagatcacaagatacagaatttgtgggagcaattacatatcctaggagcaattacatatcctaaaccacgtcgtttgcagcaatatggatggaactggaggctatccaggaatatctgtgcttttcacaatctattaatccattatcccaagaggaagggagtttttttaatttttaatttgtatgggtacatggtaggtatatatatttatagggtacatgagatcttttgatacagccatacaacctgtaataatcacatccctgtaaatggggtattcatcacctcaagcatttattctttgtgttacaaacaatccagttattttatttcagtttttttttgttttgtttttgtttttgtttttgagatagagtctcactctgtcgcccaggctggagtgcagtggcgcagactcggctcactgcaaactccgcctcccagtttcaagtgattcttctgtctcagcctcctgagtagctgggattacaggcacctgccactatgcctggctaattttttgtatttttagtagagatggggtttcatcatgttggccaggctggtcaggctggtcttgaactcttgacctcagtatgatccgcctgccttggcctcccaaagtgctgggattataggtgtgagccaccacatccagcctcttccagttattttaaaatgtgtaataaattattgttgactatagtcaccctgttatgctatcaaacactagattttgttcattctaactatatttttgtacccattagcatcccctctccccgtctctcccactacccttcctagcctctggtaaccatcattgcactatcatcatgagttcaactgttttaatttttagctcccacaaataagtgagaacatgtgaggtttgtctttctgtgcctgacttatttcacttaacttaatgacctcccgttccatccatgttgttgcaaatgacaggatctcatcttttttatggctgaatagtactccattgtgtgatgtaccacattttctttatccatttgtctgctgataaacatttaggttgcttccaaatcttggctagggagaataaacatgaaactgcaggtatctctttgatacactgattttctttcttttgggtatatacctagcaatgggattgctggatgatatggtagctcttttttttaatttttgaggacccttcaaactgttctccataataattgtactaatttaccttcccaatagtgtgtgacggttcccttttctccacatcttcgccagcgtgttattgcctgtgttttggataaaagccattttaaccggggcgagacaatatgtcatagttttgatttgcatttctctgatgataatgatgttgagcacctttttatatacctgtttgcaatttgtgtgttttcttttaagaaatgtctattcagatcttttgcccatttttaatcagagtattagatttttccctaatgaattgtttaagctccttatatattctggttattaatcccttgtcagatgggtagtttgcacatattttctaccattctgtgggttgtctccttactttgttgattgtttccattgctatacagaagctttttccatatttactttagttgcctgtgccaagagaaagggaatttagaagcctcacatatcaccagtcttttccaagacatttattcagaaaatttgactgtcccctattcaaaatggcacatctctttttttaaaaagtgtgaggttgggcgcggtggctcatgcctgtaatcccaaatttgggaggccgaggtgggcggatcacctgatgtcaggagttccagacgagcctggccaacgtggtgaaaccccatctctactaaaaatacaaaaattagccaggtgtggtggtgggctcctgtaatcccagctactcaggaggctgaggcaggataattgcttgaacccgggaggtggaggttgcagtgaacccagatcgtggcactgcactcctagcctgggcgacagagtgagactccctctcaaaaaaaaaaaaagaagtagtagtatgagctcactgctgtttttctcccttctcaggatcgaacctgcaagcacttatagacagtactcgggaaccaaatagctctgcacaaattgatattgttatctccaacaaagccgcagtagctgggttagataaagcggaaagagctggtattcccactagagtaagttacttgggaaaatatctttgctgtgggccatatttaagctcgtaatctgccctcacaggaccctggtctatgggcacttgttcttgggacttcgccattttgggtgggtgctgggcttgccttcttcatcctgtccctttcttaataatctctctatcaggtatatctttacaaggaagtgaagtatggtctgtgtaaaggttgagtttttaattatttttggtaattcattgaaaagggttgtgcttatctttttctattacaggtaattaatcataaactgtataaaaatcgtgtagaatttgacagtgcaattgacctagtccttgaagagttctccatagacatagtctgtcttgcaggattcatgagaattctttctggcccctttgtccaaaagtggaatggtaagcaaaaattatttgacatcacattgggaaatcaattgaaaatggtctccagaacagataacttgccaaacaatcccagtagtgaacacccatcccagaaatccaactcctgtttgactgtgatattttattaatactttaacacaggtcacagtttaatttcctttgttttacactaaagaatgacccaatgatgatttattaacctgctctctatccatttactttggcttgctgtaattaatcactttttctaatgtagcttagttttgtttcacattactgcaaagataatatttcatcttttgaataaatattcagaagaccttcctttatttgtttggaagcaaaagagagtgattccgtatatcccaaaatgaagagtccatcctctcttaggaagcatagaccattgccaggagttggcaaggaggaggttattgccagaaaacacatactatctatgttactgccttcttcccaaaagccttgactgcatcctgtttgtgtatgtgtgcacacagttggtcaataaatgcattttccctccaaagagtttatgtattcttaggtgaatgtagttagagcacttgtggtgtgatataaaatagacaatgcctttggtgacatgagccacacagaactaatctagcatctgtctggtggacaggtcactttgtggttagaagtcaagcacatagatgctatgtaagaacctcttgcttatttttaatagtacgtgccagcaacaagctggtattcagcttgaactccccaccttcctgtcaccatgaatgtctgttcagagcaccccagcatgcctttaactgtgcaaggcgggtacttgctgcttccagggccttcttggatgagaacttacttttacctcatttctgtgtttggcaaagaaaacatccatcccagaaatccaactcctgtttgacttcggatctagataggaaaacgtattcctttaacagaatacccaggatttttaaattctgaccactatgctttttttaatttttaggaaaaatgctcaatatccacccatccttgctcccttcttttaagggttcaaatgcccatgagcaagccctggaaaccggagtcacagttactgggtgcactgtacactttgtagctgtgagtatgtctttttctaccaacataatattagtagtcagatgtaaatgacactggctagaaggtaatgttcaaaacttttgcttacttttccaggaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctg

SEQ ID NO: 37695 - DNA, 5040 bp, Homo sapiens
cgcgactcccacttccgcccttttggctctctgaccagcaccatggcggttggcaagaacaagcgccttacgaaaggcggcaaaaagggagccaagaagaaagtgtaagtcgcgactgtcgtggcgtcttgctttttgggggtctgctggaatcggcgggctggtcctagatcgcggcgtaggccggatggcgaggattccagtcggattgtgcgggccgtggcgggttggtgcacccaggaacgcggcctggagggtcggtgttgagtagcggcaggtcggctgcctttcccaggccttctggtccttgcgcgcgtcgcgtttgagccggcttgccggcgcgactcggctggaatgttagttttgtgggctcacgagctgcctcaattctgcgagtgtttgatggcactgcgacagcaggagttgaggaaagcacccttctatccattcaggacccgtcaatctcgcctttgcttggtcccgctggaatctgcgagctcctgctaagctttggggccatgcagtctcttagttaccagtacatgccattacgtgccagcaaagttaatgagattgcatgttactcgtgcctgtgtagtggaaggaccgatgcatgttattctaagtgcctgtgtagtggatggaccgatgagggtgggaagtggacataacctttcaaagtctgatgcatgcagtgaaacgtacagtgggaagagctagatttatgtttgttcccctcacctcactgtgagatatactttggtatcaaattgccggttagctttttaaaatattaatgggaaataccattaacagtgaaaaatacagtaagaattgatctgcaatggaacttaagcatcttcttaaaatccagggttgatccattttctaagaaagattggtatgatgtgaaagcacctgctatgttcaatataagaaatattggaaagacgctcgtcaccaggacccaaggaaccagtaagtagcttattcttggtttgtattttccttaagttggcgcttgtatattgtagcaggcatcttggtctgttgttggtcctgtggtgggagactttaaggaaatgtcagctcttggttgcagccttggcacctgtggtgatcatttttagtacagcacttggagagaagcaagatggtgctttttgaattaagaaaatgtgccatgggtagttctgagcttcaaataagtactgttgataagtcactggtgtctggatagatttgataacaaaggttaaggtctttataatttaccattaacttaatttctaccctcagtttacaggcttgactttgcttatatggttcctaaatgttaagatacttgtttttttcttttgtagaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcaggtgagacccaaagttccttagagtggttgtgctatgggtgtttgaccaaggatagcatggtttgatgactggaaggagcaagttcattttatttatttattgagaccagtgaaatgtccacaaagttcattttaaatttttgttttcttgccgttgttgagtgctaactctggggttgccacaccatattttacttactatttaaatctaagatttaatagtggtgtatcatcaaagtcagattttcttgctgcatagattagtggttttttgaggaacgtttaggtgcaggtgggcggttttgcctgtcttaaggatgttttttgacctcagaattgagtgaatgttgattaactgtggcagtagagcataattgtggcagagcctctggagtgaggttaaaatctgggctccatttgcctattgtgttctcgttggaaagtaacttgttttctaagcctcggtttctttatttgtaaagtgcagataagagtgtcattttattgaattgtgaggatgaaatgaaaatatttcagatgtgtctggctaactatccagttggaatattttgtgggagttttttgtttttgggagattgagtctcttatcgtccgggctggagtgcagtggcgccatctctgctcactgcaacctcctcctcctgggttcaagggattctcatgcctcagcctcccaagtagctgggattacaggcacccgccaccacgcccagctaatttttgtatttttagtagagacagggtttcaccatattggccaggctggtctcgaactcctgacttcaagtgatctgcccgcctcagcctctcaaagtgctgggattacaggtgtgagccactgcacctggcacagttcgaatattttgtatgtgggaatgaatgatgacaaaatgtttcagtcccaaatgatacatactgattataccattatatttatcctgacattcctctaaggctttatggtttacatttctagaaatattttaaggtcccttagctgtaaattgtatttgattagtttttttttatactaaggtataaaatttacaaaatgcaaacaaggtaaatcagttttcatcactacccaagatgttttttgttttttcaatttaggcaataatatgaccactaactaggggtttttaattatattttagctctgaaattgggtatttaatcatcagcatggctttagtttggaacataaaagacgtctttcaaagtgtgcatttagagttatagcagtcacctatttacaacacagttttttgaaaaatgacataatcactgtagatgtgttcataccatagaataccatggatcctctcagacctattttcctctggtgtagttttacacttgagggggtatgagctgtttaaaggggtatatgtatatgcaatggatgtgggtttggatgccgtcaagatagtggtagtgttaatggagggtagaaaggaggagggagggcagttgagaggacctggttatttaattgggtaagaatttgggggtaacttggtaagttcaaggaagttaattctgtaaacttaaagagatgttacttatgttaggatactttatatttaataatgagtgtttgacaatccagctttttaaaattagaacttgagggataaatggataacgtaaaacctgttaaatctgacggtatcttttttctccagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgtaagtgtttctttgcttcctcacacaacacaaccttgagtattggattattcctgagatgagagaacgcatatgagacaaggtaaaggtctgttgaaatcctgtctgtgaatccttctagctatatctctttaagtgaaagagtgttaagtactcagtaaatatgattattattactattattatttgagtcagagtcttgctctgttgcccaggctcgagtgcagtattgtgatcctccttggctcactgtaaccactgcttcctgggttcaagcagttcttgagcctcagcctcctgagtatctgggaatacaggggactgccaccatacccagctaatttttttaaatttttagtagagatggggtttcatcatgttggccaggctggtcttgaactcctgacttcaggtgatctgccagtactctaaatgataacagttttttcgtgtttatttattttgaatgaagctgtctcacagtagatggagttgaaggacaggaaatgtttttcccctacttggaaaatacactgaataagttgagtggggtgggatgtgcctggagtcccagctactcaggaggctgaggtggtaggattgtttgagcccaggagtttgaggccagcctgggcaatatagggagaccctgtcccaaaaaataaaaaatatacgtatatatatatacacacacaaagaaaaaatacactgaatagacaaaacctttcatgattaatgatgcacgggaataagtgatgaaaaaagtttcggtcccagatgatggccagtgataacaacatttttctgatgttcccatgcaatatacagttagctaagagggtgtaatggaaaaagcataaggcttggactcagaagactctactaactttgccactagctagctatgtaattcagatcatctatcctttacatgtgaaaggtaaataatggcttatcttaacaggaggatttatgcaggttaaatgaggtaggtgttatgtgtaggtttattccaaggcttctctacttttaaaggaaatggcttatatctgagaactaggacttttagaaaaaaatttactgttactggtttgcaggattccagacagcattggaaaagacatagaaaaggcttgccaatctatttatcctctccatgatgtcttcgttagaaaagtaaaaatgctgaagaagcccaagtttgaatgtaagtgagaaatcacatgattcctgtagggccaaatacattgtttttgggtggaggaggagtgtggggccatatcatggccttctttttcttcctgtcatgcttgcatagtagtgatgaccattatttcaagatatactaacagttttttggtttttttttttttttttttttttgccttttagtgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgatggtttgcttctg

SEQ ID NO: 37696 - DNA, 33462 bp, Homo sapiens
ggtgcatgccgggacggcggtgggtggtgcatgcgctcgcatcatggcggctgagtgggcttctcgtttctggctttgggctacgctgctgattcctgcggccgcggtctacgaagaccaagtgggcaagtttgattggtgcgtacgtgtggaacatattcgagagataagtggctgtttccccagtacctgtctcctacctgctaaaggttgtcacttaacaggattggccgcataatttgcaggacccagtacaaaatgaaaacgtggggccccttgttaaaaaattattaaggatttaaagtcgttggaagcagagccttaaaccaagtgttaggggtcattctaagctgatccttgcgtgtaagccggccctgccatccaggaatgcttggggtgccggtcagagatcactgatcccgtcctccctcgtcaggttcgatttttttgactgtgaggtttctggtctaccaggtgtcagaggtcgccaagctgtcagtgaactttaattcctactcgaattggtgtcttgtaggcaagtgaacaggagctttcgtcttaaaagtcctaaactgagtccttttcccctctcatcaacctagtctggccctgggctcacagcaggattgcccaaaacactaagcagctagaatatgccattcactcattcattcattcacccacccacgtcttccttaaggccctggagtagcttgcttttgtttgaattttactagttaagacttgtgtgatcttggggaaagtgacttaaccactctgtgccttggtttctttgtctgtagaatgggtttactaacagtccgttatctcttacagtacttgtgagaatgaatgagacaatcccattaaattacttagcacaatgcctggctcattgaatgcagtcattaagcgttatctgttattattgctatttacactttattcttcagggcccaggtcagatttctcctcctctgaagtattttctgtcttggaaaagttgattcgcatatatgttgagtacctgttatgccagacagtgtgacaaataaaacatgttacatttttaatgatgtgcacaactgttcacaatgtcatatgtgtatgttacacatatatatcgggtgatatgtgtatctaattttgcagaatacttgatatatgcaattttcttaattttattttcatgaatgaatgaatgaatgaatggcatttcctaactgcttagtgtcttgggcagctctgctctgagcccagggccaggttaggctgatgaggggggaaaaggactctgtttaagactttttttttttttttttttttttttttttgagacagttttgctcttgttgcccaggctggagtgtaatggcgcgatctcatggctcaccacaacctccgcctctggggttcaagcgattctcctgcctcagcctcccgagtagctgggattacaggcatgcgccaccacacccagctaatttttgtatttttggtagagacagggtttctccatgttggtcaggctggtctcaaactcccgatctcaggtaatccacccgcctaggcctcccaaagtgttggaattacaggtgggagccactgcgcccagccaagactttttaaaattttttgagacagggactcattctgtagcccaggctggagtacagtactatcatggctcactgcagctttgaccttgcaggttcaagtgaccctcccagctcagcctcctgagtagctgggactactggtgcacacctctccagtttctttgtattttttgtagagacggggttttgccatgttgcccaggctggtcttgaacacctgggctcaagcaatctggctgcctcggcctcccaaagtgctgggattacaggtgtgagccactgcacctggcctacagttttcagattgaaaaataaatgaagacatacaggtatgcatcacttaatgatgggaatacatcctgagaaatgccctcttgtgcaaacgttgtagcatgtacttatgtaaatctagatggtttagcctactacacacctaggctatatggtacagcctattcttcctaggctacaaacctgtacggcatgttactttactgaaaactgtaggcaattgtaacacaatggtaaatatttgtgtatctaaacatagaaaatgtatggtaaaaataggatatgaaagataaaaaatggtacactggtatagggcacttaacatgaatgtatcttgcagaactaggagttgttctggggttagtcagtaagtggttggtgagtaaatgtaaaggcttaggacattactgtacactactgtggactttataaatactgtgcatttagactatactaaatttataaaatttcttcaataataagttaaccttagcttaatgtaacttttttactttacaaacattttatttttttaatttttgacttttgtaataatacttagtataaaacacagactttacagctgtacaaaaatatatttttaaaatttatttttgacatgggatcttgctatgttccccaggcagatattgaactcctggactcaagcaagcctcctgcctcagcctccctagcaactgggattacaggcatatgctaccatgcctgacttaataatatttttcttatatctttattctataagctttttcctacaatactaaaattttttttttcagtcttaaactattttgttaaaaactaagacacaggccgggcgcagtggctaacatctgtaatcctagcactttgggaggctgaggtgggtggatggcttgagtccaggagttcaagaccagcttggggctgggcgtggtggctcacgcctataatcccagcactttgggaggccgaggcgggtggatcacgaagtcaagaggtcaagaccatcgtggccaacatggtgaaaccccgtctctcctaaaaatacgaaaattagctgggcgtggtggcacacgcctgtagtcccagctacttgggaggctgaggcaggagaattacttgaacctgggagacggaggttgcagtgagttgagatcacgccactgcactcagcctggcaacagagcgagactccatctcagaaacaaaacaaaacaaaacaaaaaacaggttgggcaatatggcgaaaccccatttctgcaaagcatacaaaaattagccgggcatggtggtgggtgcctgtagtcccagctactcgggaggctgaggtgggaggatcacctaagcctgggaggtcgtggctgtagtgagctgtgatggtgcctctgtactccagtctgggtgacagagtaagagcatctcaaaaaacaagcaaacaaaaaacaaactaagacacaaacacattagcctgggcctaaatagggtcaggatcatcaatatcactgtcttccacctccacatactgtcttactggcaggttttcaggagcagtaacacccatggagctatcatctgtgataacaatgcctgtttctggaatacctctttttttttttgggacagagtcttactctgtcgctcagcctggagtgaagtggcatgatctcagctcactacaacctccacctcccgggttcaagtgattctcatgtctcagcctcccaagtagctgggactgtggtgcacagcactatgcctggctaatttttgtatttttagtagaaatggggtttcaccatgttggccaggctgttcttgaactcctgacctcaggtgatctgctcgcctccgcctcccaaagtgctgggattataggcatgagccactgcggccagcttggaatacctcttgaagcacctgcatgagactattttacagttaattttcttttaataagtagaaggagtactctaaccataaaaagtagatacgtaaaccagtaacacagtcatttattatcattgtcaagtattatgtagtatacattattgaatatgctgtacttttatacagctggcagtacagtgggtttgtttacaccaccttcaccgcaaacgtgattaatgcattcgactacaatgttatagcagctacaatgttactaggttataggaatttttcagctccattatactcttgtgtgaccaccactgtatatgctgtatatgcgatcaatcattgactgaaacattgttttgcagtgcatgactgtatagtaaaacgttaaaagtatatgtacaaagctgggcacaatggcatgcacctgaaatcccagctacttgggaggctgagatgggagtattacttgagcccaggagttcaatccagcctaggcagcacagtgagatcccatctcaaataataaaaagtgtatctatagtggtggttgtattagttttctcaggctgctataatgaaataccatagactaggtggcttaaacaatagaaattgatattctcacagttctggaggctggaaattcaagatcaaggcattggcaggttttgtttcctctgaggcctcgctcattggcttgcaaaaggctgccttcttgctgtatccttacatggcctttactgtgcttacacatccctgatgtctcttcctctattggattaaggcctcacccttttgactttattaaaacataattacatttttaaaggccttgccgtcaaatactgtaacactgggggatagggtttcaacacaggagtttttgaggatacaattcaatccagaagagtgatatattacattttaaaatttttattatttatttattttttattgttttgagacagagtcttgctctgtcacccacgccggagtacagtggcatgatcttggctcactgcaacctccgcttccagggttcaaacgattttcctgccttagcctcccaagtagctgggattataggtgcccatcacgcccagctaatttttgtacttttataagagatggagttttaccatgttggccaggctggtctcaaactccggacctcaagtgttcggcatgcctggaccttccaaagtgctgagattacaggtgtgagccaccgtgcctggtggagatttttaaattgttataagtgttccccccacccactcattttctgtaataaggaggcattacttttatatccagataaaacaacagtattttatttacttatttatttgagacagaggcccactctgtcgcccaggatggagttcagtgacacgatcttggatcactgcaacctctgcttcctgagttcaagcgattcttttgcctcagcctcccgagtagttgggatgacaggcacgtgccaccacgcccagctaatttttgcatttttagtagagatgggttctcaccaagttggccagctggtctcgaactcctgatcttaaatgatccacccaccttggcctcccaaagtgctgggattataggcgtgagccactgcgcctggcctgtttatttttttgagacagagtcttgtcaggttggagtgcaatggtgtgatctcggctcactgcagcctcgacctcctgggctcaagcgatcctaatcgagaaaattattagcctcacatggtaggctaccaagtacaaaggaggtgcttgctctgtgctgttaagaagtgctgtgatctcagtcgggcgtggtgactcacgcctgtaatcccaacactttggaaggccgaggcgggtgggtcagttgaggtcaggagttcgagaccagcctggccaacatggtgaaaccccatgtctactaaaaatacaaaaaaattagccgggcgtggtggcaggtgcctgtaatcccagctactcgggaggctgagataggagaatcgcttgaacctgggaggtggaggttgcagtgagctgagattgcaccattgcactccagcctgggggacaagagtgagacttcgtctcaaaaaaaaaaaaaagaaaggtaaggtgcccttttgggtgtcacttatctgaaggtaaatatgtgcttccatttagaaggaagagttagtattatctattaggagctaattttcttctcttactctctttgcatctgactacattgaatggaaatcttgcttttggtcagagctcttcactaacaaacacttcttttttttgagatggagttttgctcttgttgcccaggctgaagtgcaatggtgcgatctcagctcactgcaacctccgcctcccgggttccagcaattctcctgcctcagcctcccgagtagctgggattacaggcatgcgccaccatgcccagctaattttgtatttttcatagagacagacggggtttctccatgttgatcaggttggtctcgaactcctgacctcaggtgatctgcctgcctcggcctcccaaagtgttgggattacaggtgtgagccactgcgcccagctaacaaacacgtcttatgtgtcctaaaatgaatgtgatggtgatagccctgtgattttttttccggagcattttgtggaatggtgattttagctccttatggtcccctgtactctttttttctcaggagacagcaatatgttgggaaggtcaagtttgcctccttggaattttcccctggatccaagaagttggttgtagccacagagaagaatgtgattgcagcattaaattcccgaactggggagatctgtgagtgaactgagaactgtgtctactggctgcctcagggatgaaagacttaccattgccaactctgcctggctgattcctgaataaggaacatgttggccaaaagatgcctctcctagtggattctgatactttttttttttcagtcttaccatctttgaatatttgtatgttcctataactgacctttgcggtttgttctctcagcttgaatcctgagtgtccttaaataagatattgctgcaagcccaggcgggaggatcacttgagctcaggagttcgagaccagcctggggatcacagtgaggccccatgtctaaaattaaaaaaatcaggcatggtggcgtgtgcctagattcccagctacttgggagactgaggtgggaggattgcttgagcccagcaggttgaggctgcagtgagctgtgatcatgccagttcactccagcctgggcaatagagcaacaccttgtctcaaaaaaaaagatgctgctgcaaaaaacacattattctactttgcagtaaactctcagataccctcacttaattacctacactggccggatgtttttaggcactaaaataagggaaatagaatttatgatcactatttttcttgtgaattggatggattttattaatcttattgttgtttgtttatatgtttgatggggtggtagtggggcctggacagtagtggcccctcttaaccccttctaccctcattaccccgtgaatgggactggatcactgccagttagctatactccttcactccctcgagataaaattggacattgctgtgcaaatgaagagctcttcatttatttcttagtcttctgggttgccaccttttgttcatagtaatgtctaactttcatgtctctcagtgtggcgccatgttgacaagggcacggcagaaggggctgtggatgccatgctgctgcacggacagggtaagcagagtcctcccgtgtctccattgtgcggccagctccctgtcccattccttggctccttgatctgtacagggtctggtagggaaaggagactggggactcctgacagtgaaggacaggtacctgtttaacatgtatttgcatccagaaatcagaggtgaggccactgctcacagtgggaccctaggaagcgacagagcaagtgggaaatgacttcaccacgatcttttcttttccagatgtgatcactgtgtccaatggaggccgaatcatgcgttcctgggagactaacatcgggggcctgaactgggagataaccctggacagtggcaggtaggggagaaactggattttatcttgactgagttaaaggcttcaccggaacacagatctgcatagacagcaactctgggcttttggctttttcccagggaccactgaagagccagccattgacattgagtacccattgtggatatgcttgctcagccaacatgtattgagcgcctgttagatgcagagtttctaggtgcaatgtttgcgcttgtgcttgaatgctgttcctaatttcactgtgattcgtgagttttgcaatgttccagatataagaacataatataaaacttccactgtttagttttgtttaaagaacagcctgacctattgttaacatctttgctaaagttgtttatttttatttattgagttttttgagacatagtttcactctgtcacccaggctagagtgcagtggtgtgatcttggctcactgcaaccttcacctcccaggttcaagcagttctcgtgcctcagcctctccagtagctgggattataggcatgtgaaccacgcctggctaatttttgtattattagtagagacggggtttcaccatgttggccaggctggtctcgaactcctgaccccgtgatcctcccacctcagcctctcaaagtgttgggattacaggcatgagccaccgggcctggcccctaaagttgttcaaatgatagggtcatttgtattagcttatacattttctgatagtaattcatttggtaaacacgtgctgagccccaggcgatgagaacacatgggactgtgagacagttgctgtcattgaggattccgctgtccattgggaggcaggcaggtagcacagtaatgacagcactgtctcatggatatgtggcagagggtaggtccagttgctgtgaagtcccaggggaaggagggaacagcccttaggagatacagatggtttcagggaagcaagtagtgtggccaaatggttgcaagtgcagaatctcaagttgactaacaagaggcagagccagggttaggatccagctgtgtttgaccccaaagcctgttttcttacccactaagcaacagtgggtactgttctggactgtctctcccagcctgaggctctgcaggtgtgggctgctctcaacctgtacttgtgttcagtttccaggcacttgggctggttggcctgcaggagtctgtaaggtacatcgcagtcctgaagaagactacacttgccctccatcacctctccagtgggcacctcaagtgggtggaacatctcccagaaaggtaaggctgcctgctcacaggcaatagctgcctcgttctactctctaggagctcctctttctcctcgagggacccgaagcatttgctttaacccaggcctgtctcttgttggtgttccatggagtgtgttgcactcagaatatcttgaaggctgtgagtatgggtgaaactccggagtatgcctggagtttcctttgcactgaggagaacactctcaaactggggtgctagggcgagccatgctacgggagccactcactcgctcatggttatggtactttgtgccttctgacttctagttcaagttctagttctagttctagttctgactgagcctttcgttcatattaagagttagaacaactcaagaagacccagggtaggctgagtgaggtgtgaaatggtttctcgaggtcctgctggtagaaagcatcgaaattgggaaggaacaagagagaaggaacaagataaaaggatctacttagacaccctgtggccattttcaaagtttagagcaggactcaaaacttcaaattctggcctggcatggtgtctcacgcctgtaatccctgcactttgggagcctgaggtgggtagatcacttgagctcaggagttcaagaccagcctgggcaaccccatctctacaaaaagtacaaaaaattagccaggcatggtggtgcgtgcttgtgatcccagctacttgggaggctgaggtgggaggatcacctgagcctcgggaggtagaggctgcagtgagccgtgatcgcaccactgcactgcagcctgggtgacagagtgagacgctgtctaaaaaaaaacacaacaaagaaaatgctatgaggcgggttatgaaatatccatgagcaacactggctggatgggagctgcagtgctcctggcctgcctggagggggcagccttacccacctgattggtgctctgtatttaggcctagtgttgccacatcttctaaccgtaggaaaatttagaaatctgattgtgaagtataatatcttctaaatgttgacaactaattcaaattaagaacaacaacaacaaaagcccccaaactgtgtgagccaaacaaaacctatttgggaattactagtttgtgacatctggctgaggcctggcagcccctgaggataatcctgtcctgggttgaaagctgacgctgcggtttcttcttccctctcttagtgacagcatccactaccagatggtgtattcttacggctctggggtggtgtgggccctcggagttgttcccttcagccatgtgaacattgtcaagtttaatgtggaagatggagagattgttcagcaggtacaggagggtgacaggagcctgtgaataaggtggggttgggggagacttgatagatttctttgtactggggaacagggaacttggctgggcagatgcaaaagctacttatgctccctcattctggtcacttgccagctgccttcccattaggcctctatttaaagtactcatatttgcatgtgttatcttctggggtggctaaaaaattacatagatctagtctctgcctgtaagtatcttacagtgctgtgaaatcacagtaggacaccacatatggcaaatatagtaaagaagtgctgattctgaagtgccaggtatttaaaattatcggatatatttttccagtgaccagaaagaaaatcctgatattttttccaactttgaaggctctcaggaggttggagggtggggtttcaggggacaggaagaactcctatacaaccaaccatgaagaacctttgagcttaggacccccagtgggatgctggcagcaatattgctgttgggctgagagggaaatgtaaaaatctttcacgagcttcctgttaacgatgacttttctgtaggttagggtttcaactccgtggctgcagcacctgtctggagcctgtggtgtggtggatgaggctgtcctggtgtgtcctgacccgagctcacgttccctccaaactttggctctggagacggaatgggagttgagacagatcccactgcaggtgagaggctgccactgcttcttctggcctgaggcatttcctgcggggagtagaaagtttggcatgattcccctggagggtctttctcctagactcttcctgagcagtggaagccattcaggcctctggctgaactggtgtaagaggaaatcagtcactttcctctttggggaacttgaactggagcatttggagccacctgccatggcccagttacttcccccggcaaagtagggcagaggttgtgagcctgggatgggtcagggagtcgtcagctgttagccataatcctcctccttcttgccttccagtctctcgacttagaatttggaagtggattccaaccccgggtcctgcctacccagcccaacccagtggacgcttcccgggcccagttcttcctgcacttgtccccaagccactatgctctgctgcagtaccattatggaacgctgagtttgcttaaaaacttcccacaggtaactgcaggcaacatggtttgctaggattcaggagatctctccaagacatggatgctagaaggcagtgcttttgaatctggaaacgtttgctcttaggcccaagattgatgacaccttcccgtaagtggtttgagagggggtaggtagccttatcatagaaatggtgtatttcctcctgagtattacaaaggatctttagagcaaaactagtgccttccttagtccaaaggaaatatggggacataaatgagagcttccccatagatagtaagaacaagcagcatgggatttaagattgacctgtgcctgcgttggaggtagggagagttctgttttcagctgtagatgcaactgaggcctccctctgctcttaaatgcctgaccattctgctccaaagtggggagcactttcaactctaaggccaagggccttccctggagaggtgaccctctgtaaggcagctggctagtactggtcccatttaggagctgatgccttgcttttcccccagactgccctagtgagctttgccaccactggggagaagacggtggctgcagtcatggcctgtcggaatgaagtggtgagtattgagaacaacagtcagcacttgggattttccttcctggtctccactaggaaccctgaaaatcagaagtctgggcacattgacctggtcagtttgaacccagcgggcaggaggctgttgagaagtgaggtcttgcctcaactatagagctttctgcacaccccatttctccccaggaacgagaccctaatgtgatgaccttactttcatatggggctattaagggttgaataggctttgtgggcaggggtgagaaatgagctttgtcttctctcaagtgctaagaagacaaaaacaaaagcttcatttcagtgactgggaagtgaccctttggctgaattttctcctgtccttctctttctcatagcagaaaagtagcagttctgaagatgggtcaatggggagcttttcggagaagtctagttcaaaggtatggtgtggcactgggcagtatgccagacctagagacgcaggaggccaccaaagagagttgggggaagagctttggttaggagcaggtcctagagttcccagcttcaaatgaggtttcctaagtactgtaaattaaatgatgtttctcttaatctcattttaccgggagattaggaggtagaatccctagagtctgtttctagccactttctcctctgggcctcagcgtccccatttcttttgggatcctggctggcacagttgagtagtactctgtgcagttaccctgtagcagaggcatgagcccctggctggaggcataggttcctgctgtggcttccatctaagcgtttccctgcctcctgtcttgctcagtcttaccttgctcagccctacctctctctcagaagtctctgctactctgtactggcttccaagacaagtatggtagttgtaatttcatttatttactcaggcaccttatttctgccttaggatttagcttgcttttctcttttattctcctttgcatatatttccccttctggcctggctccttctctagggtatttgcccccaatccttggacttcctttggtgggctttgctttcgggggatacctgtagttgacacgtgctgtctgtactcctaggactctctggcttgcttcaatcagacctacaccattaacctatacctcgtggagacaggtcggcggctgctggacaccacgataacatttagcctggaacagagcggcactcggcctgagcgggtaaggcagagcctttctttgcagactgtcctgtgggcttctcagcacatggcttcctttcctcagggccaggtcttagccatggggcttggattaggctctctaaacatgtgttctagtgctctctgagccactgacttgttagaagtcacagtaaaggcgggtattatttatgccagctcatcattgtgcaccagggactgttctaagcttttaacttacacattaattgatttaaccctccaaacactctcatgaagcggttgttcctgacctggttttaaaatgattctgtggcctggtgggatcgagtaccatagccagagtcacggagccagtaagaggtgtcactgcggttcagattcaggtctaaccccacagcctggactcctcatcactacccagtattgcctctgtgtgcatctggttgtgttcctcagctgcttgggctgtggcttcttcgtttctaaagcggaaagtctaatcccggcctcctgctcactttgtggggtgtgattagagcatggatgaatggcgtggtacccgtggagtactcaggttcttccatggaaaggtctgggagaccccagcatcattatgttggctcctaagaatatgtatcacttactggcatccagataatagctacattgtttagacatcaaataatgccatggcctgtacctctgttaagtccaggctttgactcctggggtctggtgctctcagaggcatttggatcctcactgactacaccggtcttgactgtggcttatagctgtatatccaggtgttcttgaagaaggatgactcagtgggctaccgggctttggtgcagacagaggatcatctgctacttttcctgcagcagttgggtaagtagacctcattcaacccatttttttatttccccaggccttccaatgtgttccaatcagactgttttttgggaggctgcaggtttctggaagagattcaagtggagtgtgccctgagtgtttcgttcatagccaaatgtcacctgcttttttttttttttttttttttttgagatagagtcttgctctcttgcccaggctggagtgcagtggcatgatctcggcccactgcaatctccacctttcggattcaagcgattctcctgcctcagcctcctgagtagctgggattacaggcgtgtgccaccacgaccagctaatttttgtattttcagtagagacagggtttccccatgttggccaggctggtctcgaattcctgacctcaagtgatccgcctgcctcggcctcccaaagtgctgggattacaggtgtgagccaccgtgcctggcctgtcacctgcttttttttttttttttgagacggagttttgctcttgttgctcagactgctggagtacagtggcatgatctcagctcactgcaacctctgcctcccaggtttaagtgattctcctgcctcagcctcccaagtagctgggattacaggcatgcaccaccacgcctggctaattttgtatttttagtagagatggggtttcaccatgtttgtcaggctggtctcaaactcctgacctcaggtgatccacctgcctcggcctcccaaagtgctgggattacaggtgtgagccaccgtgcctggctctttttttcttttttgagacagagttttgctcttgttgcccaggctggagtggaatggtgtaatctcagctctttgcaacttctgcctcctggttcaagcgattctcctgcctcagcctcctgagtagctgggattataggcgctaattttgtatttttagtaagagacagggtttcaccatgttggcccaggctggtctcaagctcctaacctcaggtgatctgcccgccttggcctcccaaagtgctgggattacaggcatgagccactatgcccggccccgttacctgcttttgaagaataacttggcattctcggtgggatacagaactttcctcctttgacctattgattccagccccttgctctgccatttctccttttatgcaagagcttgtagtaatccctgagtcagcgagaagagtctctctagaaaatctgggagacaggcttagcttttgtttatttatttatttattttttgagacaaggtctcactgttgcccagtctggagtacagtggcgtgatcatagctcactgcagcctcaatctcccgggctcaagtgatcttcctatctcagcctcctaagtagctgtgactacaggcgctcgccaccatgcttggctaattttttgatatttatttatttttattttattttattttatttcaagacggagtctcgctgtgtcgcccaggctggagtgcaatggcacaatctcggctcactgcaacctccacctcccgggttcacgccattctcctgcctcagcctcccgagtagctggaactacaggcgcccaccatcatgcctggctaattttttgtatttttagtagagaggggtttcaccatgttagccaggatggtctcgatctcctgacctcgtgatctgcccgccttggcctcccaaagtgctgggattacaggcgtgagccactgtgcccagccctgatatttattttttgttgagataaggttttgccctgttgtccaggctggtctcaaattcctgggctcaagagattcacccaccttggcctcccaaagtgctgggattacaggcatgagccactgtgcccagccccaggcttagctttgtaaaaatgtttcctgtagcagggaaggtggtgctgtggagccgtgaggagtccctggcagaagtggtgtgcctagagatggtggacctccccctgactggggcacaggccgagctggaaggagaatttggcaaaaaggcaggtatgaacctaagaggttggagctgcagagttgctggaggggccagtctggaaatgaccacaagagacactgtatcatgcatctctggcttcctaggctgggcagattgctagtcttttctgaatgagctctgtgatgaggttccggtgcattcatggccatatggtttatgaaaccattcttttctgtgaaagaatgaactgtgaatccttctagggaaagctagggaaaaatccctctagggaaagctgagggaaaaaagtctttttttttttctttttttgagacaagagtctcgctctgtcacccaggctggagtgcagtggcgcgatcttggctcactgcaacctctgcctcccaggttcaagcagctctcctgcctcagcctcctgagtagctgggattacaggcatgcgccaccatgcccggttaatttttgtatttttagtagcaacagggtttcagcatgttggtcaggctggtctcaaactcctgacctcatgatctgccagctttggcctcccaaagtgttggggattacaggcgtgagctgctgcgcctggggggaataaagtcttaacttggtattgtaatagctaccattgcctgtgtactaaaaatttgccaggcaccttatactcattgtccctaaagcagcagccatatctgtctggagacaccattgggttgatctgggtattgtggaaacagcccagtgccctctaaagctggccatggtcccaactgccaggatgaacttgattcactctgctctgattcagtcctgccccccaccctctctcttctctccattcatccagccctccaacggatagctgttgagggcctgctctggaccaggcactctgctaggcaatgcacattttcttaagctgaggattaatttgactttactgtttatttctgctgcctggatccagcaattcaaggtaaaacctgcttcttgctgccttgttgctcgttgcctgctcacatggctagcttttggttaattgtttttcttcctaacttggaccaatgaggtacatccttggggtgtgtgtgtgtgtgtgttgactgccatgcttgtgagttgtcctgttgcttctcacttctcttccttgagcagaggtgggtggaaaataagataagcagaggttctgctccttttttagtgagttattaccatgtaccagccaccacgctaaatcctttatgtacatcgtatgatgtaattttggaacagtccagtgggttacatgccactttacagatgaggaaccagaagcaaaaaggtgaagtacatttctcagtgttaccccgcagtgagtggtgaagctgggatcttaatctgggcctgctagattccagagaccatgctctttaccttgcttccttgcatctgtttacaaatctgtggtctccaatggaggagatttggagggcagtggcttcattgacggaatcagggaaagagtgaatgatggtcctgggaactcgttgcaagtacgtctgttgggtgcaggttaaacagctgacaaagtaggaatgaagcaatgggagatggaagtacctgctcatgatacatattcactgacctgcaccctccacccccacactcatacctcttctggctttgtcatggcacccagaaaccttcttttagcatcttggatgtggggctgtggtggagacattcacagcatggctgtctcctgcatgcctgatccctgacctcttagtctcctattccaagattccagctgggtttagttgttaagagccagttaagcagtttttggaagctcctgcatgagcctcacctgagtgtgagactttgggcatcagatacaggactgccctttgggcttgtggcctagagtgtggactttattgctccagaggagaggcagagatccctcattaggaaaatcatgtacctccttatggacccctagtctgatgtagagtatgttacttttcctttacaccagatggcttgctggggatgttcctgaaacgcctctcgtctcagcttatcctgctgcaagcatggacttcccacctctggaaaatgttttatgatgctcggaagccccggagtcagattaagaatgagatcaacattgacaccctggccagagatgaattcaacctccagaagatgatggtgatggtaacagcctcaggcaaggtgagtggggtttaagctccagttactgaaccttttcaaattctgagggtgaggaacaaaaagccttcagtgagggataacactggttctagttttcaaggacagactcagttctttggtttctctttctagtagtgagccaagtatttgtttatcttgcagctttttggcattgagagcagctctggcaccatcctgtggaaacagtatctacccaatgtcaagccagactcctcctttaaactgatggtccagagaactactgctcatttcccccatcccccacagtgcaccctgctggtgaaggacaaggtgaggcatccagctctgacttgagccagactcagtgtggcttttttgctattttgtaacttaaattgctcctaggcccttggaattgtgtgagttaatgaggaacattcaggggttagaactctgtttcttctagtttcatgcatgggtggaggaaccatccagcactgatgtggaattgtttagaaagtgggtgtgacttcaccagctatgtagggagccagctctcctcttttctaaacattggctgttggttgctgagtggctattttctcttctctctttgaggaagagcaggacacaaagatatttttgtgtcttcccagaattagaatggatttttgtgtattcattctagcatagaaggcgggcttggtagacactttcctggaacggctgcctggtgcgatctcggctcactgcagcctccacctcccaggttcaagcaattcttgtgcctcagcctcccgagtagctgggattacaggcacacgccatcatgcccggctgatttttgtatgtttagtagagacagggtctcaccatgttggccaggctggtctcaaactcctgaccttagatgatccacctgcctcggcctcccaaagtactgggattacaggtgtgagccaccacgcccggccaggttgctgaattgttacttgacttttttattagttcttgtttagaactggcagagcagccaggcgcggtggctcacgcttataatctcagcactttgggaggccaaggagggcggattgcttgagtccaggagttcgagaccagcctgggcaacatggtgaaacccctctctacaaaaaataaaaacagaattagccacgtgtggtggtttgtgcctgtagtcccagctacttgggaggttgaggtgggaggatcacttgaacctgggaggcagaggttgcagtgagccttgatcatgccactgtacttccagcttgggtgatagagagagaccctgtctcaaacgaaaaagaactggcagagacagtttgacttttttctttgtgacgttagcctaggggactattcacctacagccaagaacttattttccacaaagagggcaaagactagagaacccccacagttgttgagctggagtcccagctcttcaggtctatccctaggatttgcagtcttttcttgttggtggagcctgacagtttgctcattttaggagtcgggaatgagttctctgtatgtcttcaatcccatttttgggaagtggagtcaggtagctcccccagtgctgaagcgccccatcttgcagtccttgcttctcccagtcatggatcaagactacgccaaggtgttgctgttgatagatgatgaatacaaggtactgtcttcagaggggatggagaacatgctagcggagtccggtttggggccaggtggtcaaacacagcggcccggagatggagtgctctctgcacccagcacgtgtttgggctctaaggccatcccgaagagaaatgatggctgtgtctgcatttgtgaaaactcaggttcttaacagaactgaatgtaaaccctaaactgagttcaaatcaactgatttgcagttttattcttaaggctctctttgatggggaaatttcctaactctttccttgggctctctgggtttttcaaggtcacagcttttccagccactcggaatgtcttgcgacagctacatgagcttgccccttccatcttcttctatttggtggatgcagagcagggacggctgtgtggatatcggcttcgaaaggtaggaaggcatgtcctggcacaaccctttgtggatgagatgcaggtgtttcctggccatttggctaagaagtgaattatgctactcattctactgtaaacttagattagcataatcctgatgtctgatacaaagtcaatcatttgttcatatttgttgggcagctactacatggcagatacggttctaggtgctgtggatggagtggtgcacagtagaacaaatctctgcccttgtggagctttcattccacattctttttctttttttttttgagatggagtcttgcactgtcgcccgggctggagtgcagtggtgcgatctcggctcactgcaacctctgcctccttggttcaagcgattctcctgcctcagacacccaagtagctgggattacaggcgtgcgccaccgcgcccggctaattttttgtatttttagtagagacagggctttgctgtgttggccaggatggtctcaaactcctgaccttgtgatccacctgcctcagcctcccaaagtgctgggattacaggcgtgagccaccgcgcctggccccattatttttctatagcagagagatgggactttttttccattcttgggagggtagaaggtaggaatgtgggttgagtaataagttgtacttttatatgaagatgatgttgaccaactcgtgatggaatgtgtgctttgaattttatttctagaaagggggtcagtttgctttaatcctcacatacttgagaccaactcttgtaaacagtaatacacgctggctgtgaagtccagctctgaagttcacgaggggctggcatggccttgttagcaggactgtttggagaagtactctgtggtgtgtactcacaaacagctctcccatcctgtcctgtaaggccttttgagaggcatagagtttaaccaatttgctagattggaagtctaggtttgtcacttactaactttgtgaccttgggctctggtcttctgttttcttatctgtaaaataaggtgataagtacctgtctcataaggttgttgtgagaattcaacacataaatcacataaaactgcctggcacatggtaaatgccatctgagttggaggtgctgttgttttgaaaatgcagcgcccttttgtgacatttgtaacagctaaccttagcataaacagcactggaaatggtctgcccagaagacacatcctttacccttgtgaatgaaaacataaataaataaaatcatccttctgagttaataaaaagaggaccttgaaagagacagttttgtagattcaggggagtgaactggagtgtgggtgtcatgaatctggagtcctgaggacatcatctgagtgaacaatgaccaaggaagacaaaggaggcagagctgtctgtgggaagtgagccagctgtgtgcgcgagtccgggaccacaagggagtgtgctgcctttgccctcacttggtgaccttcctctctggggatgttttagtgagttcttatgttttcaaagaaggttgtggcaatgaaggcttattattaataattttcactattttaaaaatttaggtaatacattgagtatattctcattgtaaaagagtccattgatacagagaggtgaacaagcaaaatgtgaacagacccttgtagccccattcccagcggtcttcccctccccaggtggaaagcctgtcagcagtttgctgtgcctctttctactgtccttgtgtatttatgattccctatcaacagctgtgtggacacacgtgtgtggctcatactttatttatttttttttagagacagagtctcgctctgtcacccaggctggagtgcaggggcgcagtctcagctcactgcaacctctgcctcctggtttcaagcgattctcctgcctcagcttcccaagactacatgtgcacgccaccatgcctggctaatttttgtattttcagtagagacggggtttcaccatgttgaccaggctggtctcaaactcctgacctcaagtgatcctcccgcctcgggctccgaaagtgctgggattacaggtgtgagccaccacgcccggcccattttatttttttttctcattcacatgcaattgacctatatttattcttatgaaatttgctttttttcatttaatgggttttctacctcattgttttgtcaacttcagttttttattacagaaaaatattgacaaaagtgcaaaatcatgaggtatggctcagtgaaccctcaccaagggaatacacttgtgtacctggtgaccacttcaggaaacagaatagcaccagctcctagaaggcccttgtgccctttgccagtaactacctcctgtctccacccccaagggctccgcataattccataggatggatgtataataatgtatttaaccatgagtgtttattggttggtttcctatgaccataaacaatcatacacgaaatgttttgagctccctgttagcttagacattcactgctggccccagtatacagggatcttggagtttagtaataaatggtaaattttccttgcatatttcctactcagataaacaacgggatactattgagcgttcgcctcctttcctactggctttattatctttttttttttttttttgagccggagtttcgctcttgttgcccaggctggagtgcaatggtgcagtctcggctcactgcaacctccacctcctgggttcaagtgattctcttgcctcagcctcctgagtacctgggattaaaagcatgcgccaccacacccggctaattttgcatttttagtagagatgtggtttctctatgttggtcaggctggtctcaaactcccgacctcaggtgatccacctgcctcggcctcccgaagtgctgggattacaggtgtgagccaccacgcccggtctagtatctatcttaatcaaaccgagagttctgaaatttcttcataaactagatctctattgctgtttttctggtttattttttgttttgagtcttgctctgtcactcaggctggagtgcagtggcgtgatctcagctcactgcagcctctgcctcagcctcccgagtggctaggattataggtgcctgccaccacatctggctaattttttgtatgtttagtagagatggggtttggccatgttggccaggttggtcttgaactcctgacctcaagtgatccgcccgccttggcctcccaaagtgctgggattacaagaatgagccactgctcctggctcatttttctagttctgatctctattccttcctgcacaaaggcctcaaataatgaactgtaggatgtgtctaactccagctgtttcagttctaagtgtaccctcctgattacaggcttttttgcccctgccctaggatctcaccactgagctgagttgggagctgaccattcccccagaagtacagcggatcgtcaaggtgaaggggaaacgcagcagtgagcacgttcattcccagggccgtgtgatgggggaccgcagtgtgctctacaaggtacatacagccagctgtctggtctacagcaagggctttcgaatcaggaaaacaagggcttcaagtctggctgtaggacttggtacatatatgaccttgagtaagtcatttaatccctttgagccttaatttttgtttgtgaaatggggataatataccctcctcctgggcttgttgtgatgatcacatgggatgttcatgtctagcccagtgcctagcatatggtaagtaagcaacagatgttagctcttatttttttgactttttttttgtttgtttgtttcctgtgacagagtcttgctctgttgcccaggctggagtgcagtgatgcagtcatggctcactgcagcttcgtcctcctgggcttatgcaatcctttcacctcagtctcccaagtaattggaaccacaggcacatgtcatgctaattttttaaaaacggctgggcttggtggctcatgccagtaatcccagcattttgagaggtcgaggtgggtggattacttgagtccaggagtttgaggccagcttgggcaacatggctgaaaccttgtctttaccacccccaaaaaaaaaaaacaaaaaaaacaattagctgggcatggtggtgcatgcctgtggtctcagctactcgggaggctgaggtaggaggatcacctgagcctggggaggttgaggctacagtgagctgcaattgtgccgctgcactccagcctgggtgacagagtgagaccctgtctccaaacaaacaaaaaaaattttttttaaattttttatttttgtagaagatagagatcaacctaggaaacatagtaaaaccctgtcttcaaaaaaaaatttttttttaattttttatttttatattgacagggtctcactatgttgcctaggttggtctctatctcctggcctcaagcagttctcttaccttagcctcccaaagtgttgaggttagagacttgagccactgcgcctagcccagctcttattactagtggtagtactgatagagcattctggggttaaaccatagtcgagccatcagaaactccatctctgtgatccaacactctagttagtgttaaagagagggagattaaggtgactagtgggctgcaaaactgttatgggagagaatgtaatgatagtagtaatgcacattaattacaccctctggtacagcagagactgaattggagggggtgtcatagaatagagatcacggaacttgacggtaaagctggatcactaagcatgagccagtgcaacacagtgcaagcctctagtttgactgttaagacttggctctgccgtggcctagctgttcatctcttaggctgcctgagcttcaattttccccagtataatggggataatagcaccaacgtcagaggattgttttgaagattaatgataacatgtaaagtgattagaatagtgcctgccacatacttaacattattattagtgctattgactctttttttttttttttgagacagggtcttgccatgttgcccaggctggagtgcagtggtgtgatcacagctcactgcagctttgacctcccgggcttaagcagtcctcccatctcagcctcctaagcagctgggacaacaggtgcatgtcaccatggcttattttcttttctttcttttctttttttttgagatggagtcttgctctttcaccaggctggagtgcagtggcacgatcttggctcactgcaacctccacgtcccaggttcaagagattctcctgcctcagcctcccgagtagctgggactacaagcgcgcaccaccatgcccagctaaattttgtatttttagagatggggtttcaccatgttggccaggatggtcttgatctcttgatctcgtgatctgcccgccttggcctccctaagtgctgggattacaggcgggagccaccgtgcccaggcacttattttattttctttagagatggggtcttgctgtgttgttcagattggtcttaaactcctgggctcaagcaatcctcccatcttggcctcccaaagtgttaggattacaggcatgagccaccgcacccggccagcagcaagcagtttttgagtgctagctggatgcaggcactcatttagacactgggatataaaatgggcaaaacagacaaaacttcctgacctcgtgaggctttcatcatagttgggtgaggctaataataaagaaaataaataggtaaattagatagtatattagaaagtgaccagttctatagagaaaaataaagccgggaagagggaaagcaggtacagtgtaagtcgggtggctaaggaggggcttagtgagaaagtggcacggagtgagtggacttgagtgaggaagtgagttgtgtgggtagctgcggggagagccttccagagagaaaagtcaaagtgctcctggtatgtgtgagaaacagcaaagaagaccaggtaactagaagatgatgagtgaggaggcatgtcaggcctgctgagggcagagggcaacagggccagatcacaggccaccaccgtggccttcactttggagcacggtgaagagccactgggaagttttcagcagaggagtgacatcagtgactgagattccacaggctcatttgacctagattagactgtagaggggtgaggaggaaagcagaccatttaggctgtggggtcatccaggtgctgatggtggctggagctgggctggtagcatggaggtgggaaggagggatcaggttctgggtacttttgaaggtagagccaagagcaggtatatgtgtgttacagagaaaggagtcaaggataactcgaggctttaggtctgagccactgatgtatggagtcgtgactggctggggaggagagaggagcagattttaggcaggagttagaacagttcagcttgggccatgttaagtttcagatgaaacatctgagaaaagatactgagataatttcttagtgaagtctggagttcaaaggagtatctggtttggatatatacattgggcattgccaacatccataaatggtgttcaagccatgagattggcttgagatcaccacgagggtaagtgtgacggaaatgctcaaggcttgagagctttctgatgtgttccaccatgaagaaactggggagatgtggaagaacctccaaaagagactgagaaggagaggccagtaaagtagaaggagtgctgggcagggatgttctggaagccaggtgagaaaatgtcgcaaggaggtagtgatcacctgcgtcacgtggtactagtgggtcaagtaagttgagggccaagacttagccactggatttagcgatggggaggggggtggtgaccctcagaagaaaaatatcactgcagcatttgtccctaggtcaatgagtgggcagacctggattttgtcttgggttaccatttgctatctgtgacttgaaaagctgcttaactactttgggacttttctgcaaaatgtggaccataatagctactctgcaagactgtttaagggattagataaaatacaaggtacctggcatggcacccagtacccaatgcacataaaacaagtgcagtgatgagaaattccaaacaggaagctcttttcaccagaaaccctgattcctctgccaggctggagagctccaggttggtctcacagcacaggaatggagtgtgtgatgagtcgtcgtggttctaagggaggttttctctctctctccagagcctgaaccccaacctgctggccgtggtgacagagagcacagacgcgcaccatgagcgcacctttattggcatcttcctcattgatggcgtcactgggcgtatcattcactcctctgtgcagaagaaagccaaaggccctgtccatatcgtgcattcagagaactgggtggtggtaagcggtcactaccagggacccaaggtagctccagaggtctccctgcctcctgagtcctttccagaaacccagttgctgctttggttttcttaggatctcaaattccctggatggcagcaaagcgtgccggttagggcactgggctcaggaatcagattgcctaggtttaatcttacctcttccgtttcctgactgtataaccttgaactagttatgtacacgctctgtgttgcatcattgttaaaatagggataataacagtcaccttcagtctagcaaagaacaatgcctggcacctagtaatgattcaaaggttagctactattatggcttctaagactcttgagaatttcctttgttttgtggtgaactttcgatagcctagataaaactactttgaaagttagtaaacttgatagtaaggaagaaaagtgaggtgctagttgatggttctccttcatggatctgtagctaattagaggggtgccttccagtgcaatttccctttccagttgaagcagctgctaagccctgagctgccacctcctatccctgcagtaccagtactggaacaccaaggctcggcgcaacgagtttaccgtactggagctctatgagggcactgagcaatacaacgccaccgccttcagctccctggaccgcccccagctgccccaggtcctccagcagtcctatatcttcccgtcctccatcagtgccatggaggccaccatcaccgaacggggcatcaccagccgacacctgctgagtgagtgactggggagcctctgggatggctgggttcccttgggcaaccacacttaaggacagagcaagggacacattgctggcagagccttgttgaaccacctgtaagggaaaggtggtgaggagggctatatatcggtggaaaaagtttcttagttcatctttgccacctatgaaggtgaccacttctctctcagttctcatcttttttttgtttttcgagacagggtctcactctgtcatccaggctggagtgcagtggtgtgatcatgactcactgcagcctcaacctcctgagctcacctggctaattaaaaaaattttttttggtagagacagggatttgccatgttgcccaggctgatctagactcctgggctcatgtgatcctcctgccttggcctcctgaagtgttgggattacaggtgtgagccatcgtgcctggctgcctggccttcagtcctcatttctgatataccacctctctatttggcattttcacctagctcaaaaagtcagttcctgatagcattgttaacatagctagcctgtgctgacagcttgcagaaactggcagggtctattgcccaggctggagtgcagtggcacgatcttggctcactgcaacctccgcctcctgggttcaagtgatcctcctcctcagcctcccaagtagttaacaggcgtgcaccaccacgcccggctaatttttgtatttttagtagagatggggtttcgccatgttggccaggctggtcttgaactcctgacctcaagtgatccgcctgccttggcctcccaaagtgttgggattatatgtgtgagccactgcgccagccctaaaatctcatccttatgtaacctaagcccaggacttaggacttagtggttaacaggttcctgtgtttagttgattttaccgaagatgtttgggactctcagatctgatgggcacttggcattgctgttgcttttttttttttttttttgagacagagtcttgctctgtcacccaggctggagtgcagtggtgcgatctcagctcactgcaacttcagcctccctggttcaagtgattctcctgcctcagtctgctgagtagctgggactacaggtgcgtgccactgtgcccagctcatttttaaatttttggtagagacggagtttcaccatgttggccaggatggtctcaatctcctgaccttgtgatccacacctgcctcggcctcccaaagtgctgggattacaggtgtgagccgccgcgactggcctattgaattcttaaatatgaagaagccagccctgttggcagtttatcagctttaatcaccattactgaaactggtgctatgattgatcatgcctggtcctccagtcttccctggccactgtaccgcagctgcatgaacagctgcgtttgctcaatgggaaggagacttcctgctgggggaggtatgggagggaggccccggggagaggcatgaggaaatccaagtggccttctacatttttctctttcatcattatccatatcttgattctagaactttattttctggtgtctcagaaagttaagaaaccagtgtcttcaaaagtgagaaccttcattcagacccatgcgtatcattggattattatttttggctatgtaagggagcctcattgacccatttttttgttttaaattcttatttaaatgtctgcaataatgacatttttgtaactggcccttgctggacactggatcggtgtgaacattcacttcctcctgtgtagttggactaccttctggagcaattctttcccttcctaaggctttgctggatccccgccgccccgagatcccaacagaacaaagcaggtgagaccctcatgggcagtgctgaaggctctgaccttacataacttaacctcactgattaagcttggttcttggtctctgtgtgccttcatgctgtgctaggggctggggatgtagcagggggcaagtctgaaaaagtcacctgccctcatggagcttacagtctgctgggaaatggacaataaatacataagataaacaagtaaaatatatactatgttaggtactcaaatgctaagcagagtaaaacaggaatgagctaggaagtggggatggggatgtgcgtgggtgtaatttgagaggtggcctgggaaagcccctttgagaaggtgcattttgagtgaaggcctgaaggaggtgaaggagctagctgtgtagatacctgaggaagaactttctaggcagagggaacaggcaatgcaaatcccctgagatcatgtctggtgagtttgcggagggcaacgctaggaaatgagatcactgaggtaattcgggccagaccatgtgggcaagccaatatcttattcactgttggtattgttgtattaacaaccaccatcttgtcgggttttcttacctccatcctgaatttctttgcctaggggcatgaggaatggagaggagtgtgttttggagaagtatatgagagagaggaggttaaagctaggaaaagacacaggatgataatcaggtttcagagaaatggggactgagaggcaccctggagtggagagcaggaattagcttagtggttcagtgtgttggctttaaaatggtcggctttcctcttgtggtgtgaagtgccagtcatctgtatgttctttcttttcagatttagaacaaagtaggaatctagatctcagtcttactctccagagagcttcctttcttgtagtccttcctaacattcagctgctaaatttttaactacctaatgcaagcagacctcctaggagatttgaggctagatatgtagcctggaaacctcccaggactcaggaagggcagccaagagatccctttacagcagtgctcagactgcctgtcccggctggtgttttgcagagaggagaacttaatcccgtattctccagatgtacagatacacgcagagcgattcatcaactataaccagacagtttctcgaatgcgaggtatctacacagctccctcgggtctggagtccacttgtttggtgagtagagcccacagctgccctatttcacccttggtggatcattggttgtttctttcctaattcttattccatctgccttccaggttgtggcctatggtttggacatttaccaaactcgagtctacccatccaagcagtttgacgttctgaaggatgactatgactacgtgttaatcagcagcgtcctctttggcctggtttttgccaccatgatcactaagagactggcacaggtgaagctcctgaatcgggcctggcgataaagaacaaagactgtgcctaaaagtggagagccaggggagtgtgggtcagataagcagctacagctgcagtttggtggattggtggagtatgtgtgtgtgtcagtgctcagctaagaactgtagggaagatggatgaccttcacgcagaactccttttgggatatacatgatgcagaaaggatcctacatggagagagacagaactctctcagctgacactctcagagattcctgatgggctttctcttgaagtccaaaggcgtctgcattgtttcctttctttgcccatccatgaatgttctgttttgttttttttaataagaattccggctgatttttgtgaggcctgtttaaattgactttactttgccttttgtgtttctcaattttatctagaaatctttctgactttttccatctcttgcttcaaagtaagaggggaactctccttgccgactccaccttataggtacatttggtgttttgcactgggaagaaataggatccatccttagctgaggcttgaggactgatccagcctctcatggcttccctccaaagtaacttagggttgagggatctatatgtgatgtcaaaacttactttaaacctctagtttcgtgctgtcatttattaggctgggccaccaaatctttgtttcaatttatcagaagccaagtgcatactagcgtcttgtttgttgcccattgcctatacttttcacctgagatgtgtgagttggggccttttaaaaactactgaattgtctgagccttgaagacatttccagggagaagagataatctctcatttcacccacaggctggtctaatcataacctagttaaagatgtccttgtttaagaaccccattatttatttttagtttttaatataaattaacatgtgggtcattatatttctccttaaatgaggaaattttaaattttattgatctaacctttgaagctttaaaaaaggagaaagagggtaggggtgggaaactggcatactgtgtgtatagcactgccgattggctaggccactgtgtctctgctacaaattaaagaaatcctaaaagttttccttggtcatagagttggggaatgacagaatttttctttgttgtgaaatgtatgtacagagtagaccatctctagccctgtggtgaaagaggtacactcgaatgtttgcataaagcaagtgacaaatg

SEQ ID NO: 37697 - DNA, 9834 bp, Homo sapiens
cccggggcctctgtccttgggtcccagttatgcaacagtcagtcgaggctgtggggctggcccaggggctttatctgtctccctctccaacttttgccaagttacccttctgggcttccgccagccaggagcccacactccctcagccctcccacacgctcctctcacctcctagctgggcttcgctgacttgaacctggccgagtttgcgggctcgggctccacggtgcgctgctgcctgctcgagggatatgacacgaagaacactcgccaggacaactccatccttaaggtaccagggatcctgccacctctgccaccctgaccacgggatggggacaaaccaggctgctcatcagaatcctctggaggagggttgttaaaaatacaggccttacctgaataggtagacatcgggaaggggcgagccctggaatcaggaaaccactatcagagggaggcctggctccgctgttggcctcagtttccccatcaagttcagagagggggccctgacagtctccagggtttggcaagcacctgcagtgggttcacgtcatgctgattgcatgccctctcttctcttgtggtcccctgacagcagccccacgagctgtggtatctttgattagtcccagcttcaaatgggagggagttaaggcacagacgttaagtcatttgcctgaagtcacagacagagctggcacctgaccaccagccagttgacttcttggcccagctcctaactcttccccaagtgacacgtggtagcctggcccccagtggattatcagtgaaaatgatggctgctgagggccccgggggcaggtttccagtggacagggcagccccacccccaggcagctgcctcgttggccttttgggaacagaaatgtctgggtgtccgtcaccagcacacctctcttcctctgtttccacacctttcacctggccgggaaaacaggctgtcctaacagcgcctctgcaaggggacccagggagagcctatggtatctggagcagagctgggcaggaggtggtgagcaggggctctggggcctcctagaccctttgcagagggaaccggagatgccagaaagggtccaggctgattgtcttgggagctggagcctttcagcctcagtcaggctgaaaagcacaggcacagtagccctgtgcacctcaggccagatcaagggagcctgggggccaggtagccttgggttcaagggaagctcccccacatcctgtctgcaaggtcttgggagtcacttcccctctctgagtcttggttccctcatcaacagccttgggctagctaggatgctttcatggccgagtgaataagccatagaaagcctcaacctagtggtcaccctttctttttttttttttttttttttgagacagagtctcgctgtcacccaggctggagtgcagtggcacaatctcagctcactgcaagctccacctcccaggttcatgccattctcttgcctcagcctcccgagtagctgggactacaggtgcccgccaccacgcccggctaatttttgtatttttagtagagatggggtttcaccgtgttagccaggatggtctcgagcccctgacctcgtgatctgcccgccttggcctcccaaagtgctgggattacaggcgtgagccacggcacccggccgaaagcctcaacggagtggtcaccctttcataagtggtgacgtcaggatctgtgctcctcttttccacttgctcatctctgcctgtcactccatctcagcctagattttagggcccaaatcttgccacatttgggctgttgttagtttgcaatggcttcatgctttttcatcagactttcaccaaaccctgcccaccacctgctgtgccaggccccatgagccctcttccctctcctgcctgctgggttgagctctgtggtccttacacagggccggggtgagtgtgtggcttcaccatggagaagctcattgtctaggcctgtagctgatggcagtccgctcactctgccaggcgcagggctgagcccaggcctcaccttgctatgccctcccctctggtctgccaggcaggccttggttccatctctgtcctccacacagggaaactgggctcagagaggttagtggctttgccagagcccccaagccaggagggggcagagagacaggattggaatccaagcccttctgaggccagagccgaaaggctgcagggggccctgcgcctgggcaggctgtgggtggtcagggcatagctgattgctcccctcgccacaggtcaccattggtatgttcctgctctctggagatccctgcttcaagacgtgagtgctggcacaggcctagggagcggatgggagcccagtcccgggcactaggggtggaggaacagggactctgggtgtcctctgttttcatctggtcctgaagcagggcaccctagtcacacctgtctgtcttcccaaggccaccatcgactgccaagtccatctccatcccaggccaggattcctccctgcagctgacgtgtaagggtggtgggaccagcagtgggggcagcagcaccaactccctgactgggtcccggccccccaaggctcggcccactattctcagctcaggtacagttcctcatctgtccgcccctcccctgctagcggcccgaggggtttacctccatgtcatgcccaggtccccagggagacgctgactgaggggagagtgatggtgggagggtgtttgcatgctcctgctgggctgatgagacctgatcaccttgtgcgtgctggctgtggtgctgggccctgagatcacagctgtgccttggactgagactgatgtggcctccccatcctcaaggccctgcagtctagcagaagaaacaggcctcaatcaagccatagataaatgcatgtctacctgcaaacaggataaaagctggggaagacaggcccagaaggtgggatccatctggggccagggaaggcttccctgaggatgtagtatctgagctgcattcagggggtgaggcacagtatacctggcagagggacgtgctgggagctcttgctctcccacatactctatgactttgactggccagtttgcgtctctctgtctcagtgttctttggaaaatgggattggtaatagcaattacatcccaggtcactttggggattaactgtccacatgtgggcacctgcccagcacatggtaagcacttagtgggcactctgttttttgtttatgtttttttagacagagtcttgctctgtcgctaggctggagtgcagtggcgcaatctcacctcactgcaacctctgcctcccaggttcaagcatttctcctgcctcagcctcccgagtagctgggactacaggcgagcgccaccatgcccagatataccttttttttttttttttttttgtatttttagtagagactggatttcaccatatcagccaggatggttgccaggatggtctcagtctcctgacctcgtgatctgtctgccttggcttcccaaagtgctgggattacaggcgtgagccaccgcgcccggctgggcactctgtttttattaaattatcactggtactaatgttatgaaaaatgtgaacgagccccaacccccagaggagatggtgtggcaattaggaggagggggtgttgccaggacaggaggctctggcctgcccccaagtgtttgctgggccccctcaaccctaagcagggcccccagaggtatgagccttggactgcctccaggctgattagtgaacaaggtgtcacgtgacaaccctgatttgtcccacagaatcagttagagcacaggcctcatgtggcccagcagatgcttgccgagtgattctgcctctgggaactgagagcagtgagagaccctctgacctcaagggcccagcttccctccactcccttttccactgcagacccagctagctgaggcccagaacagaaagctgggggcttcccagcacaattactctctccagcccctggatggggttccccagaagagagatgtgtctggggactaggccaccccagcgcaggtggtgccttcgtgtgaagtagaagaggcccctcccccaggcagggtgagacttgagtgcccacttgcctctggagctggcctccccccatatgcagagaacctgttggggacttgaaaagccacatagttatggatgggcacacaggccagcctggggtgtcacaggccagcctggggtgtgttgggcgggaaggcaggtggatactcagagccctgggtaggtcccacctagtcccttttgcctcctgctggggagtgccaggaaagtctgttttgaagttgggcttatgggtgacttgggacaggactgtgggcctgtccctttgggccagaccgctcgccctcaccatgtcccttccactccaactccgctgacccaggccccttccagcctcggggcctctgccgatgctgttctctgtgcctggaaagcccttgccctcttgaggccttagctggctccctccagcaatgtgtcctggaggtctgccattaaggccgtctccttggagaagcctcccctgtccccagactgggccagacccccagtaagcactgctccctgctgtgcacctctcactgcggttgtgggtagtggaggcagtttttgttcagcgttcttcttcctcgctgacctgtggtgggcaccccacccaagtgtgccctctgtggaatgaagggacctgggttcggagggtgacctatggctcaggctggttgctgctcctctgaacctgtttttcagtctgttaaatggcgccctgccatgggaggctctgtgagggcacgttgtgaagggcgacagtgagcagcactgggtgacccctgtcacctcaccccctgccccttcctgccttccagggctgccagaggaacccgaccagaacctgtccagccctgaggaggtgttccactctggccactcccgcaactccagctatgccagccagcagtccaagatctccggtgagtggctgcctggccctgcccccgtggcctcctccttcctcgggatcccccattgtgatgctcccctgcgtcgcccctgacaggctacagcacagagcactcgcgctcctccagcctctcagacctgacgcaccgccgcaacacgtccaccagcagcagcgcctctgggggccttggcatgaccgtggagggccctgagggcagtgagcgggagcaccggcccccggagaagccgccgcggccaccccggcccctgcatctgtccgatcgctctttcaggtgaggcctactgcttggtgccccctggagaacagacctctcccggtggtgccttgaacctccgcttctttacctataacacagggaccgtaaggtccccacctcagagggttgggtggtgacgattccactagctgatggccctgaagggtgcagccatgcccggcgtgcagcaggttctgttcatggctgctcttgcggttttgtggatcagacaagagcacgatctgctaggtggccttaggaagctgacttacctgctcattgcctggcatcctcgtctataaaatcggctcatgatggcagctgcaccctattgtgcatgtgaggtttcagtgaagtacagcacggagcgcacagggacattctgagcgccgctgcggctgactggcattattgtcgtcgttctgtgcttgtacctgttactgccctgaccgttgtgacttgtccccccacgacctgacccaggcggaagaaggactcggtggagagccacccgacctgggtggacgacacgcggatcgatgcggatgccatcgtggagaagatcgtgcagagccaggatttcacagatggcagcaacaccgagggtgagccgtgctgggctggtgggggcgaggccacctgctccaagggctggccctgccgcgctcagcctccatcctctcctgtgtccccacagacagcaacctccggctgttcgtgagccgcgatggctctgccacgctgagcggcatccagcttgccaccaggtagggcaggcttagggaggggtcgtcggggcggctggggcttgggggtgagagcagagtccccacagtccactcacctggccttgaacgccaaatcttgtcgccacagtgtgaccctgggcctgtcatgtctctgaacctccctttccccatctgtcaggctgtgtggacaccaccacctcacctgggagcctggggcagtgagggcacggacaggttcggtggtttcccacagttcacaaggtcacctccagcaatgcctggtgcagggctcagcacatggcaggggcctcacacgcatttatttagaaccctcccttctacttcctcccagctccagggactcgggaagaatggtggtggtgatgcctcatgggtttactgaacaaatctttccctagcaccagctaggcactaggccctaagtgaaggcctggttcaatgcaggctgctgcctacacagcatccacagatggcaggggtagatgggaccaaagttgcgggaacgacagtttatagagtgctgcgtcacagacattcatttggagcatgttgactatgtgcctggctctccatgtgctttggctaaccaaatgaatgagcgagtgagcgaatgagcttcccacaggcgggctgctgagggcaggtggggagcccgcctaacatccacatccccagggaagaggcgtggccaggccgctgcgcagaggctaccctctcaagctgctctgctgactcctgctggccacggcctggaatggcagctatcacctcccagtagcctcctgggctgctctcgggtgggggtgagggggcggtgagcaagaaggaaactgaggggctggcttccttatgggtttgtaaacacacccctccctggccccctctgaaaatgaggaagcatcttggggaaagaaaccaatctggttgggagcgagatcacagcagagctacatgctgagccccgagagtccccgactccagggctgggcctgggctcggcagggaaaggagctgaccaggtttcctgacttcccactgccctcttggtcaccctcacatccctctgagcctcagtttcttcacctgtcaagtggggcaggatgcagtgactccctgccgaggtgaccgtgaggatggggtggcacagccagatgtgcccggaagggctctgcaggccccacagactctgatgcttactatctgtgtcactgtgggcaagggacttaccatcgctggggcacggttttagcccctttgcaacacagggctggttaacagtacctgcttgtgaaacacctccagaggcctggtccagtggagcgctcaggaaatggggtatcgagggggacatgctgacctgtctctcacctgcagggtctcttctggggtctacgagccagttgtgattgaaagccattgaggagcaggtgtccgggctggagaagagtcctgctttctctggagtccagacctgtatcattccatgaggaactttccccttcagatcacctctgcgccacatctcatccatgcctcctccatgcactccagtccacactccccgtagcatcattccattgcccctcccatccatgctgggaccctcctggcccaccaaggcccaggcaccactgtgaatattctcctctgaaccactagagggcaggccaggcaggccaggcgggcccgtgcagcttgtgggcaagaaggagctggcaaggaccggcgctgctggagactgacccagccctctggctgaggacatgcagcggctcctaaatgtagagatgcctgtggctgagggggcctctctacctgtgtccccactcactccaggagcactggctttggtcacgtcttagcagcagggccttgctccgttgttcccttgccctggtggtgggggggccagaccacctccggaatcctgccacctgtgactgtctgactgcttagtgcttcagctgtcccttccttgtgtcctgggggacctgctggcggcctcttcctgggagccatgacctcagaccccacccacactccagatcgagacccctgcctccccccggcaaatgtcctcccgctgccttgcagcctgcactttgcacatgctcacccccagcacagtcccactggcccctcacctccccttccctgagctccttcccaaggactcctggtcactgcctgctgtgcagtcagaggcccagggtccagcagcccggcgggaacgggtgctgcctcttcctccagttagctccagctcaggtctgagacccgtgctgagaaaggtctgagcaccgaccgtgccctctgcccagggctgggtcctgagcagctggttttcctgcaggaaggttggagcaagcaaagtccttctctgccctcagggtcagctgcccagactggggcggatgccagagaggcaggtgggctgtggctggactggtccggagctggcttccttaccagaaaagcctcagccttcctctggaagcatcccccgttctgggcaagggggaagggctcctttaaggggtgtgctttcccagtggggagcagtctggccctgccccctactaaagcctctgctctcagcactttcccccaagtccttgtaacttgcttgaaggtgggttctggctgccagccagtccctggacaaactctcctgccccttttaaatttcactcattttgtataaacccagcaggctggtgtttacttagccctgtagcttttttcattttttctttccgtctttcttcttgagttcacggttcaatattgcctcctcgccctggtgaggggaggtgctgcttttctgccccacctgccggctggttccagcagcgctggggcccagctggggggccgggatgggggcttctctctctgggaggggtgcaggtgccctccccaggctgggagggttccttccctagctccccatctgcccccgctggtgagagttgggcttcttggtcttggaactccctggcattgggaacagagcatttccagcatttgttgttgttttactcacctaacccttagaaaatgaatgttagaaggtgcctgccgaggcgggacagagtgttcgctcgcgctggagaaggctctgctcagccctgagagtcccttcctgccccaccgatactggcactttaaaaaggaagctgaccgcacagtgtccagacgaattggcccccagaagatggggagttctgtcctgcccttctgtgtctgcgtgacctcacccagcctaggagggaggtgcattcagggtagatttgcctctcattcaaagttctggggctttgggtggaaaacagccagctttggcgctgttggggagactcctccagaccaggaaccccagaaggagacagagcctgccacatcctcccacgccaggccctgggccagggtgattggactgagaatttggccacaaccaaattgatgctggctggaaccagaggccagaaagcctggccttgtccccatgtgggagccctgtcctcagccctcttgtccccttgagctcagtgaattcccaccaggtgcccacagctcctggacttcaaattctatatattgagagagttggagagtatatcagagatatttttggaaaggagttggtctatgcaatgtcagtttggaatcttcttgaaagtttaatgtttttattaggagatttaaagaaaataaaggtctacaatatc

SEQ ID NO: 37698 - DNA, 38035 bp, Homo sapiens
gtcgcactccttttccccgagacttggtactgggagataggacgggagtctcctacacgcagtcaacacttgccacgagcggctagacttaggacaggcaagttgccctgccatccttctatcgcccccacccctcctttacttaagggcgatggcagagacgtcctcctcccccttctcctcctctttggtgcctccagccaggaggcgggagcgatccacagcagctgacccagctcaggcactgcctctctcacagccctcaagacacaccatgggcccagaggcaggtttgctacacagcagcgacgacgcaggcggcggccccagcgactcgcaactgcctccctgaccacagcggccaccgcccaacacccccgagaagccatcgccaccaccggcaggagaacctagggtccataaagccatcttcgcgatcgactaaagctacgtcaacaactatggcgggcgacgggcggcgggcagaggcggtgcgggaaggatggggtgtgtacgtcacccccagggcccccatccgagagggaaggggccggctcgcccctcaaaatggcggcagcagcgatgcgcctgcgtacagaactcctccgtcgcgccagggccggcgggaagtgaggttctcggacgagccgccagaagtgtacggcgacttcgagcccctggtggccaaagaaaggtccccggtgggaaaacgaacccggctagaagagttccggtccgattctgcgaaagaggaagtgagagaaagcgcgtactaccttcggtctaggcagcggaggcagccgcgaccccaggaaaccgaggaaatgaagacgcgaaggactacccgccttcagcagcagcactcagagcagcctccgctacagccgtctcctgttatgaccaggagagggctgcgggactctcattcctctgaaggtgaggaccgcggaggtaacagtcccagccgcgagccagggaacgcgcgggggcgggcgcgcgcctcggtggagctcatgcccgcctgggtactaagtactgggattggctaaagggtattcctcagccccctctggacttgtgccgccgtgcaagggccaccctgacccgcagcggggaaggaagcgccgaccggaggagtggaaagatggtcgtgtggagcgacccgggcagggctggggcgctctgcccaacatcgggcatcaatttaggggagtcagagctgcctttttctgcaggccttcacgaggggacagcgaattactgcagggtcggtttcatttcggttccctctaccctgcggatgtttctacagaaaccacttccatttccttctttaacgctcgcgggccagagtccccagctgaggatctaacctttcagtctttttccctcctcacccaggtgggcagagaggaaggagaaattttgtgagtgggcatttcgagggattgctgagtttagtgaattgatttgagacctcacccaatactttcaccgaaatggggtaactcatttttcctgaactgatgttccccagtgtttgataacttgagctgattgctgtttctccagtgtggtggtccctgccaaaaatctgccactttggtggccgtcactgtaacctcaagtagtctggcaaatcagactgacaaagtaacctgaaaaacaagactattaattagagttttcgtctaaatggacaaaagggatgctgacaaagtgagtgtatagtgttaggtaagtcataggtgaatcagtttccttaatctatcctctcccaccctgccccccccattttaggacctaacactgagtcacagatgaagtttcatgttaatcccatgtaaggcacctgtgaggtaaaaatcagcggacctgagtcacaatgggatgacatagtttgtggtagactattgataggcggaggagtgggttttcagcttagagcacggtgataggctgcaagtttacctgctgactcgtgaaggtactgacagatttgaagacttgattttggaaactttatgttaaagttatgtcagttatttttgggtgtagcaactgaagacagtttagcccatatatgtgttagttttatctcttttaagattacaaagtttttgcagacaaggagcctataatatatttgatagtaatttaagtacttggtttaattcagtatttttcagtacctggaagaatgctttgtacatggtaggcaaaaaatatgttacattgtattgagttccacagagcctagtgcagttatacaggctaacttttttttaacaagtaaagaatttacccctattttattaaatctttaaggatctaaacatttttcactcttctgctttcttccacatcatttgtgactctctaccccatctttttgattttctgaagtaatatatttttgtaaaacaacaatggcaaatattattatattctgttgaattcattgtattctgtctcaagaggagttctgactggtatatttcctaagttttggtaaacctaaccacctgtttctaaagaaacgaatttcttgaatttttgcttatgtattgttacaaaaatgcataatctgtgccatgatctcccaggtcatatattctgaattttaactcttgttatgtctgttttttagaggatgaagcatcttcccaaactgatttaagccaaacgatctcaaagaaaactgtcaggagcatacaagaggctccaggtaagaatagttaactttttgtttttctccttacctaccaactttttaaatgttcattgaattaaacaatgtaagtatgtgtaaagaaaagacaagggcagacacgtgagtactcaagagtaccagccacccatataaccttgtaagataggtattataccaatttcatagaagagaaaactgaaacacagagaagctaagacaattctgtaagatcacatatgtgactgagccaaaattcaaacccaggtttgtcttctccagagcccttttactttccccccaagtgcctcactatcattctctcatgtcataactagctactcagtaaaatttgttcaatgtcaaatgaatgaatatgttatactgccctgtgtttaaaatggattaacttttcttcatggtaaaatcttgacacagtgtgatcagtcttttcagtttaatactgtggtttatcaaatcttaagatgctatcgactataagaaacaccatcattgttttatgtaccacctagcaagggaaaatgctgccaattttttggtaatttgtagtaatatgccataattatatgatgcatcccaatttcaaagatgttaaagtgtttaaaaaaattgtcagaatcaatgtaacatggaagtaggctacatttaatagttcacttaagttttaaaagctgattaaaatattttaaaaagctggagaagggatcaagtccagttattaatgctttgggttttagttccatttaattttcaatttgctttttttgatattaggaaagtctcacaataataaacaatcatagctgttaaaactgataatccttggtttttagtacccagatcctgacttatttacctgtttctaataagattatgctttataatgtgagctattgtattctaaacttagaataagtatgtctggttcaagttgagtttcaaataaaaacaccttcatgctaatttttttttcttttttcttttttgagacaaagtctcgctctgttgctcaggctggagtgcagtggtgccatctccactcactgcaacctccacctcccaggttcaaacaattctcctgccatagcctcctgagtagctgggattacaggcgcctgacaccacacctggctaatttttgtatttttagtagacataggttttcaccatgttggccaagctggtctcgaactcctgacctcaggtgatccacccgccttggcctctcaaagtgctgggattataggcatcagccaccacgcctggcctgtcctatattccttgaatagtctatgttactgtgttaagattataaactatcttagaaaaatgctttgaataatgatgatataatcagattttctgggccattttggaaaaccataatcttgaatttatttgcagtagattttattgtatacctgggaaagcaaaaatgtctaattttaaatctagagtaatttataaaaattatggagttaagtaaattggtataatgaagactactgagtgctagcctccggaccattataaaactattaagtaatagaatgtcttgaatagtctttttggagtttatattaggctcatatttaagaactgctaatgaggtacaccatggctgcatgaggttgtggcaagagcattggacctcagtgaagttactcactcatcttgagccttaggcctttacctgtgttatttgccctgcataactcacagggcctctgaagaaatgagatagtacatttgaaatcactttgtacccggtaaaacatgcaagtgaggttttttttttctcatagccctttacaagagatgtgaagttcatacaattttgcttaagtgtatcctttttctcaagaagcttatgctataaatagaaattgaaaatgtttaccaatataaatgacagattaaatggaatctgcacatagattacctggactgtatcaatagcatactgtgccttcagtattactagaaataagagtatgtctgtctttgagaggtttgagatactcagggttttcttcctctaaaaggtgcttttatactacatctaatacttggcatattcccatcccatgcctcttaatgaaaggagagtttagggaattattaaatgcttataaagtctaagagaaattatttaaatggagtcactctttgatggaggactgctttaagtacaagtttaaggtaaagataagcccttcttcctcatagaatgatagacattcagtttaactttgatattcaaaatagtgctataattgtatataaggctaccggtgtggtctgacagaaaattatgcaaagatgcccttacgaataaagacctaggcccggcatggtggctcacgcctgtaatcccagcactttgggaggccaaggtgggcagatcacgaggtcaggagttcgagaccagcctggccaatatggtgaaaaccccatctctactaaaaatacaaaaactagccaggcgtggtggtgggcacctgtaatcccagctactcgggaggctgaggcaggagaatcgcttgaacgcgggaggcggaggttgcagtgagccgagatcatgccactgcactccagcctgggtgatggagccagagtccgtctaaaaaaaaaaaatacctaaaccaaaggaccaccttataaaacaacatagtaaaaatatctacatcatttggttatcttgttattggaagacttgaaaatgttgattaattcagaacaggaatatagtttgaaatcttctcattgtttgaaattccataattgagttgttttcacttaaaatagccgttaggttgtttaatcaattcaggttatatatacctacataacagttattctcctatggccagattcatttctttctggaaattatgacactaattttataatccaaaaatatattaggacaaattctatttacttttccagaagttaaatgggtatttttgttctactagtgtggtttctagctaaacaatcagatagttgttcttaaatgcttactattttatcatgaacatttgcttctctagctgctgtagttagagcattcattctccagataattattgagcacctactttgggccagtctccatgctttgatttgagggtgcagtggtgaacaaaagcagacaagtgaggaagcctcctaccaaagaagggtacttgatattttgttctctcatacctctctctggtaccctgtgtctttcaagtactttacttggctatgggatatgtatatagtagcacatgcaggaaatgcttcttaaatgaaaagatgggaactgaagtagtgattgatgtctgtagagtcagtttgattaaacatagcttagtaaaagcagacaaaccaaaaacagattttaggttttaattaaacctgaaaaggctagaagtatagagaagaaaaagaggaaggtagttgtaatatgtggagtaacaggaactaaaatttgcctttattatcatgtgtgcagggtttttgtttttgttttaaagagacagggtctcactgtcacccaggctggcgtgcagtgcagttatactgcagccacaaactcctggactcaagctatcatcctcctgccttcgcctcccaaatagctgggattacaggcacacaccactatgcccagacagggtctcagtatgttgcctaggctggcaagatttattttttaaagatatcgatataagttctaaatacttgatgtgtgaaatactgagatagatatttcatagaattttagagctggaatatttaaggggatcatcaaagttccagaatgtgttttttgcaactcagagctaagacataatgcttttttatacagatgaatgaaacaaaacataatagaatccaaattttgataaatatttggttttagaacatgttatgtgaggtacttggagaaaacatacttttataggtggttttctagactaaaattaacattttaataggatcggcttctccgctatccctatgccattgaactatagatggtctaaaataaaccctggcccacattaatgtttttatttaaaattaatttgcatttcttcaacacaaggttaaatagaatgagcgtattgaatctcaggatgttaaccctaaaattaaaatattccataaataatccacaatgagggtcagtcacaaatggaatagataattgagttggtaccataatacagattttggttcttaattgagcaatttagaagaattttatttagtatttctttccttcctacagctacggtttgctgagaaaaaatgcaaatttctccatcaagactataaattttatatggcaggaaacttgtctctagttcactatcatcactagttcgcaacagttgtcacttagaaagcttgtctctacttctctagcgtaaataaaagctctgtaaacctttgttgaataaataagggatgatcatgtaataaagctagtatgtttcacattttatatatttttaaatgttttctcttcctatattagcagtgagtgaagatcttgtaatcaggttacgtcgaccccctctaagatacccaagatatggtaagagattgtttgtctgttggtttacctttgttataaatacagttttatttttaaatatggttgtacatgtattcatatgattcagaacttaaaagttactgtaaatatacattaaaaaatctccctgtcccctctgtcattcagccagccagtctctcttcatcaaaagcaaccaatgttgtcagtttatattttttggagatttacagaaattcatggatgaaattatcttgtcctttttataatacaaattttggctttataaactctcatttctgtctttttttttttttttaatttgagacaagatctcgctctgtcatccaggctggagtgcagtggcacaaccagggctgactgcagtctcaatctctctggctcaagcagtcctcctgccttagcctgccaagtagctgagactatgcatccaccaccacgcctggctgatttttgtatcttttgtagagatggggttttgccatgttacccacatgatctcaaacgcctgggtaagtgatccacccacctcagcctcccagagtgctgggattacaggcatgagccacggcacctggcttacttttctgcactttcttgtttatttttacttaacatatatacagagatatttctatattcatatataaaaagcttccttttttaaagagattgtttcttatatattcctgtgattctttatgatgattttaaactatggtcagggactttattcttccagtatactgctaacaaaaaattcaagctggagctctgtggcacagaacgacaaaatgtccctccctcagttatctttttgactaaaacgattaaaagtattgccctgaaattgatttcatgactatgaagaaaactagtaaagacactccaagcagtctacttttacttcattttccttgtttttttggctcttaaagatgctttatcatgggaactaaaaaggaaatgtatttatctttatattaggcttctgtaccttcccattctctttatcaaagaatgatgttgatttatttcgatagatagttgactatccttttaagtattccagtggtaaagatctactaaggttttgttaatgaacctgtggtaaagaaccatatgatgcatttccttttcaaccctaatcattctcttgctatgtctcttgcagattcgacatacaaaacaaatagaaatactaaaatgagtgaattatgttcgtttatttctattcttttttttttccaggcagggtctcactctcacccaggctggagtgcggtggcgtgatcttggctcactgcagcctcctcctcctattgtagtcccagctactctggaggctcaactgagcctcctacttcagcctctggagtagctggaactacagtcatgcatcaccatgcctggctgattcctgtgttttttatagagatggggtttcaccatgttgcccaggctagtctcgaattcctgggctctagcaatccacccgctttggcctcccaaagtgctgggattattggcatgcacaactgcgcccaaccctatctctaattcttacaaggtctctttgagggtccagattaatagaatacaagagtatatatatctagtcattggcttgagaatactaatttattatgtcagtttgtggggacccagtccctatgactaggacctcccataaacagccttggtttttgttgtctataattatgcctatattattgcttaaattcatataaaaacatgtaatcaatttagtcctgctagtcttcattaaattcacactattaggaaaaaggagataacaacttaccaattaaggtttttctcttgatttattttttgtttttgtttttctgagacagagccttgctctgtcacccaggctgtagtaccgtggtgcgatctcggctcactgcaacgtctgcctcccaggttcaagcaattctcctgcctcagcctcccaagtagctgggattacaggtgcccaccaccacgcccagctacttgttttgtatttttagtagagacagggtttcaccatgttggccaggctggtttcaaactccctgaccttgtgatctaccccacttggcctcccaaagtgctgggattacaggcatgagccaccacgcccggcctttctccttgatttttatttttattttttatttttatttatttatttatttttattttctcgagacaggctcttgctctatcaccgaggctggagtgcaatggcgtgatcttggcccactgcaacttctgcctccctggttcaagtgattctcctgcctcagcctttcaagcagctgggattacagatgaccaccatgacacccagctaatttttgtatatttagtagagatggggtttcaccatgttggtcaggctggtctcgaactcctgacctcaagcaatccacctgcctcggcctcccagagttttgggattgtaggcgtgagccaccacacctggccctttcttcatttagaaagtgaattcgatacgttgttcacggcgagttcagtgtcctttgctgtaatacgttcgttgaacgggttttaattcatttcagtgtctgcctggctataggacatgacataccatgatttgtggttttaaatgaatctacattgaatgttgttagacttagttttttttacattttaattattttctaaatttgaagatgagccaaaagggaaacgcttcatttttctttataaatcattgtaccttcctctaattcatctttcacttaagttcaggccacttctttagagacttaaaaaagctttttaggctgggtgtggtggctcacgcctataatcccagcactttgggaggctgaggtgggcagatcacctgaggtcaggagttcaagaccagcctggctggcatggcaaaaccccgtctctactaaaagtacaaaattagccaggcgtggtggtgctgtgcactgtaaccccagctgcttgagagtctgaggcaggagaatcacttatacccaggatgcagaggttgcagtgagccgcaatcacgccattgcactccagcctgggcaaaaagagtaaaactctgtctcaaacaaaaaaaaaaacttctttgggaggccaaggcgggcagatcacaaggtcaggagatcgagatcatcctggctaacatggtgaaaccccgtctctactaaaaagtacaaaaaattagccgggcatcgtggcgggtgcctgtagtcccagctacttgggaggctgaggcaggagaatggcgtgaagttgggaggtggtgcttgcagtgagccaggattgcgccactgcactccagcctgggggacagagcgagactccgtctcaaaaaaaaaaaaaaaaactttttaaaaaagagaacttggaactgaaataacctaacactctttgctagagcatttttataagcaccttgtaataaaaactttgttttttattgtctgaaattatgtcatattatttaaattcatttttttgtgtgattgtaaatttaaaaaagagattttcattttaaagtaattttctgtgggtttagtagaaagaatgaggctgggtgcggtggcccatgcctataatcccagcactttgggaggccgaggcgggtggatcacctgaggtcaggagtttgagaccagcccggccaacatagtgaaaccctgtctctactaaaaatacaaaaaattagtcgggcatggtggtgggcacctgtaatcccagctacttgggaggctgaggcagggagaattgcctgaaccggggaggtggaggttgcagtgagccgagattgcgccattgcactgcagcctgggcgacagagcgagatttggtctccaaaaacaaacaaacaaacaaacaaaaaaaaaaaagtgacatttttcaattcctttatagtaatgttagtacaccttggagtttatgaaatggccattcgtggagcttgaatactagtgataccaccagactattctttgctctttcctgctgccccactcttgactctgttctcaaaagcgtgattggcatcaaatagtcttttttttcttttttgagacagagtctcaatctgtcacccacgctggactgtagtggtgcgatctcagctcactgcaacctccacctcccaggcttaagcgattctcctgcctcagcctcccaagtagctgggattacaggcacatgacaccatgcctggctaatttttgtatttttagcagaggcagcatttcaccatgtttgccaggttggtcctgaactcctgacctcaaatgatccaccttccttggcctcccaaagtgctgggatttacaggcatgagccaccatgcccagcagatagtcttaaaactatctgtaccaggggttagcaagctaccgcttctgggtgaaattggcctacaatctttttaatcagcccatgaactaagaaggaatttttacactgctgaaaaagacaaagcatgtaacagagaccttatgtgactcacaaagcttaaaatatctactatttagtcctttataaaaaaagtttgctgacccctgatttatactgatggcaagaataaagacaacaaggccgggcacggtggctcacacctgtaatcccagcactttgggaggcagaggcgggcggatcacgaggtcaggagattgagaccatggtgaaaccccatctctactaaaaatacaaaaaagtagctgggcgcagtggcgggcacctgtagtcccagctacttgggaggctgaggcaggagaatggcgtgaacccggaaggcagagcttgcagtgagccgagatcccgccaccgcactccagcctgggcgacagagcgagactctgtctcaaaaaaaaaaaaaaaagaataaagacgacaaatcacgcaaatggtcatttgtttgttgtcagagtaaattcaggagttatatacttgctcgaacatatatttattacaacactccatactaggttgtacccagagcacaagaagaaaggaaacaagctgggcctggtggctcatgcctgtaatcccagcactttgggaggctgaggtggacggatcacctgaggtcaggagttcaagactagcctggccaacatggtgaaaccctatctctactaaaattacaaaaaattagccaattgtggtggcaggcacctgtaatcccagccacttgggaggcaggcaggagaatcgcttgaacctgggaggtggaggttgtagtgagccgagatcgtgccatcgcactccactgtcggcaacaagagcaagactccatctcaaaaaaaaaaagaaaggaaggaagcaatgactcctgtgttctatccagtattcctttgagaaagcacagtagtcttatttatattttcatgtctttgtccccagacaaaacacaaagtaagccaagtttatgttttcttgagtggcctttgctcctcacaccaagtacctcccacaaatttctaggaatagcaaaatctacaggagaaatgtagatgctttggcacctgggctttcaaaataactagggaattttataagttgtaaaaggccgggttatacctaaggtttgaattccttaaaaactggccaagtaaaagaaagtaaacaaagtggcacaattaatgcttggttttcactagaggcgatgactgttaagtgatctatcttaaacataaagacctcggacttctgaaagtagcttttcctaattggttgaggttactggaaaatataacaccttcttaaacagcatgtttaattattaccatttgtctatatatttgctaaagccacagcctttatgatttctttaataatgttttaatattaaggattttttgctcaaaatatgattttaattctcaaagcttctgtatgaacattgggaagagtaataccttttttaaaaaagtatttttttaaggccaggcatggtggctcatgcttgtaatcctagctgtttgggaggccaaggcaggtggatcgcttgaacccaggaatttagcctgggcaatgtggcgaaacctcgtctctacaaaaaaatgcaactgttagctgggtgtggtggcacgtgcctatattcccagttacttgggaggctgagtctggaggatcacttgaacccaagacacagaggtttcagtgagcagagattgtgccactgcactccagcctaggcgacaaaaagagaccttgtctcagaaaaaagaggccgggcacggtgtctcacacctgtaatcccagcacttcgggaggccgaagcaggtggatcacctgagatcaggagttcaagaccagcctggccaacatggcgaaaccccgtctctactaaaaatacaaaaattagccgggcatggtggcacaagcctgtagtcccagctactcgggaaactgaggcaggagaatcacttgaacccgggagaatcacttgaacccgggaggcagaggttgcagtgagccgacattgcaccactgcactccagcctgggtgacagagtgagactctgtctcaaaaaaaaaaacaaaaacaaaaaacaaaatctaatgctttaactttcgacatgtagcagccaagtttaaaatagaggtaggtgaaaaacaaaagagggaaatgaaattaaagcttatgtagtcatggctactgattcatcatcagatcgcacttaaatatttatttccattctttgcagcttgggtaaaaaggtggaatgtttaaaaccttgcaggtatctaattattaagcactaatttcagactttttaagttgctaagtaacgttaatcatagtatgagaaatattagcaaaaatctggacttaacatctttattctataatcataaaatctattttattcatggaacaaactttttttatttttattttttttgagacagggtctcactctgtcacccaggctggagtgcaggagcgtgatctcggctcactgcaacctccgcctcaaagtgctgggattacaaggcatgagccaccatgcccagccaaacatttttaaacaccttctttatgtcagtgaccgacctaagtgctaggatcataaatagccattcaggttttttttttttcctacctcttagatgtacgtgatgtaatggaagagaaaaacaagtttacaaatcttttttttttttaagtgctgaaatagtgacatatgtctgcgggatcctagacgagaagcaccctactcagtggaagaggttgaggcggttttatgagttggaaatgacatttggattgaattttgagggatgaatagcaggcagaatgaggacggagacttgcaaatactacagtttgctttataatagacattttacctttagagagcatgcaatatgagaaattaaagtcttttatattacagacaatactctcacactagccataattctttatctgagacgttaaataatgtttagaatgacattcgaaatcatagcaggcttgggtttcttgagctttgtttaccagaatgaaaaccttgttttaaaatgtatctgtagccaagacagtagataacctgattcaataatgattgattgtcaaatctacggggattattattatttaagatctaattcatagatattattggattataaaacacaaaatagtactttttttgtttttagtgatgggatcaagatagcattgcataactagttattcttgttttgaatactattgataaatatttattgttaggaacatagaattctaaaaaaggatctttagtcactagattaaatccagaagtctgaaaagtgttgaaaaatggatagaatccatgatttattagatacttcaaatataataacatgttagaagtattaaaatcaaatggggagctcccttatgtaagctggctaaaaaataattattaaaccatctctccatgctaattagataacacatagataagcagaaaaaagattgaattttaggcaacttggtatatggagaaatgactgttaaatgaattggctctagacaaattgacctggaacttcaaatgtgtacagaaataaaacatatcttcaaatgtatacagataaaacatacctatcgaaaaaagggattactgtattagtcatactactgtactgtgtactgtactgtactattctgatagctcaacaaatgaatgtaaatctccaacatatcctttccattattatagattctaaaatctattcagccctagttaaagaggttttgtctaccatataatttttagagtaactatgtaaaacataacactgaaatataaatgggaccttagtaaagcctactgtattacatgaattacacttagaagtttattggaacctctcatattaggaaaagttcagctgtcagccgtttctttattcatctattcaaaaaattggccaagtgcagtggctcatacctgtaatgccagcactttgggaggctgaggcaggcagattacttgagctcaagagttcgagaccagcctgggcaacatggcaaacaaaaccttgtctctacaaaaagtataaatattagcagggtgtggtgacatgtgcctgtagtcccaactactcaggaggctgaggtggaaggatggcttgagcctgggagggaggggttgcagtgagccaagatcacaccactgcactccagcctggacgacagaaccaaaccatgtctcaaaaaaaaaaaaattattgagtgtttactatgtgctgttatgaacaagactgatgaggtggtaggattgtaatagactggaagtcagaagaacctgcggtcttctggctttttttattattaaattagacctatacccttagacaagtcacttgatatctatgaaccttacttatgaaaatcttcccttatgatgagatgggaatcagatgacattcatgaagggttttttgaaaatcaaatagcatcatgcaaatattaaggacttagcattttaagataataacaaaaatatgattattgattcttaagaaagcatcttgtatttgcatgctatgtgaatagttacataaatgaataaagtaaaactgctatacaaaaatatgaagtactataataattatgcacttagataataaaacttcaaaaagagaacaatacctttttgtaggaatggaaatattaattaaaaatttttggccagctgtggagctcatgcctgtattacagtctcagtactttaagagaccaaagtgctgggattacaggctaggagatgggaggattgcttgaggccaggagtttgagaccagcctggtcatgatgtaaaaccccatctcttgttttaaattaaaatcttaaaaaaaatttttttcgtttgacttttcctttttctccctcaaaaaagagaaaaagaaaggacagtgttcctaagaaacctagagcaaaatagtacttaatacaccagagtctagctctttaagagtaacatggtgttatcagcagttttctctgggttagtttttttttttaaataaaaaaatgttggcaaatatatttcagatactgatttgcacttgccactgtcaagaggaagtattttcagtggaactcaaagcttgactagtattatactaatctaattaaatggatttaaaataaatattttcaaattcaccgtataatgtgttagcagttgctttctataatactattgtcccttttaataagcaaattgaggttaaaatcagtagagataaaagctgaaattttctcagctttgttgaagaagtctaaatcatgctacttctctacatatgatccttcagcgatattttaacccaattgtgaaatacctgcatttgggtacatctcactattttttttttttttaagtttcagaatagcccatgtaaaaatactatgttccaagtttatttgatgtgttttgcttgtttatttttgttcaaattctcttttgcactggaaaacagtgacatacatggacccgccagaactagaagtttctttacctttcttcctctttggatacaccaatgctcgaaagaactgggttatcagtccagttagtgtagttggtttttaaagggagtataggggatttggcaaataagagaatgagaatatagcaaacctatacacactagaatatttgtcaatgtagaatttaatgttttttttgcatacaaaggttacattttagagtaaaaatagacctgtgactgaaggaaaattaaacacttcatttcctttttctgtttgagacagagtcttgctctgtcgcccaggctggtatacagtggcgcgatctcggctcactgcaacctctgcttcccaggttcaaactattctcctgcctcagcctcccgagtagctgggattacaggcacacaccaccactcctggctgatttttgtatttttagtggagacagggtttcaccatgttgaccaggctggtctcaaactcctgacctcaagtgatccacccacctcggcctcccaaagtgccgggattataggcgtgagccactgcacccggccaattcttagtgatttaacagaaaaagaatttatttaatgtgtcctcatgttcattttcctaaacgagatgctcttttatttattcctaagctttaacttttttcctaagcttttgtttattcctaagctttaacttttgatgttatatgtttaatatttgatgtatgcttttttcttctagaagccaccagtgtccaacagaaggtcaatttctctgaagaaggtattttacttgtaaatatcatataatatatactttaagtctttttctttacattagaagccattctgatagatatttaagaagtgggaacagagccggggactgtggcacatgcctgtagtctcagctactcgggaggctgaggcaggaagatcacttaagtccaggagttctgggctgtctgtagtgcactatgccgatcaggtgtctgcactaagtttggcttcaatatggtgacctcccgggagcgggggaccaccatgttgcctaaagaggggtgaatccattcagttcagaaacggaccaggtcaaaactcccgtgctgatcagtagtgggattgcaactgtgaatggccactgcactccagcctgggcaacctagtgagagcccatctcttaaaaaaaaaaaaaacaaaaagaagttagaacagaaaataatgtgtttttcttcaagaaaaaaaattcatgcttatctgaactgttaactgggcagaaataataggacagatagaatgagtgatgacagccttacattttaagcatcttttgtctatttgggttcattttaagcaaagataatattttctattatggtattaaagtaatcagttttccaaattctcataaccagtttatgtttgaaaagtacaggaataaaatttagtttttgttgaagctcagcataatctgagggtggtcacctgcataatagaatgtttgtgtgcaggtgtgtgtacactacccctctaccaccaacacacacacacaaatacacatctgaatttaactacacactaattatatgtagttttcctccccataaactttttccactgtttaacgctcatctgttcatttttgactctacattaaagccttatagttttttagatattactctgaatatttgtttaggaaagtattatgtgccccagaggacacaaattgagataaattttagttcctttggaactttgggattcaaaataataagcatgataaacaaacagtagttctatatctgataacttaaaaggcttcttttaatgttaaattatttgcttggtttttttaaattcagatcttctgagcattaaaatagactatattagtatattgtttacttctctttaggagaaactgaagaagatgatcaagacagctctcacagcagtgtcactactgttaaggccagatccagggattctgatgaatctggaggtaatattgctttatatacatatgactcttctcatagaactatctttggtattccatgaatttgctttttaaaaaaaactttcaaatttttattaatactttataaaaagtcgtgaatttttctttaaatatttattaaaattactgatttcgtgttcatccgattaatactatgtcatgatatctaaacaaatcacttttagctttttttgatatttgtggaaaataagatatttttgtgctcaaaagaagagttacttgttgttttttgaattttatagagaaactaatcacattgccattgggactgacaacactatctggagtgttacttttaggaagttttcatttaattatataactagctttatctctggattttcaaattcaaaccaaattattaattaacaagttctgattgtttatgtgaatttaagtttattcaatgaaagagttgactaaagagagaaaaataccagtttgaggcttaagataatgttgaacaagaccctcccccccaaaaaagataatgctaaacaaatttgtaaactctgtaaataatgagtaattttatactttagtcctgcactttcccttcaccacctccttaaaatttctgtaattccaattcttttttttttttttttttttttttaaggcagagtctcactctgtcacccatgctggagtgcagtggcgcaatgtcggctcactgcagcctctgcctcctgggttcaagtgattctcctgcctcagccccccaagcaggtgggattacaggtgcgcaccaccacatctggctaatttttgtatttttaatagagatgagatttcaccatgttggccaggctggtcttaaactcctgacctcaggtgatccacctgcctctgcctcccaaagtgctgagattacaggcctgagccacgacgcctgacctgtaattcctattctttacctcatcatttcactttaaaaataagtacataagctggtttggtttttgtttttatttttttgagacaggatctctctctgtcacccaggtttgagtgcagtgatgcgatcatggctcactgcagcctcgacctcccaggcttaagcaattctcctgcctcagcctcccaaagtgctgagattataggtgtgggccaccgtgcctggcattatacgctggttgttgggcatttggtattctgtgtgtttcccacccttcctcatttttcctatgaattcttgatacagaaatggagatttgtaacacgctggtagtgtctagctagaatttctgggttccattccttcactttttagctgtttgcctttagagagttatttaacttctgtgttcctcagtcttgtcatctggattgttgtgggggttaaattaattcatatatgcaaagcacttacctggcacatagtaaacactaagtgctgttattagtgttcatacatattacatgaagctctaaaaattagaggttaattaagccatttatatagccaatagtttgctgccattgctaccagcataactatttggaagtacataaacctcaggtcctgtgattgcgcgatcgcacttcagcctgggcaacagagcgagactccatctcaaaaaaaaaaaaaatatgggcacttcacctttttgtatcaatgtgtctgtttccaaaacagcaacctgatcacttttaaactaatttagttataaattctacttttatttgggaaaaaatgtttttaagaagagtagactgaaagcaaggcatggtgataggtacctatagtcccagatactgaggaggctgaggcaggaggatcccttcagttcatgaccagcctgggcagtaacgtgagactccatctcttaaaaaaaaagaagaagaagaaagaaagaaaaagagtatacaaaaatattgcccacttgcaataaaaatttaaagcaaaaatggatattaatgatttcaagatgctccactgttgtaaactttgaaaattttccgcaactcaaaggttttattatgtcattaccttggggcatgttctgtatcataacaattttttaagtggttattagctaatattttagatgtgacatgactctttagaaacttttttaaccttttttttttttttgagacagagtctcactctcttgttcaggctggagtacagtggtgcgatctcggctcgctgcacctctgtctccctggttcaagcagttctcctgccctaaggcctcccgagtagcttggattacaggcacgcgccaccacgcccagataatttttgtatttttagtggagacggggtttcaccacgttggccaggatggtctcaatctcctgacctcaggtgatccgcttgcctcagcctcccaatgtgctgggattataggcaagagccactgcacccagcctagaaattttttaaataaattatgcatccacgtttttaaccacctgggagttacccgaatatttttgctctttttattaatttctcactgttgtcttgtaaaatgtacagtctaaaagttggatattatttatagtgtactgttttttattttttagataaaaccaccagatcatctagtcaatatatagaatcattttggcagtcatcacaaagtaagtaaagctgtgtttacagtgtcttcctgtgagcttggtcaaatgatgttcctatttttgaagatcctcttttgaaatttaacgtaaatattgaacaagaggaataatgaatgctaaaaaaaaacttatccgatatctctctaccacttgaccttgcttattgagttattattctctatacccaaacctgaatttgaacttaaaaaacaaacaaaaaactactacttcctgtgatttgttgaatgtctttgctagcagtataaatgggttgattgcttttattttaacagactaatgtagtagtttgagcctatttatatgcacttattctaataaggacataaaattttatattagtacaatttcaactctgttgtaaaagtttggaaggatgaataaataagtgataaagcacatgtaataaaaagttaatggcaagcttggttatgggtatataaatattcatttcagtcttacaactgaaaatttttgtgatcaaatattgagaaagtataacaaaaaaagattggaaagtcatataccaaaatgctaataatgatttgcttaagaatcattggtgacatttttttaactttattattttcttttttctttttttgagacaggttttcactctgttacccaggcaagtgtagtggtgccgtcatggttcactgtagcctcgaactcctgggctcaagggatcctcctgcctcagtttcctgagtagctaagactacaggcacgtgctaccatgcccagctaatttttaaattttttgtagagacagagtctcactatcttgctcaggctggtctcaaacttttgggcacaagcattcctcccacatcagcctcccaaaatgctgggattgcaggtgtgaaccattgcgcccagccacctttattattttgttactactgtttttttcttttgacatttttaaatcaagtctcccaaaatctgagttagttattaatcaaccaaaaatatctttgtatgtaaaaatcttcaagaactttttttttcttccacattactttcttttcttaagaaaaaacttttggaaggccaggcgtggtggctcatgcctgtaatcccagcactttgggagaccaaggcaggcggatcactaggtcaagagaccgagaccatcctggccaacatggtgaaaccccgtctctactaaaaatataaaaattagctgggcgtggtggcgcgtgcctgtagtcccagctactcgggaggctgaggcagaagaatggcgtgaacctgagggggcagtgcggagcttgccgtgagccgagattgtgtcactgcactccagcctgggcgacagagtgagaccctgtctcaagaaaaaagaaaaaaagaaaaagcctttggaaatcttttttaaaatcattgtatttctagaattcaattttatattttttattttaatttttaataggttctgggtttgtgactataaaatgagacataaaatgaattagctgctgggaaaaaatcagttgtggaaaattactcttcgaattattttatgtatttgccctattttactccaaatctttgatctttggaaactcttaaatgtatctacccgtataaatgatattatacccatgcagtgagatactatttagtctggggacggtggctcacacctgtaatcccagcactgtgggaggccaaggcaggtggatcacttgaggccaggagtttgagaccagcctggccaacatggtgaaaccccgtctctgctaaaaatacaaaaattaaccacgtatggtgataggtgcctgtaatcccagctacttgggaggctgaggcaggagaatcgcttgaacccaacaggcaacggcggcagtgaactgggattgcaccactgcactccagcctgggtgacagggcaagactccatctcaaaaaaaaagaaatactatttagaaatgaaaaatgagttagttcattgtatcctaatgaaaagttgatcaagatatatttcattgactttaagatactattgattttatgtatcaatgagaaagaaaaaccatccagttaaactatgccataccattaattaaaagatatatctgtagatcaaagggcattttttaaaaagtatgtcttagaatttgatgaaaatattaaaacgtatgtatccacttttttaaaagtatatttttagtataggctgaaaacaaagctgagagaatatctgtcttatttaccataatatttctatgttcaatgttttgcacatagtagatacttaacagatagatattcatgaatttttaaattaagcatttctagaatggcccctttttttaaacagctagcacatgtttgtattcagaaaaagttgaaaataaataaatgtaaatcgatacttgtatttatcatcaaagagtaactcattttctcagggcagatttgaaaatttaccttgttataattgtaatgtcattttttagtcatcccattgtgtcattttacagttatccttaaataccacctcaaaacctgaagtagcatgttttacttcatagctactttgcaatgtccataaatctgcatagatagtacataccatttctttatggtatggtatgtggtatatgatatggactgcctggatttgtatctcagcccaactacttttagatatataattttggaaaaattaccaattttggttcccccccccccttttttttttttgagacagagtctcgctctgtcgcccaggcaggagtgcagtggtgtgatctcagctcactgcaagctccgcctcccaggttcacgcccttcttctgcctcagcctcccgagtagctgggactacaggcgcccaccaccacgcctggctaattttttatatatttagtagagacggggtttcaccgtgttagccaggatggtctcgatctcctgacctcatgatccacctgccttggcctcccaaagtgctaggattacaggcatgagccaccgcatccagctgattttcccttatttataaaatacgaacagtaatagcatctaccacataagaattaagcaaaattggctgggcatggtggctcatgcctgtaatcccagcactttgggagggcgaggcaggcagagcatttgaggtcaggaatttgagaccagcctggccaacatggtgaaaccctggtcaggagtttgagaccagcctggccaacatggggaaaccctgtctctactaaaaagacaaaaaatttggtcaggcatggtggtgcacacctgtaatcccaagtacttgggaaggtgaggcaggagaatatcttgaacctgggaagcggaggttgcagtgagctgagattgtgccactgcattccagcctgggtgacagagtcagaccctgtctcaaaaaaaaaaaaaaaaaaagaattaaacaaaattatacttgatatatatgactatatgtagtttttattttgatggtactgatcctaaactaactccttattgttgcccaattcctaaacattttgaagtttagaaatgagggggaaagaaatacacacacactttatatatatatatatatatatatatgtatatatatgtatatatatagtatatgtatgttttttatatatatatactttatatatttatatgcttggaattgatgagagaatgttttttgtctgttgtttgtttttagtatccacagtaaacaagcaaaatgtctgtgcaacatcttttttgttgttattttcaagtattctatgaccttatccctgttttctgtttcaggtcaaaacttcacagctcatgataagcaaccttcagtgctaagtaagtagttggttgtctgctcttttttcagccaatcaattcttttctctttttttttttttttttttttgagacgatgtcttgctctgtcgcccaggctggagtgcaatctgggctcattgcaagctccacctcctgggttcacgcgattctcctgcctccgcctcccaagtagctgggactacaggcgcccgccaccacgcccggctaattttttgtatttttagtagagacggtgtttcactgtgttagccaggatggtcttgatctcctgacctcatgatccacctgcctcggcctcccaaagtgctggaattacaggtgtgagccaccgcacccagcctcagtcaatcaattctaaccttgccttattctcccaacaaaagttgtaataagattttaagtcattttacccctctttacctttttaattcaccacggattggtactacctataataattactctgtgatatggaaatgtgttcagggctattttaccacaagtaatttgtattatgtgataatatatttatttgctacctgctttgctgtaggaagtggttcatcctcactgatacgatcctttgaaattatcttttacttataaaactattgcttttattgttttcttcccctactttattttgtctttctgatagattaattttataacactggaatatggtataaactttcaaagtatgggaaattatcttttgatatatgtatttgcttcaggctcaggatatcaaaaaactccccaggaatgggccccacaaactgcaagaataaggaccaggatgcaaagtaagtagataaatctctgttattgaaataatcttgtgtatttgctatgtttttcttgacaaaaatatttagttcttcagataaacatttaggttgtttgtgatttcactaataaagtacagctatgattactagtttagtaatttcttggactggcagcacatgggctgggtgtagaatgtaaatagtggcgtgagaaaaccagagattggccaggtgcggtggctcacgcctgtaatcccagcactttgggaggccgaggtgggtggatcacgaggtcaggagatcgagaccatcctggctaacacggtgaaacctcgtctctactaaaaatatttaaaaaagaaaaattagctgggcgtggcggcgggaggctactcgggaggctgaagcaggagaatggtgtgaacccaggaggcggagcttgcagtgagccaagattgcaccactgcactccagcctgggcgacagagcgagactccatctgaaaaaaagaaaaaaaaagagaaaaccagagattgatggattttaacaagctgtcagttatagcagcaatacagtctgtatacaataatgaaattctactcttttgacaatacttattttttgcttttagcagattttggaacagctttgtatactcataattttacataataaaggctgaaatgcacaagttatattttcatgtttagggttttttttctgttttttgttttgttttgttttgttttgttttgttttgttttgtttttgagatggagtcttgctgtgttgcccaggctggagtacagtggtgcaacctcagttcactgcaacctctgcctcccgggttcaagcaattctcctgcctcagcctcccaagtagccaggactacaggcgcgtaccaccacacccagctaatttttgtattgttacacgcctggctaatttttatatttttagtagagacagggtttcaccatattggtcaggctggtcttgaactcctgacctcatgatctgcctgccttggcctccctgaatgctgggattacaggcttgagccactgcgcccagcctttctgggtttttgggggtgttttgttttgttttgggttttttttgagatgaagtctccctctgtcgcccaggttggagtgcagtggcacaatctcagctcactgcagcctccgcctcccacattcaggtcattcttgtgccttagcctcctaagtagctgggacttgcatgcatgcgccaccatgcccagctaatatttgtacttttagtagagacggggtttcgccatgttggccaggttggtcttgaactgctgacctcaagtgatccgcctgcttcagcctcccaaagtgttgggattacaggcatgagccaccacacccagcctcatgtttaggttttggatggattaaatgtcacagaatttaaggaatactataaattgatgtgataaaaccatcgtactttgaactcactttctataatttctatggaaatgcgtccacgttaaatctcgaccatatttttttaaagtccatgcatattctctgccttaagtgacctttaacctccctactttactcatctaaccacaataggtcttgaggtcatcaggtattctcttacttttatttaggtaatgtaaaaatccacatcttatatctcttgctcatgggatgattaactgtaattggaccaaatgacatgcgtggctctgcttttccatcagtaaagtaggagtggtcataattcattttttctcagcagtgacgtttttagcccacatgtaagtgagttcttaagcagtctagaaccgaaataactttttgcccttgtcttactgttggttgtcatttcttattgctgtgattatgtgcctgctattagaaaaccatttcctcttataatttgctcttcctgacctattatagttaggaaaccaaacattaattattcagcttattagaattatgtttataaccaggatcaaacattaaaattaaatttgaagacccaagagatactcttggatgtaaaaatgcatgagttttagtgtatataatgtgaaaagctcagaggcatcttgtgtcatttcttagttcttaactgtacattctgagtaattaatatcagataaatgacttccagataagtgaagttagtacatacttatcagaaaatctttgcataattttttcctctaataagacactgcaatagagaaggaaacataattatattgaacatctaatagaaatgcagaaatagatctttttagttgctaaattgatagctaatttttagtattttatctgtttgcatttctactttgtcttaagttactatgtttattatggcttacagaattatacattggttgctaaccacctaccatatatagataaccacattgagctttcagagttatgtaacagtaacacaccagaagtgtgcatgtaataggatcttttagactttcaaccacatgaggactttaagatagaacgatgagcaagaagaaaatattttcaatggaagtggaagactacagtgatttttcaaacactgttatataatagattcctcttcaagaatattaaaaaaatgttttcctagcattccacattttatctctcattctttaactatatatttctgcccgctttggtgaggaaaaaaaagtcatttttagagctgagtgttcaagaaccttaggctatagattctaccccatggaacattgtcacccgacgttagcaacagtttcctgtagacaggtcccagttcaggcttctgcctgcatccaaaccttttaggaaagatggaaccactgtctttactttttcctgtttgccaggtgataaaacaatgattatagagaagaatatatgtgcatggagaggtcagagaactaatataaatgttttggaacctgtctcagaaatttagatagagaaaagaagacaatttggagttaaagctcttgagctccagtcctagctcttccacttactaattgagtaatcttggtaaaatcacttaacctttgtgaacctcaattttcttgcctttagagacagtagtgcctataactagattattgtaatgagcttatatgtgtaaacacaattttttaaagtctaaaatctcataattatcagggcttatttattgttaatgttttctgtagaatcaatagcaactatggaggatttgtgccctctactcttgatggttgtagagtgattgattatcaccatactctttagactagaaaagcttgagttttttctttttctttttttctttttttttttcttttttcttttttttcttttttttttcttttttcttttttcttttttttgaaacggtcttgctctgttgcctaggctggagtgcagtggcgtgatctcagctcactgcaacctctgcctcctgggttcaagcgattctcattcatgcctcagcttcccaagtagctggtggtgcaccaatacacccagctaatttttgtattttagtagagacagggtttcaccatgttggccaggctggtctcaaactcctgacctcaggtgatccacccacctcgacctcccaaagtgttgggattacaggcttgagccactgcgcccagctgagttttttcttttaaaaagatgttttttagaattgttgttagcatctctagtaatgttgataaaaaggatagcagttatactttggacaatgtcctgccttggcagtatataccctgctgtgtatgtgtttgtgttatatgaattatataaatattatatatggtacataattattatttagctgtccttcatcattaacatcatagaattgcacttcacagcatttttgtatatattatctcatttgatctttgcaaccatggagtgaagtattcaaaataaacattatctgatggatttgggtttcatgtggttaggtatttttattgttattttagttgtaacttcgataacctaacttagaagcttctaaataatgaaatatcctaagctaaactagtaattgaaaaacagtattcctcttacagttgctgtcattttgtcttactacatcattatggagttttttgtcatatgatcaaaaataaggctatttctgaatcttagcagggctaatattattcctccagttattccagtgtttctcaaatgaaagttgttgatataacgctaagaagatccaccaggaagttcatttatatatacaaaagttataaaactccaggcaagtgatagacggcaatactggtaatataggtcatacaaatgagataactcagcctctccaccttctgaagcctgtccttccatttcctctcttagattttaaaacctgctggtatgctaagaaagatggaagggaaagggaagggttaggatcatttttaatttcttttcttgtttttaatttttttttttttttttagagatggggtctcacaatgttgcccaggctggccttaaactcctgtgctcaagctgtcctgtcacctcagcctcttgatttgtcggaattacaggcatgaaccactgtgcccggcttaatttattttctaaatagatttagatgaaagtagaaatttgacagagttgagagaaaattatttttgagctctattgtttaaccacaagcctaaaacagaattactttattacttgtctattaacagaaatgatgagaagtttttaaatgtgattttaaaatactactagtatttgaaatggtcagaatccccagaggaaatactgaatcagtttgaggtagaaaatagtgaggattaagatttttatattaaaacaccttatccagacagctcagtagtctgtaatccacattttgtccttattttccccctctttacagcatcttcaccaggcaagagttcaatatatggcagtttttcagatggtataatatgtttcattttattatggtgtgcttagtttctttgtcctttttatcccggaagtttcaccaatcccattagatacttaatgggtcaaatacttccaaactttctctcaaaactaattattgtgtgctttgtactagaccccaccatatgctgtgaaaagctatgaaagaaataggtcatgtgtttcaaggagctctcagtctaatcggcactcagatattctactttttcttctgcttctggctgatctctgtcttctttttttcctggtggaatttgtatcttctttgtctactagaaataaatactcaaattatgaagcataagttgatagtcttattttattactctcaccattagatgacagcattctgaaatcagagcttggaaaccagtcaccatcaacctccagccgacgtaagtttatgtattcagtttttattaaatatttctgtaaaattggtattccataattgtttaaaaatgttttttgacagcagtatgactcgatgctatttgaagaatcacattttaagcacttgagaggaaaaagtatatattctactagcagtgaaattctttatagacaaactttatgagacaacatctggtattgctcttcacttaactgtctataagaccaaaaataatagctaaaataagtaaagctactaatactgttaactgagaaaaccatgctgaattgaaagaaagttagccagagcatgactttatgggattacaatggctttcggagtctgcaaacctgtatttgaactagattggaccacttacctcctttacagccttgtggcaagtttctttagttctccaagtcttattgtcctgaaagagtactaagaaaataacttaatgggctgagcgtggtggctcatgcctgtaatctcagcactttgggaggccaaggcaggcggatcatgagatcaagagatcgaaaccatcctggccaacatggtgaaaccccatctctactaaaaatacaaaaattagctgggcgtggtggcacacgcctgttgtcccacctactcaggaggctgaggcaggagaatcacttgaacccaggaagcggaggttgcagtgagccgagattgtgccactgcactccagcctggcaacagagcgagactctgtctcaaaaaaaaaaaaaaaagaaaatagattaatgatgattctgaaattttttgttcttggtaccgctttacactagtaaagttattaagaacctcaaagagctttttgttgaaaatatgggttatgtctatccatatgtaccaggaaattaaagttgaaacattttttaaaatatgtattaatttattttaaaataatttagcaagaagagtaacagatcagattgctttgcattttttctaatctctttaatgcctagctttaaaaaatggatttggattatcatatatgcttctgtatgcagtctgttacaatatattatttttgttgaagtatctacaaaaaatccagcttttatacagatatgaaaaattttaatagcctcttcagataattgtggctattcttttttgaactctccaaaactcaacaagtggtagtttcttaaatgttacttgaaataggatatctaaaaccatcttactgagcttttagtactctattacattaaaagtcattggtctttcttatactttgaatggagtatcatgcactggtcatttggaaaacattggttcactgaggaatgcagattttccaaacattgacacattaggaatgtaataaaaaatatcacatttgttaacatcactgccaatctcaagactttaaaaaagtgttaaagggtggggttcgtggcccatgcctgtaatcccaacattttgggaggcccaggcggatggatcacctgaggtcaggagttcaagaccagcctggccaacatggcaaaaccctgtctctactagaaatacaaaaacattagctgggaatggtggcacgcacctgtaatcccagctacttaggaggctgaggcaggagaatcacttgaacctgggaggcagaggttgcagtgagccaagatcgcaccacttcatgtcatcctgggccacagagcgagactccatctcagaaaaaaaaaagaaagtgttaaagtacaatattgggagttgtcaagctcatggtggcagatttaggattctaaaatcctaattttcacttgaaagcaaatatctgccaaatacacaagtctgactgtagtttgttacttgttctttcaagtaaaaaatagtattccatgaaaaatgtgctaattcgccttgtaattcatttgcacaaaattcttttccttgagacaaccatggtactgtatgatgcagcagaagtgctttgtgcataccttccatttgttcagaaagaatattgacatatgtactcaaggattcagatttaataagataaataattaactgcttcataaaggacattcttaagtaaaagaatgtccctttgttaaatcttgaatgcatggcagtgaaaaataacaatgactacactcgtacagtttggtgccactgccctgtaactcatgctaaggcatcagaagtttttctcaccatagcttttgcgtcatcagtgcaaatgtcaacacaaggtgaaagtcaaataacatcttagtgttagaagaatagctttaacttcatggacccccctccccacaaaatagggtcttgaggtaccccacagaccacgccttgagaattgctgctctaaaaggtccctactaaaattaatagcctgaaacagtcaataagtaaaagatgtaaaagtattattgttactatcaactgaataaatgaagtagaatatgagaaagtactttataaaccgaaaagcactagataaatataaattaatcctattattattgccaatagtaactagggatgagtcacaaactaaattttaccagtgttaacttgcataccacaaaaggcatcagtgaaattaatctaaagggacagctagctattataacacgtagaagatgttcatttatattgcatccttttctttttttttttttttttttttgagatggaatctctctctgtcacccaggctggagtgcagtggcgtgatctcggctcactgcaacctccgcctcccgtgttcaagtgattctcctgcctcagcctcccaagtagctggactacaggtgtgtgccaccacacccagctagttttttgtattttcagtagagacggggtttcacagtctcgatctcctgacctcgtgatcctccctcctcggcctcccaaagtgctgggactacaggcatgagccaccacttccagcctgcatccttttctttatccctttatgtacttcagaaatatttcaccttgaataattagccatgtgaatgctgagttactaaattaaaaaaatattttataaattgtattttaatagtctattctcccaactattagcagtgaaaataataacttcgctttataaactattatttttctgacttgtttatgccatttcatatgtttaaaaacttttttcctcaaagacttatttttatattgaagagacatatgcatatttgtacacataattcaaagcctatgcatgtaagattttcttgagaatgtgataaattattttattaagaaaattatcagctttcttctttaaagtccttcctcttttacctaatgtttataaagactgatattgattttaaaagtcacttgcccctgaatctaagaaagtggtatttatatctgtcatttcttttttgtctgagtagaagtgactggacaaccccaaaatgcatcttttgtcaagaggaaccggtggtggctacttcctctgatagctgctcttgcctctgggagtttttggttctttagtactcctgaggtagaaaccactgctgttcaagagttccagaaccagatgaatcaacttaagaataagtaccaaggtcaagatgagaagctgtggaaaaggagccaaacattcctggaaaaacatcttaatagctcccatcctcggtctcagcctgctatcttactgctcactgctgcccgagatgctgaagaagcacttaggtgtctgagtgaacaaattgctgatgcctattcttcttttcgtagtgtccgtgccatccggattgatgggacagataaagctactcaagacagtgatactgtcaaactagaggtagaccaagaactgagcaatggatttaagaatggccagaatgcagctgtggtacaccgctttgagtcatttcccgcaggctctactttgatcttctacaaatattgtgaccatgaaaacgcggccttcaaagatgtagccttagtcctgactgtcttattggaggaagagacacttggaacaagtctaggcctaaaggaagttgaagaaaaagtaagagattttcttaaagtcaagttcaccaattctaacacacccaactcctacaatcatatggacccagacaaactgaatggcctctggagccgtatttctcacttagttctgcctgtgcaacctgaaaatgccctgaaaaggggcatctgcttataagaagtgagagagaagaaaaatcatgtcccaagttctgagaattgttcacactttctaaccagagacagaattcagagctctttttgaaagaactagtttctttttaaagaagttaagtgcttacataaacatggaacatataaatcattcattcaacctaattatctgtgatatgagagaatcatttcagtttccattgagagctctgttaaaggtatcttaggagtgcagattatatgcagttccttagagaatctgttttgattctgggctgagttattacagttatggtatgaccagtgagagggatttgtgtcctttcttatgaaccttcctgattttttaacttagatttctcactaagtttcctgagttattagtaagattgctccctaaatgtaaccagggattttcccattatgttcccttttataccatttaggtgtgagttccttagcttctgcctataggaacataagtaatgaaaggtcatctaggtgtgtgtttggaatttttttcttttgttttttggaaaatggaaagaacaaggcaaggaaggaaaattaatggggaagctgaagggaggaaatgttacagtaatccactgagatgtagtttagtcaaacataggtatatgaactgttaatcttggtggattccgttgggatttgttttttacatctcctttttccttccttgaagaaaaattcttggctgtcccaaggattcttcatgtatattgcaaaatttaatatatttgttcacttgagtcttaagagtaggtcaggccaaggcaggtggatcacctgaggtcagaagttcaagaccagcctggccaacatggtgaaaccccgtctctactaaaaatacaaaaattagctgggcgtggtggtgcatgcctgaaatcccagctacttgggaggctgaggcaggagaattgcttgaacccgggaggcggaggttgcagtaagccgagaccatgcttattgccctccagtctgggcaacaaaaatgaaactccgtctcaaaaaaaaaaaagtaggtcaattcgtaacagtttattttggacacaccctgaagcttttgttttgaattaagaaatgagtttcaggaattgacaaaccatttgttaaccagctgtcctgggctattgaagaagatttcattttccgcgcatccacttgttgcagtccaagtcctctagtgcaacgccatagcaaatataaagatttactatgcacgtgatacattttatggagtgcctcaagccaagatagtgaatttatatgaagggtgtgaaatgtatttctttactactatagtagtttagttataactttgcatctataattgagctttctcatctgtcaaatgctatggttttcttaaaatgttacaattctagatctatccaccttgtttttttattgtctacaaaccattaaatgtaaatattgtttttagagtcagtcattggctttgtcatttaccctttgagagttccacaagtggtagtagagtggtttaacgtctttcctctagtactaccagtattcataaatgtataccccttactgtaatttgttcctcttagaagtcagatcatctgatttatagaggattatgaaaaccagagtttttgaaaaggcttattttatacatacgtattatatagagaaacaaatgtttttattaaatgtttcattgacccaagtaatttaaaagtaatatgttacctatgtctttcaggaaaaataattatagcagctgatctgtaaatgactttaaaagctattttagtaatttaaataaatttactttcttggtttatactctc

SEQ ID NO: 37699 - DNA, 38035 bp, Homo sapiens; identical to SEQ ID NO: 37698

SEQ ID NO: 37700 - DNA, 4215 bp, Homo sapiens
gccgaatcttagaagtcgcgccactgttgtggcgatggaagaaggcgaagctctacagaaaccattttggttgagggaagagtggttttaaagttaatttggaaaggagccggcaagcaaccttcagtcggtgtgcggtttttacagttgaactgtttccagccgctaattatgattgttttagcggttcgtcatctgaaaactgcattctgcacggcggtggtggggggaggacgaggatggagaagcctgggcggacatatttattagctgcggtcctaagtcacgtgtgacattctgtatccagtctatcggttatcccaaggagaacgccctgccggaatggccaatcgccttgagatgtccccgccctattcgccatcttaacatagggcattccccacagctgcaggcaccagtgaagcgtctaagggaccatcttggttgagggcggaagtgaggactgtgtcgcgctggaggagcccacagattctcccggacccacgtggaagcggcactcaagatggtaggagaatgagctcctgtttcggaggtccggggcgcgtgaagtgctggggatgtggctctggggacttggaggctcagcggctccggggctccggggttccggggctcgggagcgagtagtgagtgactgggcctgctgttcccacagctgcgccgcgaggcccgcctgcgccgcgagtacctgtaccgcaaggcccgggaggaggcgcagcgctcagcccaggagaggaaggagcggctgcggcgcgcgctggaaggtaaggcatcggccccgcgggcgtctgcgtggtaaaccaccccggcacgcatttgtgttcgaatatccgagcgtctttccaaatgcttgccggccgttttccttgcccattgggttctcctgttggttttgagagtgtttcttccgtgtgatggtattaattacttgtcactgacgttgcagtacccgggttttgcagcttgcccgctgtgtgcagtgtgtcaagttcgtcccaagttttaaagactttatcttgtcctgtagaaattctctttagagcggtggctcactgctgtaatcccagcactttgggaggccgaggcgggcggatcatgaggtcaggagttcgagcctgaccaacatggtgaaatctcgtctctactaaacatacaaaaattagccggccgtggtggcacgcgcctgtaatcccagctactcaggaggctgaggcaggagaatcgcttgaacccgggaggcggaggttgcagtgagccgagatcctgccactgcactccagcctgggcaaaaaagcaagactccgtctcaaaaaaaaaaaaaaaaagaaattctctctaaagactatctggatagcgctggtgctgcagactgcgctgcccatcctccctgcaggagttcctctgagctccgtggggaacagtgctggccccgagtgcgcacctggagcgctgtgctctgcggtaggcagcctgtggtccagggcccgctgaagccatgccttcgaagcgctgtgggcatcgtgaccaacggttttgctgtctgagagcttaaaggtctctggtccaccatcatacgtacagaacagtctatatttcttttcaaaagtaatttttaaggccgagcgctgtggctcacgcctgtaatcccagcactttgggaggccgaagcgggtggatcacgaggtcaggagatcgagaccatcctggctaacacggtgaaaccccgtctctactaaaaatataaaaaattagccgggcgccgtggcgggctcctgtagtcccagctactcgccagcctgaggcaggagaatggcgtgaacccaggaagcggagcttgcagtgagccgagatggcaccactgcactgctctgcctgggtgacagagcgagactccgtctcaaaaaaaaaaaaaatcgatgtttagatttctacctgattataaaagcaatacagtacattaagatattttagaaagtcctcaagtcatgagactaaagaaaatgaagtcctagtaaccactgtttatgggggttggcctgtagaaagttttgtcacctctatccatgctttatccaagctcagaaagggctgaggtatttttatttcaagcatgtgcaggctaataagctgtggtgtattggatgagctgaggtctccatgcttgtgactcactcagcccctctctcttccctctgcagaaaaccgcctgattcccactgagttacgccgagaggctctggccttacaggggtccctggagtttgatgatgctggaggtgaaggtaactatacaaggtagccctccccaacactgagctggcaggtctccagtccttcctcagacacaccgggcaccatcccatcagaggaaactgctcctggaactgtcccccatgcccttgtcactgcacagatggcattgcagggctctccctgagtgtgccctgtcccacttacatggcacacatgggagtgcctcactgactctgcacctggcttgttaattacctcccccactggagtgcctgctggggaaagacagtgtccctcacacattattggtgcccatacgtttattcactgcattattcaagaaacaagaaaggaatcccaaacattatagatatttgttacgagggaaaagagtttgtcaccgttggccttagcagagtgtggatttcgttgtgtaatggagtagctgcttagccccatgtgactaatatagcttaagcaaactacaattaaacaaaagattctgtttctcagccacgcttgtgctcagcagccagagtagttggaggctgccctcttgcccggtgtgcatgtggagcattcctattgttgaaggcttcggcagacagcgacatccaggcggtcttggctgccccgaagttagcatttcattcccaagactgtcatgttcttgcccctcgtgctcctgacaggtgtgaccagccacgtggatgatgaataccgatgggcaggagtcgaggatcccaaggttatgatcactacctcccgagaccccagttcccgcctcaagatgtttgcaaaggtactggtgagcagggagtgagggagagacacccaggacacacagccccagtcctgactgtacactgccatccacgcccaggagctgaagctggtgttcccgggcgcccagcgaatgaaccgaggtcgacatgaagtgggggcactggtgcgagcctgcaaagccaacggcgtcaccgatctgctggtcgttcacgagcatcggggcacacctggtaaggccggagggagggagtcggggtgggagccgtctgagggcagacggggtctctgacagccacctttccccgccagtggggctcatcgtcagccacctgccctttggtcctactgcctacttcacgctgtgcaatgtggtcatgcggcatgacatcccagacctgggcaccatgtcggaggccaagccccacctcatcacacacggcttctcctcccgcctgggcaagcgggtgagtctgggggccttcaggctggggctgcgggccaggccaggcatttgccactctgtttccctctctttccttgtgccccaggtctctgacatcctccgatacctatttcccgtgcccaaagatgacagccaccgggtcatcaccttcgcaaaccaggacgactacatatcattccggtgggtccacgggccatgccccaggaaagcatccccaccctgtgtacctcgtgctgcttgccgttgacccacagctgttccctcccaggcaccatgtgtataagaagacagaccaccgcaacgtggagctcactgaggtcgggccccgctttgagctgaagcgtgagtttgaggctgaatcccgtgtctggggtggggaggggaggctggctgtgccggggctgatgccatccctgcctgcagtgtacatgatccgtctgggcacgctggagcaggaggccacagcagacgtggagtggcgctggcacccttacaccaataccgcacgcaagagagtcttcctgagcaccgagtgagcacactcaccactcagtcaggacatggacttggaactcaggatggggctgtcatagacagacccaccagtaggaactgtcacagaatggcctgctgaactgggatgtggaactgtggcgggtggagaggtctgaataaaccgtctgtgtcatggc

SEQ ID NO: 37701 - DNA, 213564 bp, Homo sapiens; identical to SEQ ID NO: 36372

SEQ ID NO: 37702 - DNA, 63299 bp, Homo sapiens
cgcagtcggggggaggcggcggcagcggcagcggctgcgggcagcgcgcggggcgcagggcgcggggcgatcaccgtcggggctcgggaggcgggcagtgggcacaggctccccggtgcccgcccctccgctgcggaggggggccgcgagcgggcggccggggaggggccggcaccgccgccacaaaatgagcctgctgtcggccatcgacacgagcgccgcctcggtgtaccagcccgcccagctgctcaactgggtctacctgtcgctgcaggacacgcaccaggctagcgccttcgatgccttccggcccgagccgaccgccggcgccgcacccccggagctggccttcggcaagggccgccccgagcagctgggctcgcccctgcactccagctatctcaacagcttcttccagctgcagcgcggagaggtgggtgcccccgcgcgcccccgcccaccgccccaccgccccaccgccccaccgtggcgggccgttccctgtctgacccgctcttcctggcctggcgcggcccggctccgcattgccgggcccggcttggcttggcttcgttcaactctgccaaactcgccgcccgaagtccccggggtgccgggtgcgcgtcacctcccggctgagcccgggctggagcaatgcaggccggggcggagctctcccgccccctctccctgccagggcagccctgctccaaaggggttgggggagggagttgaggaggggttgtctccggattttcttcagacagctggggtgcggcctgggcggggagccccttcgaagtgtccttctcacgcccaaccttatcctcgtcctggccaccgcgggctgggaccgagagtgcagattctgctcggagctcctctggaagggcctaaaatcttttctccgacctctgcggttcccgacccgaaaggcaccctggagagcagtgactgcccagagggcttctcctgctgttctcactcggggaccccagatacgtcctccagctgctcgccctcccccagccacataggaagtggtttctgagggcttgaccccacagactgcgctgtccccagccctcccagcctcgaaggaaatgaaagggaaatcctcttgagctcttgggaggggggctagaaagggggggggagaggttccagctgcccagcgccttctgcagaaacctgggccggctgtgttgcaaagtctgcctgtttggtggattcagttacaaagttgactgggcagcgcctctttgccagcaagataaatacacagatcgccaccacctcccagccctttttgaagagtctccagggcctgcccagataccactcctttccgtgggctggactcctcccctccctccatttactcctgcctcatttgggaatttcagacacccatctgtggccttcacttcctccccttgtgggggttttctctgcaaagatgcaagaggtgtgttcgggggaggacacacatgggggtcactttccttccagacctgggcacaccggtgagttttaggagagtcagagtcctgaatgggttggggaggaaagcctatgtacgcaagggtgtgctgggggtaagagagggaggcagagggtcgcccttgagttcaactctgccattatttactaggggaggcatggacatataaaatgctggcccaaggccaacactacccaggctgacctgttgacctgggtgggtagaacaggcgtgggagggggctgggtgcagaggaggaagatgagtctgaaagtgcaccctttggtgtcaggcaaaagcatttctatgccaaagctctttgtaaactgtaaagcattctctccacgtgaggaatggttcttggctggggatctttctttcttgtaagagacttttctgcctcttcagggaattggcttcaggtgaccagtgactggaggaccgtttgtggggtgtttctttggtgcatgcgtcttttcagttgtttgttctcttaccaaacatttgttgagctctgggcaggacccggggattcacagccacaggctagtgggggccacggatgagtaaacagacaaggtgatagagggtatgaatggtgggtgatttgatgggggtgcttgtgggagccccacgggagtttctcaccctgggagaagggtgaacatgacccacaggtcaagtgtggacccctaatcaacctcttctagcctccctctgctccccctaccatggtggcattgttccccacctgtgggtctcccctgagaggacctgggagtttggaaccatcaagagtaccctataagaataggatgttgtgctgctttttgaaaatttctggcatccaggatcccaaccggagctcagtgagaactgccctctgtcacttcattgctgcgtacctcagtttccccataaagtcacacagtgtgaaaggagcaggaaaaggttatactgtatagtgcagtggtggggaaatgtctttcacaacctgacttcagggaaccccgtctctctctgggccttagcttacctatctgttaaatttagtctctgctacaccccaggatggtatatctatagtatttgagacctgttcaaacaagagagggctgggggagtcaagaggggcttctctgatgttcacaggccagtggcttcctcggaggtgatggagggctgtgcctgctgacttccggaaggctctcttggcttcaggctcactcatcctcaccccccacccactttgcctcctaaaccctctcaaagcctcagctgtgttcctgaggacaggcctttcctgcgcccagggcttagctggtgacctaatatggctccaaaatagcaactggctgagaaggcaagaaaaaataccccccaccccaatgccaccaaggggctggtcggagaggaagcaagtcgtgtgtgggccggaggggactctacggagggacccagggggcccaggagcatcaccattctgtgcgaggcctggcaggcccagtggcagtgcctgcggatgtgacttgcatgctgaccactgaccacggcctgtctgcgccaacccctgtgccaagagcccaccccctcctgcaccacccccaggctgctcccaccacaatagcaaaacaccatgaatgcagctgggatttgagggggggtgaggacatgggggcacagaagcccattgtgcccctggaacctcagctctggaagctgaagataagccaacggttctgagtggcacactggccctgagagcagagagagagatggcagagttcacaccagagttcctggtgcaggagcaagcaccaggaggtgacttggattcttgtggggacttcccagcttgtggtgagggtgccaggccaaagcggacacaagcaccttgcacagtttcttaaaaggcttctgggtctacaaactaggccccgtgaaacccagtttcaaaaacctgatctacggcaacaacgatacatttttggaaagggattcctaaggcccttggctgagccccttctctctctccaggtacccaaggaaggcagttcttagatggagtaggggctgggctgcatggggtcttccctgccaagtcttgtttggaacttaaattcacaaccgtaaaggggctatgggagtcatttctggaaaagctgagttacctccttgtgaagatggcctcttgggccccttgaagggctgcccagagcccctgccaggtagtccctgtaccctccagcctccagggagatgtggctgtctcactccattcaggtagaattcttagggcagctgttctctttccctctttctccagggacagacgtagctggaaggtgtggccctactgtcaagagacccccactttgtgaatgttgggggagggactttgtggtcaaatacatttggaagacacagtgtccttcctttcccttggaaacacacagtgcccactagcacaggaaaggccctgagaactcctgcagtgcaaaacctgttaacctttcttcagcttgacagttcccacacctatttgagcagagaacatttttggctcaggacacctgtcagtgtccttcctggaaaacctcttcattgttggatagttccaacctttaggaagctcttcctagagcatcagcctctgcagcaatgaacctcctctttgctgctcaggtctacccattggaggtttgagaacagtagcaagggtgtcacaaggcttaacaaatggcctttccctgggcccagcccttctgtatggacatggccattaaaacccttagaggagtacatacagtgtcctcctttaaaaggccccagtcttgacagttttccgagggtttggatgtgccctcaacagacggagataagcccacgggctgcctgaccagtgtggatgtgtggaacaaagccacatttctgcccaagaatatgaggtgcctatgttcgagagtgggcttaaggagctcaggtgggttcccagcagcctttgtggtgtgtgtgtgtgtgtgtgtgtgtgtgtgtgtgtgtgtttagggggcagctccagggcctgagagtaatggccattctatcccagcccagagttcgggaggatgctcccagctctcttggccacccttgggaagctgaagtgtgactcaggcaaggaggaccgtcatttgagaagctgttggctgaggcaacctgaccctccctctgtcagattacgttgactggacaggcatggactcagagggaagaccacacctcgtggaccttctgagtcaggtgggagggaggaaagcagacagcattagtaatcagtaagtggcagcagcagggagccagatgctgtcagtacccagaggagggctccgggaggagatggccctagtggaacagtcctctgctcttgggtggtgctctattcatggcctctctttcctcatagcttccattttttgcagaagaggacacagaggcctggcaagtcacctagccagtcagtgggagagctagatctagaattcttctgtgttccagctacgggttgcatctgcgacccgtcctgcaattggtccccagatttgctctcccctggatcagcctctgggtcccagtgagggcaggcagcaatccgtctggacggggccatcctatcaagcctcagtgcctccgacattttgtccctggtcctcaaactttctggaattgctgagtactggtcatgagtactgggtttcctaccatgtccctgttccagccactccccatcaacccagcatgggggcatgagtccagggctggcctgctttaggagaaggagagaagatgggcactgagcactttctactgcttctgcacccatatcctagtctgtgtgcagcatccgcattgtctggatggggaaactaaggctcttctaaagaaagacaatgcattcagggaatcagaggcagaaccaagactccagcctaggtctcaggtcctagatctgttgtgtgtgtgtgtgtgtgtgtcgtggtggtggtggtggcatgtgattctttattcagccctcctctggccatactggtctacttggggtttttgaaaacatcaagcactccccctcctctaagcccctgcacttgctattgctgctacctaaaatgccattccctgcccttgtacatggacacattccaactggcttctttatgacacaaatggatgtcctttctctgaggggttttacttggctgccactgggagcagacctctttccagctgctgtgagcctgtgaaagatgagttgtaggtgctctggtaaagcatgtctttttttttttttttttgatggagtctggctctgtcacctaggttggagtgcagtggcacaatctctgctcactgcaacctccacctccccccaggttcaagagattctcctgcctcagcctccccaatagctgggattacaggcgcctgccaccacacctggctaattttttgtaaagcatgtctgaaggattggtcttgttctgtaatagcaatatgtgtgtctgtctcagtagttagattgtcagcaccctgagagtaggaatcttgtcttttctacttagtagtcctggcatctggttcttagcgtgcaggacatgctagctgcttagttaatgttttctacgtgggtgggtgtcttgaattgtaacctcccctcctcccttccacctcctgacttgtgagcatgtaagtactctcctgagcctcttcaccttttgttttgtctcacagaaaaaaatatgtatcgatttcttgattcattggaatgagctgacttgggagatagtgaaaccttgtcccctacaagtgtttcagcagaggcttgggtatgctgatgaatggtccttgaccttctttggttagggacctctttgagaatctgaagacaactagagtttctgctgccagcacaaggcacagaacataagcatgcgtgcacatgcatatacacatgtttgcatgtgatttcagtgggatcacacacaccttcatgcccacagtggatcacagatcaaggatccctgcaatggaggctgcaagcctcagtggtactccagacagagtacagtctagctaaatatgcgggtcctttccagtcctgggattctcatattcttgctctctgctttcattcaacaaatatgctctagcagtaagaggcagcccggtccccagtgcttacacactagctgggcagagggcttatagctgtgaaacgtgagcacctgtcaggtgagtggtgaccctgggctggagctgttggaaccaaggaggaaagggatctccccaggtctcctctgctttgtcctgctggcactgtctgctccccctttcctgggtcctttccctatttctctctgcccactcccccaccaaaaataacctagacttgtgatttaaataagaatcttttgctaagcactgactgtgtccagggaactgtgttttacatttgctgggtgaatgggcctccaggaggcagtggtgccctctggagtcctgggtgaagggttgctgtgcctgtcgtggccagcccagcactgtcctggcccatgggtcagctttagacctgggaaacaaacagagccaggggctgagcacagctgaaaaccctcagtcaaggtgtggccatgttttcccattggctcgcttcccgccttgcccacgggctatctccttgtctccctgagaccggctggtgtccacctctgtatatatcggacatgtatgtgtttgaccagccgcagatagatgcctggggtggaggaagtacagatccccttgggagcagggtggattcatttgcgagatgaatgatctcttgtcccaaacagaggagtgtgggtgcgtgtgtgtgtgcgcgtgtctgtggggtggagtaggggtggctttgggataagaaagcggttgttcagctgatgaaaggaacccctacagagctagggactcgaatcagagttcctcctccggggccttctcaggcctggggagcaggactcagcccttgcttctgccgtgcctggtagcctggcccagacgctgccttttccatggtctcactgtggccatgtccttcccagcacatgctgctccccatcctgcctgctgtcactgcctctcctatctgtctcttgtcctgtttctgtgccctctcttctccctctgggctgccctctgcagcttctaccctcctgccctaactcctgctacccctcacctgctgtgcctacctactgtcctgcagggaaggaagaaaagagaagaagtccctcttgtcaggcttgctccggggagaactggagtcagccttggaaatctctgtctctgcaccccgtattctgcagcagaaccaccatgcccagggcctgcacccctcatgcagcgcagagacactggtccttcatcttgccagggccgaggggcctagcatatgatgtcacagggcctctgtgccaagtagagtggtccgcacctggcattttcctctgactccccttcctataggggaggtcaagccttggaggccatgtagaggctgaaatataacagggcaacacgtgctggctgcgttaccttgggcaaatcgctcagcctctctgagcctcagtttctagctctataaaatggggccaataatgcccatttgaatagtattcttgccaggtaagaggggactaagaaaggtaaaagatttagtcaaatatatgacacaccgcatgatcagagtaaaccacaggccgagcacggtgactcatgcctgtaatcccagcattttgggaggctgaggcaggcagatcccttgagcccaggagtttgagacctgcctgggcaacatggtgaaacctcatctctacaaataataaatacaaaaaatcagccagccgtggtgccatgtacctgttgtcttagctacttgagaggctgaggtgggagaatcacctgagcccaggaagtctaggctgcagtgagctgtgattgtgccactgcactccagcctgggtgacagagtaagaacagtaagaccctgtctcaaaaaaaaagtaaactataacgtcttcccaccttcctttccccaacagccaagcaaaaaccttggagaagttccagcactgggcaggagtgtgatgcatggtcccccagatgcggtgtgagggtcacatccttcctgctacctgctggggtcactgacctagggaggaaagagaggtggcctcttccctaagcctggtgatctgggcctagatggcccaggggcttccacttaccccataagtggctttgccctgcaccagtgcccagagcagcctaatctaaggtgggagtgcccctccactcggcccatggaaatgagaccgctagggcatctgttaccctatctgtcaattgggcaggcccttccctgctggtgaccatcgcacccagggcaggctgtggggcaatggagggttgcagaacctttgtcttcagggatgtccagccttgtgggagaggtgaggaggcctcacacacggggagagattagagagcgacttcagagctccattggtcactcaggcggggctgcgccatgatccctgcgccccctcctgccaaccgcagtgctgactgggctacgctggggtgggagaggtcagcaaggcctctggtgggagtcggggcctctatggccgggggtgcttcaggagcacctggatctgtgcttttcatgcttttccttggagcctgaggcctgagtaaggggaaaggatgaggtcaaggccacaaccctggagttagagcccgatctggagccaggccctggaggggttctggatggacatagagaagggcattcccaggctgaggcagcaagtgtgggctggagggagaaaggcagagctgcgcggtgggcatggtgagaggagcagggttagggctgacagatgaaggcttttagggccaccttgcactccagccacagaaggaaggccacagaacagatggtgcctgtgtcggcctctgcatgccaggctccaggggcgtctctcaggacccgggtgtctggaccctaggaaagcaggaccacagggatcagcaaggtcacccttcttcccccttccccgctccattttacactgtacagatgggaaacccaagaggccaagccccagctccgagcaggagggggatagagctctgggtcctggcctctgttccatccagtccccacaggctgtggaaacaaccaggagactgatttgcctttcacctccctggcctgagctcaaacggggcctcagagaggaagcagctcactgcctcacccacccttcacactggccagccaagcaggatttctggccctggggcctggctgggtaccctggtctgcgtccctgtgcccctgtgggcctcagtttccccatctttcatgtgggaatgaggtagggtcagctgacggtctctaccctttcggctctaaggtagcgttcgtctggaattagggctgggggatgggccctaattccctggagacaggctggagggcactagaggtgggaaggccatgaggaggggaagctctggcctcacttctctcactgtggagctgcctggggcaggggcaaggctgcggccctccagagggtggggtgtcgagctgccaaggagagggcacccgcttagaggcctctggctgcccagggatgcctgtggggccgtccgtgggcaggggactgtggccgcaagatgggggagaggtttttcagggtgtaattagtgcactttctggcacccaccaaacttccccttcctcttgacaatttgctgccaaacagcctgattcctgtggacttgcttaaatcttatccaggggaaaaaaaataaaaataaaaaaaaaagaaagaaagaaaggaagaaaaagaaaaaaatattaagagggttgttatttgtgaaattgtgtttcccagccatgagggtgagtcacaccatttggggcttcaagtttcttgtttggatgaacttttctctgggaggctggggcggatttggagggggagggggccttctggtgtggggaaagtcttcgagtcaagataaggggagaccctggtggttgggaagtccaggtgctccaaggctgggtggggctgggctggttgtacctgaattgcctgggggagcttgaaaaatacagattgggctgcagtaggcgggggcgttgttgtttcacgggcatggagtttcagtttgagaagatgaaaaagttctggagctggacggtggcgatggctgcacaacagcatgaatgctcttaatgccactcaactgtacacttaaaaatcattgaaatggtcaattttgttgtgtatattttgccgcacacctaaaaatacagatttcgggccctcgattccaggtggctgctttggtaggtctgaggtggggcccagaaaactgtttgttataagcttcccaggtcattcaatacaggttggggcacactcatgtaatctgtaaaatgggatagtgactcatagagttgtgggcagaatcagctatctgaatacgtgtaaaatttccagtgctggggtcacagtaagagcttggtctgtgtcactgttatcctgtgatgtggtttttatcagaactctcccccatgccgtggaaggttgacccccattggctcccacagctccagggacgggggaccctctgcttctcaaggtggactgctccatcttggattcatctgagagctggagtgcccatcaggctgaacgcaggtcaatgtggaatcttccactggtcctggatttggtggtcgggccaggcagtgatacagaagttacagtcagttggacccattgaaatccttcccagtcactataggtgactgtgtgctgggctggcctgcccccgatgtggtgtctgtgtctttccttccgcatcccaggctctgatccagatgcacacgagacggaacagagtcccagaaggaaagggctgtggtcacacagccgtgtgtcctgaggcaccaagaacatcagtggcacccagatgatgaggaccatgtctctaggaggggagtggcagatgcctgcagatggatacagttgggtggctgggacacatacttgtgcaaagtaggatctgcttcagttgggggaggcaagactgtgccctgtgccctggggccagcttgcagctcgcctccctcccctgcctatgctaagggaacacagaaaggactgtccccaacctgggcttctgtctgccccatctttgtaagggagcctgaggcccttcctttcagaggccctgtttccccttcagcctggaactccccaaaacaaatccttgtctccccatcagacacaaggccccccaaggtccgcagcttattcctgcagttcttgggcacctgtgctggggccaggagatacttaagccccaagcccagatttgttgttgaccctcctggggaggccgcctctttcagccttggccttgctccaggaaagggggacccctggctgctccctgccagccccaccttcgctaaattccagtatgcaaggcagcccggagcccgtgactcctataaatagaggctgtatataccaggagggggcctgggccacgtctgctttgaagctaagcaagatgtctggttcctgtcatctggaggtgagagagatggaccacttccctccttgggcttccagagaggtggtttagggccaggctgagggctccccacacacagactacacaagcctcgggctgcaggaaacctggcaaagggctgggcttcagtcttgtctagtgtgaagcgggagcaatgccgcaagctgacattccctttccttacaaggtggggaaactgagtcagcagtgactttcctaaagtcaccccaccagttagtggcagagccccaaatctgacaggttgctttctactatatgttcttacctcatggcagtatgttaagaactaatggtaataataataatagccatcatcaacatcattgccatttactgagtggttctgaagtgccaggcatgagataaactactttccattcatgacctcattttagcctcatagaaaccctaggaggagctgttactaggaccattttgcagatagggccactgaggcccagagtagttaactggcttgtccatggagacacactagttaggatttgaactcaggcttctggagcccagagccctcgggtagctgaagactcagtgtgaatccatgcgtgtgtttgggtggggggttatggaacttctcccaaggcagaggctgtagtatatgtgcctctgtctcccacaggcgctgagcaacagtgtgtacaagggcgcctcaccctatggctccctcaacaacatcgccgatggcctcagctccctcaccgagcacttctcagacctgaccctcacctccgaggctcgcaagcccagcaagcggcccccacccaactacctgtgccacctgtgcttcaacaaaggacactacatcaaggactgcccccaggtaaggcagccctggcccagggggtgctcttgggctcccctactgacctgcggacaggctcctgtgggtagggcaggcgaagcagtgtccccagggccccttccaccaatgagtggccccgtggtcctctggcctctacccttttgtccctgctgggatttctgaggcaaggctggctggtgtggtcaggacagaggcccatcttgggcccacgctggttggtcagcaatctgggtgggggatttttggacccgaactgggcccccaaaggaggttctgtgcctttgggtctccaccagtcttttttgctaggtggggcctgttctgagggggcagtctcctcacagctccctggaggccccatctcatcacattcacggggaaggaatgcaggctctgggccaggaatccagatgtgcaccccctcccctgaaccccacctctgcctcctcagcctgtgagggaagaggggaggggccctgccccacactctgtgctcccaggatagggctgggggaaggcttcaggcactgcagggcggagcatctctttcttggagtgagaagggagggtcgggcagatcgaggcccccacctgatccaatgcttcagtatgacagagtgggcctaccatgccagcccacctacaggatggtccctgacccactgatagacatggttttgggatcctgggaaaagagggtagtagtcattttaagtacagcatgagattatcagtgattttttttcctattagtttttcctattttccaactttttttataatgtggcattacttttattttacgtttgtaatggaaatggaatcctggaaactctggaaatgcatgtagtgttcccctccagatgttggaaactgacgtgtggttgggtggggctgggtcccttcaggaccagtgggaggccaaaatgtgctgtcattcattacattcccaaaccctgctcagaaacggccacaccatgcttcaggttcttgccgcttagagtacggccctggcagagatgcatcagtgcctccagggagctattacaattgcaggctctcagagcagcatcttagcaaggtccccaggtgatctgtgtgcccccatcccagactctgcatacatagtgggagctgacccactgacgactttcctgcagaccccacatctccagtgggtcctgtcctccccctcaatatacacagtaagcaggaggctattggctcccagcagagagtgagtaccctcagcccccctggggttctctggatagaatgaggggcaaacaggcaactgaggatctagttggtccttaagggcatgctcatggcctgtgcagtccatagcctgttgcactttgtccagctgagccccagcacaggggcccccagctcatgtgcacacagccatccacagcagccctccctcatcccctgcctacagcctgggaagtgggcagagccagactgagctccgttaaggagacaggcactgtgctgagtgctctccaagcagtatttcatttaatgaaactactctatgtgttaagtgctctatttgcctcattttccatggggaaacagatgcttcgagggaggaagggactcacacaggattattgagctatcaatggaagagctgggattttaatccaggcaggcaggtgacactcagacatcaacaggggctctggagccccgaggaggtatgcttactctgggctggtagcctgggaatgctaccaggagaagggctttggagaagggtggcagggcctcccccagggtgaccaatatccaaaggcaatggatgtgagccagaggcccggggatagcagagggtgtgtgtgtgtgtgtgtgtgtgtgtggtgtgtgtgtgtgagtgtatgtgcacatgcatgcaccatcctctctcctgacagggccagcgctcttctaaatgctggggcagaaggtccctggcaccttccagcacagtgctaacgtgggatcttccttcatagagatcatcatctcatattggactcttaactctacggcagaaggaggagcagaggcctcattttacagtcttggggaggtggagagggcagaatgtatacgagatccccagtctcaggatttctgtattctttgcctccttaagctccttgtcactccaagctaagacctgcatggtctgtggggcctcagtttctcactcaagctgattgaggccttctcctggctccattccaaacttgattctgtcctggactcgtgaaggcccaagcaccttcttcctcccttcatgagtggtgggaggacagacagaggctcgcagcatcagtttcgtcgcctgtcccatgaggctaaggagagcactgacacccagggtattgtgaggacatagtgaaactatgcatggaaggtgcttagcacagtgcctggacacaggaagtgcttagtaaatgttggctagcatttttttctcctttgggtcactatgaagagtgcacccatctggcaaggcactaggtatttgggcaggctagaacctgattggatgctgtctacccctcacctggccatagctccaggggcaggtgctgggctggattcatctctgtgctcctcaccatctgaccacgccagctcaagggacctcacacgcagcggtgctcagtgcaaggctccctgaagggaggaacgggttgacagggcttttataaaccacagaaagaaacctgtgtcacaaatgaaatagtgtgttagaacctaatttctataatatttaaaagtagaaggattttcttgggaacagctttatgagatacaattcacttcccatataattcccatttgaagtgtacaattcagtgattttcgtatatgcctggagttgtgcagctgtcacctcaatcagagaacattgtcatcaccttgaaaaggaatttcatactccttaggtatcacctcttttttttatttttttgagacagagtctagctctgttgcccaggctggagtgcagtggcatcatcttggctcactgcaacctccacctcctgtgctcaagtgattctcatgcctcagcctcccgagtagctgggaatccaggtgctgccatcatgcccggctaatttttctgtttttaatacagatggggtttcaccatgttggccaggctggtctcaaactcctggtctaagtgatccacctgcctcagcctcccaaagtgctgggattacaggcatgagccacctctcctggcccagatgtcacctcttgatcatccatcccctcgcatccataaccactcatctatttctctctctgtagatctgtctattctggacatttcatataactagaatcatgtaacatgtggtcttttatgactggcttctttcacttagcataatattttcatggttcatccatgttatagtgtgttaggaagtgttccttcctgttatattttctggaagagtttgtaaagtatcagcagtaattattttccagatgtttgatagaattcacctgcgatgccgtctgcgcccgggctttcttttgtgggtagatttttgatgactgctctgaactctttactcattatagagtattctgatttttttttatttctttttgactcagttactacagtttgcatcttcctaggcatttttccattttatctaatttgtctaatttgttggcatacagttatccatagtattcttttataatcctttttatttctgtaaggtcgttaataatgttacttctttcatttctgattcttgcaatttgagtcctctctttcttcttgtttaatctacctaaagttttgtcaattattttggacttttcaaagaacaaacttttggtttagctgattttctctatttttttctattatttatctcattaatttccacttgcatctttacttttaaattatatttaaaatacatatggcataaaatttaccatcttaaccatttttagcttacggttcgtggcattaaatacattcacatcgttgtatgaccatcaccaccttccagccacagagctctttttatcttgcaaaactgaaatttatcttgcaaaactgaaatttatcttgcaaaactgaaatttatcttgcaaaactgaaatttatcttgcaaaactgaaatactgtacccattgcataataattctccctccctgccccccagcaaccaccattttaccttctgtctctgaatttgactactctaaatacctcatataagtggaatcacatggcgtttgtcttttggtgattggctcagttcacttagcataatttcctcaagtttcatccacactgtagcatgtatccatttcattcctttttaaggctgagtaatattccattgtatgtatataccacatttttaaatcagttcacccatcaatggacaactggattgcttccaccttttggttattgtgaatactgctgctgtgatcgagggtttataagtatctttgctcgctttcaattctccacttcaatatttattatttccttccatcagcttgctttagatttagtttgctcttctttttctagtttcttcaggtggaaggttaagatactgattttatatccttcttttcttttccttccttccttctatcctttcatccttcctctttttatggagacaggattccactctgtcaccgaggctggagtgcggtgctgtgatcataactcattgcagactcaaactcctgggctcaagcaatcctcccatctcagcctccaaaagtgctgggattacaggcatgatccattgtgtctggccccttcttttctcaatgtagataattacagctatgaattttcctctgagccccatcccataagttttggtatattgtatcttattttcatttatcacagggcattttttttttttatttcccttgtgatttcctctttgactcactggttatttaggagtgtgttgtttaatatccacatatttgcgtgtttcccacacatcttttagtgatttctaaccttattccattgtggtcatagaagatattttatattatattaacccttctaaatttattgtggtttgtttcagaacctaacattatgagttattctggagaatgttttgtgtgcacttgagagaaatgtattctgctgttgtttggtggagtgttttatagatgtctgttaggtctagttggttcatagtgatgtctatgtctcctcctgctttgttgatattctgcccagttcttttattattattttaagtggggatatttaagcctccagaaattattgtttgtctatttctttcttcaattctgtcagtttttgcttcattcatttgagtgttctattattaggtacacctatgtttatagttgttgtatcttcttgatggattaatcattttatccttataaaatgtccttctttttctctagtaactgttttttttttgttttaaagtatattttgtctgatattagtatacctagctttctaatagttgcagattacatgacagatattttcctatcttttatttccaacctattcatatatttgaatttaaagtgcatctcctgtagatagcatatagttgatcttgttttttgttgtctaatctgaaaatccttgccttttgattggattgtttaatccattcacatttaatgctctttttgacgtagatttaggtctgccattttactgccatttgctttctaaattactcatgtcttttttatttctctattccttctaaagaataacacaataaattgctttcttttgcattgattttctaactaacattttaatttctttaatgattttttttcactatgttttgtgagttatttttttagggttgctctagggcttatcttatacattgtgtcttaccagaatgcctcagatttataacttgattccagtgagatagagaaatgttactcctatgtagctctattcgctccttgttttggctttcagcagttttactatactgtgtctgtttgtggatctctttatgtttatcctgcttaaagtctgttgaagtgcttggacgtattgtttaaattttttcatcagatttggaaagttttcagccatgatttcttcaaatattctttctgctcctttatctcctctccttctgtgagatgatttttaaatgatctaaatgctttaaaaacctttaatggtctaactgggagtaaaatgtgcagaacactaggcccaccctgcctaggtcctgaagctgcccatggagcccccggggtctgaggagggcaacagtgaaagcaagcttaaagcattcactgccacgggagccaggggttggtcacttattacttggtcctttctcaccttaagagtaggatagaggtgtccagagctcagctcatcagactgatggggcctctcacatatccccagggcagtggaagggggattggacactggcaggaagactgggaaaccccaaaacagagggagaaggtgctagaagccaattctgaatgtcaacaaagggcagtccatccttgtggggtgaggctgtgcctaggccatggtctagtcatggtctagccatggtccggccaatgtcagcactgaaccaagaaggattaggactcaagagtgtctatcatttgcttcttgaaaaaacagctgctattgtcctcatgtagtgcaccagccatccggccccaaggtaataataatatcatacactatacaatagcaatagcttctaagcactgagtttaccactgggtttagcatattctatgtattagctcatttaatgctgtcaaaaattgtctcggtaggtactatagtgatcttcaattgccagatgataaaactgagacccagagaagtggagtgacttgcccaaggccacacagctagtgaatatcaaagctggaattggaactcaggtgctcctgattccagagcgcatgctttttcaatatcatcctgcatcacccttggcatccagactttgatctccactatcattctcagaaagtcagggttctttaaaaagatagatgactggaagtagagagggtcaaggacaatgtgggcagaggccatcccaagcctggtctggccaagttggtgtgcctggtagtttcaccacccagcctcagggtgtctgctgccccagtttagtcaggcaggtcaggagtgggttgggattgccagctctggtggcaacagaaaacccagtgactgcagggcggcatggttgatatctgctgggcctgcctgcagggtcgcctggtatctcgttttggcctctgcacgctgatgggtcaggactctgaaggcctgagcagcaatgtgttgctgtgagccagctgcacttgcctgtaggggtctgtggtgggggcctggcgcagtgccacatctgtgcccaggacacacagtctgtccaggacagagcaggactccagacatgttcccatcacccaaccattcctgagagtttcttgtgcaccaggcctgtgctggataaggcccttcccctgtcctcggtggtacagatagaaagagtattggccactctgggggaccagggctgtggtgaggtttactgtgcaggcccagctcagcctggagcttcgtgggaggcctcagagaggaggagcttggatttggagtggggaaggcttccaagcaagcgtgtaaataacaggaatatgctttccgggcactgtgagccctgggccacagcaggcgctcctgggggaggagtgggggtgtggctggaacaggtgatgaagggcttgtgtgacaggctgtgcaaacttggactttatctggaggccagggagaagggttttaggtgacatgctcagattggcattttgaaagatcctgctagtggcaggttggaggctgggctgaaggaggcaagaacgctaaggaagccagcccctgaacatggatagggactgatgactggacacaagacagcggtgagcagaagctgaaggggagggaatggattctggaatggaaaagtaccatctatgggccgtggtgcccagtgagagggaagagggagcaggcagcaaggagggctaccagatctttacggtggctgcctgggcaaatcagctgccaactgggatacaaatacacgtgcataaacaggtaggctcgccttccactctgcagttatttattgaacatctactgtgtgtcagacacatagcaagcattagaggacaccacaatgagcaaaacaggaaaggctccctctgtctaggagcttgtgttgcagttggtgaagtcaggcagtaagtacaaatcagtgggaactagggaactatcagatcagatgaagaacacagaagagtgctttcatagtgtgcactgggctgccttctcctggagtagcaggagttagtagttagtagcatgcatgcttaggcccatgatacttttagggtccacagatatgtttcttttcttttttttttttttttttcagacggagtctcgctctgttgcccaggctggagtgcagtggcgcgatctcagctcactgcaacctccactttttgggttcaagcgattctcctgcctcagcctccagagtagctgggattacaggtgcctgccaccacgcctgactgatttttgtatttttagtagagacggagttttaccatgttggccaggctggtttcaaactcttgacctcaagtgatccgcctgccttggcctcccaaaatgctggaattataggcgggagcaactgcacccggccacagatatgtttctatttgcctatttgtatttattttataaccagatgagaaaatgggtataatagtgaatatataattatgaactcagcctggagatttgtgtttacaccaatgcagtcagaaaatatatatatatatatatatatatatatagtatatatattttgtttgtttttgtttttttgagatggagtctcactctgtcacccaggctggagtccagtggcgccatttcagctcactgcaagctctacctcccaggttcaagctattctcctccctcagcctcccgagtagctgggattacaggcgcccgccactacgcctggctaatttttgaatttttagtagagacagagtttcaccatgttggctaggctggtctcaaactcctgacctcaagagatctgcctgcctcggactcccaaagtgctgggattacaggcatgagcctccatgcccagccagaaaataaaatttttaataaggttttatgcaaaaagggcccacaaaggcaaaagtgcctagggtccacagaagtcataatgaagccctgaagggtgtctggggcagctttcgattgggtggccactgtgggtctctcctatgataggacatgaaaacttcacgtactaccactccactaaagctcaggcagggggagggtccacatgcccacagtaaggatcctgatgttgacgtgggtgatatcttgttgaggtcaaaggatacagccttgaatttttaacccaaaggcaacttttcctaagctgtctctttgcccttcacggctgtcaggcccagccatgcccagcctgacagccacccttcaggcactgacctgggagcagaagctctctagaacccgtttccatcacttctgagacattgttagtggtactcattactcctttgagggaggtctgaggggtgttgtcacctgtgcctcttgtgtccagctaagaacagggcgccgcgagaggtctgggagggcctgagcccaggggaactgccattcctgagtcagcatgcccagggctgctaatgaaatccagatgttagacagaaaacaatcatcgcccccacccatctggcagctcgggtttcttggagattgcaaaagaagaaaaatagagccgagagagaatggaatcctagaacagctgagatcttagaggcaggatgtaaatagtctcagggtcttgctggggaaagggcaggagacaagggaaagagggggctggcccagtcctccttcttcctcacccaggtctctgcagccctcggaccccagcccctgcacccctccccaggccagagcaggctggtccttgaagggagtaggctgttggaggcagcaggcagggccgaggcccccagcccatgtctgacccttgcctacagtttccaacccctcattccaaccctgacctcactgcaggtctgggtgtcctctgggaccagagtggctagagcccagggaggggacaggccaaaaaggactgaggctaggcagaattgtgggctgactagaagcttctcctcagaaccccagagctgagtggcatagggatagaggatgaggggtatggtgggccagctgggggacctagcctcttcttcccaccagggtagcctcacacatatccacctcacatgttagggagcatgcgaagggaaggctctcaggcttataaagtttaacaccattgattagttcagacccatcaacatactggtggggaaactgaggttttctcacaacactggggctaaggactgcctgtcataaaaaaatgtatagaaggctgggtgcggtggctcatgcctgtaatcccagcactttgggaggacgaggtgagcagatcgcctgaggtcaggagtttgagaccagcccggccaacatgatgaaacctcatctctgctaaaaatacaaaaaaattagccaggtgtggtggcgcacacctataatcccagttacttgggaggctgaggcaggagaattgcttgaactcaggatgtggaggttgcagtgagccgagatcgcaccactgcactccagcctgggcaacaagagcgaaactccatttctaaaataaatgaataaataaatataaaaaatgcatacagggaggggcagaaaggtaacaccacagacaaaaagccctttgaatgttagacagtggaattagcaaagaaagtgttatactgccacccattactcattagcaaacatccagaaggaaggaagaaaggaagaaaggaaagaagggagggagggaggaagggagggagggggaagggagagggagaagagggaggacagacagcatcattctgtgttcccactgaggaaggactgggcctagggcagatggcatagcaggggatgggtgctgaaggtagcattgcagggggttctcctggagcctgggctggctggccaaggggcctcagctgaggttcttccagcacttggcacagaacctggaatgtcgtgagcactcagagaatgtcagctgggatgggtgttgctgggggtgtcgtgcctgccgtttggcaggtggtggcttggcatagatgctgacgttagggtagtgccccaaacccagtgtccgggcctcgaggctctcctccttgccctgccgaagccctctcctttcagtgaggtgccttcgagcacagccctgaagccagcctgcctgcgttccacccctggcgccgccttgtagcagcagtgctatgtgcctttgggaaaaattcattcagtctttctaggcctcagtttcctcctctgtaaaatgaagatattaaaacatcctacttcatgggatgttgtgagcttaaccgagttattttatctgaagtgtttataacagtgcctggcaccttgcttgcactgcaagtagtaactcttaggactgttaattactgtcattattattattattattattattttgagatagaaacttgctctgttgcccaggctgcagtgcagtggcatgatctcagctcactgcagcctccgcttcccgagttcaagcgattctcctgcctcctgagtagctggaactatagacatgaaccaccacactaggctaatttttgtatttttagtagagacagggtttctccatgttggccaggctggtctcaaactcctggcctcaagtgatctgcccgcctcggcctcccaaagtgctgggattacaggcgtgagccaccatgcccagcctactgtcgttattattatgcctcaattccgctgtttcaaactggcttgagaagtcccagggttctaagagactgcttcagcactgtggggatccacagaggtggctggagccctcccttcccaccctcattccctaagggaggggctgcctctgggaggggctgcagagaggccaggtgacaaggctgtgctttctcaggggtcttggggaggggacaggggaaggcccagatgactttgagtcccccaggttgtgctggggggactctgctgtgcccaggatgggtgctgtgggaggaggggcgatgcacagctggaaggtgcccagtgccgcctgtgggctgtcagttcccctatggcccagggaagaggaatctctctccaagtgcttgcctaggagcagctgctgggggtggagcaggggtgggggattggaggggtggggcatggagtgtgagggctcatggggagccacttttatatccttcctgctgcctcttgcctggcaggaaagagcctaggagggccagtttcacatcctcagctgccagttctgcttttagaagaattgcagatgataattaggagtccccaggaatctcgatgggtcaatggcctcaccttcccagccctctgcttctgagccttagggacagagatgttggcagagcctaggagccaggaccagtcctggtcttgaactacctgcaaggcctagtgaatggaatgctggagcacagcaagtgcatccttaagctgaatagctccaagtgtcacctcctttgggaagccctctctgatttctcctttcctccaagctcagagggactggcctcctctgaatgccagaaaggctcactcactcactcatttattcctcacctgccaagggcctccagtgtgccaggcccttggcctgcccctctcacatggctttcctttgtcttggagtaactcaagtgccctttgctgtgaagactccggggaaggttctggctgggacatcccttggtccctcaacctcagtaagaacaggagagccccaggcagcggagtctcactgagctggactcagagttcacttttgctctttcccagctgtgtgtccttcgccgtgttgcccaccttctcccaggcatctgtaaaatgggttcaccatccttgcagagtgtgtgtggaaagcgtctaatgcagggcttggcatcccacaagcactcagtaagtaagtggcagccctcactgttggtatcacttgttaggccgtggggcttcctgagccagatctgccctcatttgtaaagtgaggctcatgtacctgatgggagggttggtgtgagggagatgagaagcagcccggatacctgggaagcaacacccaccggagcccctctccttctccctgacccacccctgcagctgcttaatttcatgcatgcacgcagacacatatgtgcacacatgcaaacgtgcgtgcatgcacacaccccttgggcttctcagcctcaaggccttgctcacactgtccccgagtctgcaatgcctttcccgaatctcttctctcctatccccctttcagagcccagcttgagcccacctctctcagggagtcttccccaaccatccagggcctcagagctctcctctctgaaccctaacttgtcaggacagcaccccttccccagaacctggttttaaggccctcaagaggtaagaaatctcaaccaggtttctcatctttcccccatccccatctggcccctaggggacagagaatgcccctctttgggtgggcttcactctgccctgccccagtcctggaaggtagcccagcctgggccgtttgacctctgctcagccttctcatccccactccacctgtgctatggccttagccagtgactctctcatctcccccaggttcagcccaaacacgtcctcttgcatggtgcagcccctatgcccttctatgccccatgtgctcctgccttggtgagtcgtgcctagcccagggccggtcctggcacaagtctgtctcctacttcctgaggtcacttcccaggcgaggtctgtgtctgcctggcaggcagagggagcatggccttggggtcagaaggcccgagctctcatcccagggctgtctctctagctgttcaacattggccaagttgaccttacccttgggcccccacacccccatgcatgaagtggcatcagcaatgaagcctgtctctcagggcttctgtgagatccagaggcgatcagacaggtgaacgcgctttgagaactgtgaagttataccatttgctccactgcccagcgagcagccacatttgctgagatgatcagaggtgtgcgagcgagggtgtttaggccttggtggctgctgtgagctgacccctgcctcaactgccatggggtcttggaggcatatttgtgagggcagcattttccctttccaccatgtctggggtggctgcccagggtggagcctgtgttgggtgcctcctgctcccagtggctttgtgtggagtgggaggtggcccagctggggcaaggtggccagatcccagcctgtgggttagaggacttggcaccactgacctggcctgacttggagacatggctcctcaacacaccgcccccactccctcccattccaaggctcagggctcagagaaacggggcagcaggtgcagggaagaaatgtgcatggaatgggggtgaggagcccgaggacatcaggccttcctcatgcctggctcacggagcaccttcgtctcatttgctggctgggttcttacactcacctggatgtcatctgtggcccatgtgcccactcttcttctctttcttcatctctgtctctcatcctttcttcctcttttcttttgtaacagattacataacttgcccctggtcccacagctggttaggatcaggccaagtcagtctgaccttaggccgtgcctttcccactgctccctctgcccacaacaacggatgggggtccatcctctaggacatgctgtagacctgctgatctccagccctggcagaaatcaggctgcaggaggcactgtgaacccaggccttcctccctgcctggcttcctccaagttccctggctgtgtgggagccacaggtctctccctgacaggttggggtgatggtgaggtggaggggtgcccccaaagcagtaggcatgatgacaaggggtaaaacccaacaggggcccatgctcctctgctccttcctggggactgtgaagctcaaacagagccttgtgcccctccctcccgcaggccctctgagccctccccatgcatcagtcctccctctgtgttcccaaaacaccctgcacaaacggcttagtattttgtattctcttttgattgtgatcccggggagggggaaggctggcagaaaatcacttagcgcagcacctggcacatagtgagtgctcagcaagtgtgagccattgcgttgctgtggcttcagtgcgccatccacagtgtctgccgtggtgcccactctgagcagggccccgtcataagggaaacatattaacagcacagcagctacacgcacagggagcgctcactgtgttccgggcactgctctgagcacttttcacccattgactcctctaatcttctcatggcccttgtgctggacactcttcttatccccattgcacagaggaggaaactgaggcacagagaggctaagtgacttgccgagggtcacacagcttggacatgttccccagcagtcttgcttcagaggctgtgctgtcataaatatgtgcaaaaaaaggaagaaatgaacaagactcaggatgtggaggaggaaagaaaggcagggagctaatgttgactgagcatcctccatgtaccagcacatcactgatgtcttcagagacgtcaagggattcgcccagagtcacacaggagccaagggcatggctgggatttgagccctgggtgatttctaatcccctcctccccaccttatcccaccagctcaggcctcagagagccagcacagttcatcaagggccccctggacacccccagcagccttggaccacatagctgagttggaggcaagacaaggaattactcagtgaggccactcattaccaacgcgtttggttctaaccagccataggtgaggagtttagaggaaggagcagagccaagtgggcgaccttgaataagcccattgcccttgccacacctcaatttccccttctgtgcagtggacccagcaatatgcatcctgtccctctaggctgccgtgtaggtcttatgagctaacaaagctggaaatgacgaaagccaagctgaacaaaagttaagagctttgtaggaataaaaatacttttatttatgaacatctaaaggctttgcctaaaagtgtggtcagtggaccggcagcagtggcagtacctggagcttatcaaaaatgcgcagcccgggtcctcaggctccaccccagtcctgctgggtcagagtctgcattttcacaagcttcccccatcacccatgggaaacactggtctaggaatttcttgcttctcagttccccattcccggaggctgcctcttgggccttctttccatagcctacaaggggttcttggcaggaaattcccatctcgttggagaaaatgctgtggcccagccagacccctgccctgctcaactgcctaggagatatgagtgcatcagaattaagctgaagttgggcagaggctctaacagcctctgtcactccaacaacctctgatgagaccatttgttgggagtgcagctgccaccagaatcaacaaggcctttcagacctgggagagggtgcagggaggagtgagggggtaccctcagcctgggctcagtagggctaggggtttcttctgaacaaagggcatttgtaccagatattctccaccttcacccaggaaggcaaaaggttgaaaccgcagttggaatattccaggttagaaataagaagcaacgtcccaactgatcaggagcaagccagccaaggacactgaagactccatccccttaaatgtgtggccagtgtgtgtgaggtcaagaggcagagctggaacggattcccagaggccctctgcccaccgtcctgccctgagaccattttgacttcaaggggccaagggactcacctaaggtcacatagcaaggagccctgggttctgattccctgtgcctggggcccctcttcattgcaggccttcctggaggctggggagtgaccttgatgaccttagcaacctcccttgaagcagcctggaggttttgagcatgtcaatgggaggacgggaggggctggctttgtgagcctagcaactcagtgtgtctcactgtgtcttagccttcatggtacccaagatcattaggaataccccaggggcagaagtcctctgagacagatgcggtgagtcagggacaggaaacctggacccaaggggtccaggtagaggaagcaagtagaggcttgggaggcctgacattgatgaagagcctggggaccagtgctgtgtatccttaggccagttacttgcagtctctgtttccctatgtgtaatatggaggagaggttagacaagatcagtgattccatctcgggcttcacattagaaccacctgggttttttttggttttggtttggtttttggtgctagaaatttgaattcagtagatccagggtgggcctggccaagggcatattcctagctccccaggtaattctgacgtgcagctgggcaaaagcaccattgccaggtctgagatggtggggtgctctggcagctgtggtggctgcaggtgatcataaccacaattatcctcctgaggtcctgggaatgcaagattacaaggttccgggagactcccaaatgaacattccagaggttctagatatccagaggttccagatgttcaacctcagattccctaggtcatgtgactgcagctttattattctgagaagtgaagcttcccacaatggaggattctgacacttgagtgttctggttttgtgactttaagagtgtgagattctataatcattctgtatacctcaagtacgtgcttctgaaaccttccgtgtgtttctgtgttccaactgcagttattattcttctctaaaatgaagattctccatgtctgtaattccaacacattcattatcccaaattctagagactccaagaacttaagctattgtggcactaatattttttaaaattctaaattcagcaactctgtgacctgtcattccatctgggcagttggccgccaaggcttgggcccagactttgtctccttgagacaaggtggtgatcgtataagctgggacacgtgccccctcacctccttggcctggagagcctgtcttggtggaaggggtgagggtggggagaacagagaccccacggagctctcacttctttggctcttcctccaacactggctgtagaggactggaaggtggagcaagtgtgaggggcacatgtggccatgcggcaaggagggcagcaggtggacatacagctacatccccgaattgctgcttgtatccacccatctcacagcaaagctgtgaattctctgtgtcagactggcttagacattagaggctatcacatccgaagcacctccctaaactctctctctctctctctctctctcacacacacacacacacacatgcgcacgcacatataccctttttccacctaggaaaactaaggcccagaaggaggaggtgacatgcctgatagagctggcatccaaacccagggccctgaactcccggttgtcattgcatggtcctttccagctagtcaggcccaggtctggctttctgcacagaaccatcagctttctatagctgactttcaggtccctccaaggggacagggaccagcccggtgactcaggattacacatttaaagcctgtagcctggcggatttcactaggcccaggagaggctccccctgcccccgcatgacctcctggccgtttcctgcctgcctgaccacagtcttccgttccactcccccaggacgggtgcccgccttgtgccagtgcacatcaggctcagaggccaggaggcagaggctgggctggagtcaggcgtggggaggggtcccgccactcactcactgtgtgaccttgaaaaagtctctccacctctctgggcctctccatgctgtgggccggtggatggtaattgacagagttactgtgaggattaaatgagaccccaggggaaaacccagcatgctgggaggggaggggcagaggctggtcacatccaccgcccactggtcccctcagcactgaacccattttggatgagtggcttgtgtttgttgaaggtgtctgggtagacttccatataatccttcagagataaaatgatggattgcagactctcctgggctttcagaaggttggctggtagaggagatagagtccaaaggccttggacacctgagatttaggcagatgtccagaaaatggtgatgatgatgttgatggtggctattgttaactgaattccagccatgtgcttggtactcatgagctccttaaagcttctcgactgcctgcctgatcgatcttattatccctacttacacgggggaaaccaaggctcagagcatttcagaaacttgtcgaagctcttgccgccagtaatggctaagttgggattcaaacccaggtctccaggaccgcacagccagagctctgtttcacttcgtactcagctagaagaggggacgcagggccacatgatggatggtggccatctctctacgtggctgcaggcagtccacggccagggaaatagaaagacattttctagaagagatgctagtggttgcctgttttcctccctcggtgggattctcccaattttccatgtggctatttttatcacttttagaaatctggagctgcctgtggctgcccagtccctggagatgggtggaacacacagggctctgcacagccacccacaccatgtacgtacgcggggctgccaaggggcgagggtgtacacgggcatgtccgcccctcaccgatgcacctgtgcacactcgcacagaggctcatgccgctgcaggctgctgccaagtccaggggacccaagagcttagcaggaagctcctgagctacctcccttggggttctggagccatgggtctgccttggccactcacttccttgtcagttgacttaaaacggagttggcaggtcatgccacggtgcgttccgctcgctccctgtgtgcatgcatgcgtgtgtgcatgtgcagctgcagacctgtgcacacccaggcccagttcagggcacaggctcaatgccccctgtggaggcgtagcaggaagtccttgctccagggcttctaaaagccaagactccccacgtggttcctcccactcgcgagattctggccttctgggcttctgggagccagggaagggcaggagagacagccagggctctgtaaggggcacatgtggggtgctccagggactggggacggtggacttgctgggggtcctgccctggcagagcaggtctctggggctgagaaaccttctcagagtgggatggcagggtcctggggctgagcatggcacctccaggaggggccgaggcctcctggaggtctcctgacccttcttctgtcctcacagttgcttcagactctccctagcactggcctgggatcccaggaggcctgagcttggccctgcctctcacaggctgtgtgggctggagtcccctggccttggcctcctcctctggaaagtggggcacccgtgggcagtggaatgagactttggcagtcctgctctgtgcatatactgggcacactgagccctgggaggctggggccacctttccctctagaatctggttccatcctctccctcctgggttttcttccgctgcagactcaacaccccttccgttgagtcctccttcatggctctgaagaattgttttggggcccagcaggcaacttggaacagtggggaaagccctggcctgccaccgtggcctgtgttcacatggttcctgctctgagcctatttgctcacctgcaggggagtgtgtgtgtgtttaattatagcaccatgccaggatgcctggccacattagactgtaaatctaaagacagaggtcaaggcctctttttaccagccccgaggtgattttcaaatcagctttagggtggatcatacccccaagggcaccttgagcaggctcacatgacaggtttataggcgattcctgaggacaggagccagggcaaacagttatcatgaggctgccatccatcactgttgcctgctgtccagtgacggccagtcctccttccgtccatcactgccggcacaagacaccgtcatcaccttcccttgctccaccctggccttgtcccccagtcagagccagggcaaccatgggccaagaggggagctcctgcctcagcccccacagccccgcagctgattgaggccacacacctgggagttgctcttgagtccttgctctcctcccccaaggctagcccaagtgctgctgactcaacctcctgccatctcaggggtctctcactcttctcccctctgccacccatccccagaccacacccccaccacctctccccagcaatgtggcagcacccccctaactggtccccccatgtccaacccctctgtccactcagcagccaaagagatctcacaatgccaggcagactttcgcattttcagcgcttccctggcttcccatactcctgggctgatatttaactctaagatatggtctaggacctggactggcctggcctccaagcctcaagccctccatgcttcccgtggtctagccctttgcacaggctgctccagccccacagggccctttccactgtgacgtcactcctccccagccatgctggccagatgctcccagaacatggggctctgctcatcctgagcacatcccagaaggccagatcagtgttcaagcatgctacttttgtctgactggtcatcgtgtatttattgagtacctactatgtgccaggtgctgctccaggcatgggacattccatagtgaacaagaaagatgaggaaagaatgcagttcccaatcttgcaggatgacaaatagtaaagaaattgacaccaatggatatgctatggtggcaggtcatattcaaagacagttgtcagggatggtgtctctgaggacatgacaacttgagtagagacaaatgaagcaggagcaaatggtgtgggcatctgggggaagggtattcctggcagagggaacagcaagtgcagaggctctgagtgaggcacagatgtgcttggcttgtttgaggaagagcaagagggccagaatgggcctcctgacagctccagctcagagggagagttggctgggaggggaggggcggaggcacagggttgaacgcatcccctgccttgctctcccttctcccgcctcctcccccagctgggcagctcttctctgggggacacagatgggtgcttgtcttgagagcccccgtcctccccctgctcctccaaacactcgcagtggggacaggaagtgtcggccctcgccttccagctgcccgggtgggacaccactgagctgggctggcctgctcagggagggacagaggccctattgagcccgttccctggaccatcagggacaatagccacactgaggaccaggaacagcgaccagcatgcttgcccaggaagttgccaggccgctgcctgccccatccccacacctcccctacccctctggctttctcttccagatacttctctcaggctgatagtcatgtccaaatggtcacttgcccttcacctgctccccagagccccctgtcctgtgccagacccacgctgggcccagggaatcagaggggacccctacagggtctctgtccctgaggagagggcagggaaggaggtgacagacacatgagctgagaggggtgtatcctaagtgcttcctacagagatccacaaggtacagggggtccctggagggcaggggagatgtctgctagaagtgctggtaggaaaggctccctggaggaagagtcacagttctaaagagcttccgcagccagggttgtgctttgaaagcccagcacccaagtggcccaagcctggcaaaaactagcctctgttacatgcccagaggtgtgcagaagcagtggccaggacttggactctgtccacttctcaagcctgtgtgctgtctactcatggaactatttgcattggaaggatctttagggatcatctaggtcaggaatgccaactcaagtcatgtgtgcctgctgcccccggccatggcagggcaggcaccacgaaaatcacaccattcttgcctgtcgagcttggatatagctgcagaatccttcacaccacagtagttttgtggcaagttacgagtggacacacagggagaagtatttgcctttcctgattttactttatccccccatcatggacagatggggaaactgagacccaggcagggaaggggcttatcccaggtcacagagcttgctggtggcagtgtgtagggactgggtcagggacaggaaggaggtcagaaacacccaccttttgcagtttaggctgtgaaccgtcagagactgggaatgggaatggttgactgccctgaacagaccttctgtatggcttctcactgtgaagaggggatccccattctcctctgccacgacaccccattccttcatatctctcatcacagctttaatgatctgaatgggatacttacttttcttccgcgcctggctgtaagttcatgggggccggggttgcatctgtcttgttaaccaccctcctccagtgccttgtgggtgcctaattcatagttgtcgagggcacatgtggaaaggaagtaaatgcacgtggtgattggtgctccaaagccttccctgctccctggctggttgtttggcctgcagacaacaagcgggatccctgggggcacctgggatccaggcatcaagctggtcagatacatgccagtatatagtaagcagctggcctaacctgggtagtccctgagctccctgcagggaaactgaggcccagagtgctataatcataagccaggagtcgtgcaggcagagcagggagctaagctggggtcaactggcttccgtccaggcttctgggcacccaatcttgccaccagcctccacatctgtagctcaggggctgacttttcccaacagctgggcccactgggagctgtgtgtgttggtgccaaggcaaacatcggtggtggaggtgggggcaggaggtgcctgcaggctctgtgttcctttgccttcctgaacagacagggctggagcccctgagcagcccggcctcctgctccatgatcattgttcccggtgatggtttccagatgctgaggagtcacaggtttggggctgggccaggagagccaggccagccctccccagtaccccgccgccactgacaccaccgccggtcttgcttttaaagagatgggcctttctcccccaatccaggctttcccctctcaagcccagcagcctcactgtcctgcaaccagcccagctcctggggtgaggagccctgcgctccactcccagctctgaccctaacttcctgtatggcttgagcaagtcacttgccttctctgtgcctcagtttcctgggctgtagaatgggcagatggggacagcatggaggtgacagtatctgactggactttaacagactgtgaccaggatcactggggcggtggctccctaggtgggtccccagaccagcagcagctgcaccgcccaggcatttgagactctggttctcaggccctccccagacctattgattctgagactctggggccagggcagcagcgtgcagtgtaccaatgccccgatggtcctgtgcgtgctctcgtgagcgaagaagagcgtgtgctctagaagcaggggctcaggaatctggaatcagaaagacgagcacagccgtatggcttcagaatgagccttcacttcctgctggggaatgtggactggcgctcccagccctgtgtgtggcatggttactgtgcaacagtcagcctggctcccacaccaccgagtgctcctctgggacaggcgctccctgggggcaggtctgcacctggctggcgctccaccccatcagcactttaaaggcgctgtctcagaccctagcaaagaggccatgtgtgcacacaggttgcggggcgtgtgtccagcttgccttcagcaggtgtagagggggccctagggtggcactgtggcacagagagtgacaagaggagccctggggcaaggggacagagaccagaagggtcaaggaggcttcccggaggaagtgcagcttccactggatttggttgggaggcagggtgtgccaggtagtgagactggggtgtgtaaaggtgggtatgaaaacaagtaccaccagccagccccttctccttctcctcccttttcagggcaccagcgggattattgtcctgtggggctgtccacagacaagggcaaggaggtcagagctcaaggccatgtaggaggcatgcggcgttgcagcagtcagtcaggcctgggttcagatcccagctctgctgtttcctgcctgtgtgacctcaggcaaatctcttaacctctctgtgacttggattcctcatctgtaggggttacagggaggatgaaatggctggtggaggtaaccccacacatagcaggagctgtgagggttttagagccagggaacctggggcccaggcaggggaagtgaccatttggggacactccatcatcctgcttcctgcagagcttcctgcacagaacaccctcgcctttggggacagtggagaaaggtcagtttgggaatgtctttccagccccttggtgaagaagcagggtcagcaggggtgggaaatgtgaggcttccttcctccctgcgacccccctgtaaaagtcacataagagcagctcttcctctgcagagctcccctccacccaattgaagaacaggtgccacaggtgtcctttgtacctgtccatggccttctggacctccgatatctcgctcagcaaggagggaattgggcaacagggagaaaggccatggttcgaagccttctgcttatttgctttgtgaccttggacaggtgacttaacctctctgagcctctatttcctcacctggaaatgggatcacaatgaagctacctacaggttgtgtgcgtggccagccccagcacgcaggggagactcagcactctccaccccggtctgtggttgccacagtctcctaagtgctgtgagctccagcgctcacccagagatggaaagtttgcttctctttctacccagatgaggagatcgaatcccagagagaggaggtgatttatgtgagggttttgcgaggctggaagtcacgcccacagcctcttgccaggcagcagtgggggcctcagcccccaggcctctgccagagtggccccaaactgctgacttcagcatttcactggccagggcagatcagatttcttttctggcacttggccaccctgcacacccttcccccatcactattttgagctgagctcccctgtcccctcctcccagggctgtggccctcacacccaaagcctcactccaggctgaggcctttccacctcttgacccaccaccttccctccagccagggaaggctgggctggtcacggccatgtctatccaggccttgccagggacgccttcagacacagagccaggggccagctgccctgtgcaaatggcgctgctagctcaagacagccgtccagggtgctcagcactgcccaaggaggcgtcctgggactggacagagcccacgccatgatcagccctggcattgccacctcctacctgtgcgacctccaccctgccctaacttctgctgtccacctcacacctcaccctttgcaggcactgccactcctggtgtcccctccagctgccaaaggattctgagccccagcctgagcctagtgctaccatagaagtgagaggtgtggagggtgcacctgaccgcagcacacagagaggcttgtgggaaacaagatggcagtaggggaatttcgtttaaatttcgggtgaaatctctgagtttggcaagctggaggttgggtcagggcaggacatgacctagggaagatcatgtctctcgcctttcctggagctaagcgtgtggtgcaaaccacagagtcccctggaagttcagggagagggccttctccagggcaaggcggcgggtgggttcttatctccacaccagccagcctgggactcagcagtggagtgagctcctgagcagtgcattagccctctctgggccagggagaccagggtgcccctggagcttgctcttgaagggtacatggctgttcactggtgaagtgttgggtacagggaacagcaagaaaaaggcacagatgggcagcatgtcacttgcagggagtgacttttctttatttgagtgtaagtgctgtgggtggaaggtcagctggggccagaaggggaaggggcccgaatgccttgcatgtttcatctcagctctgcggtgaggcccaaacctgaagtgggccttcatttaagtatttggggagattctgcctggcccaactcaggcggtgactgcagcaggagagagaggtgcagtcggaagaaaggtcttgctgagcaaacgggacccaaagagggatgtgcaagatctggaaacaacaaatggttttcaaactcaatagtcccctccagcaatcagcaaacagcagggtggctgcagatcttccatccacccactaaggcagccagcaatccctgtctctgcagtggcggaggaaacctctgtcttttgcaatccctgtgattcggaagctttccacccctctggaccggcccctcttcccctcccgcccctccgctctgatccgtgtggtttgctaagggaggaaagccagagcaggaaacagataacttagggagtggctgttcatgtgattaaaatgtctttgctttccaaaaagttttgcctgagattacttcaaatcgcctggctggggtgggatttggagagggggcttcttgctgccttctgggcagcagcgcctcagggccgggcacagggctggaggcacggggtgttggggggcttggcacttctctgggtcctggaggggctccttggcctctgtgggccccgttcccccgaatgtctctgtctcccagcccttttggtttgtttctgcatcatgtctcgcctctcctgggcaccctgtccccccttctcctcttatctgctctgacgggcgctctctcactccctgcccctcattcccaacatcgtgtcctcactccctgtctctccaggatctctccctcatctctctgtcccccgcttgttttctcctctctatctcccttccctcctctccacacccccactccatgcccccctccccagggttttcctgaggccttttcctgtccctgtgaaagctcccattgttccttgcactttgacaaaccctagtgttgtggaatcaggatggcatttttgtggtggctttgggctgggaacgggggtgggaggggtgacaagaggccaggccttctgggcccatgctgggctgcagcaggaacccagaagaggggagggggccctgggcaaggaggcgaggacggctgtgcgcagacaaggaggcccttgaggctccagaggaagccccgggtggcctcttgccgcgtccttcctccctcccagcatcctgcaggccgcggcccagcccacctgtccctctgaccgcctgcttcctccggggcctccgtggagcctgcagctgcccagaccaggctgcagggacgcagcccttccacctgcctcccccggccgtgcatgtggacatgtgagtgtggaggtctttggttggtccctaaagcagtaccacagagcacagaggggaaggaaaagccaggggctcagcacttggcagacttgctgcccctgtctcgagcctcagtttcctcatccgtcattagggttaagagtgctgattcaatgaggccgtggcagtgatcagagataatttcatgtggcatgcataggtcccatgcctgtcacttgggaggtctgtctggcctctgcctgagggcgtgaatccaagtgtgttttcacaggtgtgagtccgacttgggcttgagcccaggagtatgtggctaggggagttcgcgactggtgtgggtcacggttggggaaagggtcacagggctgacttctttggaaggccttggactgagagctccatgaagacagggcattcttcatctgtcttgtttccatatttctggaattttccacagagcctggtgcagagtgggtgctcagtgtaaattaggtgaacaaatgaatattgaggtggtggccagggtcggaggtaagaggtgcggctgtgttcctaggagcaggctttttctttaattttctctcaaccgtctcacggagaggccgcacattcagtggaaagtgtcgttttggagtcagcaaattgggtttaagttctggctccatggctgtgtggccttgagcaggttgcttggcctctctgtacctcagtttgctctcctgttaaatgaaagagctctggagagccaggtcagaaagcgtgtggcacattgtaggtgctcattgaatgctagtgtctccagctccaccagagcagccccctcacatggaagatagaaaaaccaaggctctggccgggcacagtggctcacgcctataatccccacactttgggaggccgaggcgggcgtatcacaaggtcaggagatcgaaaccatcctggctaacacagtgaaaccccgtctctactaaaaatacaaaaaattagccgggcgtggtggcgggcacctatagtcccagctacttgggaggccaaggcaggagaatggcatggaactgggaggtggagcttgcagtgagcggagatcacgccactgcactccagcctgggtgacagagcgagactccgtctcaaaaaaaagaaaaaagaaaaaaaaagaaaaaccaagtatctaagacaggcgtgggagagccagggcccaacctggacctctgacctctatcccctgtttactccgcactgccccaggctcaaggagagacactagggagaatgaccagggaccttctgcctcctctggtaaaggcctccagaaagggccagcaaggccacacagaggatcctgggctggggtcgtgagtccgtggtcagccctgcgccccctctgtggactagttgccccacccctgtggcctctgtttctacatcagtggaaagtctttctcgaactcctgagaccggggctcttgctctctgggaaggtagactggagcccagggccacctcagcggccgggctgcaggaaagcacgcagactgggcagaccgggcaggacaggggccagcaggcagcccatctgttctttatttcctccccctgctcctcttggctccagccagagcctctcagctggacgcacggtggggtcggccttgtgctccatgggagggcggagcgtgagtgggctgccaggcacatgctgagttatgggcctcctgggaggccagtgaccctgcccagcagtcagtccaacctctcattctggagatgggaaaactgaggcccagagatggggagggatgcccccagcatgccaggacccatgagaacagcggccccttcccgtttctcaccatcccggcttggtgggtctcttctttgtgcaatcctggcatgttgtgtagcaatttagaaagtgagcccacgttaggtggcttgggctcggatctggactaccccatttcctggcagcgtagcttgggcaagccatgtaacctctacatgcgtcagcgttcccatctgaaacctgggactaaccgtacttagctcatggatggttgtcgggacacaaagagtgcctggccctgaccaaaaatacccaatgttggagcaacagtgatttctccatcccagggtttggcagggcacaggcctgcgcccctgtgcagatgggagtggcaaggccaggtctgggggtgaggcacatacctcaggctgggaggtatcgaggcctatagctggaacccatatccagagggcagaggccgtgcatcctggggcacagtgcagcctggagtcttggcgtgcagggcacagcctcaggctctcagtgcccaccctgctctcctcctggtccctatgattctctgcctcaacaaccaaaggccacaatgtcacctctgtgcaaaagggactcattgtctaaaagggatggggagatcaagcttcaccctaaaggatcactcactcgtggtgggacttcaagcacctggaggggagtgaccagtcaggctgtggtgtcacgtgacagtgtgtggacatgtctggcttcccttaaaatggaaggagcagaagggacccaggggtggggagtgcattccacagttggggggctagctctatggacatgagtatgatccaacagaaccagcagcctgaagccagccagtgcccaggccccagggtccacacctgcaggggcaggagtgtggccacagccaccatctctgtggggtttctgtcaccttgggaaagcacagtgcgccccctagggggcaggaggggcctgcaggccagggagtgggctggctaccatcttcttccaagccatacccactcattaaaggcaattcattcattaagacagagcataagctgcagaagtaagatcatcaacagtcctgtctctcagcccttgtggctgctttcctgccagtcctgttcttgtgcagcggttatcttcggttgcttatcctgctctctttataagtattttcccaaaccccgaacaaaaatcaccataactattttagtggctttattgtcattcatccaaagggtataacgtaatttagggaacccgggcattgttgttgaatgtttcgctcattccagatttacattgtcctaactcatgctgtaatggacatttttgaacaccccttttgtccgcatgtctgataatttccttgggatagtcgcccagagatggatttgcttaggataaggaatgcacatttttttaaagtttgaaggcttacagaagtttgaagttgtcctatagaaatacagtaggaaaatatacctgttcagcccccaccccagcagcatctcagagtgcctgtctccacacctgcctggttggcctttaccagctgcaggggttgggaggactgtagagttggaagtgcctccagagtcaccagatccacctgcctgaccagggcaaaggccccctcagcagcctccctgatacttgttctctcagcctctgcttgcatacccccagtaaaaggcagctcaccacctcccagccaacctcaagagatttcacgcagggatgggaagaaaacactgaaccattctgaagaagtgcccagagagtgtgagcctcctccacatctcttccgaagccgctggcttgcccggggggcccctcccacttccccgccctgcagcgctgccttctctgctccttggcttggctcctccttcccacccccatactggccacagcttcccacttcccaggctgccctcgtgtgaggatcccagcctcactctggaagtcagaggatccttccctcccccgagctcagtcagatttactgagtgtgtccttgagtgagtccccttgcctctctggtccccaaagggcctgtctgtgctacaaggagtggtttctgagctccagtgagctttgcccaggctcctggcagatgtgatcccccagaggggtacgtggcaggggcctgggtcaggagagcctggtcaggcctggcttccttcccagccgggcgggtggtggcccctgcagtgctgtcagcagttaccgtctgtttcatgctgaagtttatgagaagaggccgtgcctttctgggaggaggcaggggggtgtgtggtgagtagagaagcctttgttccgttagaaattccttctccccttggccctgccctcatttgtaagcataaacaacgtcgggactgaacccttccaggaaatggctccttgctgctaagagctgcccacagtccttcttctcctccatccactgcctttacccctgccctgtaggccacctctaccgaggtcaccgccaaggcctgacactggactgggctgaggggaggccctaggaattttcttataaaattcctgctagggggtctctccccaccaacacaagcctccatcatggtgggggcaattttgggggtggcagacagaagaggtgggtcaagtgtggccttgtggaagagcctgctgagcctagcctgctgcccttcacgcactggaagcactttggcaagtcccaccccttccctgtgcctcagtttcaccatctgttaataggttgataatgtcccctgccccacaggattccaggagagttggctgggggtctgacgggctgtggagtcctaagcataaagcccagcacacaggtggtgccacacaaatgccagttctctttcctctttcctcaacctctgccagcagtgtccccagagcttctgcagcgtggtccttccatgagaattctagaaagcgaagatgcctaatgctgtttcttcttttgcttgccagtccattcctacccagggatagagagctacccagatatccctcccaggtttccctcccatctctggaaccatcctcctgggactaatgcctgtggacctcagccctagcctcggcaatacctcagacacctctgctccctctcctagtgcaggcaacgaagaagagaatcaccctgaaatagctaatggtgaccgagcacttgcagtgtgccaaccactgagctgagacctttacacgcatgaatgtgtcaaatcccaacagccccgggaggcaggtcctttatcatcatcctggtttccagatgaggaaaccaaggcacagagagtttgaataacttggcgaggaactccctggatagtcacaggcagagccagatgtcattgcaggcatctggccctggagaccacaattggagccacatcccatgcaatggcgtgttggagccgggccctcccagtgcctggcctgacagcagccgtgggaatggtgcgctgaggacgtctggtcctgcaggaggctggggccccatcccttgcctgccaagcagcccacacgccctgacggacggctccagacggctgcttttctaattacatggtgcgtctgtgcttcctggctcacccctcgctcttctctttcatcttcctgttcccttcggttctcactcagtgtcttctttatctgtgtgggttttcttcccgttcatttctgaagcaggggctctgggaacaaattcccagagtccacctccagtctggccccagtccccacgcttcactctgcccagtgtcctggaatgacttgacccctccttctggtaccttgacccctgtcctttgccccaactgtgtgaggccaggcaccaggtcctgtgagctctctgagctcagaggcctgcagaaccagatccagagtgggcctggctggtgagagtccccaagttcccaccttcgatcaaggagtctcagacctcagcatcagggaggcacccatgcctgccccctcatcccctctgaagacgtagatgcttctggggagacatgggggagtgagttcatccagtgctttatttcagataatggaagatgaggggttgtgatagagggggtggcttagaagtcacaggttccagaccccaggtgaaggagaaggtagcaccagaaacagtcagagggacatgcactaacttgagatcaacagagctcagtgtgccttcagaggcacacgttgacccctctattacaaactgactggccccgggccctagctgcccactgagcactcccctgggtgtggctgacccctttctcagatctgaccagtgctgagggcagccctgccctggagctcaggctgaaccttctcccaagaatgttacagctgccaggaaggccactgaggatccaaagacgttaggcagtgggcccaggagatcagggtggtgttggtgtcactttctaactttagatctgcgcactcagcacgtatgtcccctcttaatgttttgtctgaaattctagcaggctatcaccaagtggtagtaatggcgcctgggacaaagaggcatgattactaaaggaagaaactatgtaccaattttatataccactttttgttctacattaataaataacaatggcattaatattcctgttttgtcttctgtgtgccaggcactgttctaaatgttttgcatttactcctcagctcatttaatcctcagaacagtcttatatggtagttactatccttatccttgtgaagtaacttgcccaagatcacagagctgggatctggatccagagcgtgtgcccttaaccattatgcaccacttcataaatgggcagttccccaaggaaagttactatggcaacatcatctcatagcccagcacttctttaacgtaatggcatatgaattctctggggctcttgttaaaatgcagttctgattctgcagatccaaggtggggctccagactctacatttctaacaagctggtggtgctgtcgctgttggtccggggaccacactttgaataaccactgtggagagcctgcatttaagcctctccaactcaaagcctgcgagggcctagtagagaacgtaaattcagctctagttggtgggagcagaggtgatgtggaggaagcacgtgcatgcaagctgatggggcagccactccttaacctcaaccagcaaggattctagaccagtgtggtcgtatttctgtgtgaaatctcccatttgcaaatattagggtaactcattcaacttttaagaacacttgcagcttgcacgtgaatgttcataatagcattattcataatagtcaaacattagaaacagccccagtgtctatcatctaataaatggggtaataaagcatggcatatccatacagtggaatattatttggcaacagaaaggattgaagtgctgacatatgctgtagcatgaacaaaccttgaaaacatgacactaagtgaagccagacacaaaaggacaaatgttgtatgtttctacttatattaaatacctagaatggggaaatccggacagacagaaagtacactagtggctgcctagggctgtgtgggataaggaagtgggagtaggatggggaaggactattactgggtatagggctacttttggggggtcaataaaaatattctaaaattagattgtggtgatgactgtatactctgtgaatttacttaaaaccaattgatttgtccactttaaatgggtaaactgtaagatacatgaattatatcagcaaagctgttaaaataacactgtgtgggagatagctagtttctttcatatataaaatgcagttacaaatcaacaagaaaaatattaggctattcctgcatgaaaaaagaatcacaaaaagtatgaacaattagttcacaaaggaaacacaagtgagtcttaaatgcatggcaaattcactcttgctcataataaaagacatacaagtcaaagctcctctgagaagattttctaccttttagattggtgataatgaaaactctgttgatgctgatatggaatgttaagttgggatacctgcagtatgtgggaagaaggggcagtggcaatttgctctttaaaaattagtggtgctcatacccattgacccaacaatttcacttctatattcacaaatacactcacacatgtgcaaaatgatacatatatgaagttattcattatagcattgtttgtaataatgggagaacagaaacaagctagatgttctaaaatagtaactggtcaatgcactacggagcttgcatggacttatattgtgtgcacctgttaaacagaatgcagtagctctatttgtagttatgtagggaaaactctaagatgtattattcagtaaaaaaaaacagtagccaggcacagctgtatgcacctacgtagccccagctactcaggtggctgaggcaggaggatcccttgagcccaggagtttgagtccagcctggccaatatatcgagaccctgtctcgaaaaaataaaataagataaatctttagaatggaagatgcagaaccaggaagatgcagaaccagatggataatctgtttccattttcatgagggaaaagaatgtatgtacaaatgtgcatgtcatatgcatctgtaaatgcagggcccgcctttggagtggtgtgagggaatttagattgcctcctagtaggggagctgactgggtgcagggaggaggaagactcattggcactgccaccagtttccgtgcttgtattgcctcttcaatgaccctttaaagcacactgctgggtaggccaaagagtgcctgtgtgcaggcccatgagaccagctgcccttgatgacgtgtgagttaaggaagtaatttccagccaccattgagtactttaccccttaaatctagaagagacgtgcgccatctcctctgttttttcaccatctcctctgttttctgttccctatgtgcctcccagccttcggattcccgtctgtgctctggggatgaccctggtattatctagactggggacaaaaggtgcctgcacacatggacacaggacatgaagactgaggcggaggccaggggaaccctgtggggcatcatcttggcctttggactccaatcccctgtgtttgcttcctgccctgtaggcacgccccaaaggcgagggcctgactccataccagggcaaaaagcgctgcttcggcgagtacaagtgtcccaagtgcaagagaaaatggatgagcgggaactcctgggccaacatggggcaggagtgcatcaagtgccacatcaacgtgtatccacacaagcaggtgagccgggcaggctggggccttctcagaaggaccgcgggagggcaacttttcccttaccggacctcagtttactccctcctacaagggagatctctctaagttgaccctttctttccttgtctcatctgaaatgggagggaagggaagggaaggaggatgatggggcaactgcaccaagatcttgagaccagagaaccccggggaattgtaaaactagtgaacagggtgtgctgttgtgagacagagatgtgcggacagcaggaagcagcagaaaactcaaatttccttccttgatccatccagtcggccagtgtcaacagggtggctgtgtgcaccaggcccgggcatgtgggaggggtagggccagctcctcctaggaaggtcttacctcaggcagctgcacagggaaagccactcagaggagctgatgctgacttggggacctggaggatggggggaagctaggcctatcacaagtggggggctggccatcctaggaagggggcacagcaggtgcaaatgccctgaggctgtaaggacttggggtgcttcaggcccacggttcagtgaaagcgcaggagagggcagcaagaggcttggggtagagggctagatggggcagtcacagagccctgggggcactcgagggacccaagagcagcagggctttcagattcattttaagtcagttactctggttgtgtgcagagattgagtgtggaaaccagtgggaaagccaatagcatagcctcatgtgagctgggaggggactgaactctggaggtggctctggagctggatgtgacaccaagcatcaccagattggtggtggaatgtgggggaagaacaggagcctaggagaacagtcccaccccaggcaggctggagcacctgaatggatagaggaggtcgttcctgaactgggcagcctgggcaggacacagatgttggaaatgaaaccaggggtcctctgatacaggttacatttgagatgtttgcaaaaatccagttagagatgtcaagaaggcagttagatctgtaattctgaagctcatgtgagaagtcaagatggcccaaatgtaagtgggtgtcatcaacctaaacgtagtagggaatggatttgagttcctgcagaaagaatgtagacagagtagagaagggattccctagaccaagtgatgctgaatcccagtgtttgatggtcagatagaggaggaagacccagtaaggagaaggagaaccagggggtgtggagtcctagaagcctggggtggggtcgggagagtgctgttggaggcttggctggtggttggtgctcaaatgtcaggtatagagaccacagaggagtgccttagaaatctggcaataaggcgatggtcctcaaattttacaaagcaaaacaaaagcattacttttacatggggaacttgaactacaaccaaggtttgagaagcacagaagcccggccagtcaggcatgagggtgagagtggaggtgctgatttgtagctggcctgaaagtcaaggcagtgtccatggagcagtgttaggggaggctggtgtggatctggctgcagagggaattgcctcattgtccactctcttgaggagagtttgattgttgagagaatcacagcagtggccgcaactgggaaggagcccttgggctgggtgttgtggagatagtagagcttggagcccagtgcagtctggtgagaatgatctagaagacagcaaagggctgatggtgcaggggcaaaacgggggatgcttcacccatcggcacaggagggagggagaagagggggtaattaggaagtttcatgggttggatggtgcaaagaagaacctcacatccaaggcttctgttttctcagtgaatgggagacaagcgggctggggcgggcttgaggaaggatgagcaaggaagcagcctgctagggaaagctggctggaccacccagccgcatcccaggcccagggaggtgtgcaatcctaatgcagtggcaggcatcagcctagttccgtgacttgctccagcacagctcgcctggcaggtgcaggccaggcctggtgtacggagggtccacggggcaaaggttggctgggcgagcactccagagggcagatggttggggggtgggcctatttgtaaaagtatgatgaccgtgcttcatcgtggggcatcggcagggaagggaagctagacgggaccggtggagagggaggccgggtgggcctgtggactgggtggagtctgggagccagtggaatggaaggagagaacgagggggcagagatgggtggtttctgaagaagcccaagtctagggtgtggctgaggggtggtaggagggaaaggtcactgtcgatgaggtagtgggggatggaggagccaggggtgggatgggccatccatgtgtactgagtcaccgcaaaggacaagcagacagaggaggcaggaggggagagcgctccgggagctactgggggaaggctaccctgagggagagatgtaagacagctctgatggggtagaaggtcagtagaccgggggcccggaggatagcttggagcctggaagggcagataagtggcctgggagggagcaggggaggagggaaggcagataatggtggctggctgggggcaggagtcaggaacagcccagtttctgcagggcctcagatgtatgggggctgctggggtctgtgctgacagtcctgggggctgggtccttacgacccccactgtgacttaagcagagagacagggcccagcctgtgcaccaaagccccacaggaacccagtctccgcagtggctccagccctcagcccctgccccgatactgccccagcttctggctgggcagggctcctcaccatgccccttccacaatgccaggcccattcctggcttgtgtcaccatccccaagctggcaacggccccacctgcctcgccatctccatcctgccaagctcagtcccagcacagctccctgaccacctgtcccccatctccacattcaggatcagctctcccaggacccaatctaaaggatccctcaagagtgtgtggctgggcccttcccctcttccagtcattaggccactgttgagcacctactgtgtgcactggggacactgaggccccaaaaggagacaggacttgagtagtcaagtgaccagtgaccagtcagctggtgtcaaggggccctggaactcaggtctcccaccgcccagggctctatctcctctcctgagctcccaagctgggagggggtatgagagtggtgcctctctatcccccagctgtcgggagcctttgaagagcccagcggcggtgctccccatgttgccccgcggtggagagggctggtttatttctcctgccccacagagccctgacctgtgtggcctccgtctctggagaaccccccacttccccactctcctggccgccacatctgcttcctgtcggcctccagctgcagctccccctaccgactccggtcccctcaagaagaaaacaccactgggccttgccttgctgcagggagtgggggaggccctccaccacagtcagccccagctgcagagtgttttccgtctgccgaggggaatgtcttgacagcttccccaggctcctcgcccagtggcaggccaagcagggctgagcagtcgagccagagcccgtgcccacagagggaactcccaccatggggtcatggccaaggagggggcacagctcagatgagcccaggagggtgctggcaaggatgtttcaagatcatttcacccgggacttcgctgtttcccctgcccccatgctgcccctaaccctatataacacatgataccaatactggccaacattttgaatgctctctatgtgccaggcactgttctaatccctttgcatagactaatttactcttcacagcaaccctatcatgtagagttagcctacagacttagcccccattttatggaggagaaaattgagtcccagagaagttaagtgatttgctaaaggtcacacagcaatcactaagtcttctggagctttttatggttataaaatactttaagacaatcatcgcagctgggcacagtggctcatacctgtagtcccagcactttgggaggccaaggtgggaggattgcttgagcccaggagttcaagatgagcctggtcaatatagtgagacctcgtctctataaaaaaattttttttaaacaattagccaggtatggtggtgcatgcctgtggtcccagctacttggaaggctaaggtgggaggattcactgcactccagcctatgtgagagtgaccctgtctctaaaaaagacagtcagccaggcgcagtggctgatgcctgtaatcccaatactttgggaggccaaagtgggtggatcacttgaggtcaggagctcaagaccagcctggccaacacagcgaaaccccgtctctactaaaactacaaaaattagatggatggtggtgtgtgcacctgtaatcccagctacttgggaggctgaggcaggagaatcactcgaacccaggagacagaggttgctgtgagccgagatagcatcactgcactccagcctaggcaacagaaatgagactctgtctgaaaaaataaaaataaataaaaaataaaaataagacagtcatcttatttacttctctatcacacagacacacacacacacacacacacacacacacacacacactaggaaaaagtcagtgaatgttattaacctctcacccagatcccaaaagggcaagttgaggttgtggaggagaaagatccttcccaacagcccttagctgataggcggcagagctggcatgcaaagctctgtctatctgactttggtgatatcatgtcatatggagacgttgcagaagacaccagacacagagttttccagaacagtcttcaaaacaagctggcagtgaccccttcagtctccatggaggttctgccctcagtcctgggcctgcaaaacctctgtcagccccagagatgaagactcagaaggcagatgccagtcagggtgggtgcagctggcaggtgccagtgaattcccaggggagagcgctgtgcctgtgaagacacgttcccctccatcaaacacaggagggtgctgccctggggacagaaagccagggactcagacgggctgggagggagtgctgcagtctggggtgggcactggtcacaagctggccctgagccccaatacagtgtagccagtggggccagctgcaggcggtaggcagtatgtccctgcagtgcagggcttggaaacagcatgtgtggctttccagccaccctacctaccacctcctcactgcaggccccagggatgtccctaacgtcttggagcctcagttgcctcatctgtggaaactcccttccccatatatctgtgacctgtttcctccctgtgccactcacagggaggtggtgacattaggtggcgacattaggtggcctgacttaggtggcagtactttgccacataatgtgtaagccatggggagtgagggttgtgtggggcctgctgagtctggcctttttggcctgtcctggaagactgggtccaggaagaggccctggccagtcaagggggtgggggctgcaaaccagctttgttttggtgtgctggaggggacacttcacgactgtactgatcagaccgtcctttgggagccaagcagagtctgtgtggctgggatctccaggatgaggtgacagggacccagattctaactcaaggtgggaagtcttcttacagtgcaggcagtaaactgagcggtgggctctgccagcaggcagctctccagccctgagggcacccaagccccagatggaggagctgttggaggtctccctgggacgtccaggaaagcagggaacgtgcccttcctaggtcctttcaccttgggatcttggcttaattttgatagccctccaccagctggtgtccccctcccaccgataagacaaacgacagacagcttctgcatgccgggctgtttgtattcattatctccattgagttgtctggtgagaacaagcccatgagaaagctgttatcagcatccctgttcacagatgggagcatggagaccagaggggacaggtggcctgcccaaggtcacacagctcttaggtagcagagccggcattcgagcccaggtctgacaggaagtccaactcctctcttccctggccaggatgaaagctggacagggaagccagtcacctgaaagcctcttgtgatgtggttgacgtgcctgtctttccctccaggccttggctttgtgactttaagcctgggagcacagggatgggttttatgacccctgggccaggggcagaagggtggtccctggatcagaaccctcccaccacagtctccccacctgccttctagaaccttctgactcttccattcccagaccgctctgagtgtcctcttggggccaagactgtggattgggtggagaagccagtatactacttttgagccattcacagcctggccagggggacagagcacaccctctgctgccctcccctgtcatccgggccatggtctgcagtccaggttctgccccctctcctgggcatgtggccccaggctggccctgaccagcttcctgtgagccccccatgtccatgcaggggacccttctgcaggcaggggctccagctgaacagaaggcagaatccccgtgagctggccaagaaagcatccactcaggagctcttcgtcatagcctccataaattctccagggaaacaagtcttcgccagctttggagagtcaggaggggaggaaaagagcgagcagggaagctccctctctaatagaaatgtgctcgtctgtgccttccgctgtccagttcacacactcccagacgtctctctggatcctcccagtcccctgcaaatgaggcactgtgaatggcccacttcacagatatggaaacggaggctccctgcgatcacccagtgagtgtgtggcaggacaggcccggcaagtcacctcccttctctgggcctcaggttccttgttggaaaactgaggtttcattcatgcagcctcaacaaatagggcactgggccggccctgagatgtgggggtcaatcaacactcatggagctcactcaccacaagcccgaagcactgtgactgtgtccgggttaggcttcccttgagttctgaggccacacaagcagggctgcgagtggagagtggccagggaagaggcgccggatgctggggtcgggagatgtgggtccaggcctccgttgctgtgggcctgggtttcctcatctgacaggctgcacccgtgtcctgcctctaacctggactcacgtgaacttcaggtgctggctcctcaggcagcactcagggcagagcagagcagtgcacatggccagggtgccaggtacaaggcccctccacagccctggcccagcctagggccccacctgtgtgccctaggactcagacgcctgcatgcgggctcaggaggagggccccggcaccgtggctgaaacaacctgtgaccacaggcgccctctccccacccctcatcgggtgtgtgtctctccctcactgtgtctgtcagtctctgtctctgcagaggtgtgcctctctgtctggtcccctccctgtgtacctgtctcacctgtctgtctctgtgtgtctctccctgtctgtctctgtgtttctgtctttctctcccctcactcccctgggccccttcctccttctctctgcagagacccctggagaagcccgacggcctggacgtgtccgaccagagcaaggagcacccgcagcacctctgcgagaagtgcaaggtcctgggctactactgccgtcgcgtgcagtgacgggctgcccgcccgcacccagagccaccccccgccagcccgaggagacgctgcttccctgtgctactccgaggggctgcgtgtcgccctgtgcatggggtgccctcgcaggcctgcggggctgggccgggggctcttagcgtccttgtcttgtgtgtgttgacaaacagtgttactgacattgctgccccccacaggccagggaaagcagggagtctggggctttttgcaggcgggcctggggtctcagtggaggggacaaaggcaagcaaaagcccatgtccaggagccctgggtgtccccacaggctcgcctctgagagcctctttggggtgagcagccttgtattggccacaggtgcactaaattgactgtgaatcccaaacctccccagaccagccaggccgcctgcccccacccagaaccttccggtttgccctgtatggaaagccactctcagaaatccctctttcctgagtcagcaatcgtggcaaggggacatgtgttccaacagcggctggggagtggacctctctgtcccttgcccaccttaagccccaaatccagaccccctctgacatcactggcattgcacctgggtgtgcccccctccccacgctatggacccagataggaggggttaggcatgggggaggcacagaatgctggagagatgcgtcctggtgaacgtggggcagcccctcccacgacccccaccagactgccttaggttttgtcagccccactccctttccttcccctctgcctcccacccactctgggggtccacatcaagatagctgggcccagtgtggaagcccagcgtgtctgttccagcagaaaggacacaagcctggtgttctggagacctcggctcaagtctttgccctgctgccgacgcattgtgtcaccttgggcaaggacttcgcatctccaggcctcagtttccccattagttaaatgacagcataacactagagagcagagggcccatttcagctctgttgttctgggattcaggctggccggtgctgtgtcctggagctttatttggggagtttcacccagaatggtgggagaaacctcccaggtgccaggtaccccgcatcgtgacccttcacttggtgtcttaggaagtcaagctgagggatgctgagtcctcccctgctggcccctgcagccccagccctgcttttcatcccccacccctgcaaacatggaggagccccctccttctcacctcggtctcctagcccctgacatggagaaccctgagacaagccacagaacccctcttttctaaaatggagacaataatttcctacctcccaagggagcagagaggcctcgtggcacgtccgtggccagggagcccactgtcctggctggcggcgggatcgtgcgctcctctgtctcccggatgagaagccccgtttccatggtcttgacccttcctttctcccggctgtcagaactgggtctcttgattttgcccctacattatgcctctgtgggaaaaaaaaaaaatcagaccaagaaatgagcctgaaattcagtgtttaccatggctcaaggatgcccatctggtgtccagttgccttttgtattcaaatgaaaatgctttgtacaactgaggagttacagtgaagtgttaaccaggggtccagggagcgagttgaaaagatggagtgagtgtatttgcagccagggagctgcagggtggatttgaggggccataccctctgagcacttaaaaaaggtatttgctccaggccaggcagcaggctgtggacacccttgccaccactggggactgccactgaggactccccgagcacgttgttccccgtcttctccaaggtgttgaggtgagctggggttggccccggcccaggcttctgtcccaaggagaagctgccactgacagtcatcctaccgcactgctaaagagaatgttcgcagtggtgggcggcgtgcctgtgccaacccttccagggacccggccatgggggaccttggcccaaggatgcctggggcctgccagctgtgctgcaaaggtggggggcccacaccctaaaactaacccaggccccagaccactggaggccagggcttccctgcacgggctaaggggagttgggatatcaccccaaagtgaccttgccagtgagctgttcagcaggtagccactgccctgccatctgtgcagagccagccaccttgggggctggggttcccgctttgaggcccaccttccatactccccttgactcggctctggctgaactggggaactctcttgtggtcagcaaagcccctgccatgcaggccaggtgccattgagaattaagtgctcagagggccaggagcccaggggatgggaaagtgtgtggttttagtacgttcaaaagggacaatcgcttgcagttggtagatctagcgatctagttgggagataatggtgtttaccccatatgaagtattcaatagttctacttgtgaatttgtatttattttgagttatacttgacacagaattccttttttaaaaaaatatgtgtgtattttggaaaaaaaattcatagatgttaaaatttctgcatggttaccagtttttctcacaacactgaatttggtagcttttcccgaaaaaatcttcacagtaattttttgtctgtatatatttgagggcctttttttaaaaaaaaaaaaagaaaagaaaaatataattgtttgatttttgagattaaaacaaacaaaaagagaggcattttcaaaatttcagaactttcaggagggcaagagaatatcaaacaaagatttctggaagtattttgccaaccttctggttgagctgcaagaaaatatttatggtgagaacttttctgtttcccgttattgggtttttggttggtttttgtttgttttttactatgctttggtctgtaaaaatatgcaactgaactacattcagaaggaaatattgtctacatagaatattatatgaagttggtacataattctgatgaggaaaaaaaatctttgcaattctttaagccatattgttgtttttctgtgttgttttccctggatgaaaatatcagtattaagtagacagcatattattcaagtgtttagacttattaatatgttcttgtcctgtatttatacatatgtgtattttggaaagtattgccttttttaagggaagctataattcgatacatagtgaaaaagggaatggtgacccctttgtgcctcttccactgaggataacaaacagcattgtaatccattctcttgcaccttcttcttcttatcttgttattacggttttattaattttgtagagggacagggagtgggcaaggggaagaagcagcttatttgactaaccagcccctctgtggtccaccagcgtcttggcttggtgggagggctctcaatcagcagggccccaggagggaagaagaagtggggcaaagcctggcctcgccgctcgggagctttgccatctgagccacgcctcctccaggccatgctccttgaacttggaaatgtcaaccggagcccttacaccagccctccagcatctaatagacttgaatctactctaaacgaatatttaatccaacctcactacattgtagctcagtccaacgactaaccctgaaatgggggtgttccagccttcagcgagatggccaagcggtcccctgggggctgtggcagcgggcttatccttctctgttgccaaccttgccgtccgacctcctccgcccccatgcggtgaccccgtccgtgtctgtgtctgtccatacgtgtgagtccagctaaaaagacaaaacagaacccgtgggcccagctcggaaggtgcgtggagaaggctccgacgtctccgaagtgcagcccttgggatggcattccgttgtgtgccttattcctggagaatctgtatacggctcgcctatagaaatatagcctcttcatgctgtattaaaaggacttttaaaagc

SEQ ID NO: 37703 - DNA, 63299 bp, Homo sapiens; identical to SEQ ID NO: 37702

SEQ ID NO: 37704 - DNA, 17921 bp, Homo sapiens
gcagcgccggtcgggagcgcagcgcggcgcacgtcggcgcgcacggcgggacgggcgccggagtggtcgggcctggcggctggacgggcgcccctcgctgccccgcgcgctccccgccgccccccatgagcgcagccccgcgcggcccgggtccgtaggcggcggggcgccccccatgctgctgcagcccgcgccgtgcgccccgagcgcgggcttcccgcggcccctggcgcccccggcgccatgcacggctcgcagaaggacaccacgttcaccaagatcttcgtgggcggcctgccgtaccacactaccgacgcctcgctcaggaagtacttcgagggcttcggcgacatcgaggaggccgtggtcatcaccgaccgccagacgggcaagtcccgcggctacggcttcgtaagtggcccccgcgcccgggcccgcaccccgccgcacaccttatcgcggcccgggcgccgagtccactccggggcacacgcccagacggcccgctgccgcccccgccccaggcgcctccagccggcgcccgcacctgccgcctctcccgggcgcgctcctgccggtcccgcccccaccaccccaggccccggcccccacccccacccccacccccacccccacccccggtttaaaaggaagagccgctgtgttcaattaggactcctaagttggtggggaggttttggagccagagggcactcgggatttcctggagcagcggggggtgaggagcaatggctccaccccggggtgttaggagctcttcggcctcccccatatttttaacagccctctcagccgccccaaataaacatcagcttaagtaaaaacgtcttgaagacactttcctgcttaccttccaagcatagcgtcgcaaactccttctcagaggaaagtctcggccctcactggtgggcaagtccaggcggccccccaagctcccttcggggttcatttttgccctatccccgcaggggattatttttgtccttgaaggccacatttcccaggccttgaactttgacgggaggagctggaatccaggaggcatctttgtgggagagccccaggtagggttcagaggagctttggctcaaggaccctgggtcacaggcaccctcagaggaagggaagagaggggtggcagcatccggtgccagggcggagccgtctgcccctttcgcccctggttccccccacggcagcccctgatgtgtctctgctccaccaggtgaccatggccgaccgggcggcagctgagagggcttgcaaagacccgaaccccatcatcgacggccgcaaggccaacgtgaacctggcatatctgggcgccaagccgcggagcctccagacgggtgagagcttgtgttttcctgcctggctcttctcggtttctatattgggtgtcggtatctgtcgggtggaaagaggccccccctcctcgccccagcagtggcagtcggctatcatgtgcctgcagagccggcacagggcagccatccccccctcgaggatctagaccccttctcacagcgtgtggcccaaagaagggggcggggggcagggagggtactgcaccccagttgccagctgtcctcgcaggagggaggaagtggccatggggcctggaggttgggagtgccgacaccagtggctgctgacacctgcgtcactcactgccacacttcagcggtgtgccttggggttcacaagggggaggcctgggaggggagaggaagcggatgatcccttttgactagaggtgtgtggcttgtgggattctgccaccctgtgtgcagcccttgagacgtggctcgtgcagcaaggccaagtccctgattgttctctcgttttaggctttgccattggggtgcagcagctgcaccccaccttgatccagcggacttacgggtgagtggacatggctggcttggggtgggtagtccgtggagatgaagtggagagggccttgggcttcctgggtctggaaggctggggaaatgacagttttcagacatttgattgcgtttaagccaagggagtgaagagaaggcagattgcacttctccatccctggcagaggccataccacctaggggatggtgagccttggagcctgcctgccttggtacacaccccagctcccttcgctaggtgtgtggcctcagtttcctcacccgtaaaatgggagtggtcacagcacatctgagttctctgaatggagggcctagggtgggcctggtgcaggtaacgccctcttgaagtgtttgctgatgactcttagggactggcaggctgagttcttccccaggcactcctctcacctgttctagtgctggggcaggtggtggcagtaggtcattgctaccaaggtctgatgtttgtgaacgttgctgtagatacgatgtgtttggggtggaggccacctgcctgagtggcctggcctatgggcttctagtctgactcatttacaagcagcgcagcccactcttctccatcctaaaacgcctcccacctccctgcccttttttaaaacatctagtaagtcctggcagctgcttggggagggacacacacacttaagggatacaaagagtcctgccttgcggcctgcctccccacccccatgatggatggaagctgtctgccctagcgccgtggcatattgatggggttggagttggaggggaaggcagctcagagaccaccacccctttcagggcattggcacttcatgaactttctgaatccaaatccctaatgccagttgatcacgtgtgtgtgctcacgcatgtgcgcaccacgtagattccattgagagagacacagcttgaggagtaacctgcctgactggggcagtgtggacaaggatcctgtggaacccggctgagcctggctcccaggtgaatgggtcccctggggcctggctcccaggtgaatgggtcagaggccccagcagaagttgctgtgcccactttttgggaacgcttggggtgactcgggggctccctgccggcttccgtgtgtattggtggatgtgtgcaagtgtagcagtgggaggagccgctggctgaggggtgctggagggtggccggggcccttctagcctgtgcgagtggccgggcagctcaggttcctgccggggtgcctctgtcctcctgggaagggagcgtgtagggtggtgggagcaggcggccctgtccgtctcgtcctggaatctgttttgtagatgtctagagtcgtcttagagggtgtttggggacactgtagccttcatgccttcaccgagattcttcctatggggttcaggccacatgaagagggtgttccttgttttccagaaccttggctccattccccaggcccacagcaggcgcctgggggcatggactgggcgggagcagctgcccagaggtgagggtgtgtgcctccagtgcctgcagctcttttctgcttacagtgggataaggccttcccacgtgcgtctgggctcgctctgatccacacagctacctctgggactccatacccatcagtgcttggcctctggggcctgcagaggtgggttcgaatcctgactttgccccttaccagctgggtctgtcttggcagtggcatcctcatccggaaaacaggaacattaactgcttaaaacagtgcacaggcatgtgggctgggtgctctggcctcctcagaagtcctctcctgtcctcatagcaggcctctgaggatgggactgaaaccattcttactttatagatggggaaactgaggcagagaaaggctaaccacctgtctgggcctgggggcgggtggcagggccagggtggggaggcgtgaggtaatagacgtccgggaggagattggaacacaggtggtgggtgcctgaacgcatgctttcttggtgggggacggtgggaagggccctggcccgacctttcccttgctgtcctggagtcctgtgaacaccacccatccagaagcagttgggatcggtcacagagtttgccactgtgtgcccccgacttcaggcgacggtgttttgtaactaaatctgctggctggccatttaatacttgtgacgatgaagaggccgcagactctatttgttggttgccaaagggtggagacccaaacagggacggtgtcagaggggccatccgctcttggcttcctgggagatctgaactcaagcctctgagaatcgcgccgcctcctgcccctgcctgggccttactgaggtgggtagggggaggctcccgggtgcagctccagggaggcagcggggcaggctgcctgggtcagctgtctgcccccagcccccgcccgctgacggagctggagagctgggccggagctggagagctgggccgtcagcgtcccttttgtctttgtgaacaatcaggccccgggagcacagccgggcctgactcagcggccagttttgtcggccttgggctggcagcgacttgctgttggctgagggcatggagggaggtgggagccaggagcccaggcagctgagggttgtccaccagttaaccccttccgtgcctggctgaactcttccttgactttctgaccccgaccttttataccttgccctggacaactctgaagatcccacagctctgcttttaggcaagaccctgtggaatcttcttcgcctggctgggtcttaaatgttagtttagaatgatttaccaaagaactttacactttatgctatttgccggagtttccttgcctcttttcctttttttaagttgaacaagctctgtgagacctaactcacctgtgcatttctgacctaactgtatgtggccactgtccgcggtttggaggagccttcctcggcagtggcaagcacgtggtagtcacagcaggagccggtggccgtggcccaccaagggtgtctgccagctgagtgtgtctgtcacctgccggtgggaggggaggtgcagcagtctggagagggtctgtgtccaggcagagcttagtctggcctggaacggtgccctgtgtcaaggggtgtctgtccattcttgggctgagggcaccgggagcagaggtttgtcctgggactagctgcacccagagcctctccttgggttatttttgaagggccagctgcttccctgggtgcgggtctccctgcctgttaagggggcctggctgtggccttgactcccgttcacagagtgcctcatatgtacattatagaacgtttgaagggggtggaatatccctggcctccacccctagaagccagtagcattgcctcgcccaagtcatgactaccaaaaatgtctccagacattgccaaatgtcccctggatttagtggcatgaggaccagtatctgtgagtctcttggaccttgcctcatggtcacaagatgactgccacggctccagacatcccacccacgttcagggcagaaaggacaataagggccagtacgaactgcctctgtcttttttagcagaaaaatggaagttttcacagaggccacaacaggcttccacttaagtctcactggccacaactgggtgacaggacacggccaccacaggggctctgagatgagaagacaggctcctcggactccggagtgtcaggtacaggctgtatccaggagcaagagccctgggggtctgcctgggcttaaggccaggcccagcctgtctctgcaggctcctccccatctgtgagtgagaacggtcacactgccttccctacagggccaacttgactgtgtgtggagggcctggccctgggaagtcacggtttgtcagtgacgcatctcttgccggccctgcttcagggtctgttgattgattacctgtgcaaaaccgaggcttagagcaactgagagacttgctgagttcacacatcccaggatggtggggcctgagctgtgggctgcgagactcttgtccctcccacaaggactcaacgcctccctctggctagatggcagctcttggatgattcagagcacaaggcctcgagactgatgatgaccgtgagaccctctcccaggcatgtgcctgccccactgcatgtatagtttcagggacccctacgtcctttgtgtgaaggtctctggtgcccactgggtagtagatggctgcccttaccatcacggggccttggtgtgtgcacaccacggggcctggacagagcacctgggtccccagagcaagaggacgtactggggaggcagtgatgggaagatgtctgtctccttgagagcatgggatgcacaagctggggagaatgtcgacagctactcccagcatcattcattcatcaggtgtttattgagtgcttgctgtatgccagacctggtgccagggatcctttgaataagaaagacacggtccccgatctcgtgctcacattctgtttgtgcactcgtgggcccacatggtgatgcgtgcagttaaacaggaagctggcggaatgagtgcctgcgtggggacggaacagttccgcgtctcgagtacagtggtggggagatgtgtctgtgtgtgtgataaagcttcacagtttgtgtgtaactacacatgacatgtaagaatgttggtgtgtgtagaagatgatgcagcgtgctgaaggcctgcagtccaggtcatagcagtgtgcctgggttagtgtcctggttttgctcatgtccttagttactctgatgtgcccttgggggatggaggaggtagggtacacaggatctctctgtactgtttttgcaacttcttgggagtcttttattattttataatacaaagtgaaacaaagccagaggagctgtttgcaggtgatggcgtgtgtgtgtgtgtgtgtgtgtgtgtacgcacgcacacgtgtgcgggcgtgctggggaaggctccactgaggatggcggaaatgggccctgttggcttctggggaagagcgagcagcccaggcccagggtgacaggccagctgcaggtcgccgtggcgggcacagggtgagcaccgcagggcaggggcagaagctgaggtcagagccaggcggcatgggggctgggaggaagtgactccccccaacactgtggcgtcacgttttcaccctcagggtgtctcgtggtggccccgccgcccccctgcccccccacaaggcttcctgtttggcagctcatctggagccaggcgtgggctgcaccgtggccctcctgggcgggcgcccgtgccgcacctgttgtttgtcctgtctgctgaaacagaaagcagcctttgggtggcgggggctcttctccgagcatgagttctcaccctggctcgctgctgggcttggggagcctcttctggaagccttgggccaaggggcacagctttgtctcagggtagaagcctgatcacagactgagtggaggcccaagctcgagctttcctcgtttagcctcagtttcaccttgtgtccagggtggacaggctgataactctgcagtgtgcttgcgggcatcaggaccttcctgctgatctcatttggatagagtagggagctggacactgggtcagcttgtctgacagatctttgcttgctttgtgccaggctggggatgcctgccatgggggtgaggggagacccggtcccagctcctaatcacagtgctttctgcagcgaggtgctgagaggaggacagagacaaaggaggtcagcatgcctcagaaggcgacaggagctggggaggggaagggagcagccggggaggctcagggcccgacagggtagcctcagctcctagaggactttgatgacccagggaggcactgctacattcctccaagtgacaccggaccacgcaggctccgagcggaggagggatgggtcagtctgcatttttgttttcagagtgtttttgcttctggctgctgggttgagcctggactgccgagggtattgtggtggttggaggcccttagaggatgcccagtaatccaggcatgagacgagggtgctgcctgcaccagcggccctggtgagatacagtgagattctgggtgtctattttaaagaacctgggaaagaaagaggagtccaagaagattctggagctttgggcctttgaaatgggagatgggcttggccctgactggggtggaggcagctgtgcagtacagttttggggagaaggtcaggagttggagtttgggccggttcaggtggagatgctgttccgggcctggcattgccccacagagagggcgttcgacctgtgtcctgtggctggctgccccacagaacttgaatgtccctagacctcccggccctccccctcacaagtcactggggattcccgggaggcagggccatggcctggcttcctgcctgccaggcgcctcggggaccttcccacacccagccaggcgggagtcagaaccctaagagctgcggtccgtctctgccgaggtggggcaaggcccctggagagcagggaaagtgaaatgggctcatttgcctttttcgtttttattttcagaggcgactttatgttcagaaaatgagtcctcctgggccgtggtcagttcttttcgctgcgagttctgctttgagtgtgggcagcatgtgtccccagcaccatctgtacttctctctcccgcccaccacggggttctcagactctgccggaggcccaagccctctgtcttgggggcaatctgttggactctgcagcatccttagtttacagatggggaaacagaggccggaggggctgagtgatggtccatgcgacttggacaggcatggccaggatccgggcttggggctcttcctgcccttggacccctgagtctctgtggacagagtcagctggggtgctcttgactgtgtgctgaccctgggtgtgttggggtgcaaatgctgcctgggccacgtgtgaacgggaagggaggcaggcacctcagatttccagtctggaccaggctcggggtccccctgtcctctcctgggctgtggcagagccagctcctcctgcatgcccaaccctcccggcatggcctggcctttccagccctaatggtggcccgtttcagtggctccgtgatttgggggtttggtgttgcccaggctccggcactagagggaagcagagaacccctgagtcatccttccgcagacaccccggaccccagctaggtgcctgtgcccagtgtccagcgttgcagtggggcttgggtggcatgtggggggtctgtcccacccattcctgtggtttcttccttggctctgcctggactttgcacacgtggtgggattaattctctggtaaacagatccgcctctgattggtgcaagacccttctctggggtcttggtgggaggatagaagttttctgcagaggatgaggaggcacagacgcccggttgttctgaggccggaacttggaaggaaactggaagggaaggaggctcctgccctctcctttgaggttacagctgggctgtggctctgcaaccctggggagcgcgtgggactccagcagcggccgtacagagggccgattccaaagtggcttctagaggagggagcaagtgccgtgtgcccaaagaggccggtgggccctggccaaacaggagcagccctgatgagcattgggtcccccgacctttgggctcctacctgactgcgcctggccgctggtctgttttgctcaccaagggttcttggctgctgccccctgacctggggctgaaagtcctaggagagggagggcctctgtccctcccagcattcctcaggcccaaggaggcgtcgatgctgctgaagtctctggggtgcacagaagcaatagatcctcacagcagccccctggggcgtgtggttccccagaggcagtgatgaggtcacccggggccgccaggcacctggtcggggagcagaggctggcgggctgtgcctgtctagctgtgacttgctgggtggagccgtgcctgcctgtccctccagcctgcccagccctggctgctcaaggctgaactgctttctctgccttcttggggcagggactcttggcctgggaagcagaggccattccacgggggggctcttttgcctcccagctacctgcaaagccggggcctgcctcagatgctcagcactgggcacctgctgtgctggggcacttgggacgcagcagctgagaccctgctcttgtggggaagacattgtgcaaggtagatgatgaaggggcttccgatcataaggaaacagagccgcctgggtggacccctgaggggtgagctttgagctgtgggaagaagcaagtgcataggtgcgaaggtcctgtggtgggaaggagtcgaatctgggaacagaaggagcccagggcagtgggagtgtggccagggagggcgcagtgcaagtggagatgagttagaagaggtaggttgaggcctaataacgcaggaagccacaagggagcagtttgggttttcttctgggtacagtgggaggcagctggagggttctgcttctggaggtgatggggtgttgatgttttcgtttgtttgttttttgaaacggagtctcgctctgtctccaggctggagtgcagtatcttgatctcagctcactgcagcctccgcctcccgggttcaagccattctcctgcctcggcctcctgagtagctgggattacaggcacgcaccaccacgcccagctatttttgtatttttagtagagatggggtttcaccgtgttggccaggatggtctcaatctcctgacctcatgatccgcccgcctcggcctccctaagtgctgggattccaggcgtgggtcttgatgtttttaagacagctccaactgctgctgggtgaaggattcagggatggaggcaggtctccaccaccaccaaggcagggccacgccactgcgcccgcctggagagtcggtgatgaaggagagggaggatcggagaattgagggatggaagcagggagctccctgttggatggtgtgggcataggctgcagtgggggtgagtgggcagggcagtgcctgggtggcctggtgggctcttcactgaggtggagagtgcaggagagtcccaccagggccaggcagacacgtgccctggcaggcgagcctgtgcaggggacacacttggtgggtggggcggcgtgcagctaccaggctgtgcccttgtgtgcagaggctgtggcacctgagctttctgagcatggcgtgtgagtggggatgctgaggaacctgcctggtgcgtgcacccgctccccattgccaggcagtgaagccttgggcctgcggccggggcggggccgcccttggacagtgcagggccggtggtttggctgcatttttctttctcacctgaccactcagtgggttcgcccatgcgtgcgtggctgcatgagcccctctgtctctctttgctcccacctgccttctttgtggccgcccggcgtgggcacctgtggtcagagcagcagtgaggatcccttgtctttgcccttccccttccccatgtggtttctgatggtccacagtcgggcgtctcagccttggcactgcggacctttaggacggcatcgttctttgttgtgggggcaccctgagcattgtaggaagcggtcagcacccctggcctcgacccctaatgtcagcagcacccccacccgcacctcatattcctagttgtcagttgtgacaactaggaccgtccctaggcattttccagtgtcccctgggggcacagttgtcctggttgggaatcgctgttctagtggcacctctaggcctcacagcaagcttttgaggtcagcctctgtaggacccaacttacagatgaggaaactgcgccttggaagttttgaaacctgtttggtaactcagacaagtgcaggggcgaggcgcaaccctaggagggagagaagctgctggaacccagctcctgcctggcggggcttcgtggctgcttctaccttaacttcagccggtgttctcactcccccttggggcttgaggtgtggcccgtgctgtgccttccttttattttgagctgaacctggggccccagccagtccttgcaggcacagctaccagcagcaggccccactgtaccagtcccttgctctgcgatggggcaagtcgcttggggcctctctgaacctcggatttcctctctgggagatgggctaacactagcatcttttctatggcttttttttttgagacagagttttgctctttcgcccaggctggagtgcagtggcatgatctcagctcaccacaacctccaccttctggtttcaagcgattctcctgcctcagcctcccgagtaactgggattacaggctcccgccaccacacctggctaatttttgtatttttagtagaaatagggcttcgccatgttggctaggctggtcctgaactcttgacctcatgatctgcccgccccagccttccaaagtgctgggattacaggcgtgagccactgcgcccagccttccgtggctttgaaaatgcttcgtaagttatcccaggccctttacgtacagaaagatgagtagataccgacatgcagtgtctgcaagggtcaggaaacaggagagccccgccttcctccccagcctaaacattgctcacccacgcttgtgtttgagtgtccctgagtagggcagctccttggtggccaaggcagcgctctggccccgatgatgtggggcatcagaacccgatagaaatgacgcagccctcgaggtgagtgtggccggaacccagctgccccacagccccaggcacttgtgttctgtgtccctggtctgggcagcggttcttgaatgcagctgtggatcaggaccccggggcctgttcttgcacattcctgggccccatctgcctttgcagtctgcatgggatccacatttttagcaaaaccttgcggggagatgtctgaggcaggggcatcactgcccatgtttggagaaggtgtgtgggttcaaagcttccatagcctcctactaaggaatgttttcgaggttctgagagctgggtcgggggggcactgatgatgccagggacagcctgctgggcacagccccaagacagtccttgctgtgtctccactcgcccccttcccaagggaggcctccgagacccttctggggccccctgcctccgctggccagagctcctcatccttctcagtggggtctgtgccacccaccgggcctttgttccgtcagcaccatgtgcccagtgcctcctacaggcctggtcctggcagagagctgggagtccagacagagccatctccctgacagaacgccatccagtggggcatcgggcagcgtagcgaggtgaggggctggcctccatgtggggttgggcctcgccaggttaagggctccaggcagaggcattggcaggtgccaggcccaggtggggaggatgcgagggattgaggcgctgtggggcatgggccggcaccagggtggacctgggtgtgcagtggaagccaggggtcagcagacccggccgcccccatggtggaggtgccacgagagggttgtgcacagaggctgccggctgccctcatccactcttcagacactcagactggcgcctgcctccgcccttgtgccgccatgctgctcccctgtggccagctctgcctcatcattaggtctctgcaggcatcccctccttcaagaagccaccctggcctttcccccatcgctgtccacacatcacagccctctgctgtcttgacttcccctgagccccccactctggtttatgggttggtgcattttggtgcctctcccatcctagaagctaagcccctcgagggcaggggctctgtggtctgctcctctctgcatcctggcagatatgtgagaaaggcgtcacagctcgagagtcagaattcaaacccaggcctggctccgcgcgaggcccttgttcccatggaggatgcagggtggacagcagaggcttctaacctggggagagggacaggaggcgccactgcggggttcctggcaggagctgcctgggcctctggacagatgctgtggagggttggccgtgtgggctgcaggtgtggccacagcagccactaggatggctcaaccttggaaggtaaacagtagtagagagggtgacgcagtgtagaaacttcccacacacttcccagatggggtggggggagcaagaggccctgtcgtccaggttttcctggtttccaccgttgctgtagggctgcaggatccactgagtgcacctgcctttgtgctggaagccagggctcctctctgaccctgagggtccctggctctggggagggagctcgcagggctcctctctgaccctgagggtccctggctctggggagggagctcgcagggctcctctctgacactgagggtccctggctctggggagggagcactgtgttttcagtgcccacatgttgccaaaccgcgctccagaaagctgcccagtttctgtccctgccgaacgcaggagaatgcagggaaggatgttgtactttttctccagagctgcttcccttgaggggggcccctgcctacaggtcagaaggaagctgaggttccaagtcaccccccaggcgggcctggcctgtgtaacacgcaggcgtgcaaggcagaggagatactgatgcccagggcacagtgccgtgccctggaagaccactccgtgcctcggactctgcagcagcttctgatgccgcggaggtggctgttctgttgcagacgggaaactgaggcttagcggcttgccccaggccaccgagcagctggttggcagagcaggcacacgccaggagagctgcctccctgagcctcatttccccctgtgctgagggctgggcatgctgttgtatggccagcccacagcaggcaggaagtgttggcctcaatgcgtttccacagtggcctgcccaggtagggttaagagcacagctctgaggccggctgactcctggcccctccacctcatcagctgtaggaccttgggcaactcacctggccccgtgtgtgaaatgggcctcatgatgggaagaccaagccgacggggtgacgcacccagtcacagtacgggtctccccccagcgtgggcgctggcgagtatggcagctgttggcgccatcatctctgtggtcaccgccattgcactcctttgctccagcattcacgcagtcactctcacatcctcacggagctgctgcaggccagagtccatgctggcagggacagaaagaaaccctgtgagggctgggcacggtggctcacgcctgtaatcccagcactttgggaggccgaggtgggcggatcatgaggtcaggagatcgggaccatcctggctaacacggtgaaacctcatctctactaaaaatacaaaaaaattagccgagcgtggtggcgggcacctgtagtcccagctactcaggaggctgaggcaggagaatggcgtgaacccgggtggcggagcttgcagtgagcggagatcccgccactgcactccagcctggggaacagagcgagactctgtctcaaaaaaaaaaaaaaaaacaaaccctgtgaggagcaggtgttggctgggagagcaggcgtgtacatgagccaagtgtgcagtgtcacttggtgggtgttgagtgtcagggagatgagcagggaagggggacagggctggcctcccagacatgcaaccaggacattcgtaccgggccctgctcttgatcgcatgctccgccgtcgtggcttcaaactctcaatcatttgaaaacaaccattcaagatttttatttttgcaccagctccggggatgtggggtgtagggctgggatgcgggggtgcagtctgggaaggccttgctgagaaggagacatggagtggaggagggagcctggtggttagtgcagacagtcagtgcgaaggccttgaggcggcagcatctggccaggtgctgtttctgtgcccatctgaccgatgaggaaagtcggggctcggggtggggggcggcacgcatcgtgtaccccactgttctcccagctgtattccccaactccgttctggccctaacctgctctgcttggccccacaggctgaccccgcactacatctacccaccagccatcgtgcagcccagcgtggtgatcccagccgcccctgtcccgtcgctgtcctcgccctacattgagtacacgccggccagcccggcctacgcccagtacccaccggccacctatgaccagtacccatacgccgcctcgcctgccacggctgccagcttcgtgggctacagctaccctgccgccgtgccccaggccctctcagccgcagcacccgcgggcaccactttcgtgcagtaccaggcgccgcagctgcagcctgacaggatgcagtgaggggcgttcctgccccgaggactgtggcattgtcaccttcacagcagacagagctgccaggccatgatgggctggcgacagcccggctgagcttcagtgaggtgccaccagcacccgtgcctccgaagaccgctcgggcattccgcctgcgccctgggacagcggagagacggcttctctttaatctaggtcccattgtgtcttgagggaggactttaagaatgactgagaactatttaaagacgcaatcccaggttccttgcacaccatggcagcctctccttgcaccttctcctgcctctccacactccaggttccctcaggcttgtgtccccactgctgcatcgtggcggggtgtcacagaccctctgcagcccctggctgccctggactgtgcagagatgcctgactccagggaaacctgaaagcaagaagttaatggactgtttattgtaacttgatcctcccgagctgtgagcgcagtctgaggtgtgaggacacggcctcctgttggagtcccattttctccatcagggcacgtgggcggcttcctcaagcccggaggagctcccaggcgcacaggggccgccggtaacaggggccgccggccaaaggcccctttccagtcatagcactgaagttgcaacttttttcttgtaattgttttgctactaagataatttcagaagttcagtctattttttcagcggatactgccgccaccaagaatccaaaacctatttttgacttggagagacttgcttttgttggttccgcccgtggagacgacgatagtgtttctgtataataaagtgtctgccggctcgcgggccaggatcctctcggtgggatgggcaccacagacaggaggcccctcaggcccgtgcgggccactgtctgctgccgcctgccggggtggcagagtgagttgtctcaggaccccgtcactgcgacgttgacactcctctcccttcccttcctccccaactccccaaacactgtggaaggggagaaggaagtgatccacagcattcaggccacttggggtctagaccatggtggtgccagcctggggggggcagtggccctcagctctgcccgctggagcggttgagtgcagaagggtgcgcctcttccctctacccccgcaccacctgctgtgtgccagcctgagacggttcctgcctgtcttgggggttggtggagggtggaggcagttctgccagccgtggcagggctgctatggggcatccagggctgtgggggtctggaggaggggacatgaggtgagaggtatcctggccgagggcggggggcagcggggggtctccctccggacctacctcagggagctgagcgtgcaggcgctccagggcaggcctgggacagagtcaaggctcagagaataaaggtagctaatctcatcataatatttttattagaatgttctgatgataaaaataaaacttgttttctttaaag

SEQ ID NO: 37705 - DNA, 8021 bp, Homo sapiens
gcttggtgcgtgcgcggcgactgcgacgggcagtggcagtcatggcggctcagtgcgtgaggttggcgcggcgcagtcttcctgctttggcgttgtctctcaggtaaggggcacttggtctccctgggtggaggtggcagcgcgacctcccgctccgatgggggcctttcccggccccggggcctccttcccggcctcggccccggagctgggcatctccgggctcgcggttccccgccgcgggacgcggaccgccccgctggggcctgctctgctgccaggctgccagctcagggcttgggaagcgtggagcgggcgggcgccgtgtcaggaggagaggaccgcagcgcggggggcgtttggctcggaaggtacggtggcccacgtgcgcgtgtggtccagggcctgcggcgacgcctcgcgcgcattcacggtctcggcgctcacgggcgcagaggcagccgcaacttgtgcggttgaagaagcgaccaaagaagctcgagctttgtccaaggtcacgcagcgaggccgagccgggccgggtgtgccctgggcaggagctgtggttactcatttccgtgccgcagctcgaggccggggccacagcggtgctcgggaaacttcgtgtcgcaaggtgcgtgttgcccgttcacgggctttttccactcgacctcgaattccttcactccgccttctccagcgtctgaggtcaaaagagcagtcgaacctgtgctgctgctgggcgaagagtttgtttagacaagggcacatttcgggcctgagggccacgagacagtgcccctttttttttttcccctcaaatctgccccttctgctttttgaaagttctactttagaagttagtatggcaagtacttgctggaggaagtgcctagaaccaagttattgattagagaagccactgagggccaaattggccaaaagctgggcagtgagatgtagttctttcctgaaggagagcaggcaggtgaggtgaagatcactttcagtctaggtgattaaggggtaagtgctagcttaataaattatatcttaacaacacaggagccaagagcaacgacccacgtggaatacttgagtaaaaagactttggtcaagtaattggtggttttgtattggaattaattgccaggaaagtgaccaccaagtcagcatcatttctgtctctagaatggtagttttgtggaaagatgctcaactagggaaaggcaggagaactgactggtagtcatagctctcagagtaactaggctttctgagactcagtttccctctgcagaacgagatggccccgggtgtgggtcctgttgcacattcctggccacactttgtgttggctgtgcttcggaaaggggtctgtgaagagctgacctgcagaaaggctggtggctgtcacacccccaggcagaacaactggagaggaaggtgggcttcacaacagtacactcagtttttatttaaattcttagctttttaaattcacaagagtaaaaatataaaatggtcatcgctctccacccccatggcaagactgtaatggaggcttccactccacttctttccacagatctaagatattaataagtacacaggatttctagtttgtctttacaaaaataggatcctgttttgtgtatttctctgtaagttgcatttcttaacagaacatccaaagtgtatccaataaatggcagtttaactcatttttaggagctgcataatattccagattgtgttagcaagtttattcaaccatttgctcgctgacaaacattgtttccaacttgtcgctcgcagtgctgcaataaacagccttgactgagttctgtgtgctggcagccttcaccttcctattcgttgaagcagttttaatctgggaagaaaattgaatgtagcttattctcagataggactgtggcctaatttaaaaagaggtcctggccgggtgcgggcggatcacgaggtcaggagatcctagaccatcctggctaacacagtgaaaccccgtctctactaaaaaaatacaaaaaaattagccgagcgtgttggtggacgcctatagtcccagctactcggcaggctgaggcaggagaatggcgtgaacccgggcggcggagcttgcagtgagccgagatggcaccactgcactccagcctgggtgacagagcaagactccgtctcaaaaaaaaaaaaaaagaggtcctctggtcctggtgaagaaatctaggttttaagactttattttatcattcgttgatggctttgtgacctgggcttatcacttggtcttggtctatttcaccggtacatatcccatgctttcctgtcttcatgcctttgtccaagcagtttcatcttcctgaagctgcatctatcccattgtcccacctctgatccctttttcgtaactcttacctatcctacaaagcctttcatggttttccattccccaagctaggtatctccttctactctgagcctcccaaagcacaaagcacttagttccctttttttttttaatcacttttttttttttttgagacagagtttccctcttgtcgcccaggctggagtgcagtggcgcgatctcagctcacctcaacctgcgcctccctgattcaagcgattttcctgcctcagcctcccaagtagctgggattacaggcatgcaccaccacgccaggctaattttgtatttttagaagagacggggtttctccatgttggtcaggctggtcccgaactcctgatctcaagtgatccacctgctttggcctccctaagtgctgggattactggcgtgagccagcgaacctgtcttaatcacttttaaatcacaaattactgttctttgtgtttagataccttttttttgcaagatctctgctgggtctatctttgtcatcaggatcagcagtaggccagcctcactctagtagtagctattccataagtacgtggttaggtctgggcagactgtctcagtcaccttagaatggaaagaggaggttagtactgttctgtaccaagtactgtaacttggcacattgacatgtaagtttaggcatgtacttacagaagatcttataaaaaagacaggcacagtggctcatgcctgtaatcccagcactctgggaggctgaggtgggaggaacacttgagcccaggagttcggggttacagtgagttatgattgtgccaccatactgtagcttgggtgacagcgaaaccctgtctctaaaaatacatggagaggccaggcgcggtggctcacgcctgtaatcctagcactttgggaggccaacgcgggcagatcacttaaggtcaggatatcaagactagcctggccaacatagtgaaaccccatcgctactaaaaatacaaaaattagccgggtgtggtgacgagcaactggggaggttgaggtgggagtatcccttgaacccacgagacggaggttgcactgcacttcagtttgggtgacagagcaagactctctctctcaaaaaaaaagaaatacatatagatatagatagatgtatagatagatagatatatagagagagaccaatcctgtctctaaaaaaatatatatatgtttatcttagatctaataaaggcacattgtatatgacttacagcttttatatttactaatatagcttctatatgtcacgtacagtgtgcctttattagatctaacagaaatgttttctccccaagtaatagtaaatagtttgaagctattttaagtttctaaagtcatacatctgactttaataagcacaaaaactaagtcttcgtttctcacgtgtggacttccctgtaggccatctccccggttgttgtgcacagccacgaaacaaaagaacagtggccagaacctggaagaggacatgggtcagagtgaacagaaggcagatcctcctgctacagagaagaccctcctggaagagaaggtcaagttggaggaacagctgaaggagactgtggtgaggactgtgaggctcctgtgggggcgggctcggctgaactgtttctctcctgggccacataaaggttccaggtttcattggtgacagactaaagccagagttaagccgttgtccatggcctgcagtgggcccaggtggcaagttactgccaaagcaaagactaaaacccaaatcctgtgcaactctggttctggcaagagactaatctttacacgctgttatttgtcattgaatgaaaacttaaaatcatctttacaaatgaggaatgctcagtatggttgtttaggctgggacttaggagaggaagcagaaaattgcaagtacaagagttgggagcaggagtgtggttttatgtgatgctctcataggcaggtaggagttttatgaactagtaacatggattattactccatgtgaaaacacataggtggcacaaatcaagttctttaaggatttgagaaagacatcaaaccctgagtgctggcaccattccaaacccgttacatatgttaatcctggctgccaggtgcggagccagggctcgaactagaaccccctggacttggagctcttgctccttgccactgtacagtgattacctgaagactgaaaatggatgcagtatagaggcccccacagagcaacttagtaaatgttaaaaagagaaaagctagctgggcgcagtggcttacccctctgatagcactttggaaggttgaggcaagaggattgcttgagcccaggtgttcaagaccagcctgggcaacatagtgagactccatctctaaaaaaaattaaaaattagctgggcgtggtggtgcactcctgtagtcccagcaacccaggaggctgaggtgggagaattgcttgagcccaggaggttgaggctgcagtgagccgagattacaccacttcaacctggatgatagagcaagaccctgtctcagaaaaaaaaaaaaaaggctcagatgagtgagcttaccggaaggtggtgagacatgaggaatatactagaactcagatgatgattacacaaggaatgtttgaactgagccacctctgggtaacacagcatagcaaaagatcatgagtgcagcttttattaagctttcattaagctgccctccttagtcacatctcaaaggcagtgatattacttctgttttgacttgtagttagttacacagccgttttccaatcaagctcgctttcctatgactttgttccatattaatataaatctcccggccaggcatggtggcccacacctgtaatcccagcactttgggaggccgaggcggtcggatcacaaggtcaggagatggagaccatcctggctaacacggtgaaaccctatctctactaaaaatacaaaaaaattagctgggcgtggtggcaggcgcctgtagtcccagctactcgggaggctgaggcaggagaatggcgtgaacccaggaggcggagcttgcagtgagctgagatcatgccactgcactccagcctgagcgacatacagagcaagattccgtctcaaaaaaaaagatatatatatatatatatatatataaatatccctttttttctcttttaggaaaaatataaacgagctttggcagacactgagaacttacggcagaggagccagaaattggtggaggaggcaaaattatacggtactttcaacataacatggtgttgattccggaaagaagataatggggtggggaaggggaaggccatgcatacggaagtgtcagagagcaaggctgtggggtggggggtccagctgttgcatcccctgcatttttttttatgatggctcaacagcaaaggtgtctggaggagcagaaatcaagtagctgagactagcatgaagaattgtaaataggtgtgtcctcccccacgcagagaccttggtgggaacctgcagcaggtcagcctctgatgcccatccccttagccctccggaagtaacactggcatcacttcagaactcccagcatgctatatgcattgccacctttggatgtttttgttactgtccttcccattttacagttgagatcattgaggtttagtcacctgccacacatcacaaagctggtacgtaaccccaggctcccagctccacaggctggttgtttgagtgctggctctggatctctgcgtgactgacagtgggtattagagatgtggaacctaaggctcgagggagggtaaatggccttgcctgggtcagacggtgagaggccacatggaaactaagagctagagtctctgtcgcattcacagagactgaggcgctcattgaaacactttttttcctggatactgtggcctgtttcttggtattccgcctctctttgtggtaatgtgctttgttggttcttaccctttccgacctgtaaatgcctgggctcttgggactcagtaccagacctcttctctccccttgctgtgctccctgggtgacttacatactcttacgggcttagtggcatccacacacaagtctcagcttcaaactcggatcttccgagttccagtcccctaaatcttactgcttgcttgacatctgggcttggatgtctcaagggtattttcccctctactgcactcctttcttcacattttagtgaattctaaatttagtaaattctgggtctcatcccacaagtagcttttgagagttttgtgttgttttttaaagttattgagccattggaattctgaggcgattgatttgacaagttactaaatagcctccacatcaggtcagcagtgctcagtttggaattgccctgtgcggttggtatggagtgcaaatgatcttctttaacttcatccaggcattcaagccttctgcaaggacttgttggaggtggcagacgttctggagaaggcaacacagtgtgttccaaaagaagaaattaaagacgataaccctcacctgaagaacctctatgaggggctggtcatgactgaagtccagatccagaaggtgttcacaaagcatggcttgctcaagttgaaccctgtcggagccaagttcgacccttatgaacatgaggccttgttccacacaccggttgaggggaaggagccaggcacagtggccctagttagcaaagtggggtacaagctgcatgggcgcactctgagacccgccctggtgggggtggtgaaggaagcttagctgctgttgatggggtgggtgtttttaaactcacttgatgtaactctcaaggctggttcattgtttctcatctatgagtacgtgtgaccttttcccaaaccttattggaaaccttaagtaaccagtggctaaacagaaaagccggttgcccaactgcattaatgaactctaattcgggagtctgttcccttttagtgccacgcgttgaatagttccacatactttcagaagagctcagcagggccctgcctggtctcccgagcatcatgagtaacgtgtctgctcagactctgctgacaccaaagtattttaaacaaataaaaggtcttggggaattctgtttggctacctgggcacgccagtctgcaccatgtgtccctgcggcgcatgagtgactggcgtatttagcccgtcacatttcattcgctgaaggaaaggcaagagagttgaaacatttttcttacttaaaaaaaatgatctttgtgaagaacatagtgagttcgtttgtcttcagtcaacagcggctgaaactgaccactgagaaatgggtgtgggcactgacagttctcccccattatttggccaggaattgagcttggcttggcaaagttccttttaccctgttctgttcatctaaatgcagacatatttaaatcatattcaactagttactaatgacctcaagttgtattccctggcaaaatggactttctcaaaataggactgcacgcttggtgtactttaaatgttaatgtttaatttaaaatttttatttaagaggattaaagccctaatgtttattttcctac

SEQ ID NO: 37706 - DNA, 8021 bp, Homo sapiens; identical to SEQ ID NO: 37705

SEQ ID NO: 37707 - DNA, 113539 bp, Homo sapiens
ctgcggctggggctgggggcggcggcggcggcgacgcgggcggcgggcggcgcggggcggtccggcgggttcaaagaggaaaacatggcggaaaacaaaggcggcggcgaggctgagagcggcggcgggggcagcggcagcgcgccggtaactgccggggccgccgggcccgccgcgcaggaggcggagccgcctctcaccgcggtgctggtggaggaggaggaggaggaaggcggcagggccggcgctgagggcggcgcggccgggcccgacgacgggggggtggccgcggcctcctcgggctcggcccaggctgcttcatctcctgcggcctcagtgggcactggagttgccgggggcgcagtatcgacgccggctccagctccagcctcggctcccgctccgggtccctcggcagggccgcctcctggaccgccagcctcgctcctggacacctgcgccgtgtgtcagcagagcttgcagagccggcgtgaggcggagcccaagctgctgccctgtcttcactccttctgcctgcgctgcctgcccgagccggagcgccagctcagcgtgcccatcccggggggcagcaacggcgacatccagcaaggtgagccggaggccctgcctggcatctgggccgcaagggatttgcgcaaccctagaggagctggggacggaggtgctggggcctggggctgctcggacgggcgccatcccgaggggtctctaaggtgaaagactcgcccctgggacactttccagagaagctggaccgcaagagataaggggagcatgaagggaggggtgccggctgcgagaggctgggggaggggacactggctccgagggagggtttgtgatgtgcggaacccggccgagcgctggttctggagctggcagacccgtacagtgagagaagggggatttgggaaacacgttgtgaggaagcgttttggctgaaagggcccgggccagcgaggtgttgagggagtaggtaagaggtaagggcagtgaagatggattgctttggagggaggggacttggcgtgttcacagataggagagaggaggactatggattaaatggaggtggagagaatatgttggagagcaaggggtccagagaaggcgcctggaagaaaattgtaagatgacatggggaaagagaaactcggaaagtggactgcatggttagggaaaatcctaaggtttggggatgaaggagaaatgaactttgaaggaaattgagagttagggaaagctgggcatgaatttgttttagctaattggccgttaatgagcccctagtgttggggcactgtgctaggattgaataaagtactcaatgaagacttcattcacagtctaacaggagaaacatataacttgcagcagtggaggtgagtcctcagtacaatggttgtggcacaatagaggaaaggtcagggaaatttcacaggaaaggaaatccatgaacaggtttcttgaagaatgagtacctcactgggttggagggtattcagggcacaggacacccttctacatccctggaactaaagactgtgtagggtgattggtggaaattagattggattgatgggctgaaaagataaaggtttcacagtctcttaaactcttgggatccaggtgtaaggacttcagaatattttgggatttttcttttttctggcaaggtctgttatgtgagacttttatcagggtctgagttaactctatcaaacacgttaatgtttctacattgaaacacgtgaatgtcacgctaatgggatagacgataaataacctcccagcattcacagtgggttctgttgcaaaccaatgaaaaaaattaaaatttcaaagcttttgaatttcgggactgtaggtaagcgattgtggagctgcactaaagggcttggaattcatcctgtagagtgtatcctcgacattgtggactgaaggatgttcctggagggctttcatatcaagaggataaaaggatcagatttctgatccagaaagatcacttagggcacttgagggatgagggaaggcaaggctggagacaaggagaccagttaggagaatcctggcggttatctaggaaagaaatcaacatttggaatgggtagtaaaggaatgatatatcaggtattacagaatgaagcattttggtttgggggaacggtagggtttggaaatctactttgccatctcctacttacgacttgggcagatgaccttttcttagcttcagttttctcatttgtgaaatgggaaaaaagtatataacctcatagggttattgagagaatgaagtaagataaaatgtgtaaagtgattagtacgtggtagttactaatgaaatggtagctagtatattaatagtagtaactaatagtggctatgggaatggagggatggggggagtgtattgagattggtgtgagggagacaaacgtagaattccacattttttgtttggtggatggcaatgctattaatacatattcagacactgaagcagggctggggtgagggtgagggctggggtgtagggaggataaaatgttttcagattgggatgttttgggtttctagcattattggtacatgtaggtaagaatgttaagagtaaggctttggttgttggagaagctactaattgttagtaggtgttcagagaataactgctggtggtctgtgcacccatgaccatagtaagacacataggattcagtgttcttgtgggaacctgggttaggtaagagatttagagggaacccagaaatacagattgtgtttgactgatgtggctgagggactgaggttatgaaattggctctctgaaatttatgaaggagagagaataatatgtaaatcccctcttcatttctttatcctttctttttgaaggagggggagtaagtggaagggactaaccaaatgctgtcaatcttaagtaatatttctctctaaccaatatctaaaacaaattgagtctggaatccaccatgtttttgattaaaaaaaatttttttttgagacagtctcgctctgttgctcaggctggagtgcagtggctcgatctcggcttactgcagcctctgcctcccaggttcaagcgattcttgtgcctcagccacccaagtagctgagattgcaggcgcatatcaccacgcctggctaatttttctgtttttagtagagacggggttttgccatactggtcagactggtcttgaactcctggcttcaaatgatctgcctgcctcagcctcccaaagtcctgggattacaggcatgagccactgtgtctagccatccaccgtgtttttagatagtctagaaaataatttgtcagtattaactcctatataccattctgctttgctctttaaaaagatcaagctgtgctggaaagagcactagattgggtgttaggggacatagttcagctctttagctattttacgctaaaggaagttcatactgtttttgtccttcagtttccctttaaaatgtagctgatagtcgtttacttatatctcaccaaggcaaataataaatgtgaaaatgctttgtaactgagaaatgcttcaacaatacaggatattattgatcaacctcagatatcatctctggtctggagatcatagctagtggttttaactcaccatctttttcaagtgattttgaaacaatgatgagtataatgccctcctgcctaactggccttttcctgtttctcttaatacatttattcacaccctctggctgttctttctagatcaacagttctcagagtgtggttcctggatcaacagcatcagcatcatctgtgacattgttaggaatacagattcttgggccgcattccggacctcctgtccagtagtctcgtttaacaagctctccaggtgattctgattcacgcttaagtttgagaaccactgtcttgaatgaagggctctcacttcaaatgtctcctcagactttgacttctcattttaaagtagtcctccaggtcgctctctgatagatcatcttattttctttgtagcacagctaaaatccaaaatgtttatttttgtttacttgcccgtctcactttgcactaggatattgtagactgttcaataaataagttttgtgtaaataagaatcactagagagcttattaaaatgctaacttgggagtttcttcagagactggtttagttgatttggtgatgactccatgtgcctgcatttttaacaggtgccctgtgattttgatgctggtggtaccaccacactttgaggaacacagatttaaatattttgaggagaaagtacaatctgtttaccgttggagtatttgcaaaatcaaaatagataaattagttaatattgaatctcaatagtgagctttttaaagtgtttttgtgattttttggggggtgctttttcaggttgaggcagaacagctatcagtagtgggtatatatacatttatactttatcaataaaaatacagatttgctactcaggaggctgaggcgggaggataacttgaggccaagagttcaagatcagcctgagtaacatagcaagaccctgtctctcaaaaaatctttttttaaataggaatcatattgatgcatctgaacaaactctcagatgaactcttgaaggagatgaggctacctctgagatggcacaatgatgtggctgaagaaatgaattggtattaagttgcattgggttctgctatttttttttttttttttttgagacagttttttactcttgtcacccaggctggagtgcaatggtgcgatctcggctcactgcaacctccacctcctgggttcaagtgattctcctgcctcagcctccccagtagctgatattataggcacccgccaccatgcccacctaattttttgtatttttagtagagacagggtcttgtcatgtaggctaggctggtctcgaactcctgacctcatgtgatccacctgccttggcctcccaaagtgctgggattataggcgtgaggcaccacctggcctcggttctgctgttagttagctacgtaacccttgggcaaggaacctaggaagtctctccaggtcttgcaatacgaagaggctgagttcctatcccgttagttatatgattctattgtcttttatgctaacattctgtatgtacatacgtttaatgtccttatagtttgtggggaggaatagtggaatcaccatggaaaaatcattctgttactgaattcttcaacttactgtggactgggcacagtggctcatgcctgtgatcccagcactttgggaggccgaggcgggcagatcgcttgaggtcaggagttcgagatcagcctggccaacatggcgaaaccctgtctctacaaaaaatacaaaaatttgccaggcgtggtggcaggcacctgtaatcccagctactcgggaggccgaggtaggagaatcacttgagtcttggaggcggaggttgcagtgagctgagatcacgccactgcactccagcctgggggacagagtgagaatccgtctcaaaaacaaaacaaaacgaaacaaaaaaacttactatgaaaagtctgagatggcaacaatcatgtgtaagtgggagggaaaacctctgagtgtagtgtgaagagcacttcctcatagtgtttctgtctgtttatcacagaccatgctgagccactctgaggagtcttctgtttgagccctcggaatttcttgtccctggagtgtgtatactatatgacagttctggcctcagtgtgacttaactggtttggggactttttaggctctactttttctgactctcctcttcaacagaaacaagcttgagtgtttgaatgatcatgtggtactccaccaacaaccagtcattaacgatgtgtccaagattgctgaaatacttctcacaacttctgtctagcattgtggtcaaactacctgaattcatttttgagctctaccatttactactggaatgaccatggataagttacttaacatctgtaaattgggagtaataattacacctacatcatagagtttttgtgagaattaagagagttaatgtgttgcaaggtacatttattgggagcttacatgggaagcccccaataaattgtagtagtgttatttcggtaatttttcatttgtccccccgttgtctttgtgactgtatctcacagcaaacagaaagaagaggcaggggggtaaattgtggttttaaaggcttttctgatgtctactgatatgtacagcatgcatgataaatcatttgagttccaaatcttctagttacctagatcttgtaaaaacttataaactaatgtcctaaatcctaagtctttataatgtctagtatttgtacatcaaaagccctagttaggggactttaattacttttacttttctcatggattctgctgtcagtgggtcctaaatgagaataccttaaagcagtgattctcaaagtgtgggccacagaatgctggggtgggggtgatggtagtgaccgtgtcactgagacccttttagaggtgcacaagtttaaaactattttcataattacactaatttgatattctccttattcactgcgctgacatttatattaatggtgcaaaagcaatgatggataaaactgccatcacctctgcgtgaattaagatggtgagtgactccatttgggaggccgaggtgggtggattgcttgagtccaggagtaggggactagtctaggtaacatgatgaaaccctgtgtctacaaaaaatacaaaaaaattaaataggcatggtagtgcgtgtctgtagtcgcagctactcaggagactgaagtgggagaattgcctgaggcacggagtgtcgaggctgcagtgagccatgattgtgccattgtactccagccttggcaatggcgtgagaccctgtctttaaaaaaataaaaaaaataaaaaaataaaaaaaaaggataatggctccaagccatactataaaagtcattgcatatttactttcacacacttagagaaagaacaaaaataaacctatgtcattgtcacttaatatcctttatgaaacagtaacaattactatattacattttgatctttaaagctctgtgtgatgaagtgggaaatgtgcctaaaatgcttctgctgcggaagaaagtggaagaagagtacttgtgcagttttttgagttccaagctgaatttgctttttttcatagaaaactattttacttgaaactatggttttacttaaaaactatggtttttaggcatgggtatttggcagccattttctcagaagtgaatgaattgagcctgtcatttccaggaaaacaactgacatatgttgccagtgataaaaattgagattttaaatgaaaattagaattttggaaaattggtatttgctgccatgagctggtcagtttctcagtatttaaagactttcctgaagagattggtggtgatattaatgaacgtgaatttttttgatattgtgtaatgtcaacatttcaaagatctgcgtagcttattgcaatatattctaaatgagaaatgcatgatgttaagtgcaaaacagagcaataataaatagattgtattttattttattatttttattttttgagatggagtcttgctttgtcacccacactggagtgcagtggcgcaatcttggctcaccgcgacctccgcctcctgggtttaagcagttctgcctcagcctcccaagtagctgggattacaggcacacgctaccatgcctggctaatttttgtatttttagtagagatggggttttgccatgttggccaggctggtcttgaactcctgacctcagttgatctgcccacctcagcctcccaaagtgttggtattacaggcatgaaccaccactcccagccaataaatagattttaacgcgagagagtagtcaagtttatttttaaggtttgagatgccacattgcaactgatgtttaaaaaataaatattcttcttaagtttttgtgttatatcaaagaaaaatatccacacaatgatctgaaaagggtattaaaatctgcttttcccttttcttagatacttagctgtatgaagccagattttctttatattcttcaaagaaacaacatattgaaacattaaatgcagaagcatatatccagccatattctattaaaccacatgttaaagagatctttaaaatgtatcacaatgacactctttattaatttttttttgttttaggaaatacagttatttctgatttttaaaagtgttgtttaaacctgtcgtgccggacatggtggctcatgcctataatcccagcactttcgaaggctgaggtgggaggatcacttgagcccaggagttcaagaccagcctggggaatatagtgagactccgactccagaaaaaataaaaaaattatccgagtgtggtggtgtgcgcctgtagttccagctactcaggatgctgaggtgggaggatcacttgaggctgggaggttgaggctacagtgaactgcgatcatgccgttgcactccagtctgagtgacagtgagactgtctgagaaaacaaacaaaactagtaataaagtaaacgtcattttaacattttaaaatttaagattcatttttaattcatcttgtaatgaattaaaatatatttaaaacatccatttttattatacatttgatggtcataccccatctaaacaaaagctctttgtgttcctcagtaactaagactgtaagagaggtcctgagaccaggaagtttgagccctgctctgttaaaggacattaagaacatgataatgtctcagagtctttgggccagtaggaagaatgtcagatcataagatagtaggtggcagatttatacatttatagttcttcattttggagtacccataacagttcagaaaaagcctccctttagtaaaatgtaaaaatgaagaaagtacttattaactgaagttaaacttctaaaaataggtcactatagatctactgatttttttcatgtttatgacagtctatctaagccaacttcagagattgggctcaggatggtagataaattaacctctgtctcttctttggccacaaattgcacatctatccctagccatttgactcaaggggaagtgggaaaaagaacaaggatggataaacataaatataccatttttagaaaaatatttaaagcctatgccccagtgatgagtaaatagcatgcactatatggtactaatgagtacatttgaatgcttatatgctatttatgttccttttgtgaattatttgtccatgtgttttatgtttttctttagattgcttacattttttgttttgatttacaagaattcttgacaaattctgtatactgatcctttgttgatgatgtaggttgaagatttattctgagcctatggcttggtgtggtagccagcctctaagatggccccttgttccttttctcctgttattcacaccgttgtatggttgctgtccagttgctcaaggctggtctccgtgaccaagagaatataatagaattaatagtgactttattaaaaagtcattaaagccatatatacagttttttccttgctctttgaatcccttgttctgggtgaaaaacagctgtcattctgtgaaagatactctagtagtcctttaaagaggccatatggagaaaaattgaggtcttctgcaaagacccagcaccaacttgccagctatgtgaaagagccgcttttgaggtagattctctatcctaatcaagctttcagatgactgcagtccttcctggctgacatcttgactgcagccttcttagaggcactaagccagaactgcctgccaagtccctcccaaattctttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaattttttgtatttttagtagagacggggttttaccgtgttagccgggatggtctcgatctcctgacctcgtgatccgcccgcctcggcctcccaaagtgctgggattacaggcgtgagccaccgcgcccggccccaaattcttgtttcaagaaagctgtgagaaataattattgttgttttaagtcattaatttttgaggtaatttgttacatagcaatagataactgatacactttttagagagctgtcttttcatgtttttatattaaaatagtttttcctccttttttttttgctgttcttagtagctttataataataagcagtaagttttgttcattaaggtaatttcactgccctctctacgtataccttggtcatcttcaagattatctcgactgatcttgaccttttgctcctttttttttttttaattaaaaaatttctttttccaagacaaaccttggccattcaccttttgctcactcttatactaaaatgtattatcttgtgaaagttcattttaaaaacttattaagctgtgtgtggtggtacatacctgtagtcccagctactcaggaggctgaggcaggaggatggcttgagcttaggagtttgaagctgtaatgtgctatgattgcacttgggaatagcaactgtactccagcctgggcaacacagagagacgccgccatctctttaaaaaagaacagaaaaacaacgacaacaaaaaacctgtcagtgtttttgttggaattgctttgaatatgtaaatcagtttgggagaaaatgtctttattgtgtctgcctatttatacacatggtatgcctccacattttcttaagtccaaaaatgtttttgagtgtatattttgagacagagtctcactttgttgcccaggctggagtgcaatggcacgatctctgctcactgcaacgtccgactcccaggttcaagcaattctcctgcctcagcctcccaagtagctgggattagaggcgcccgccaccatgtctggctcatttttgaatttttagtagagacaggatttcaccatgttggccaggctggtcttgaacttctgattctgagctcaagtgatctgcctgcctgggcctcccaaagtgctgggattacaggtgtgagccactgtgcccgacctattttttaaatgtctcaggtatactgatttcatatttatatttgataattccattatctgatgttcttgatgtcttattttactgcttgcttctgcctgctcatttgttgtgggtggtgtcctcctgtgttttatagttttagacagtgagcctgttcactagggctttatgaaatctgccagactggttttagggaacaagcctccagagggtattttgcatttgcttctgtcaggtgccaccaacacagaaattactgaagcagacttttagtttactatatcttagtattgtcagatgttgatttagtgtttaccttataggctggcttgtatttagaaattctcagaattatacacaatgtgggtgtggggaaaaaaaaaagggaattctcaggagaaaacttttttccttaccccgaacccagacagtgacagatttcttcatttccatgctgttggtcagatttttttttttttaatttcactgttctttgcttatgcaccctaataactgaggttgtaatcgttcaagtcagttttaggaagatgagtcttgatctaattaatactttacacaggccctaggctcccatgtcttccccattctttgtttacgcccttgtttgtacatcctaaagaagagtcactaagagtataatttctgagcctttgaatttttgaagttttctttattctactcccttcttaaatgatagcttggctggatatgaaattctgggttaaaacttttttcctcagaacttttaaggcatctcttccagtgtcttaaatcagtgttgctgatgctactctgattttactcctttgtacaaccccagttgggtttcatttgtttatttacctcttcttgagatctttttatctttttatgtcttggatctcttcatctatttatcagttgttttgaaatatagtgatatgcttctatttttttttctaaaagtttctaaaagttcattatgctttttcatttagtcttgtaatcttcatttatagtaagagaactttacatttttttcagaaggtccttccccacctcccactcttattgaactattactatttggatgttggctctcctaggttcatattctccgctgtctttttctagtttccttccctttgttttcttgctccactgacattctgaaagatcttcttgtccttgtctctaacccttttatccaatttattaattacattgtacatttcttttttttttgagatggagtctcattctgtcacccagactggatggctcactacaacctctgcctccctgggtcaagcgattcttctacctcagcctgctgaggagctggaactacaggcgcatgccaccacacctggctaatttttttgtatttttagtagagacgagtttcaccatgttggccaggctggtcttgaactcctgacctcaggtgatccacctgccttggcctcccaaagtgctgggattacaggcgtgagccaccgcacctggcctacatggtacatttctaagagcttccttgcttaggttgtatttttataagattctgttctttttctgtggacttaatatcttctttctctgaggatacaaatgtttttcttccccaggcaaaatatgtattttactttatttttcatttgactttttacttttgaaacatttcaggtatactgattccttatttatatttggtaattccattatataacttttttttttttttttttttgagacagagtctcagtctgtcgcccaggctggagtgcagtggtgcgatctcagctcattgcaacctccgctcttggattcaagtgattctcctgcctcagcctctggagtagctggaattatagacgtgtaccactgtgcccagctatcattatataacatttttgacatcttattttactgtttgcttctgcctactcttgtttatcttctattccctttattatctgttttacttttttttttttcttttgatctttgtgtttcataggcttcctcgagcaatagatgatccttggttgtctccccacttgaatgaggcaatacagttctgatggaagattctgtgcttctgtgtggggcctgttaattgttgggcattgctttagatcagggattggcaaactggcccatgaactaaatacagtcaactgtatggttttgtatgacctgtgagccaagaatgatttttatattttaaatagttgggaaaaaagaatattttgtgacacatgaaaattattagaggccaggcagggtggcttacgcctgtaatcccagcactttggaaggccaaagtggacagatcacctgaggtcaggagttggagacaagcctcgccaatgtggtgaaacctcatctctactaaaaatacaaaaaaaaattcgctgggtgtggtgacaggtgcctgtaatctcagctacttgggaggctgaggcaggaaaatctcttgaacccgggaggcagaggttacagtgagccgagattgcgctgttgcactccagcctgggcaataagagcgaaaactccatctcaaagaaaaaaaaattttaagtgtaaatttgtgtttagaaatttttatttgaacacagccacgcacattcatttatgtattgtctttgactactttcatgctataatgggaaaattgagtagttgtgacaaatactgtgtactgctttttggtacattacaaattgcagtgatgcagctataacttgatagggatgtgtatggctgtagcacaacatttaaaatttaaaaaattgtccaaaatattgcatacctatcatttcaaagaagagtgagtggattttaaatgtcatgcttttacagcagagtacattttgttttgagttagatggcaaagcatggtgtttattatgtacttacactatagctgtgctgaaagagtacagtgttttgttgacaactccagagtaagcactgattacattattcccaactcacaggaaagtaaaaatcagaaataagaaagtttaaaatggaatatctgatcacagcagaatttcttaaaaataaaaaatgaaaatgaggctcttcaaacatgggaagtttttgagtggctcattcattagccaaacagggatagctcttcacctgtggtgagttaattaaaattttcccaattaaatgagaattttattcttctcattggtagacctgtattacaaaaaaaattactcaattattatattttgaatttgtagataaaaattgtggaaatttttctttcattatgtaaatacctacatactatccttgatacttttttcctaaacaacctaagttatttactatgccttgtgatgccacatcccatgttttcatttgatgggacatgttaggtgttggttatgaatcagatttcaggcagtgttgtgtgtacagcctgacctgttgtccacaatagatttggaagaatgagaatttacagggttctacttctaacatcacaaatgactgccagaatgaattccacaaatgaattttggaccagtctggcctgtcatccatgtgtggtttattaatagaatgctaaaattcaaattacacaactcatttcttttcccatcactgagggttggcttaaatactatccctcacaaagtaaatacttaagcaaaaagctaatgtcagtcaaaagatccccatcagttttttgtctgccgtagggcagatatgagggtaaggtattgagaatcatttcactgtattactgtgcttatgaatctgaagtattgaaagtaataagagcactgcatttcagctgtccttcgtatattacattttctgctttgtgttgaacattaccttcatttgttgtgaggcatataaaagggatgtatgtaatgaaccttggacccactgaatctcgctggagaggtaagagattatattaaagaacagtataatacattttataataaattagtaataaatttgatttcagtaaaccagatatttgttgaaatatggttcaaaagaattagtcatagctgaaatttactatttctgctcttaatgttggtttggaggtgattccctctttttcatttgtgtattatatgattttagtccttatgcttttggctgtaatctaggctgctcttgacatccatccaattttctcttctctgttttccttcctcaatttatgttgaatgctttcaaagtagattatctgaattaataatggcaggaaagaactagctgtggataagtttatttgaatctgtctagacttctgttccttgtctgtaaaataacatattttgttatgttttatcttacgttaaagataaaactttttcgtgttatcttatttgcctataaaaatcctctcagagggaagactcattctattttgcggaatgaagttttgcccaattaaaaagaattatttcagggtgataatattatccttgtttcttttttaaacaaatgaggccaccgaggtaatgtggtaaaattatacctaaatgtggcctttccatgttaagctgatagcacaaactcagatgccttcaggaactaggaaagtaactagtataagacattgagagtagtgaaacttgcctagccttcttgcatttaaaaaatactctattttggcaggcatgggggctcacacctgtaatcccagcactttgggcggccgagatgagcgaaccacttgaggtcaggagttcaagaccagcctggccaacatggtgaaatcccatctctacctaaaaatacaaaaattagccaggtgtggtggcacatgcctgtaatcccagctacccgggaggctgagtcacgataatcgcttgaacctgggaggtggaggttgcagtgagccgagatggtgccattgcactccagcctgggcaagagagtgagactgcctaacaataacaacaacaacaacaactactctattctggccaaataataccagttaggctgccaattttctgtttttgtcctgacttggtagaatctgattagtcatttttaaggtggatgtaattaatttatagttagtttgatttcataatttttaaaagtttatttaagtacttaagtaaactagcattatagtttaatttgcagatctgtgagaaccggtaaagtccaacatcttttagtacggctgttggcctttgaatatcattttttgtagttgcctgttcgggttgtgcttaccttttcccctgtggtttgtctaccttttttcccagtgcttttgtaggattctttatatattccaatcatgactcttttgtcaggtatatatcctattttatggcttgcctagcagttgtgttttaaaatgttaaatttattttagcttttgagtaaacagtactttcccactggttgaaaagttaaataagtatacgaagctggatattgagaagcctccctcccactccttatcctcatccagttcctgtctcccccaacacataacctgtgttaatactttatctgtccttccagtatatccaagtgatactggacaatggtgccagatccattcagtggcagaaatattggtatcttcaaaaaatgacattgggccaggcatggtggttcatacctgtaatcccagcactttgggagcctgaggcaggaggatcacttgagcctgaagttcaagactcgcttgggcaacatagtgaggccctgtctctaaataaaattaaaaaaaaaaatggcggggtgcagtggctcacacttataatcccaacactttgggaggccaaggtgggcagatcacgaggtcaggagatcgagaccatcctggccaacctggtgaaaccccatctctactaaaaatagaaaaatgagctgggcgtggtggtgcatgcttgtaatcccgctacttgggaggctgaggcaggagaatcgcttgaatcaggaggcggaggttgcagtgagccgagatcgtgccactgcactccagcctggcaacagagcgagactccatctcaaaaaagaaaagccagatgtggttcacgtctgtggtccctggtaggtacttgggaggttgaggcaggattgtttgaacctggggaggttgaggctgcattgacctgtgattgtgtcactgcactgcagtgcactgacagagcaagaccgtgtctcaaaacaaaaaaaggatgttggtacaactggattttcacatgcaaaggaatgaagtcatacccctacttcacaccatatgcaaaagttaactcaaaatatatcaacaggctgggcatggtggcttacgcatgtaatcatagcactttggtaggctgaggtgggagcattgcttggggccaggattttgagatcagcttgggcaacatagtgagatcctgtctctacaaaaacaaaacaaagacaagtaacaacctaaataaagcatgagcaactaaagaaaaaatagtaagtcggacttgatcaaaatgtaaaacttttgtacattgaaggccattattcagaaagtgaaaagaaaacctgcagaatgggagaaagtatttgtaagtcatgtattggatgatagtgaaatatataaagaactctcacagcctgataataaagacaacccaattaaaaatgggcaaaagatctgaatagacagttccccaaagaagatatgtatatatggccaataagcaaatgaaatgatacactagatcgtttgttattaagagaaatgtaaacaaaaccacaaggagataccacttcacacctgctagggtggctctagttaaaaaacaacaaagtgttggcaaggatgtggagaaattagagtcctatattgctggtggaatgtaaaatggtgctgccactgtgggaaacagtttggtggttcctcagaaagttaaacataaaattagcatgtgacctagcaaatccattcttacatatctgtgacccaaaagaattgaacactgggactcaaacagatacttgccagtattaattgcagcattattcacagtagccaaaaggtggaaataatgttaagtgttcaacagatgaattgataaaatgtatatacatgtaatgggatattatttggtcctgaaaaggaatgaatttccgatacatgctgcaatatgagtaaaccttgcaaacataagtgaaataagacagacataagagggcaaatataagattatacttacatgaaatgtccagaataggcacattcatagagacagaaagtagactagaggttaccaagggcttgcagggagaatagggagggaatagagagttgtttaggatgggagtgggggaggaatgggcgattgttgcttaatggatatagtttctgtttgggatgataaaaggttttgaaaattatggtgatggttggatggttgcacaacatgttgaatgtagttaatgccatataacatacctgatagttgtatacttgtatacataatatacatacataatagttcaaatggcaaattttatgttatatgtatataccacaataaaaatgttaaaatatgttaaaaatgtttttccttctagaaattttaaaatcatgtgttttaaagtacgttttattgtatgttaaaaattgattctcattcatggattctgtgttttagaattcacctacatgctaaaatttatttgtaaccccagtattaataatagcagtgccttcacagtcatccctacacatgggcagagcagcaaaaaatttgactcgcccaattcacatattcccagctgaggtgaaactgggagatgctttgccttctttcagcactcatagcataaatatgtgtccttgttgtggccatgttctcattgtgctttttgttgacttcactgcttcaaatggccctaaatgtaataaagctgaagtgccccgtagtgttgctaagtgcatgaaggatgtttgtgctttatggagaaaacacgtgtaaggtaagcttcattcatgtatgagttacagtgttttggctttgaattcagtgttaatgaaccagcgatatattttatttatttatttattttgagacagggtcttgctctatcacccaggctggaatgcagtggcccagttacggcttactgcaacctttgcctcctggtctcaagtgatcctttcacctcagcctcctgagtagctgagactacaggcccatgctaccacacccagctaattttttacattttttgtaaagactgggtttcaccatgttgcccaggctggtcttgaactctggactcaagctttatctacctactttagcctcccaaagtgctgggattatagacttgagccactgcatccagccctcagcaatatgttttaaagtgactttaaatataaatgcatataaaaatgttatgtattgactggttgatgaaaattttgtgaccggaggcttgcaggaacctaatcctgcatttcctctaggagcaatagtttagttaatttgttaatttattgtttgcagcaactgtatagaatataactactataaatgatgagaatcgaccctaggtcaatgcaaataaaattatttcttttatataaatggcaacacctcaagatctttctctgaaaagtacatagtttcctttgatttttgttctgaagtctatttgatcttatattaatatagccactcattaaaacttaattcacaaacgatatgttaatcacacatttgaagtgtatggttcagtagtttttagtatattctgagttgtgtaaccatcaccataatcaattttagagcatttttattactcccaaaagaaaccctctaccaattagcagttattactcacttacccccaaaccattccccccagacttaggcagccattaatctactttattgtctctatagatttgcctattctggacatttcttacaaatcgaaatatacgatgtgtggtcttatgtggctgaccttcgccttcatctgtgctgtagcatgtatcagtgcttcattctttttttaaatactttttaaaaaaactagtcaagtgcagtagtgatatgaggagagagtagagcaaagacttagatctgtaactgactgaacaatctgttgagataactcactaccttcaagtcagccagtacttcactatttttaggcctgaataatatactcttttatggctataccacattttgtttaaccattcattagtaaatggacacttgaattgtttctcttttttggctattatgaacagtgctgctatgaacatttgtggataagtttttatgtgaacatatgttttcatttctcttgggtgtatacttgagagtgcaattgctgggttgtgtggtaacttatatttaatcttttgaggatctgccaactgttatctgaagtggctttagcatttttctttaccatcagcaatatgtatgagggttccagtttctctataatgttgccaacaattgttatcttttttattgtagctatcctggtgggtgtgacatagtatttcattgtggttttgatttgcatttcttttgtggctaatgacgttgagcattttcttttgcacttattgaccattagtatatcttctctgatgaaatgtctgttcagacttttgtccattatttaattaggttatttgacattttaaagttgtcagttctttatgatagtctggatgttctaccctttttcttaattttttttttcttgtctttcttttttctttcctttccttttcttttttttttttttttttttgagacggagtctcgctctgttgcccaggctggtcttgaacttctgggccctaacaatcttcctgcctcggcctcctaaagtgctgggattacaggtgtgagccaccatggccagccctgacgtgctgcacccttatatctgatttagcgctatcttctatttgtgggttgtcttttactttctgtctgggattatttgcagcacaaaagttttttgtgtgtggaaaaataacatgtaacaaaatttaaccattttacccactgttaagtgtgttcattggctttagttatattcacagtgttggcagcacatgttttttttatttatttatttattttttgagacagggtcttgctctgttccccaggctggagtgcagtggtgcaatcacagctcactgcagcctcaaccttgtgggctcaggtaatcctcccaccccagcctcccaagtagctgggactacaggtgcaccactgcacccagctaatgtttttatttttttttgtagagacaggattttgctgtgttgcccaggctggtctcaaactcctgggtccaagcgatcctcttgcttcagccccgtaaagtgcttggattagaggtgtgagccactgcacttggccacaaaagtttttaagtttgatgaggtccaatttatattttgtgcttttgtttttcgcaccatatctgaaaaatcatttcgtaatccaaggtcatgaagatgtattcttatgttttcttttaagagctttacagttttaggttttagattcagattctctgataaagttgagttaatttttgtatgtgaaatttgtttgtgaggtaaagatctagtttcattcttttgcacaaggatatccattgtccctgtatcatttagtgaaaagactactctgtcctccatttaattgtcttagcaacctgtctaaaattagttgactgggtaaatgtgagggtgttttcctggacttaatttcattccattgatctgtatgtctgtctttatgccaataacaaaattaaacaacaacaaaaacagggtctcactctgtcacccaggctgtagtgcagtggtgcactcagggcttactgcagcttccacctcctgggctcaggtgatcctcccacctcaccttccccagctgagactacagatgcgtgtctcacaccactacagatgtgtggctacaccacacccagcaatttttttattttttgtagagatgggttcttgctatgttgctggggtgggttgttctttttcaagatcgttttggttcttctggatcccttgaattttttttggtttttgttttttaaaggacagatcttgctctgttgcccaggttggagtgcagtgatgcgatcatagctcactgcagtcttgacctcctgggctgaagcagttctttcacctcagactcctagtagctgggactgcagccgcatgccaccacgcctggctaattttttaattttttgtagagatggggtcttgtattgttgcccaggctggtcttgaacttctgggctgaagcggtcctcccgcctcagcctctcaaagtgctaggattacaggtgtgagccactgtgcctggcctccatcttcttttaatgtacttacattattgtgtttgaagcttcttgtattaatagatagcattactgttagattatggtttaagtttattcactcttctggtctttatttagttcatgtgtttaggagtatttaaggtatgtaggtatatttaaggtaattattgatgtgttatggcttaaatatgttattgttttctgtttgtttcctttgtttctcttgacttcgtttgagttacctaaagttctttttaagattccgtctttatttatggtggttttgtgtagtttatagtttttggagtgctttgaatagcgtcttagatatcgcaacgtttatttgtaacttaaagtctttgtattgacattttaccatttggagtgaagtatagacgttttacttctagttaggtccctttactcttcctagttttaaaatgattatctttaattttctgtctatatagatgaccagataatatatgatcttttttataagctctcacatgatttaagaaatccatgagaagaaatctattatatttactctcatttttttttttttttttttttttttttgagacggagtctcgctctgtcgcccaggccggactgcggactgcagtggcgcaatctcggctcattgcaagctccgcttcccgggttcacgccattctcctgcctcagcctcccgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggcctatttactctcatttttatcattccagtgttcttttccaaagattcaaggttccttctgttaacattttttttttctgttacggcaagttttctttaaccatacatgcttttaggggtattagtgacaaatttttatatattttttcatctgagaatatctttagttgtccttcattcctgaagggtatttgttgaatatagaatttgcatttctgagttactttctttcagcctttgaatgatgttgagccaggttgttttttttttttttttttggcctgcatggttttacatgagagatccactgtcatttgaatagatgttcctctgcaagtaaagtggtcattgtctgctttcaagatttttttctttatctttcagaacttttatgatgtatcttggtgtggatttatttgggtttttcttatttggcattaactcagtttttttatatgtaggtttatgtattttgtcaaatttgggacattttcagtcattatttgttcaagtaattttttttttttttttgagacagagtcttgctctgttgcccaggctggtgtgcaatggcgtgatcttggctcactgcagtctccatttcctgggttcaagtgattcgcctgcttcagcctcccaagtaactggtactacaagcgtacgccaccatacctggctaatttttgtatttttagtagagatagggtttcactattttggccaggctggtcttaaactcctgacctcaagtgatccacctgccttggcctcccaaagtgctgggttacaggtgtgagccactgcacccggcctgttcaagtaatttttaaattttatgtactcctctccttctggaactctgcagctctggtgacagcaatgctagctagctagttttttattgttccacaggttcttgagactgtgttctgtttttcttttcttttcttttggtctcttgattttgcctgaaggtcagttattctgttgcctgttatcttctcttgtctattgagcccatttattgagttttaaatttttggtttttgggttttttttttttttttttttgagatagggtcccactgtgttgcccaggctggagtgcagtggtgtgatcttggtgccacgacaccggctaatttttgtatattttttgttagaaacggagtttctccatgttggtcaggctggtcttgacctcctgacctcaagttatctgcccgtctccatttccaaagtgtattttttaatcctataatttccattggtcttttttttctataactttcatttcttttctattttccatttgttttaaggacattcgtattgccgttttaagatgaggtcttactctgtcgcccaggctggggttcagtgttgcgatctcagctcattgcaacctcttcctcccgggttcaagcaattctcctgcctcagcctaccaaatagctgggactacaggtgtgtgccaccatgcctggctagtttttgtatttttagtagagatgggggtttcaccgtgttggccaggctggtctcgaacttctgacctcaagtgatctgcctgcctcagcttcctaaagtgctgggattacaggtgtgagccactgtgcctggcttatattgctttttgaagcattttcataatggttcccttaaagactttgtcagatgtttctaatatgtgatatctgatcatcttggtttgggcatgtactgattgtcttttgtcagttatgattttcctggtgtttgacaaataattttttgagtatattgcaaatattttggatatcacattctgagacttgcgattctatttaatcttcatttttttccagcagtctttctactgaggtataacataaaggccaggtagggtgtatgttcaccttccccttgggcctcctgacaccaccctggcaaaagtggagtgctgactttctctgccatgttgcagataggtgagatgaaagttcaatttctcccttggtccttcctgatgaagtggggtaccaactcataccaccttgtcacctctgatttagggtttaagttcagttccactgagcccttgtgataccagggagggaggaaatgtagggctaactcattccactggattgctacataataggggtggagtctcagctttccacttggattttatcataccaggcaaagggataagaagtgatgatttgcctggtctcttacccccttattccttattattgccaggtgggagtagaagttcagcttcctgctattccctactgatattgaggagtaggagattttttttttcagtatttttagttttaaaaaaaaaatgggggcttcaattaaagtcgcctttatttaagatcccagcagtggaaatactgagttcttttggtcctaacattttacagattatagtcgtgagattatggaatcatgactcactaaattcatgcttttaattcctattctctgcaaggcagtgttagattatctctgctcttgggagtttggagttttggagactttaataaacacgtactttttttttttttaaaagacagagtctcactctgtctcccaggcgggagtgcagtggtgtgatctcggctcactgcaacctccgcctcccaggttcaagtgattttcgtgtctcagcctcccgagtaggtgggattacaggcatgtgccaccacgcctggctatttttttgtgcatttttgtatttcttatttttatttttggaggtgtagtctcactctgtcatccaggctggagtgcagtggtgcgatgtgggctcactgcaacctccacctcctgggatcaagcaattgtcctgcctcagcctcctgagtaactgggactactggtgcacactgccatgcctggctaatttttctttatttttagtagagacagggtttcactgtgttgcccaggctggtttcgaactcctgagctcaggcaatctgtctgcctcggcctcccaaagtgctaggattacaggagtgagctaccatgcccagcctaatttttgtatttttaatagagatggggtttcaccatgttgaccaggctggtctcgaactcctgacctcaggtgatccacccgcctcagcctcccaaagtactgggattacaggtgtgagccaccatgcccagcctaaacacacatttttaaagatgaaaaggatgaccagtataattcttgcaaatgaaacaatttgcaggtcagagtcttgatggttagttagccaagttttttttatttttttaccagttcaattaaaaaattatttagaaaaagtaaaacgtgggcatggttagagtttcaaacagtataaaagaatataaaataactcatttaagtctgtaagtttccaaagtatgaaatgctgactatctcatctttattataaaatttgaaacaacacactaacaagctcttaagagctccttgaattttgtctggcagaccattatttcaaaataaaacatctttttgcaaactcagttatgtacatttttatttagcacaactgcctgcttaacatcttttcttgagtgacccagatgtgtctcaaatttactgtctctaaacttgaactaattgtagtttccaaacctccacttacaaactgtaacagtcatctcattgttccggtttcctaaaccagaaatttgggcatcgttttcatctcctcttctaatactcctctactcctcagtctgtagttttctagtaatattttatctgtgatgtctttgtcttatgtctttggtaacagggtgatattggcctcttgaaatatgttttttcttctctattttctaaagagtttgtttgaggtttgtattatttcttccttgagagaattcaccattaaaaccaactggggccgggcacggtggctcacactgtaatcccagcactttgggaggctgaggcgggtggattgcctgagctcaggagtttgaaaccagcctgggcaacatggcgaaaccccgtctctactaaaaatacaaaaaattagctgagcgtggtggtgggtgcctgtagttgcagctactcgggaggctgaggcaggagaatcacttgaacccaggaggcagaggttgcagtgagatcatgccactgcactccagcctgggccacagacagagactccatctcaaaaagaaaaaaaaaaaacccaactgggtctggactttcctttttgtagattttaaattactgatctagtattcagattgagtttttctatgtcttcttgagtcagtttggtaaaaattttttttttcaagacagggtcttgctttgtagcccaggctggggtgcagtggtgtgatcgcagctctctgcagccttcatctcataggctcaagcagtcctcttgcctcagcttcctgagtagctgggactacaagtgtgcaccatcgcacctagctaattaaaaaattatttttgtagagacagggtcccactgtgttacccaggctggtctcgaacacctggtctcaagtgatcctcccatctcagcctcccaaagtgctgggattacctagctggtaatttgtatttttaaagaatttgacccattttgttttagtggtctaacttggcataagaggttcatagttctattagtccattctgacactgctataaagacatacctgagactaggtaatttacaaacaaaagaggtttctctggttcttcctgctgtgcaggcttctgcttctggggaggccttaagaaacaatcatggcagaaagtgaaagggaagttaagcacatcttcatacggctgacaggaggaagagagagtgaagggggaagtgctgcagactttcaaacaaccagatctcatgagaactcagttactataatgagaacagcaaaggggaaatctgcccccgtgatccaatcacctcccaccggggccctcctccaacattggagattacaattcaacatgagatttgggtggggacacaaatccaaaccatatcagtaacattttggcaggatctcttgttaagtcttatatttcatttttggttttggcacaatgtgctctcttttctttttagatcaataccaatctgtcttctctatctccccccatctccctccctgcactcattttcccatctaggtaattgtttatcagttgttttcaaagaaccagctttgagtttcgttcccctttcttccctattcatagctactctgatctttatttcgtcctatgtaatgttttcatttggtcttctttttcgagcttaatgaggggcatgttgagatgattgcttttagatgtttttttcctttctaatatatgtctttgaagctatacatttctctctaagttcatggtgttaaatgtggtacctaatggccatatgtgacaaaattaagcgtaaatgaaattgatgatttacttccttagtcactgttgtcacatttcaggtattcagtaatcatgtgtggctgatggctgccatattagacagtgcagatatagaacattttgtcatggcagaaagttttgttggactaatggcctgtaatcccagctctttgggaggccgaggtgggcagatcacctgaagtcaggagttcaagaccagccgcgccaacatggtgaaaccccatctctactaaaaatacaaaaatattagctgggcatggtggcgcacatctgtaacctcagctactagggggctgaggcaggagaatcacttgaactgggtaggcggaggttgcagtgaggtgcgatcacgccactgccctccagcctgggcgatagagtgagactccatctcaaaagaaaaaataaatgtttaagcactctttcagctgtatcccatggggaggaaaaaaccaatataaaaaaatatatatatacacacatatatatatatatacacacatatatatacacacacacacacacacacacatatatatatagttttttttctttttttttgtttttcttgggttttttttcggacagtgtctcactctgttgcccaggctggagtgcagtggcgcaatctcagctcactgcaacctctgccacccagattcaggcgattctcctggctcagcctcctgagtagctgggattataggcgtgtgccaccgcacccaactaatttttatagttttagtagagatggggtttcaccatcttggccaggctggtcttgaacccctgacctcgtgatccaccaccttggcttcccaaagtgctaggattacaggcgtgagccaccacatctggcctatggttttaattttgtgtttggttcatttacatttataattgttacatgtatctgatgtattgattctttaacatataaaatgcttcattttacttagtaatatgctttgagaatctttttttcttctttcttttttggagacagagtcttactctgttgcccaggctgcagtgcagtggcgtgatcttggctcattgcaacctccgtctcctggggttcaagctattctcctgtctcagcctcccgagtagctgggattacaggcatgcgccaccacacctggctaatttttgtatttttagtagagacagggtttcaccatgttggccagactggtctcaaactccggactccaagaatctttttttttctgatgttagtgtgactactccagctgtcttatggcaacagctttcatgattttatcttctcctctccttttactttatccctatttattcatgattttatcttctcctctccttttactttatccctatttatgtatttgaatctaaaaatgtttctttcagaggatatatagttggattttactttttatccagtttgacaatctcttcttttcattggagtgtttactcagtgatatagttggatttaggtatgccattttgctagttgttttccgtgtgtcatttttgttcttttccttctttactgagacttctatgtttaccaatatttttagtgtaccttaaaattttcttttagtttttgttttagttttaactcttgcaattatgatatctctctttttttttttttttaaggcggggcagggccttttcacttctttttttttttttttttttaaattgatcattcttgggtgtttctcgcagagggggatttggcagggtcataggacaatagtggaggaaggtcagcagataaacaagtgaacaaaggtctctggttttcctaggcagaggaccctgcggccttccgaagtgtttgtgtccctgggtacttgagatcagggagtggtgatgactcttaaggagcatactgccttcaagcatctgtttaacaaagcacatcttgcaccgcccttaatccatttaaccctgagtggacacagcacatgtttcagagagcacagggttgggggcaaggtcatagatcaacagcatcccaaggcagaagaatctttcttagtacagaacaaaaatggagtctcctatgtctacttctttctacacagacacagcaacgatctgatttctctatctttccccacatttcccccttttctattccacaaaaccgccatcatcatcatggcctgttctcaatgagctgttgggtacacctcccagacggggtggcggccgggcagaggggctcctcacttcccagcaggggcggccgggcagaggcgcccccaccttccggatggggcggcggccgggtggaggcgcccccttcctccctcccggacggggcagctggccgggcgggggctgccccccacctccctgctggatggggcggctaattatgatatatctttaacaccacaattcacttcaggacaatactaccttcattttgttaaaatatagcaactttgttccactgtagctccatttctatcttttgtattgttatagtcatgattgttacatttatatagtctggttttatttcctgtcatcctgacagacttcctttagattttttgtggtacaaatatgctaagtgtgactttctctcaaattttgtttacctgtggctgtttttattttgccttcatttttgaaggatatttttgttgcatatacaattcttggtttataatttgtagtttgaatatgtcattttattgcttcctggcctccatatttttaatgaaaagtcagatgttgatggattggtttccttgatgaattatttttctcctggttttcagcagtttgactgtgatgtgtttggtttgattcatttcgtgtttattttgtttgtggttctctcccctttttgaatctgcagattaatgtgtttcatcaggttttgacattttccaccattatttcttcaaacattttttctatttctttgctcttatgtcctgtgacttttattacatttatgttgggagcttgacattgttctactggtttctgaggatctgttcttttctcgtcagtcttttttcctctctgatttttttgattggattgaaattaaattttaatttatccatctacaagttcactcagatctttttttgttttttgagatagagtttcactcttgttgcccaggctggagtgcaatggtgcaaccttggctcactgcaaacctctgcctcctgggtttcagcaattctcctgcctcagcctctggagtagctggaattacaggtgcccacaaccacgcctggctaattttttgtgtttttagtagaggcagagtttcacatgttggccaggctggtctcgaactcctgacctcaggcgatccacctaccttggcctcccaaagtgctgggattacaggagtgagccaccacgcctggcctgaagtgtattattgaagcccagatatgtagtgaattttttattttgcatgtacttttaatctgtgtggcttctttttatagttcgctcttaagacttcttatttgttgaggctttgccatattattttattatttgaacactggttcctttttattcttttaaaatatttataatagttgctttgaaatctttgtttttattctcacttggcctttagttttttcagggctttcttgtgtctccctttggtatgtgcagtgtcccaattagccatgtctgtatagagagttgatcttagcccttccgtgactctctcatttcaagtttctttgtattaatgtggttgatctgctgcttgctgtgtgacccccaacccaggtatagcaaaacctgttctttccagacagatactaatttatacctggcaaatctcatgttttcgcattcacctctctccccaattgattctaccgtgtgtgacagcaaagctgctgtttttatggtcagccccattctagtaaaactactgatttttcagaccagactttaggactaaatggggaccatgggagcatcctcaagcaagagggccagtgcctttcattgcttttacctgaaactttagcagtctttgtagaataagtgtgtctcattttgcatgacagtagttgattccctgtggtctgaattcgttgtttgctttttttctttgtgacagttttgtacagttttatactttgtctttgaagagaggatttgctttcccttgtgccattattgaaagtggtccagctgttaattttttttgtaccttcattttgttgtaaacttatcttttaaattttagtagtcttaaaaaataagtgacatctcaggtatcctgtgttttctagaactgcagtgtcctgtaccatagcaactagtcactggtggtgatttaatttttagttatctaaaatgaaattttaaaatttagtttgttggttccactagccattttgcaagtgctcagtggccagtgttgtattgagtactgcattgaacagtgcacatacagcacgtatccattattgcagaaaattctgttacacagtgatgctctaaaatctttgagatgaatagtaacttgtaataatagcttacattttgtgagcacttagtgtgtgtcacattttatatgtataaacatgtagtcttcccaacaacctttgaggtaggtactgttatccctgttttgcaaaggggaaactaagactcaaagattaaggaattaacagctctgaaggggttgagatttaaatctgtgtagtctggctccagaatctgttccattaataattttgtatattgcctctttggtaaatgacatgcctggtttctgacttgaatagagaagtgtttttgttttttttttttcctttaaggttttgctagctttaaatgctatttaatattttggtaaatgattctttcatatttaggttgtttgcttctcttttttagtgttcttactaaaaatgtctgaattttatcatatgccactttaacatctgtttatataaccatatagttttcttcttcagttgttttgatatgattattttgttaaatttctttccgttgaataatccttgaattcttggtaaaccttactgatcataatattcttttgacagattgacagaatgtttgctaatatttcatttagaaatgtagagtcaatacgctggagtggtctgcagttttcttcttttgcattgcctttggtaggttttaatagtaaaacaatgtcgggctctataaaatgaattcggattttcactcttttgttctagattggttcaaataataatggaatgctggtttattctttaagcattactctcctgtataactatctggattttgtattttttttaaaatggcaacgtcttctaatctttgtatgcttacatgtctcttcaagtttaattcttgttttgcttttgatgaatcatattttactagaaaattggccatttatgctagattttaatattgcttgctttagagttacatggagtattttctgatataggcttagtaatcttttaaaattgttttgctttgtctgtttccattctgacttctctatgtttttttctcttcattagattcctaaagattttacttttttctcaaaaaatttttaggttatcaattttgttttcagtaatgtatatatttcagcttttatatttaattctgttctcatacttctgtttttttaaaaaatttgtcaaggaaagaactaagttttattagttttgtttttaaacatttaagtctacagatggaaataatagagttgagtatgaactgtttctgctgcatttttttctagatagcttgtaatttaggtttgatttccagatggagtccatttttattttgggttgtgtgtagtgatgtttttatttactttcactttgtaaagttttaaacttttataggatgtggactgtaaaattcagtatctttttaattgaaaggtttttttttttcttatttgtttttggtagctgaatacaagatcaaattttttaaatattacacagacatacccaaaaatgtatatattctattctaggaatatataataaatagctctgaaattatttcatccattcttttatgttttggttttttatatctcacttgaaaactgtacttctatgttttcatgatctcctttattttaataatttttccgtattattattttgagacagagcctttctctgtcaccctggctggagtgcagtggtgtgaacatggctaactgcagcctccacctcccgggctcaagcaatcctgcctcagccttgcatgtagctgggaccacagatgcacacctacacgctgagctagtttttaaagtttttctagagatggggtcttgctttgttgcctaggctggatccttttatttatttagttgttgtttttgttgatagatttcttttgaaattttcatgctgttttttcttggtcatactaagtggcattctcttttgctttgttaaacatttatttttattttgagatggagtcttactctgttgcccaggctggagtgcagtggcgccatctcggctcactgcaagtcctgcctccaggttcacgccattatcctgcctcagcctcccgagtagctgggactacaggtgcccgtcaccacgcctggctaattttttttgtatttttagtacagacagcgtttcaccgtgtttgccaggatggtctcgatctcctgacctcatgatcctcttgccttggcctcccaaagtgctgggattacaggcatgggccaccgcgcctagcctaagacttatcctttattactgttttttagcagtttgattatgatgtgctttgcatggttttatttagaagtgctatcttcagagattattgtggttcttcatctttggcttatagtttttattaaagttggaaaacttgatcattagttcttaaagtatatttctcattgtttttatttcttcttctgggaattcagttacacatatattagaccacttgataattgtcccacaggtagtgagcctctcttttgttttgtggggggtcatattttgttcatcttcatgttcatttctgtttgtctcccttcagttttgccagatttttcttcatgtgttttgaagctgtcttgttatgtacacatatgcatataactatatcttcctgagaatggatatctttattattatacaaattttgctcttgtctctaatgattatttttgtgtaagggtctattttatctgatattagaatagccactcctgcttgtttttttttttttgagatagagttttcgcttctgttgcccaggctggagtacagtggtgggatctcggctcaccacaacctccacctcctgggttcgagcaattctcctgcctcagcctcctgagtagctgggattacaggcatgcgccaccacacccagctaattcttatatttttagtagagacagggtttctccatgttggtcaggcttgtcttgaactccctacctcaggtgatctgcctgccttggcctcttggcctcccaaagtgctgggattacaggcatgagccactgcccctggcctttttttttttttttttttttttaaatagagacaaggtcttgctcagtcacccaggctacggtagagtggcatgatcctagctcactgcagccttgaactcctgggctcaagcagtcctcctgcttcagcctcttaagtaactgggcctgcaggcaaataccaccacacctggcttaattttttttttttttaatttgtagaaatggggccttgctgtgtcacccaggctggctttgaactcctggcctcaagtgatcctcccacctcagcccaaagtgctgggattacaggtgtgagccaccgcaccaagactccagctcttatgtaattactgtttccatgatttgacttacttttttctttcatcctgtatttgtctttgatttacggtgtgtttctgggctgggggcagtgacttatgcctgtaatcccagcactttgggaggttgaagcgggaggattgcttgaggctgggagattgagacccgcctgggtgatatagtgagaccctatctctacaaaaaatttaagcaaactaaccgagtgtgatggtgtatgcccgtagtcctaactacttgggaggctgatgcaggaggactgcttaagcccaggaggttgaggctgcagtgagcgccactgcactccagtctgggctacagagactatatctggaaaaattaaagtgtgtctctggtaaacagtatatagcagtatatagttaattttatctgctctttattttcattggggtatttaattcattctcatttactatcattattgttatggttagatctacgttgattgctttgctctttgttttctgtatagctcatgtatttattgttgttcattggttcctccttatgttagatatgagttctaaatttctcttcaaagaatcaatgtcagtgtgttcaattctttgccttctacttctaaacttcctcataaagcaatctttttcgatcacatgctccaccctgactcattccaattacctgctccacactgactcattccgattacctgctctgccctgactcattctccaccctgattcattccgatttcctgctctgccataaccatttttcctgccaaaccactcaccccgtcactctctttaaagtagccaatcggaattagtttagcctgtgtggtctaaccctcaccaataggggaacaacacagcagcaggggccatgtgcgtcaggaataagaaccccttcccctcccttgtccaggtgtgcgttcaccattgctccatctgtgagggcgcatccttctataaaaataaattgccttgctgaggaaaaaaaatgaatttttttttttttttttgagacagagtctcgctctggcacccaggctggagtatagtggcatgatctcggctcactgcaagctccgcctcccgagttcacaccattctcctgcctcagcctcctgagtagctgggactacaggcgcctgaaaccacacccagccaatttttttgtatttttagtagagacggggtttcaccatgttagccaggatggtctctatctcttgacctcatgatttgcccgcctcggcctccaaaaaaagaacattttatatttgagtgctatttcttttgcggcaccaaaactttataacacactgccttctgaatttttttttttgtttctgctcagctcattgttaatcatattgttcccatgtatgtcatgagttatttttctcctagtcttttcaaaattttcttgtctttgacttttaacagtttaattgtaacagtgtatatctttaaagttaaattcatgcttgtgaatttttataagagccacaaaggccttcctctgtgttttgtttttgtttttgtttttgttttcatttttgagacaggctctcactgtcccccagtggcccaatcactgctcactgcagcttgacctcacaccctcaggtgatcctcccacctcagcctcctgagtagctgggattacaggcaggtaccaccatgcctggctaatttttatttttgtagagacagggtcttgccatgttgcccaggctgatctcaaactcctagactgaagcgatctgcccgcctctggctcccaaaatgttgggattacaggcgtgagccacagcatctggccacttctgtattttgttttcaatcactttattatgaaatgagatacactgttataaagtattttctattttgataattcttaaaaattccacttgaaaaattttctgcttgaatcacagtattgttccttaattagcaattatttcactttggggaactggtcatttttaaaattttatttcttagagttatttggattatgctcatatatgttgtcattaaaatatttaattttggaatttaagaaaattgcagccaggttacatgattaatgtggacataggaaaacaaaatatttatgtttctaagtttaaaaattttattcatatattcagtgtttgggatgcataagtgttcacattttaggaaggcaagatggtacttaaatttccagcatggtctgtggtcgtaccctataatcaaatgccttaatatttctgcagcagtatttacactaaatagcgtaactaaagatatatatagctttatgacagttcaggtcaggtttttttcactaaatgtgttttgtagctaaacatacaataattttctgtatttcaaaaactggataaggaaatgtgagcttgacaaccattcaattttttataaaataacatgttttccatttttgttttaccttttgtttgtggctactatcctgcataaattgcataatttgttttgacaatttgtggactgtgtccttcattgttgtacagtattcccactattcctatttaatgcttttttaacttttacttaggtttatctaatgctaatattcttcctgtttgtttttgttttacctttttgttttgttttgttttttgcagttgctgctgtatgtttgtttatccttttctttttcaataggtatgtcttgaagtttcattagtagcagactactaatttgcttctcaggattgccatttttcaggtcttctaattttttaatatggaaattgtgtttatttaaatttagcagggcacttctttttttttttttttgagacagaatcttgcttgctctgtcgccaggctggagtgcagtggcatgatcttggctcactgcagtctccgcctcctgggttcaagcagttctcctgcctcagcctcccgagtagctgggactagaggtgcacgccaccacacccagctaacttttgtatttttagtagagtttgaccatattggccaggatggtcttgatctcttgacttcgccatccgcccacctcggccttccaaatcgctggaattacaggtgggagccaccatgcccagtctgatttgctttcttatcattcatatgctcactggactgtcacttttaatttccttcaagaactttgcaggccaggcgcagtggctcatgtctgtagtcccaacactttgagaggcctatgcgggaggattgcttgggcccaggagttcgagaccagcctggacaacaatatgagaccctgtctttacaaaaaatcaaaaaattagttgggcatggtggcatgagcctgtggtccccactgcatgggaggctgaggtaggaatcacttgagcccaggaagtcgaagcttcagcgagcagtgttcatgccattgcactccagcctgggccatagagcaagaccctatctcaaacaaaacaaaacacaaaacttttcctttgcattcacaactaggctaactggcgcaagaggcctagcattggcctgtcttggcttttgatatgccttctcactaagcttaacaatttctagctttttaaaatttaatgtaggagatgtttgacttgttgttgttgttgttgttgttgttattgaccaagtcatgctgaatcgattcttcttttcagttggacactttgaggccattgcagggttatttattggcctaatttcaatattgtttggtctcaggcattagggtggcctgagaaagggagagagacagggagtggccagtcagtgaagcagtcagaatacatttattgattaagtttgctgttttcattgggcgcagtttgtggggcctcaaaacaattacagtagtaacatgaaagatcagaactcacaggtcaccataatagataaataataatttataagttaggaatattgcaaaaattaacaaaatgtaacagaaagacgcacagtgagcacacattgtgggaaaaatggcgtctactaatttggttaatgcagggttgccacaaaccttcaatttataaaagctcagcatctgtgaagcagtataaagctaaatgcagtaaaacaagatattcctgtataacttcaagaatataagaagccctaagaataccaacaagctttatgataatagatattagttatacttagtttattataagatattagtgttcttcgtatatgattgtatgtgcacatatgtggccatatatgactatgacttcaccttaagccagcttcattcttaagtgataaaattaactttggaaatacttactgacattatctaaatatatgttactctatgatattattttataggatttaagccatttttattataaattatttcagttactttctgtatcatatctccaagttttccctgtataaagcagcattcttctttattctccctctattgacaggtcattttgtctcttttcttcattgccaagttttttgtaagagtgggcaacatattcagcatttcacatcttcagttccccacgctcatgctaatgtctgtctgccgctacctccattgctataaaatttctttagtaaagatcagtgacctgttgctccagaacataattattgtttttttgccatcattcctttttggcaaatacatattgctttctaggtctctattttttaaatttgattttcttgctctgttataagaactaaattatcttacagatgccagtgaacaattttgaaaaacacttccttaccccatatcacatctctctgacagagagagaagaggccatgattatgtcaacagtttgaacagcggcatcttgcaagaatttcagaccaactgaccactcatcaaagaacttggcagctttttaatcttgtttttttaatacaacagtatatccattctgatgacaaacctgtcccgccaaatctccacaacacacgttgtaaaatcagtgattagcaaattagtcagctttggcacggagctgtgcttgcttgcccatgacagtctggaaactggttttgtacttgcaacagattatcaacaataagttgctcactgtaagaagtagagttgagtctcttctgcaggtgtgtgtccagtgatcagcatgtgtgaaaagtattccttaatatatcttctgaagactttttctgtttctgttggaatcttctttgattacaaattggttattaccatctatagaaccacttgtacccagttcagccaacaaaaatgcaagatgtttgggctgatgatgtaatagtttacaaatatctgtaaagttgacaaaataagttttcttggttcctactcaaatgacctgtagaggtttgatgacagatttccttttcagcaaccacatctggattcttttccctcgtgatgttgcacactcgcttcagtagctccttatgtgtatttgagactgccctagcagggcctgtatgattattgaatgagatactgtcatcttttttgctgtcttcatcttctagaactttgtctttctctagtatttcatcctcatctgggaacttgacattcttctttttcttctttttattgccaagcataatattaaggtcatactctggttcagctggttcttgaatattttttcaatcttaagatcctttacaccttcttcagcttcatcagtatcaaacatcttttttgtttttttcttttcttttcttttgattaaagaagttcaagtcatctagatcatcagaagcacctttttccctactgttctcttcatcagcttccaattctttgtccccagttggctctggcgccacttgttttgtttctaagggctgggtctcctctgtttgggtatccccttcctcctctaactaaaggactgctgctgctgattttacttcttggtcatagtaggatcaaaaatcatctcatccccagacatggctgcagctcgaatgggctaggcacagacaggaagtcagacaaatcagccctagcccccagcagcagcgctgctcctgctgttacctctcacaccactgcactctctagccccttattaatgtgtgcacatagggtgggaatagagatgaataagagataggtgcatggtggagagaggaactagacttaggcatggttatacttctccagtttgaggtttctggcacgacttgacaatctttttccatccagcttctttttcctattctttggataattcattccagtctttcaacacttaactcacaggactctcttatcatttggactgggctctgacttaagtaattagaggctgtaggtataaattctctcaactcccctctctatctgaaaatatatctgtaatttttcattattttctaagggaaaggagagtggtgttgatgaccaaagctttggtgtgactgcttgagaatattggaaagagaagctagggctaaatgaaaagattgttaggtcatgctaagagtcagctgactttaagcgcattatgtaattttaaaagtaaattggtacagtggtaacaagttaatcataaatggttaatggaaaagtagttgatccttgtttgacttgtgtttgtttcagttacacagacaggtatgtatttgtgtcctggcctttgatgtaaagtgtacttcctgtggtttgcagttgaaaatgtttgaaagctgtctcctaaatttgagagctctgtttcttctgcttgacttgtaaatattggtgtaacaagggttattgtccttgataatattcttcctcagcagtcataactacatttcacatttgagttatttacatgctggtagctccctccacacccttcagctccagaaatatgctagttaaacaccatctatccaaaacttactcattacatttctggctaaaacactttttcctcattttgagtagttatgtaattatctatgcattacccacaccaggaacttgggaatcatctagaatttctaatttgtttcctcattgtaactcttagtactccttcatcatacagtcatttattaagtccaattgatactctgatttatcctctacatttcctttaatactgccttagtttagtctcttttgttactgatagaccagcgttttaattagagaaatagtttagcatagttcttaagagcatgagctgtagacacagacatgttagttgaattcagatcttggcatttacgtcaccacatgaccttcagaatgtttcttaatctctccgaacctcaattttttcacctttaatgtggggatagtaatagaacctactttacagggctgctatgaggactaaatacacttatacatataaacttcttgaagagttaactgatctggcggggtgcggtggctcacgcctgtaatccgagcagtttgggaggccaaggcgagcagatcggtcacctgaggtcaggagttcgacgccagcctgactaacatggagaaaccctaatttagttgaaagatacagattaaaatcagcaaagagaaaaggtgcatggtgcaaagcccaagagaaagcagacccatgctttcagatgtccccagcaacaatgtgggacaatacactgggagtattgccaagtagggaatctcacctgagccttggtgtctaagttttggagatcagtctcattgccacgcagcccccacaggactggtaatcagctacttggacaccagtgcacccagaggtcaaacacggtatggcttaaagcctcaggtatacaaaagtactcttaccaggcagaattttccacgggctcagaggtcatctcccaggaacgtgtaaagggccagtcctgaagataggcctttcttaagaaggaatgtgcagcatttgagcaacccaggcctgccaaataaaccctttcttgcacactagtatagtcacgttcattcttcaagaccctattagaagtgttatctttttggtgaaaatttaactgatttactctaagaagagttagttgctctcatatctttgtctctacagttacttatacttatcttctttgtagttttatataatacactttctcaagaggtttttaagtcatgctttcccaaatgtgaaaatatttttccttttcccctttctcttcactttactatttctccctttggtttgaaaaattgtttttgtgtgtttccttttaccaagatctttttatttatttatttttttttttgagaccgagtctctctgtcgcccaagctggagtgcagtggcgcgatctcagctcactgcaacccccacctcccgggttcaagcgattctcctatctcgccctcctgagtagctgggaatacaggcgcgtgccaccacacccggctgacttttttttaatttttagtagagacggggtttcaccatgttagccaggatagtctccatctcctgacctcgtgatccgcccgcctcggcctcccaaagtgctgggattacaggcgtgagccaccgcgcccggctctttttatttatttttataccatgtttttggtaaaataaagaggaaatattaataagaacagtattttgttttaaatatataacagtagttattttttaattttaattattttattttaaaattagagatggcgtctcactatgttgtccaggctggcctcaaactcctgggctcaagtgatcattccactcccaaagtgttgggattacaggcatgagccacctcacccttcttttagagtgataagttttatttatgttttcattttccatcagaatgactatatatggtactacagtttgtgtactacacaactcatggggacttggtttatatcccagtctttggtgctttctgtaattgtgtacattataaactataaaaattacatactaatctagaatccttcttgaaggtgtggattgtgtcatttatgctgtatcctctatttcatggctgacatgtagtcagtttgttgtgttgactctggtgctattttcagttatttagcctctatgtgttacctcaacagtttatccattctgataagtcctggaacactagcaggtgaagggacagatgatctttcttctcatattagcatgtattcaagtatctctaaccaagtcagaatttataagatgatagattgtatattagttttctgttgctgctgtaacaaaattaccacaaacttagtgtcttaaaacagcacctgtcttactgttttaccattatggaggccagcagtttgaaatccctttcactgggctaaagtcaaaagtggtggcaggactggtccttctggtggctctgggagaaaatccatttccttgtctctttcagcttctagtggttgcctgtctttcttttctccggcttcttccttcatctataaagtgcatcactctactccctgcgtccattgttattataattgccttccactcttctgtagtcttaccttcctcttcctccccctgataaggtcacttgatcacgtttaggacccgctggacaaaccatctccagagccttaatcgcatctgtaaagtcccttttaccatgtaaattaatattcatagtttccgaagatcaggatctggatttcttttggggcaattattcagctaaccacatattataatgaggaagcacttcttgggaggcatcataatgcttgttttttcttttcctaaatagagtatcacttttacccaaatggaataactcgctgggttattttactgagctcttgatgctcatttctttggtcttctctgtgatgaattaatgtttctatatggacatcatgcacaatttctttattcctgaagaatattttaaaatgttgttattttatgttgtagttggtgtaatacggtgcccagtatgccgccaagaatgcagacagatagaccttgtggataattattttgtgaaagacacatctgaagctcctagcagttctgatgaaaaatcagaacaggtatgcttctcaatttttctttatattcctatcttgatatcaaactgtaagttataagaaaaacatgtttggatagttaagtcatttagggtggttctgctatggattcctgtttcaaatagaaagttaaagatagctttcttatatactctcaaacttagttaaatgagactaaagctattacttaaaatgtcaaatttgggccaggcatggtggctcacgcctgttgtcgcagcacttagggaggctgaggtgtgaggattgcttgagccccggagttcgagaccagcttgggcaacatagtgagactccatctctacaaaaaataaaagtactagccgggcgtggtggcatgcgcctttagtcccagctacttgggaggctgaggttggaggattgcttgagcccaggaagttgaggctgtagtgagccgtgattgcactactgctgtccagcctgggtgacagagcgagagcctgtctcaaaaaaaaaaaaaaaaaaagtcaaatctgcacagacttcgtgttctcagccttagatttttacctacatgaatgatctgtaaggaaaaggattttgttgaagataaatggataacaaaataattttattctgtgtacagtgaaatagtatattgaagaacaagtttttttttttttttagatctagattttatgtatttaatttagattagtgcttatttcttcttttaggtatgtactagttgtgaagacaatgcaagtgcagttggcttttgtgtagaatgtggagagtggctatgtaagacatgtatcgaagcacatcaaagagtaaaatttactaaagatcacttgatcaggaagaaagaagatgtctcaggtaagatagatgcattgtaatcattacaatgattacagttaacctccttcttttgcccctatagaattttctacttattctttataaactttggatagcaacatcaataggaatttagaaaactagacaaaaattttatgtttggttaaaaaatatttgttttattttgctacagagtctgttggagcatctggtcaacgccctgttttctgccctgtacacaaacaagaacagttgaaacttttctgtgaaacatgtgatagattgacatgtagagactgtcagctattggaacacaaagaacataggtacagaaatcataattgcttaccaggaaatactataaaaagtgcttgtaaagtcattcttcttcttaaagcaaatattgattatatgtttgtgtcttaatcttttaaatctgtattttacatattttaatttcttgagcaatatatgttttggtaaattatttaaagatttccacatttaaatctaattgtcttatgaatgtttgttaaaatgtatcattttgtaggtttgggtttacaagaatggagttatattatgcatttgtttgctactcctgtgattcaaataagctttttcttggtgtcctatagtatttttggctgtaatctacaaaagcagtattcttttaaacatcaaatcacaaatacactgatttcatgttacatataaaatttgtagaaaagctagggatttatgaacaactaagcagagttactgaccctctaatacatacctttgtattttagccttgtaccctcagaattcagtagtattcatttactaggagtgtgtttcatatgaacggtttggaaactgtacaaaaatttctagtcagttgtgtaacaatatccttcagtaaatttctccagcttccatggcatctgtttattacaagtaaaaagatggtgtcacccatagtccagaattttccaaagtgtttttcaaacaacagtttttatggctggatgggaatagattttattaatctattgccaaaaatgtataagagaacttgggttaaccacacttaaatgtgtttcttaacgatatgatttcttagggtttttaattcattagaattcattgaagtttattagagccttcttaaagaggggatacagtaatcccaattgccaaccattattgcagccttactttgtgccaggtacttttctgagtgctgaatatgtatttaattcacaccaactatccatgaggtttaggtactagtattatgacggttttaagtgtaagagagcctactcacaaaaggctgtagtaatctgtacaaagtctcatagtaattggtagtaccaggatttgaatacaggtagtcagactccagatctcttcttaacccatatgctcattttcttccatagggtatagagaatatagaatgcagaatgtctcaaatttgactatataaaggtgtagtgctttttgttctttttcaaggtatctctcacagctttacagtatatttattaaatttttgtgctcttaatttgttcagaaatgtcttaacctataacttggctgaaattttagattgtctgctaacagtctcagtaagacattagattacctttttcacagctgcagtcagatctttttttgagtgttagatttcttatagctttttaagttgatggtgagaggcaaaaagaaaaggaagatgtcatacttttcctcattaaagaatagcttcagcggcattgccacctcaaagtttaaccattatccttccctttcttttaccattttcctttaccacttatatctaagtccttattatctcttgtataatttaaaaaaaatgttttttttctcctcctatactcacacaacacagagcacttctgtgaccatgtgtgtgaccagtttcccctcatattgactgattctcgccagcttggtgtccagaaattcagttcagttctgtcgccgtctacctggagttagagtcaggtcccacaagttaagggctcagtcctgcaaactgccattccacttcaaataccagtcgttaagtcccaccttctggtacttaaaatatatatatataaaatataaaatataatatataaatatataataataataaatatataatatatataaaatataaaatataaatatatgtatatatatatatatatatatttttaaagacaggttcttgctctgtcacccaggctggaatgcagtggcatgatcatagctcactgcagcctcaaactcctggcctgaggctgtcctccctcctcagcctcccaaagtgctgggattacagatgtgagccactgagcttggccccggcctctggtattctgactgacttactataaattgggggtggggcggggcggttcccacgaccccttccttgagtttggtcatttgctggaatgggtcacagaactcagggaagcatttaacttactactgccaatttattacaaattacagcaattacgacaatttaaagatcttaattggttttatttgtgattttagatttgagcaatacttcattccataaaataaaacaagtgtttcagtgaactgagcagaggagcttggttttatagagagagagggactgaggaaagcaaaaacaaataataaaaagtggattggtcatttcaaagttactttcctagtaaggctggagaagggcagaacaatagagaaataatttattggctaacatcaggttacctcaggttaccctttgttgtaaggattaaagacatcagcaccgtaggagaggtttaccaaaaaaaaaaaaaaaaaaaaaaaaaaggtggcggggggtgttaaacacagggagcctcattatcatgccaattgaaacaggcttatttgggaaattagggtgttatctctctcctcatttcttggatggtctgataactcattttcagcttgatgaactcagcatgaaggactccattttgattttttttttctatttcaacagtttcaatgaaagtttgtatataagattactttattcctgcatcttctcaattgtttcttccttgtattttggccttttcctttcttacttggtgagatttgactttttgttcaaggatctttttgcggtctttgtccagttttaacctagtgataaccactatgctggcgtgaatgcctacgtggacagttgtgccattagccttttcccatggcacctgttcagtgttgatgatatatttcaaacttcgactaaattgccagtttgctgacctttatagtgtcctcgcacaatctgaaatttatcatccttttgcatgggcatggaatgaacgttgtacttctgtcttagctcttaggaaagaggggaggacataatcttcctatgaatgtgggaaggtgcattgaaacaccttttgtggttcttgcttcagtcagaagttacaaagggattaaactttattttggccactcttgcttcagcagtggccacaaaagggaagagaactatatgctacttctggttctatctgtattttgatttttagtctgatctgttggggcctagtgcaggagcttagtccagaacaatgtcctcctgtaatttttgtttaactgtatatatatatggagagagagaatttttcttattttttgaagagacgggatctcactctgttgctcaggctggactcaagctcttgggctcaagtggttcttccacttcagtgtcccacatacctgggactagagatgtgtaccactagacaacattttatttaattttttaaaagaggttagatcttgctatgtcgcccaggctggatttaaactcttaggctcaaatgatcctcctgccacagcctcaccagtagctgagattacgggtgcatatcaccatgcccagctcaacaatattttaaagaatacaaatgaacaactggatgaagagatgcatagggtgaagtatgtgggaaggggtacagagtttccacaacactctgtggtggatgccttatcctccacgtgttcagtaacctggaagctctccaacccttgctctttcaggtttttatggagattcattatttagggatgcgtgattaaattgttgatcgtttgtgatcatctcagccttcagcccttcccttcctaggttaggaagtagggctgaaagttccaactgtttaattatctggttggttcccctggcagccagcacccatcctgatgggtctgggagtccccagccattggtcattttgttaacatacaaaaatatacttatttcagagattctgagggttttaggaattgtatgccaggaatagggacaaagaccagaacaaatatatactaaaatatcacacatttcttctcttttgttcatgctttcattttattttctctggatggactgttgcagaaaccatgtcattggacttaaaagccagcttcccattactacaacacatttacaactattctccctactttgagtttaactctgttaaattcatcctgtctatattgctgccagggttattttgctaacgtatagttgagcccccattaaaaaaatacttaacagtaaccaaagtttaagtgttcagtatgttatcacccagacagattctccttttctccctgtccagaaaaagtcaatacactgagacagcaggaggtgtagcagagaaagagtttaataattgcagagtggctgagcaaggaggatgggagatatttgagaaatatttctcaaattccaactccttgagaatttggagatgagggtttttaaaggatagtttggtgggcaggggctagggaatgggtgctgctgattgcttgggtcagggatgaaatcatagaggtgtcaaaactgtctttgtgcagtgagttatgctgagtcacttcctgagtaggggtcacaggaccagttgaattagtctcttggtatggatcaccagcctgggtggtagcagttagtccagcagaatgcagagtctgaaaaatatctcaaacactagtcttagatttcacaatagtgatcttatctataggggaagttagaaatcttgtgaccacttgctagtgactcctgagcaataagcaattataaaaaacaagacagggaacaatggttgctgtttatgcctaaatcttagcagaatttaggctcctactgtaattctaaccttatagcctttcattagctttacaaaggtggtttcagtccctgaacaaggagggtattagtttcaggaagaaactattatgcttgctttaaactataaaataaattcctcccatagttaggttggcccacatatgggaatgagcaaagacagcttgtgaggttagaagcaaggtggagtcagttgtgttagatttctctcactgttataattttgcaaaggcagttgcaagtataacatacattattgaattttaccagtgtctttcttcattgtctgttcaaagttacgaaacagtccacaagatcaccattacttctgacaccaactgcagagttccgtgaaaacccaaacataggggaaaatcacatgcccgctgagttgattttttaccttctgtaatcacagtggtggccctccaaacaagatgctgtccattcaccttggaattgtccataaaccaaactgctctttactgattaatagaaagtagtttatagtgtagcacccatccgatcacaggatcagcagctcctcaggtagtttcaaagtcagccttagggaaaaagaagctacctgcttataaatataatgagtacctctttgcattctcctggttgtaaatcctgtgcaaactatttctattttatagggaactcttctggacactgccttccttattagtgtttctccgacatcacctaagatattatggctgttttgaatttcaggattattttatgtccttcagtcatagattcagtctcagttaatgcctgtagtagctatttttttctacagtgttgtacattgtactatggcatctggacatcttctggtccaaaaatcctagtggttgctgctgggtggcactcatagggttttgcccataagctgtagtctgcattagtatgtgtggctgacacttcccaaaatcatggcggaatgtccatagggccggacatggacaaaatcatggcggatcatagggctggaaagtatttagagagactactttctgcagttcagatacagcctgtctttgatcaggcctcattgaaatgtaggcctctttttgggagttttattgataggagcaagcagtattcccagatatggaatatgtgtccttcaaaacacggatatacccaaccaaacactgggcttcttatttagtgctggggtaggtggctacagcagtatatttttctttctctgttgagtatcacaggatgcttctactctggttatttctaaggattttttcaccatttaggcatgccgttagacctttgctggatttatcatacagctcctgttggtcacatgtcatcactgcttttttcccctaattccccaaactttttatcaccattgcgtttaaattagtcctgccttggtcttcagtttctgatagtatcatgacatcatcagtatactatattattacatgtggggacccgaatcaactctaaatttctcctaatcaaattatgacagtaagctggtgagtggaaataaccctgtggtgatagagtaagtgcaaattgggatctctcccactcaaaggcaaattgtggttggctctttttgaggatggaggtaaaataaaaaaagaaattcacaagattagtccctgagtactgttttcctttggcctgctatatattttatatgttttttgtactgttgagaccatattaggaactgctgatgctatggcggaactacttcaggctttcatagttcactgttagtctccatgagccatctgcttttttcataggccacacaggattattgtacaaagaattcattggcaccagcactccgttgtctaattcttcattaaaatggtaatttctttttgtccaacaggtaatttcatcaggcagtaccttacactgtccaaaattaacaacttctgagggcctgggtggttctggtggttcctaattagcatttctcatcaacattgacctcaaggtgaacttacgtgctttctgttttcaatattagacaggtgtacttttcagtcaaacatactgtctatcccaatagtacattcaggtaatgaagacgtaaccacctcacataaaggcagctgagacattctagttttaatctaaatgtttaccttaatcccattagctgtcacctttcaatttaaccttaacacctgttaggacttcaacaagatttagaattatggtgccttgggcctccctgtcaaggagttttagtaaggtctcttatctacccctggcatttttacccacacgtgtatattgccttagttccccagttgctggttgacctctctgtcttcatcttgagtaatctgccagactattgtcccaggcaatttgaggtcaggttgcttattgtcatctttgttccctggctttttaaatcttcccaaactggggtaaaatacagcatagttagtttaaggccctttaatgttgggaactagctggggctctcattggtttatccagtcccatggtaatgctgcattaagacctttgtttcaattccatctgtgttcaatttattcatcccattttaaaacaaccatctgtagatttccatcttcctgggataaattccttgacctctactctactatttccctgttttcttatgacttaactctgattttcttagcatctgttaagacctgtaaagggaagcttagacaatacttctgataaggcttctcagattattgctagattttacagcagtaaggttacatgggggtatccatgcaaaaggggccccctcaatcacagtatttaccatataccataaggcatactgagtcatagtcatgtcactcatagtcatctcctgactatcccatcatcatgtcagtccagtgtagcttgcataagaagcttatcagctgcttattctggggagttcaatttggcatttataggaggaggaggatagttgcccttttcaaggtaaacacactttacagtggcttttatatctagtccactgggctagctgtccccttgggaataacctgctggtgtgtctggatcatgtatagccttctctggttgtacagtagtgagctgtgggtctcgcttcaacctagacacactcttccattctacagcattaaaaaccaaagatcctgtgcctctaagtcaatcactgtcacagtccattttagtaaaggtttttattccagaagctgatagtgttgatcaacaaaatgagacaatttgtactataatccctggtttcagtagtttcttggttttgtctttctcatacctagactacctccttgtaactggaagtcacagacatgctatctaatgttccagcataatttttccttttggagtgaccctgagactagtgactgcagcccagactggctgaagtctgagcttggcccagtgtcaagatctgtcctaacattctcttgtattttcattttagctagtacaggtagcagtaacaaaggaattgtttcattaactttttttttttttttttagaggagtcttgtgctattgcccaggcttcgagtgcagtggctcactgaaggcttgaattcctgggctcaagcagttctctcacttcagacacctgagtagttgggactacaagcatgtgccaccacatctggctaattttttatttttttgtagagatgaagacttcctatgttgcccaggctggtcttgaactcctgggctcaagcagtccttcctccaggacctctcaaagtacttggtatataggcatgagccaccatgcctggcctactttttttcttattagtttgcatttccttgtttatctggtggttcaactcctctggaattgggtctaccatttctaaattccattggtaatttttacctctagtaactgcagctgcagttatacaaccataccatgactgggtacccatccaagaattaaaggtttatcaattcccaccttctcatcctccctcttcgcaaaccacctgttttagtaagccagggtcattcaattgatcccacttctgatgctaactataaaattagagagtaatccacgagactcctttcacttctgacaccacttgtaagatcaagattccctaaaactacactcaggtttgataatttgctagaatttacagaactcactgcaagctgttatactcacagttatgtttattacagtgaaaggatacagattaaaatcatccaagggaaagatgcacagggcagagtccaggagagttccaaatgtgaagtttccagttgtcttctcccagtggagccatggacatcataaacacctcctgatagtgatgtgtgacagtgtgcacaaaatattgccagccatggaatctcacctaaaccttggtgtccagaatttttattgggtcagtctctgtcacatagatgtggttcaccagccacatggtagacctcagtctccaggacagctcctcctgaggttgatatgagactgtgtgacccagagctcccactgtaaatcagattgttgacacagactatctagcttggctcaagtccccaggcaaacaaagataatttcatcaggcaggacatttcagggggttagagattacctgccagggactgaaggcaaaggctagatctctctttgggcaaagttaacttttttactaaacaatctcttatcttccacttacactttagtagcaagaaccctctacctaaccctccaactttgtacatgcggtttcttagacctgtatttattaggagagccatttaaccttaaaacgagttcacctctttgtatctttttttttttttttcctgagacagactctctctgttgcccaggctggagtgcagtggcatgatctcggctcactgcaacctctgcctcctggattcaagtgattctcatgcctcagcttcccgagtagctgggattacaggtggacatcaccacgcctggctaatttttgtatttttagtagagatgcagttttgccatgttggtcaggctggtctcaaactcctggccttaagtgatctgcccacctcggcttcccaaagtgctgcgattacaggcatgagccactgtgcctatccacttctgtgtgtcttaactaacgctttctgctccattcttttccctccctaccaacaccccctcttcctcgctctggacttaaggacttttagggcgagttctttaagaatctcaatttcttatacgcttattgagtcagtcaggtcttctgtctcttctgggttgtttgtttttaggagacagggtgtcttgctctgtcacccaggctggagtgtagtggcatgatcatagctcattgtaaccttgaacctcctgggctcaagtgatcctcctgcctcagccttccaaattgttatgactacaggtgtatactaccatccctggctaatttttttttttttttttttttttttaagagatggggtcttgccatgttgcccgggtcttgaactcctggcctcaagcagtcctcctgccttggcctcccaaattgttgggattacacttataagccactgcacccagctcccatctcttcttgagtcaactttgcaattgtgataatttatattttgttagaaaattatttagtagaggttaaaaaatgttgaattaaacattaagattttatgaagatctgtagttatatcttatgattgtttattattattattacttttttgagacagagtctcactctgttgccaggctggagtgtagtggcgtgatctgggctcactgcaacctccgcctcccggtttcaagcgattctcctgcctcagcctcctgagtagcttggactacaggcgcacaccaccacgcccagctactttttgtatttttagtagagacggggtttcaccatgttggccaggatggtctcaatctctcgacctcgtgatccgcccaccagtgctgggattacaggcatgagccaccatgcccagcctgtttatgatgttttctagctgagtttatttcctgttctttattagattggccataagtttgtggtctttattggtcattttagtgacccagttttttaattcatttattctttagaagtgttctgatcctcacagttttcttttatctttattaattttttgcttagtttgattttgctgtattctttttagaatcttatgtgaaacctcagttaatcaaaaagatgtaaattttcctctgaatttagcttcattccataatcatccatttatacagtctaaaactgtgttttgttttttcttgcctctccctgctttttaaaatttttgtttaaattaaaataattgctgcatagtgaaaaagatgagctatgttttgtgtgtatatcttttaagtgaaatatactgccaactttataaggttgttgtgaggattacaagcactgagaattgtacctataaagtgcttagcatagtaagcactcaataacagtttagctattattggctgttattacagttgcagcccacatgttttatttttttctctttatttaaattttttttttaattgaagtcttcgatttactttatggctttagaagttgttttgaaaaaggaaagcagctatagaactgcatgaaattttgtacctgagaacattactaggtttctagataaaccatggggtttttccatctccctccaaaaattctattcacattaaaggaattaaaaaatctgtagacttacaaagactaagaatgggagaagagacatcaatggggatttcagtccttttttttttttttttttaaagcagggtaatgaatggaagatttggtggatctgatatttgacctaatgggattgaatgatctaaggccatgcaaaggagatatgaaggaagccaatcaatatatttctcaggaacctgtaatacctagtacctagagatgataggtgtcacaaaaaatggacctattctctggagaaataaaatcagagaggcactggacttggggatattaggtccacatggggaggaagtaccaggctgaaatcagggagattaagtataaatctgtccattaagctctggggaccttcagtctccctgacttgcttccatattgctagtaatggcgctttttcatttcactgtcccttcctacctctcttttaggatttagagaccttttcaccctcggaagaatatttaaaagaaaaaaattacgagttccagcagaccagtataaattatagaaaaaagaaaacaaatgttgggaaattattagataactattgcaagaaattcatctaagaatgtagagtcaccaggataaaatgtcccatttaatgcccagaacaatgatttttaaaaagacccatatcaaggtgtataacatcataaaatgatagtatgctatggattaaggttaagatcagtgaagtttccaaaaccagcaatgaaataggaatcaaaataggaacgttaggccagacatggtggctcatacctgtagtcctagcactttgggaggccaaggcaggcagatcacttgagctcaggagttcaagaccagcctgggcaacatggtgaaaccccatctctactaaaaatacaaaaaaattctagtaaatttttagtttccaaagccagcaatgaaataggaatcaaaataggaacgttagtccgggtgtggtggtgcatgcttgtagtcccagctactcgggaggctgacgcacgagaatcacttgaacccaggaggtagacgttgcagtaagctgagatcatgccactgcactccagcctgggtgacagattgagactttgtctccaaaaacaaaacaaaacaaaacaacaggattgttaaaagaaagtcgggagatgaagggcaaaggttttcaatctagtattctctttttttgagacggaattttgctcttgttgcccaggctggagtgcgatggtgcggtcttggctcactgcaacctctgcccctgccgggtgcaagcgattctcctgcctcagcctcccaagtagctggggttacaggcgtgagccaccatgcccagccttgatctagaattctgtagctaaagtataaatcaatgtgagaataaaatgtagacatgtttcatcatgcaagtattgagaagctttgcctcttatgtacctctttttggaaagccattagagaatgtgattcaccaaaataagttagtaaaccaagaaagtaaaaggtaagggaatgcctaaaatgacagccatggggtaagataatttagaatgaggaatgaaaactgaggatcctgtgaagaaggtctccaggaaaaaaatggaaccatgtctattaaatttgttatattgggtcatttgaaaaataatgctgacaagtttggcatgtggtagttcatgagaaacattagcgattgcagcatggggcaagatggaataaatttggagagaatatattttggagaaatgtatttatttctcctgaaatgaatagtcacttttaagaccacactctcttactcttcaatcctcgtttgaggtggagatagggttgactcgctgaaactagaatttcttttccattgacagttttacaagaggaagacccaaactgcatccttcattaccaccaccatttgcagcctctccatcattatcagccttgtatctactagactaatattgttacattttttatctgtatttttctgttacccaagagagtgccacaagtgccacactcccagacgtcccctcatctgtcacactttaattccataggctctacatgtgcctgattctgccactttgtcctttggaattgttggcatgtcatcagaatctgcatatccccagcctcttttttgatccttttctttgctttatttggcataatggacactgcttctcttgcaactgtcgtgactggtgactttttttttctttcacatctcgtgtatgactgggcctggaggtatgagatacgtctttttactgttttttttagaccattctttctctttactccctgaaatatccggattttaatttcatgtcatcacccataacctctcattgctgctgtcatctaaaaacccttgggtcattccccttcatctctcaaaggtttttttccctaactcagtggtaaactgtagaatgctactattaagtcctagcaattttaatatatgtggatttgatccttcagacactctagtctttgtgttctttgacctcctttccagtgttcttgtcatttacactgctgtagccactcatatgcatagtcatatactagatcttatcatttgtaataattctattcaattttaagcattcctctctgtggccacatctgttactccagctcattctgcttagtacgaaacttctacaattattcaaccacacagtgacttttattttaatccattgatcctactaccctttcactttacctcatccctttgtgatctcatttaactccttccttatttaatgtcatagctaatcagtttaatcactcccttgcatttagccttgactcccatatcccactttttgaattcacttggcataactacagtcctgattaaacccgacttccttcctatcatattttgtttatccagctgaatatcacaggagaaaaacacattctagcataatgataccaataggtcacattctcaattcctgaccacttccctcaagtagaccgttaatgttgtctggaagtcatattgtatattcatacctttccctcttttaaatgtcaaatacttcatcctcactctgaaatactggcatttgcttccaacttcactgagaaaattgaagctatcaaaagagaactacagactccctctaccacatctacttttccaacaagcacctgtacccatatttctacatttctgttatcttagatgaactctcttcctttagaaagctaatttctctacttatacactgagttccatcccctctcatgtagccaatgacattgtttcagaaatttgcccttctttctgctaacctgtcagtttttcagtctctaacaattattcctatatttcagtatgctgctgtttttcttccatttttaaaaatgaaacacgaatccttctctttaacttcctttccttgccatcagagctgtccctgaaaaacttcttgaaagaattgcttgtaattatggtctctaattcctcctgtcccattctgtgtaaatttacatgcttttgactgtcagcattgtaccaacattgctcttttcaaggtcatgaataaccactacatgactaaatttagaagtgttttctcagttttcatcttgataccttattgtatcagcagtatttcacatgtttaatgttccttttaacacatttatgtacttggctaccagaagaacacattgttttcattttcttcctactaattactgattactttttctcaatctcatttgcttattttgtttgttcttctaggttggatgtacgagggtttacaccattatctatacgtatagtcttagggcttaaaataccatctatatgttattgatttccaaatttatatttctagctcattgtttattcctgaactttcagatttgtctgccctacagactctgacatctcccacttgaatgtctactttttcaaacataacgcttccaaaactcaactactgatcactttctccaaaccttttttcactggtagcctttcctcatctcagtttggcagttgcattttttttttcagttgcataggccaaaaatcttggcaccatcctcgactctacttgtttctcatacccaaatccaaacttatcaggaaatccttttggcttcaccttcaaaatatatcaccaactcctaccacgtactacctctgttgcctctaccctggtctctgccaccatcatttcttgcctagattactgcagtagtctctatgcttctaatactacctctcttccatttattcttaatacaactgctagagtgaatcctaagttgggctgtatcactcccctgctcaaaacctgcagtgactcttcagtcaatctttatagtggctttaaagaccttatacacgcattttatctgctactactctgcctatccctccatctctgctacagctacactggctttcttgctacttctcaaacatttcaaccttctgggtttaagcaatccttctgcctcagcctcccaagtagctgagaccacatacagctaatttttgtaatttttatagagatggggtcttgccatgttgcctgggctggtctcgaactcctgggctcaagtgtgatcctctcgcctctgcctcccgaagtgttgggatgacaggcatgagccaccatgccaggctcctttctctgttttttaattggaatgtataatcttgttatatttaatataacttgtgatatggttaaatctaccatttagtatttgttttttatttctctttttttgtgttttgttcttttgttgtctctttgctgcattattttaagtttataaatagtttttggtgttccattttacatctactgttggctttttaagctgtactttattatttttagcgattgctgtggggatagtgatatgcaattttaacttaatgtctacttaaaatattgtatggttttagtaactttacaaaaggattattcattttactcaattactatcctttgtactattgccacatcatttattcatgcattatataccttaacatacaatacttaaaaaaaaaagctgtcttttaaggaagttatgagaagagaaagtaaaagctggtgtttcatatttaccaatttattaccatttctgtttcactttattccttccagtatatatgagtttctgtctcttatattcctttggtctaatgaatattctccagcatttcttgttttgcaggtttgctgacaatgaatactctcatcttcttgtcatatgaaaatcctcaatttaagctgggcacagtggctcactcctgtaatcccagcactttgggaagctgaggcaggtggattgcctgagctcaggagttcgagaccagtctgggcaacatggtgaaaccctgtctactaaaatacaaaaaattagctgggcgtgggaacatgtgcctgtagtcccagctacctgggaggctgaggcaggagaattgcttgaacccaggaggcggaggttgcagtgagctgagatcaccccactgcactccagcctgggtgatcaagcgagactctgtctcaaaaacaaaaacaaaaaaaatcttcaatttagaaggataatttgctctagaattctgggtgggcagttttttctttcaacattgaaaagatattgatattactactttgtattctggcttccattgttttggatgtcactcgtattgttccttcctgaatgttttatggcttttctctggctgctttcaagatttcctctttttctttggcctttcccttttgaccatggagtttttagatatgtttgtctttctgtttatcctctgtggcgttcgctgagctgattttcatcaaatttgggaaattggccattattcctcaaaacagattttccagccagttgtggtagctcacgcctgtaatcccaggaatttgggatgctgaggtgagaggatcactttaccccaggggttcaagaccagcctgggcaacatagtaagaccccatctctaccagaaaattttttaaaattagccaggcatggcagtgcttgcttgtagtcccagctacttgggaggctgaggtgggaggatcgcttgaggccaggaggttgaggctgcagtgagctgtgatcatgccactgtgctcactccagcttgggtgagagagtgagacctatctccaaaaacaaaaaacaccccaagtctcctaggacttcagttacacgtatgttagactatttgattttgtcacaagggtccctgatgattgttcatttttcttgaatttattctctccctctcttcttcacactggatactttttattgatgtgtgttgatggtcacataccctttcttcagacatctcccatttgctgctaagtccatccagtgacgtttttcatttcagttattgtacttttctagaatttcctttttttcttttagtagtttccatctatctgttgagatttcctgtcagtttgttcactaagaacctatgttcatttaaaggtttgaataaatatacaatagcccatttaaacttttagctcattacagcatctagatcatcttggtgtcaatttgtattgagtacttttttctttgctgtgagttaggctttcctatttctttgaatgcctgataattttttattgtgatttggacattgtggacaatacactgtagaaattctagaaattttatcttcctctgaagacttgattgttcttgtaggcatttaaattactgtaagcttgtgtatgcttggttttatgctttgttagggaagatctgtagaaagcccaagtcatttcccaagcctttctaagttggtggtacccaatttctgaaccttgtttcttagacgatcttgtcaaggcttggttttatttaggttttgttaggacaggcctaaggtacagcttactccagggtatagtcctttaagggtgacctttctggtttctcaggtagatcccagggagattaacaaagtctgtctcctctgaagatagaattcaagctgagttcttctagaaatccatgacctctagttcttctcttccagtgtcaactttatagcaacggcagtctgctaaactttgtgtaatctcaccctgtcatatatagcccagactttgaccaagaacttgtgaggaattcacacatattcaatatcttctcttccctctatctaccctctgttccccattctcatcctacatcattccctccattccagtgccctgccccgtggatttcagccactcatgagcccacaccgtgatttttgcctctgctctacttcgcctctagccccctgttccagttatcataaaattgtctacagacagagaggtaggatgattatgatgctctttaaaggaatgtaaatttttgtctgcatgtggttcagtgactgaatatagttgcctcatgtatttctgtcttcttttatagtttttggtgacaagggctagtctggtaccagtcactgtgtcctggctgaaagtgaaagtcacctttgttccaccttcatacattaattttttttttttttaagaaacagggtctcactgtgttgcccaggctggtctcgaactcctggcctcaagtgatcctcctgccttggcccccaaagtgtttagattacaggcataagctaccacacctggctccaccttaatattttttataccctattgcagttttgtgtatagttagagtagagtaattttagattgtttttgaagatactgtttaagagagagtggctacttaaaacctagtatcagatatttttattaaagagtaagatagtttatgatggtagttacttgaatgatataagtgaggtttctctaaaatattttcttaaagaaatagcttttcatcagggtgcagtggcccacgcctgtaatctgagcactttggaaggctgaggctggtggatcgcttgagtccaggagttggagacaagcctgggcaacatggtgaaacaccatctcattcattcattcattcattcattcattcattcattttgagatggagtcttactctgtcacccaggctgaagtgcaatggcatggtctcggctcactgcaacttctgcctcttgagttcaagcgattctcccacctcagcctcctgagtagctgggattacaggtgcatgccaccacacctggctaatttttttgtatttttagtagtgatggggtttcactatgttggccaggctggtcttgaactcctgaccttgtgatctacctgcctcagcctcccaaagtgctgggattacaggtgtgagccaccgcacctggcccccatctccattatttaaaaaaaaaaaaagggagagaggaagagagaagggaaagaagaaaaggaagggaaggaatagcttttcttagaattggacttttgaattaagattttgtgtggataaacttgagagcagatattcacaattctaaatttatattaaaagtagggagatttaaaaaaatatattgatgcctcattcctattccaggctagttagataagaatcttatattatggcctggatataaaaaattgtttttacaatcttttaagaatactggtaaatcatcccaggtagtttgcattattcatagctttaaaagaacctttgctgaaactcacttttttagttcttccgtaaattcttctaagagttttttttttctttttttttctttttttttttttttttgagacagagtcttgctttgtcgcccaggctggagtgcagtggtgcgatcttggcttactgcaacctccacttcctgggttcaagctattctcctgcctcagcctcccaagtagctgggatcacaggcgcccaccaccacgttcggctaatttttgtatttttagtagagacagtttcaccatattggccaggctggtctcaaactcctgacctcaggtgatccacccacctcggcctcccaaagtgctggggttataggagtgagccaccatgcccgaccctaaaaattctttcagatgcaatccaagtagttgaagaatctgaatacattttttgtagaagtgataagtaaatacatatctactgtcagtcctcttagggagctagattcagagctatggcaacaaataaagatttcctatccaagcataattttttcatggggtacacttattgtcagacaaaatggtttgtttattgaacttcactcaacaaatgagtattcattgatctcatttgttcggtagatattcaagtactcatcgtataccaggtaccttgctaggtgatagctatacaataatgaaaaaatgtgctctgtccttgctatcttggagttgtgtagtctgtatgagactgatactgagtatttggttccgtaatagttcatcccttgagtattctttaaaatttgaattaattcatttgggtattgctgaaacatagcctcattaattttcatattatagtttctgatcctattaggatatcaaactatctgaagagcccataggttcaatgagtcagttacccagcagaatcattgcttatggctagaaggagaataattccatatggctaagagttaacttgaaagagaagaatatcaggagagaagacttgaggaagaaacacattcagagtcgttagtttcacagataaaagttacccatttggcaaagagggcagatgggttgagaagtatcccatgtgaaaattttattaaatggcaaaattattgcaaagaataaaaccaattggtcattttcctttgcaaaaatgcagctttacctctgattatttacagctcatctgttatctctctgtgcatgcctagttcctatctttgaaataattgtacgttgtcatcacgtcttcaagagttcccttctgtgcatgtatccaatgtagaatgtttagccacttaacgtcctctctatcacatcaccctattcaaatttttgttttctccttaattaaaatgtaaggaaaggaagaacaggaccttattttaccttatttactgtggtatccctaccctttgaatatttcttggcaaataggcaaatttagttcatataaataatgactacatacttttttatttttaaggggatgaggtctcactctgtcaccaaggctggagagcagtggtgtggtcatagctcactgcagcctcaaactcttggactaaggtgatcctctcaagtagctggaagcacaggcatgtgccaccacccccagtcattttttaaaatgttttgtccagacagggtctcgctttattaccctggctggtgttgcacttcaggccgcaagcgatcctcccacttcagcctccgaaattgttgcggattacggggtgagccaccatgcctggcctttgtattttaagagtcttaaaagtcttttaagagtcacaagatacgtaatttatacacagaagtatacctaaagaaactgtgtaaagaataacaaagatgtctttaaaaatgtgcgttgtgattgtgtctttcaatcagtaatctcctcacatattccatgtgttgcattctttgttggtccttcttctggaattccagttagatgtatgttagactcccctcaatccattctccatttctcttaatgtttgtattccccccctttttttacattgaaaatgcaaaacagggagacacttttctctgaacaatctcagttcacaaatactctctttatgtctaaactgccattaaaacccatccattataatttaaatattttaaatcagccagctcctcccccttttaaaaactttatttttagatagcaaaaaaagttcaaagaggtcttttgtatacttcatctaaaattttaaatagttgcctgaacattttagctgtgttttattctttaaatagagtacatgtatttattttgcctctgttagtgagtcagttcttcctgttatttctgttgattcttgcttagggtgctgtttttccttatatatgtagtcttttaaaactatgaactttcctctttccttgaaaaattatgcaatttttttttttttggtctaaaattaagatactttctttccacaataaaggattgaatttcctgttgctattgcctagaagcactaccagtttccgacagttaaatttccggaatgaagttttgaaccaccaagatgatgtgcacttggtctgaaaattcacatgtgaagtgttttgtggatacaacttctgagggtctcccccctcctcttccacagaatcattgttattgtcattcagtctttttgaggtgatagaggggcaggttactcttagtatacccttatgttaaggtcataacacttttggatctctgctttgtagtggtataggttttagatctctgctttgtggtgacggactgtgaatccatcatcacagtcaaaatagtgaacatctttatcactcctagtagtttcaccttcatgttaacttttctggataaataattcaaggctgaaagttttctttaagtagtttaaagatgttgctccactctcattgtttccatcaagaaatctgttttatttttgttcatttgtatacagtgtatcttttttctcttctggttgcttttaatattttctctttatcactggttttaaacagtttggaaattatataccttagtgtagtcttctgaatgtttcttgtgcttgggggatgttgagcttcttagagctatagatcatcaaatttgaaaaacttttatccgtaactactatttctaatattttttctcttcctctgtttttctcctttggggatgccaattatacatgtattaatgtactaatgacttttcactgctcactgttttttttttgatggagggcttcattttgggtaggattaacagagattagattttttttttttttttttttttttttttgatacagagtctctctctgtcgcccaggctggagtgccgtggcgcaatcttggctcactgcaatctccacctcccaagttcaagttctcctgcctcagcctcctgagtagctgggattacaggcatgcaccaccacacccagctaatttttgtatttttagtagagacggggtttcaccatgttggtcaggctggtctcaaactcatgacctcgtgatctgcccacctcggcctcccaaaatgctgggattacaggcgtgagccactgtgcccagccagaagattagatattacaggagaaaagataaatgattttgaagacagcaatagaaagtgacatcctgttctaatgaagtcttaggtaattgaaatatcaggtgatgtcactgtgatttttgagatttaattagagttagcttttgctccctgttctatttatgtgaggattttaatgtctttctcatactttatagaaatttctaccctttcagattttcctcacagttgctcacatttcctactctctgtccctttcctgaactcttatggttgttatcatctccccttcatatagagctttaaataaggaacaatatacatttgcaacaagataaattctaacagtataaatcctttaaaattactgctaagaataacagtgatagcaagcattaaatccttagtatgccttaagtgctttgctttgtgtgttttgaccagtttaattcttaggacagtcctgtgcatgtatatatgatgattgttctgtattttactggagaagaagtgagacacagagggttgtcaaagtcatctagcttttaactatgaaaatagtagtagtatctaagtcattaagtttttctaaaggttaaatgagagaatgcatgttaagatacttagcccagtgcctgaaaatgtagtaagttatcagaataggctattgccatctatagattgagaaatgtttagataaagtatgatgtttggagttttcttcacagtagtctaagggatggagtgagtgggtgtatagataaaatcagctatgaatggatacttcttgaaaatgggtgatcgattcagtggaattagacttctaatacatgtttgaaatttaatgtaatttaaaaaaatggaataactgaagaaaaatgaaactgggttttattaaaaaggttctcttattcagtttggatataaagcactatgatgcatttttccctagatgtgccaaaatcaaaacttaatatatacagtgacaattactaagaatagtactgtatcacttggcaagtagagtagtagggcacaggacttagtaagaccataatgtacattcagaagtttgaagttattagctaagtgattctcagccttttaaaaaacacccatccatgtatatttgtatgcatgttgcccagactggccttgacctgggctcaagtggtcctgttacatcagcctcttcagcctcccgaatacctgggacttacaggtgtgggccactgtgcccagcaaaaaacacccttttattatttatctcctaccctttactcatgagcaccatattttcataaacttcttacaaaactgtattaaatataatttatatctcaataatttaaaaaagctaagcatgctgattaattctgatcaaaaccagataattttaccaggtttatataattctagccagaagcacaaaaagttttacttagtctgtcctaactaaatcctgggcatacatcatttttactttattttacctattttgaaatatggagaatagttcattgtgactaagaaagcccacaagaattactactttagactgggtgcggtggctcacgcctataatcccagcactttgggaggccgaggtgggtggatcatgaggtcaagagactgagaccatcctggccaacatggtgacgccccatctctactaaaaatacaaaaattagctgggtgtcgtgactcatgcctgtagtcctatgtactcgggaggctgaggcaggagaatcgcttgcacccaggaggtacaagttgcagtgagccgaaatcgtgccactgtactccagcctggcaacagagcgagactccgtctctaaataaataaataaatactactttaaaatgcaagattaaaatctaagaaattactttgaagtatttatgtattaatcaaaactacatttagttcatttgttggttattctttccccacatttcagctgtaattttgattaaagaaaattcagtttacctaggtatatcatatttaggaaaatagtgtgtgtttgcttgtttcttgttcacatgaatgtaacaagatatatttagaaacaggactttgaaaaatatttattttgggataaggggaatttgtacatggttaaattttatgaattagaattttgtgaattttgatactagttaacctttctatcaaatgcgtatatgttgacatcatcaaattcttcaaaaagattgtttttcatcacaatgtaaataaagctaagtcaaaagggttaacatggaatcctcatatttctgctttatttgttcagatttaacatagtaatagtttttattggatgtagagaaatcatagtatgtgggataaatcaaatgttgctctttcacgaaggaacaaacttcgggtcccctatctaacagtaaagcctctttaaaagcctcttgccaggagtggtggctcacgcctgtaatcccagcactttgggaggtcgaggtgggcggatcatctgaggtcaggagtttgagatcagcccggccaacatggcaaaaccccatctctactaaacatacaaaaattagccaggcatggtggtgtatgtctgtagtcccagctactcgggaggctgaggaggagaactgcttgaacctgggaggtggaggttgcagtgagctgagattgcgccactgcactccagcctggacgacagagcgagactccgtctcaaaaacaaacaaaaaaactctctgaaaatattcacgtgcttttttgtgctattagtatcttttttttttttttttttttttttgagacagagtctcactctgtcaccaggctggagtgcagtagtgtgatcttggctcactgcaatcttcgcctccccagttcaagcaattcccctgcctccgcatctcaactagctgggactacaggtgcacaccaccatgccgggctaatttttttgtattttagtagagacagggtttcaccatgttgtccaggatggtctcgatctcctgacctcgttatccacctgcctcggccttccaaagtgctgggattacaggtgtgagccaccacgcctggcctgtgctattaatatcttatacaagttataatgttgctcaacattgtagacagttgagctttaaaaatgttctccttaaaaatggttaaattgggctggatgtggtggctcgtgtctgtaatcctagcattttggccgaggcaggagaatcacttgagaccaggagttcaagaccagcttgggcaacatggcaagacttcatctctacaaaaaagtaaaaaaaaaaaaaaaaaaaaaaaaaaaagcgggtgtctatagtcccagctactcgggagaatgatgcaggaggattgcttgggcttatgagtttgaggctgcagtgagccgtgatggttccagtgcattccagcttgggtgatagagtgagaccctgactcaaaaaaaagttcagacggataaattttactacgtatattttaccacaataaagtcagtgcaccagcagttttctataacagaaattcccatattgatctacattttctctcctactgtcctccattcttcttgtacctcttgtatcccactactaagtaaacttccctttatcttaacaaactttcctttatgttaacaatttcatagtctttcctcttgtctgccttagctgagactttcattgaagaaacaatggacatttagatgctcatagtattattacttttgtgattttagtgcccatatagacaattacacagtaattgtgaactcatttccaatgatttgtttcttgactgtgccttagctaggcatttagttttcaggttgtaccatggaccttgccataactgacacataacctctcaaatctgctgatctcactgataaagtcagttccagcttgtttgtttggctgtaccaaccagtactgtaccctgatctctgatatgagttactgtcttagagttttagctggtctttcccttctattcccttctttgggtcttttatatttctgtttgatgattttcctagaatgtaaatgtgattattacattctggttagaattcttcagaggttttccattacttagagaattaaatgcacaaatagtgtgctatacttggcccttcacagtttgcctctggattttatcagttattgtctcatattctgacttttgtatatttttctttggccatattgaagtatttatgtgtggattttatcagttgttgtctcatattctgacttttgtatatttttatttggccatattgaagtatttacatgtctcaaacatgcctctgtacctagcataagatgctgttcttctctgctgtgcttttcttggtattgaggccgatttaggcagtggtttcttgtaaattatatatacgtgaattatatctcttgtcacagtatggtatcattttgtatttgtgactatttgttagtagtacaaacaataatggattctttagtccatgtaaaaaggacatagaaaaaaactaaataatatttgttgacttaataacttaaaaacctaataaataatttacaaaaaggaaataaaagtagcaaagaaaactattattctagcttcctagtagccaaagaaatgttattagagtctatatttgcactattatgattagaaaattttaacatatagcattcatgctgacaaagtaaaactggtgttgatgtgatgttttttattgatttaacccttgtggaaagtttgacagtacatggcatccagaactgaaaaattattttaagtgtaattataaagacaagataaagaataaaagtcagatgtaaatttgcatgttcattattattataattgcatttaaaaatgcatagttaggccacatgcagtggcccactcctgtaatcctagcactttgagaggccaaggcaggaggattgcttgagaccaagagtttgagaccagcctgggtaacatagaccttgtctttattaaaaaataagtaaataagtacatgtataattaaaagattaaggaactatatattacagtggtagcagtaattttgtgatgttggaactatgggtgatttcccttccttttatagtattttctataatgtggttacgctttatgatttaaaatgtatacaacttatgccaatatttgaatttttaaaaagatgtaatcctgaatcaacactctaatataagagcactcaaccattatctgagtaatttttttctttcataatggcctttcagggtcagagttggagggagatgggtgattgccagttaaaagttgctgttgagataaggtatgagtggccagcatagagttgatcacttaattaaggtttcaagattgactcatttagctgttctttatttccaaaatcttaatcataaatgttttgttttaaatgtagttttgttttggttttaaggtatcagtttttggaagaagcttttcaaaatcagaagggtgcaattgagaatctactggcgaaacttcttgagaagaagaattatgttcattttgcagctactcaggtgcagaataggtaagtttgttgccttaaaaccataattttaagaattactaaaaagaagtgggtccagtttaaatctgtttttctgctatattaagcatataaagaaaacatttttttgagggggaaatggtatgaatttgggattataatatttgtcaattaaacaaaatttaattgaccaaactcttgtatacccttttaggacacatctttgtctattttaataagactgtggtctgtgttaaaccttaaatgtggaaacaaataaattaatatggagagagttgacttataaaatttaaagtggagattgtgtggaagatacagtatagagaagagagtatcacgggtggaccaattatttccccatttgtaaaacaagcattgaaaacagtgcttatcttaatgagtagcattataagatgaatacatgatatagtttctggtacatagtaagcagttagattttagctgttgctattgtatttataattatcatcaccatttattatttaaaaagtattctactttggtatatttctaagtaaatttattgataagtgagagtaggttccataagagagcagattaacaaagttatgactcttacaccagaaagacaaacactttgagctggcataattaaaactaaaattcttcggggtatgaataaggttaatatgtgtttatagactcaaaaatattaggacttctaatgaatattaaagttcattaatttatgattaaaatgacacatagtagatgctcaaaagtattaaataattgaatgaatgaatgaatgaaaatagtactttacacatggtagaactttttttttttgagacggagtctcggtctgtcgcccaggctggagtgcagtggcacaatctctgctcactgcaagctccaccttctgggttcacgccattctcctgcctcagcctcccgagtagctggggctacaggcgcccaccaccatgctcggctaattttttgtatttttagtagagacggggtttcaccgtgttagccaggatggtcttgatctcctgacctcgtgatccgcctgcctcagcctcccaaagtgctgggattataggcctgagccactgtgcccggccagaactttttatcttaagtaacaccaaaagaaaataaaaggctccttagagcttgtagattgtacacacacacacactccattggtgggtttttgtttttggaaatgttcagttgttttaggttaaactggtgatacagttgatttggagaagactgtttctcagaaatgatagatggatgtctctttcaaaggaaatgtagtgagttgattcatatggcagtcccatatttttatacagatgttttgtgtgtacattgtataagtattttttaaatatattttgtacacgtgttccagaatctgtatacaaaagtagggcaagaggtttacctgttacaagattgcacggggttgaggagattgatttcatctgtagaaagtttttaaaaaaacagtattaaaatctctgataacttccccttttagacacatttttcactgacctatctccattattttttaatgtacatttttttctttcttcaaaactgaacatacagtagacttaattaaatccaataggagtctgactgagactaactactctctaactactctctgttttcagcatgcttagtgatttctatcttcagcccaatcattttatatttgaaacctatatttcttatcactagttattagtacctttatatattaaaaatatcttccactcaccttagtaagataaggacaaaactcaaaattttcaagtaagtgccaaacgatgtacagagaaggaaaaaaactacattatttcttggagtgtattaaagttaactaaattcgaacttggcaaatgaaaggcagtttaggagctgaaagcatgggttatagtttttacagaagtagaatgtataaaaattgaagctatgtcttatggttggtcgttgacattttatatatttatagtggtgggattatccacttcctgttttgtaaataccaaagtatcagccacttcatatttgcacctaaaacttccataactgctttgagtgcttacacctacttataaaacatctaaagctattcttaaaaatggattgaaaatgttttatgccctttactgtatacaaagggaaaccatattaagagtaattttgaagggagtgtatcagaacccatgtttgaagtggctaagttataaatgaaaataaatgcttctatgtttaactattatcctttcaaaagataattattgcttgtgacattgtccttttgcacattgttcttggaaaacgtcaaggttaaacagaaccaatgtgccacatttgacactatccagaagtcactggtgtttgtgcatcacattcatgtcatagttacttaagtagattgccatccagcttaataaactgtcctttatgagcataatttaaaattactaaatattagtttcattatttgtctatgtacataacttgtttggaccaaattggtcaggtctgctgaaacatgagttgtacattttgacaaagttttcattttaattactcggttaagtgcccagttggatgaatttctgtaacagttgatgattcagagacctaggataagttgataacctaatgatgcatttctcttattcaggataaaagaagtaaatgagactaacaaacgagtagaacaggaaattaaagtggccattttcacccttatcaatgaaattaataagaaaggaaaatctctcttacaacagctagaggtatggttcaaagccaaaataaaacaaaaactgcttctcttgctctttagctgtttttaatgtttattgaaaactattttagatggattggggggtatggaaataaaggaaaacgtaaaataaggtttttaaaatttacttttggaagagaccttttctagttagttactttgcggcccaatttaataacactgactttagctgtataccttaggaaatagtgatgtcctcttagaaatcaaataattgttactaagactgggtatggtgactcacacctgtaatcccaacactttgggagcccaaggcagacagatcgcttgagccccgggatccagcccagcccaggcaacatggcgaaacctgcctctacaaaaaatacaaaaattagccagggtggtggcatgcaccagtagtcacagctactcaggaaactgaggtgggaggatcgactgagcccgggaggtcaaggctgcaatgagctgtgattgtgtcctgcactccagcctgggcaacagagtgagaccctgtctccaaaatgaaaaacagaaaaagaaaaaagaaatgttactaaaatgtgatgtacgtaaaggcaaagtagtcccaccacatttcttccccacccccttaagatggggcctcaatttaattttaccatatagattcatgttgggcttctgcttgagtcatttgtgtattttaccttattttaaaaatatttccatagttttgcagaaaatgctgctctttttgaaatttataaaccttaaacttagtgaaaattttgtgatattaggtatttatattgcatattttgaagtttatttgtaggtgtaagtttctagatgaaaatctagtcagttcatgaaatctaaatttttaatcaaagtctccactgccgatttgatttatttttagcaaatttcaaataggagttttctgggaaattgaagtttcagaaagagaaatgtttcctgattgaaaatttcatgctctggaaagttgaaattttggaaagagaaatattttctgattgaagatttcatgctcttaactaggttcagatgatatggggattattttttctgcaccattgaatagtaataatgaaatgatttatttgattatttccattaacctcaaattgtcaatagtttttttttttttctgtcccatctcttcatagaatcctttaaaaatattaggtgaataattacataaaaatgaaatgatgtcagtagaatgttatctctgaatggaatacatctttccagtgaaacacaatttgtgagattaaaagtactcttggccgggtgcggtggctcacgcctgtaatcccagcactttgggaggctgaggtgggtggatcacaaggtcaggagttcgagaccagcttggccaacatggtgaaaccccatctctactaaaaaaaaaaaacaaaaattagccaggcgtggtggtgtatgcctgtaatcccagctactcaggaggctgaggcaggagaattgcttgaacccgggaggtggaggttgcggtgaggcaagattgcgcctccgcactccagcctgggcgacagagcgagactccgtctcaaaaaaaaaaaaaaagtactcttgtgcagattgttaaagttgtgggtcccttttcctactgtacaccagtctgttgcatttaaccctaataggtttttccccccaaaaggacccatgtgaatagagagcacttagtaactatttttgatacacttaaacttactgtaatacatttgagctgtacgtctaaaatagtatttgtaaaaccatttcaagagtttctgaattaaaagatgcttcttaagatcccttgagcctgggaagtggagtttgcagtgaaccaggattgcaccactgcactccagcctgggggacagagtgagactctgttaaaaaaaaaaaagcctcttaaggctaaagtgtatacaaatacctaatggtaaatacgccacatactactaacatgatgataaatttaaaatagatgttttctagtgtaatatgttcttatactttgtagaagaaacgtttttctaagctttataaaagaaatgtagtaaaccatacttctctcagttgaatactcttatccattgatttacattataaaatgaacagcttctttccttaggaaaaatattgtccagaaaaaccaacttgagtcatttttgggagaaagttcttaagaaagtagtagatgagttgttcagcatgctgaatgtcaaaagtatgtaggacattacccatccctcctggggtgattttagttcccataaagcagtttatttttcctttgcagtgtttctctgaaattggtttttgcagtttggtcagtccttacttctttgttctctgtgaacttctgtgatatcaaaagtttccctaattctactcttagaactctggaagttatctttttcattttgtcttatatatttaagagagattttaacttcattctcatgccataccaggaggtggcactggtgacacaaaatttttttggcctttaaagtatattaagattacataaatttatttctaaagttagctccttatgctataaataccatatattagattaatctaataggaagacactatttttaacagacatgttgatagaaaagtgacattaactaacattcatttctatatgtggaatatcctttttagcttagagaactgacttttagtcccacttttgttagtggcttttcctctgatgataggcttgctaaataatcatggagcttattcacttagcccatttttaaaggaagtataggtattgtgcccatttgcattagaaatgtggggttgattttttttcatatggaattctacagcgaagctcttgttctgtttcagaatgttacaaaggaaagacagatgaagttactacagcagcagaatgacatcacaggcctttcccggcaggtgaagcatgttatgaacttcacaaattgggcaattgcaagtggcagcagcacagcactactatacagcaagcgactggtgagacacatactgtttttatttttctttaatggactttattaagatatatattcagtgaattgcacctgtttaaagtatacattttaattttggcaaatgtaaccaccaccacatcaagatacagaaaacttccaccaccccccaaagtttcctcattccactaggcagccactaatctgatttctgtcattttttagaatttcatataagtggaattatatagtatgtactcttttgaagatacctagtatcttaatgcactttattacccaaaatggcagaaattcaagtatgtatatttgatttgattgctaatttaaatgttgatgctgcctaatctgaggctgacactgtgggaatatatgtgcttttttttcttaatgtctttatcttatgatttcccaattgatatttaattttgagactaatgtggatttttttccctttaagattactttccagttgcgtcatattttgaaagcacggtgtgatcctgtccctgctgctaatggagcaatacgtttccattgtgatcccaccttctgggcaaagaatgtagtcaatttaggtgagaaataatgagttttatgaatataacttggaacactgaattagaaggagaaaatacttaaagcaaatttagataaaatttttaactttataaaactaatgttttacattttatgtaaaaatatgttgttattcattggaaactcactttagctgtggttttgtgtggctgttattacatcttaagaaagttgagcgtctactctgtatattgttttttaatgtgtgctgtttctagtcccccgaccctccatcttttaaatttatattgactgtttcatatagaaatcttagcaaatgattcattgtctggaataatttcatagatttttagttgtttaattaagccaaattgtgcattagcaacagacttttaggatgctaatgtgtccagtagttaggtcctgaggaatgtttgaaagataagagtagctcttttcacatggaagagaaatggattttccttttgttacagcgtagtatggacctaaagaccatagatgaaagttacagagagctcagttaaaacacatgcacacaaacttcctagcaattagagagctatttacagattgagtaaactcactttcagaacagttaagtcctaaacagtgggaattgtaaaagcagaggctggttgccctttttttttaaaaaaaaaaaaaaagtaatctttgcatataataaaaaaaaattatattcaaatttagctatagccttagttctgacatcagccagctgtttttgtgtgacgtagtagctaagaatggtttttacattttcaactggttgtaaaagcaaacaaaaaccaaggactgtgagacagatcttatgtggcctgccaagcatgaaatatttactctatagcccattacagggaaagcctgtcaacctgtgccttaaatcacatcttcctaaaatttggcttctatccctagaaggcaatggctccataaaaagcaaggaaaaccatcacgtctaaggatataagttgtttaaagcattcagtatttccacagaagacgattttgtgacattgtaatgctctgccttgcatattttggcaattcaaaggcagatggaatcagtattggcaatcttgagtatccttgagtaagtcttgtcatgggagaattgatttagattgattagataggcctcttctaatagataatctcttttactgtcttaattttctgtatgtctaagtaaaaaagaataaggacagagagtatatttttctgaataaccaaacgtcatttattcagctttggaatgtattaagtttctgatcatcatcatcatctttaaactgactccattccctgctgtactgttggagctttgaggtgctgatagttgtcagaggaaagaggaaaacatggtgattactcaacaaagtagatgatttagttgattatatgcaaattctcattttttaaatttttcaggtaatctagtaatagagagtaaaccagctcctggttatactcctaatgttgtagttgggcaagttcctccagggacaaaccacattagtaaaacccctggacagattaacttagcacagcttcgactccagcacatgcaacaacaagtatatgcacagaaacatcagcagttgcaacagatgaggatgcagcaaccaccagcacctgtaccaactacaacaacaacaacacaacagcatcctagacaagcagcccctcagatgttacaacaacaggtaagtatcgtgttactacattattgatagaaattatgaagccctcaacactacactttttcctatataattaagttacacatttcaaagttactagcaagactgagcagagttcaaaagtcagagtttaaatatttgctatggttatgatggtgatgtaagggagctgtgaagaaaggcagtaagtaaattgtcttgggaaacaaaattaattcactaatactctgaaaggatgtaagttctcatcctttcacatcaaatcttttttgttttccacgtataattttgtggaccaaaggaccagactgtttctgcctaggatctgatatgttccttaggcatttgttcagatctttcctatacctgtgtgtcttttgctctctccactgccatcccaatcaaaactattactccaggatgggatacgttaatgttgatacgctttaaacacacatatagagaaaaagagggggaacaggtaagagagagagagagagacaagggaaattagggagtgatatacaaactagtcattaccagtcctctggggattggggctagcgataagaattatttatactttttactttatacccttttatcttgactgaattatttttatgattacattttataattgagataaatttattttaaaattattacataaattgcaatttctactttttgtagcctcctcgattgatcagtgtgcaaacaatgcaaagaggcaacatgaactgtggagcttttcaagcccatcagatgagactggctcagaatgctgccagaataccagggatacccaggcacagcggccctcaatattccatgatgcagccacacctccaaagacaagtatgcctagagttacatttgtaagaatcctacaattttaaaattaaaagacgtcattttcttaatcactttttgggagcaggtcattgatgtgtttgagaatttgattaatgctgtatatcctcttgtcccagaaaaataaacatacacatgagattttgtatttaattttaagagcttttaaaaaatgctttaagtgcatcatatactgtgggttaagaaaccctgatgtagttaacccattcaatttgcagaagtgaaaaaaatctaatgagctggtgattttacccacaatcacaaaaagcaatgataaaatagcaagaacattagtttcctgaaaatgctgctctgctcttttaatgtggctttttgatcctaatatataaaaagggctttgagagtaacagagctaactatatgtattattattattatttttttttaccttttctctactcaaatattcttccttttaggatgtagatacgctttaataagtgtgtttagagacatgttttataatctttgcctggttatgtttatatgggagatatgagtatacagtgaggccactttttcataggatttctagttataatagagtttattttttaactcttagaatgatgtttctcaaaacatgttttaaagaccatcagaatcaccagtcagctttggtggagtgggcaaccttgtcagaatggattcctagccataaccactgaatcagaatttctaggtggggagtactcagtaatatttaaatttgtattaagtctctcaggtcaatctgcgtactaaagttggagaaacactgtcctagaacagtggtccttcaactttttggtccatgtacgcccagaaagagctttttaaaataatgcgcttcttggctgggagtggtggctcacgcctgtaatcccagcattttgggaggccgaggcaggaggattgcttgagcccaggagtttgtgaccagcctgggcaacatagcaagaccccgtttctatttaacaaaaaaaaaagaaagaaaaaatatatactcgctcacatttgaaggctttcatttaaaatttccattataggtttaagtttaaatagtttcaaaagctgtactttatagcatattgtaaatattgatgctataaagttaaaaaaacctttgcattattttaaatgaatccgctggaattccagataccctagcaagctctccttggacttgaattacacttctacttcttcaacagagttttatcttactgtaagatagctttatttgatagatatagattagcctattgtaaatttctgcaggaaaaaaatttttttataataaattgttaaatttccagtgacaatagggttattattaagatttgaaactttttctgtggaccaaattatcgttatatctccacaattgttgaaacaaaatgggtgtgtttacatggtttaagactattagaagatacaaaactcttttggatatacatttctttgagctagatggagactttttacctcctgcttctggttatgtatgtttgtatgctgttacttatttttaaaataagtcagaattcaacattggtttttattactagttttttgggatttgtttttatgtaatgcttaggaaacgtttacaaaatttacaaattacaaaaatacataatttacaaaattatgtatttgggaattaaaagaattttattatagtaatatccctcaattctttgaattttttctaggttataggctgagaaaacgatctatcaaaactatttaaaaactttttgtcagtgacaacttcatttttgttaatcatcaaatattcgaacccatttgaaggtttgttacccaggttttggagtcagacacccaacatcgttatttccaattgtacctttgattatttctacaggtttttttttttttccttcctggtgcagtgtgcctagaataagatttaggaatggtcaaaggtgtagtgttcttttgtcaaggatggaggaagggcagttgcgaaagtggtggaaaaggagatccagcagagcatggcacattctcaggcaaatcagattttttttttctttttaaagagcacatacaaaagattgatggtctgaacatttatttccttcacacttttcacataatcatgtaccccttagttcatggaaggccttcaagtatttctaggggccaagtacaccttgtcagagcgcagaagctacacagtcagactaatgaatcatctcagaacattttccttagactttgggtatacctctacagaaatcactggatgttattaagcctttttagtttttaaatatttcaaatgatttatttatatgtgtagaattcgttttcttaagattttcttctatattgtcttaaatgatcctcataacagccctcacaatgaaacaagtgaggtattgttatccacatttctaaatgactgagattatgtgatttgtctaaggtcacacagtattagagtcaggacttgctgccatttttcttttctgtaaattcattgttctttctgccacttcaagctgcattatatatcatttttattggaaaaatgactaaaggtcgaagaggaataatgaccgaatggtagttctcttaccccggtgtttgaaaatttggaggtttacagatcctctattacatacttccttcttctgaaataagatcatatcaccaggctgatgtgttgggaaattattggcaagtctgcctttccctagatactatacaaaaatgaatagaaaaatgaaaaggctgagtttgaactgttcttctcctgaataagtttgaaagggcccacttctttgtttcttctgtttccttcctaaactaaaaattataaaggtatagtttatattcagcgattctggcagatcaagtaatgataatgtcttctttcttattagcactcaaacccagggcatgctggaccctttcccgtagtatcggtacacaacaccacaatcaacccaacgagccctactacagcaactatggcaaatgcaaaccgaggtcccaccagcccatctgttacagcaatagagctaatcccctcagttaccaatccagaaaaccttccatcgctgccagatattccacccatacaggtttgtatttgagttgaatgaggcttcattaaacttaatgttaattacagagttagagtatttatttcagagttttttttttttaattcaggatcaacatttccttgaaatttctgaagagtaaagtctaaatcactaaaagtctccttccagtctaagtgaaactttcatcaacatcctctctttccgcattccccgcctaccctctcctctagcctccagttaaccatctttctatcctctgtttctatgagatggacatttttagattccacatgtaagtgagattagtcagcatttgtctttcggtgcctggctgattatacatagcataatgtcctttggttccattcatgttgttgcaagatgacagaatttccttctttttagaggctgtatagtatattccattgtatatgtctaccacattaaaaaaaatccattcatccattgatggacatttagattgcttacatatcttggctattgtggataatgctgaaatgaacatgggagtgcagataatttctctgatgtaacaatttcagttcttttggatataaattttagtgatctcttgcattgcatggtgacaacagttgattgatagtgtattatatatttcagaattccaaaaatggatttttaatgttctcaccacaaaaaaatgatgagttagtggagttagatatgttcattagcttgattcagtctttctataacatagatcagagcattacattgtataccacaagtacacacaattgttatttgccagttaaacaaaaaagagttaagtataaatatttgagtcttgaaaagttatttagctaaaaccagcattcctcaatattttaaagttctggggaattgaaggtcgtatgaatagcaaattatgggaatatctaaacagaagtacaataatggtggattaatatcacttttgctaaaaggctagttactccctttctacacctgccacaggcaaacgttgttccgatgatgcactcctggtatgagtttggagccagagagaagacccaggaccaaaatgtggttagatctttgttgttcttctgttagatccaaaggggtagtcagttgggctgagaaaaggatggggttagaaggccaagatagtagacactttgaggcttatactgagagggggaaatgatggagaacaggagtagatggaatgtgaaggacctttgagtgaggccttttgcccctttcaaccgaagaaaagtatcctttggatccttctgaaatttcaccaatttgtttcagttaaaagcattttcttttaaaacgtaaatataatctgccagcgttatactgaatttagttttatgcattgtatgcgttactttcatatcttggagtccggggtcaccataggaacaaggagcaatgaaactgttgtaacagtagcacccttgattctttctgtggctgcagtttaatattttgttttagtgggttttaatgggcttatgtaaaagttttaaaagatatttctatagcttcaaactttttaaaattttatttaaagtaagtgtgtatatttaaggtaacaacatgatgttaaacatatacatagtaaactggttactatggtgaaacaaattaacatatccctcatctcacataattacccatccccctgctcctgtaagagcagctgtaatttactcatttaacgaaaactttgaatacaatgcactgttaacaaaattgttcagaaatcactaacatattgtgaattctcttaacctgattgcttccctaatactaggagaagtcttttttggctgagggaatggtagttttattggtgatgagaggactggaccatacagaatggaaactttttaaatataaattaaaaagtaacatttctaagttaacagcttatagtttgtgaagcgctttcacaggcaatatataagtttaatgcttaaaatcacctgatatgtaatatccctgttttatggataagagtaagagaggttcgtataaccgcctgacgggttatctgcccaccacacaaacaaaatcaattcacggagaccatggcactgcagtaaagagtttaatgacgcgaggccactcacgccacgcaggaggtggagttattactcaaatcagtctctttgcaggcttgtagtttaggagtttttctttttctttttctttttcattctttctttctttttttttttttttttttttgagatggtgtctagctctgttgcccaggctggagtacagtggcgcaatctcgactcactgcagcctctgcctctgaggctcaagctgttctccttcctcagcctcccaagtagctggaagcacacgcccccaggcctggctaatttttgtgttttagtagagatggagtttcatcatgttgaccaggctggtcttgaactcctgacctctgccttggcctcccaaggtactaggattacaggtgtgagccactgcgcctggcagcttaggggtttttcaaaggtagtttggaggaaggggtgggggcagtaaggcaatgggtgcttgctgctgattggttggggaatgcagtcataggggtgtgggaaaatcccccttaattgctgaatcgcttctgggtggggccacaggagggcttgttggagggcttgttgggtccaggtggagccattgtcagtgtcagacatgcgagaaacctcaaaagatatctaaaaaggccaatcttaagttcagcaatagtgatgttatctgcaggagtaattaaggaagttgtctatattatgacctccagagtaatggctggcagtcctttatgtcaacaccttagcagaattcaggctcctttcctcctcctagcctggtggtctctttttaactttacaaaggcagttgagttttggggaagggctattatgtaaaccataaactaaatgtctcccaaagtcagcttgtctcaagcccaggaataattaatatcagcatgaaggttaaaggcaaagaagagggaggttgactagatcagatcctccccgactctttcactgatagaatttttgcaaaggcagtgatacagtttggctctgtgtcctcacccaaatctcacctcgaattgtaatccctactggtcgagggaaggacctgttaggaagtgattggatcatggcggtggtttccctcatgctgttctcacaagatctgatggtttttaaagtggcagtttcctctgcactcactctctctcctactgccttgtgaaggtgcctgcttcccctttgccttctgccatgattgtaggtttcctggggcctccccagccatgcagaactgtgagtcaatttaaaccgcttttgtttataaattacccagtctcaggtagtatctttatagcagtgtgaaaacgaactgatgcagtttcattggtgactttcctagagtcacatgatagatagaaaagttggaattttaggctgggtgcagtggctcacgcctgtaatcccagcactttgggaggctgaggcaggcagatcacctgaggtcaggagtttgagaccagcctgaccaacatggagaaaccccatctactaaaaatacaaaattagccgggcatggtggtgcatgcctgtaatcccagctatttgggaggctgaggcaggagaattgcttgaacctgggaggtggaggttccagtgagccgagatcgcgccattgcactccagcctgggtaacaagagtgaaactctatctcaagaaaaataaataaataaataaataataagaaaagttggagttttaagtccagactactaattataaatccagttctttctccacactacctgtaacaataccagggaggcagtgtgggattgtaggcctggaaacacatggtattgacagctttgggcagccagaggtatgtacagtataacaatgtcattcagtttttactaagcacttactgtatgctaaagtcctcaagcattgaggataagataaacaagacttggttctagttcttaagaaacttagaaagggagaggcaagtatcatctacttttttattgaaatacaattcatataccatgagatccactctaaaaatgtacagttcagtggcttttaatgcattcacaagattgtacaaccattaccactaattcaagaatattttcatcacctcaaaagaaatggtactcattagcagtcactcatatccttctcttccagcccctggaaaccactaatctactttgtctctgtggacattccacatgtgaatggaattatatttggcctttgatgtctggcttcttttacttagcataatgttttccaggtctatccatgttttagcatgtattaggatttcattttttatggctgaataatatttcattgtatacatatatcatttgttcatcattgaacatttgcttttcttctctggctgtcaggaataatgctgctgtgagctttcatttacaagttcatacaagtatgaacgtagtgtaccaggctgttgttgcattgctgtttataaagaaaagaggtttaattgtgtaactgttctgcaggtttacaggaagcatattcaggcacatttatggattatttttaactctttttctactgaatttggctagattaagaattcacatggagaaaacctagcattagcattagtttaagctggtgaaatagccaagacagctaagtttaagactcaaatgtagaggtgaagtctcaattttcttttgcctaatcaagaaaaacttcctcaaggactgaattatactttagtgtgtagatatgagatatatttgttggtcaagatagagtatggtatatgcaatggcttgagggagtgagaaggcacaactggagtaatacagaagtgagttgttatacaaaatagaatagatgaggaattatttgtatagcttttgattatactaagtcagatgtattaatggtgatatagttaggtaactagaagaaatatattaaaatgaagaattttagcatttacattttatttatgcaagaaggtaataggagatagtaaatggaaaacagggaatgttttgtagtatatttagtgtttcacttatggtacagtacatgtatctcattaatcagttttagaacatttctgtttgttggtaaaatgtaatattttcctgataatcagtagaacagcacctaaatatggaatccttttattaggttcaaggccaagtcttcaatactgcataacactagaacatttctggaaacttggatcactattaatgcacttgtatattttctttaacaaatatctgagaacttaccatgtattaagaccctaagtactgattatagaaggatcaaacggaaatggtccttgacctcaaggagtttcttatataatagggagacagttttcttttgttcttttttattgctgttgtgctttttttttttttttttttagatggagtctttgttgctcaggctggagtgtagtggtgcagtcttggctcattgcagcctctgcctcctgggctcaagcaattcttatgcctcagcctccagagtagctgggactatgggcgtgcaccaccccgcccggctaattttttggatttttagtagagacagggtttcaccatgttggccaggctggtctcgaactcctgaccacaggtgacctgcccacctcagcctcccaaagtgctgggattacaggcgtgagccactgcacctggccgggtgacagttttctaaacagggtcaaaacagtgagcttattggtacaaatggatgtgtatagatgacagtgaaagaatagaggcagaagatcctacatctgcctgtggaagtcagagaataaactttatatgagataatcttaaatttggacttgaaagataagtaggcaagtgttagctagtcaaggttagttagaaggcagatattccagataggaattatgtatgctgaagcaacaaagggcatgaaaggagtgtgagattcaaagcagttaggtatactgtagatgataatttcaaatcggaggtcagattttgtgatttttcttttttatgctgactttgtcactgttttattttaagctctcttaaacctgggtgcagtggctctgcctgtagtcccagcactttgaggaggccaagataggaagagcacttgaggccaggagttcgagactagcttgggcaacatagcaagacccagtctctacaaaaacaattaaaaatgagccgggcatcttggcatggacctgtattcctggctgcttgggaagctgaggcaggaggatccctttagcccaggggatcaaggttgcagtgagccgtgatcgtgccactgcactccagcctgggcaacagagtgagaccctgtctcaaaaaaaaaaaaaaaaaaaaaaatagaatctacctcatggatatgttggtaagattaagtttggtgcctgacatataagtatttaataaatgttagttgttatgattatttttctcttccttttctttttcaccagccctcattattaaaaagtaagctttgggaggaaggaccactattacgcttttgtattatgcttaataggaaaattataagcattcatccaagtgtgttgagtactttgtacttgtcttgaggaacagtagggataagagagacctgctgtcatagagtttacaggccaggagaatgcagacatttatagattttttaaaaccctacctataataaattgtatagcattactcaaaggggaaattgtaaggcatcaacctaaggtgagtatataccaggagaacccaataaaacttagtggattgttaaagcctctttgaaacctggaagcggggtaagagttagtagggagatgtcatcagtaaattttattaggaaaaagggcagaatttcaaatcccacaaggtctgaaggaactgggcacttttgaagaacagaaaaaaggccagtgaagaacaggaaagagagaagggcctagttctgtagaggaaaatggaaactagatcaggtagggcctttgtaagctgcataaaggattttggattttatcctaaactcagtgagaaagcatttttgaagggttttggtggggtaggatcagtgtacatgacctatcagatttgcctactttttaaaggcttttatgagccatataaaaccattgtagcttttaaaaaagaaaaaggaaaaaaacaaaaatagttgtctaccccattctttcacctgactaaatcccagcactataaccaattggtgtacatcctttcagatttttccctaggaatatgcaaacacgaatttaaaaacgtgtgtgtgtgtgtgtgtgtgtgtgtgtgtgtgtgtgtgtgtgcctgtgatttattttggtttattttgttttgttttgagacagggtctcactcttttgccgaggctggagtgcagtggtgctcaagggatccttctgtcccagtatccccagtaactgggactacgggcacatgctaccatgcctggctaatttttaaatttttcttttgtagagatggggtcttgctactaatagttgactagactggttttgaactcctagtctcaagtgatcctcttaccttggtatccgaaagtgttgtgattacagatatgagccaacctggccatcctgtaatttttttaagtaacagaaaatgagattataccacatgtacacacctagtgctataaatactgtgttgcaagttttaccttttttttttttttttttttttttacagttttgcttttggactttttcttttcagaaaaagtctttttcttttcttttctttttttttttttttgagatggagtttcattcttgttgcccaggctgatgtgcaatagcacgatcttgactcaccttaacctctgcctcccaggttcaaatgattctcctgtctcaacctctcgagtagctgggattacaggcatgcaccaccatgcacagctaattttgtatttttaatagagacggggtttcttcatgttggtcaggctggtctccaactcccaacctcaggtgatctgctcacctcggcctcctaaagtgctgggattacaggcgtgagccactgcgcccagctacttttggactttttcatgtcagttcttagagctttcttgtgttttaatccatatggtattccatttcattggatgtttttttagccctctgttggtgaacttttggtttatctctcacatgttactattaaaaacaaagctgcatttgtgaaaagatgttaagatcattagttattaggaaaatgcaagttaaaaccacagtgagatgtaccacgacatacttattaggatggctaaaattaaatagacttaacattaaccatagcaagtattggtgagaatgtggaggaactagaaccttcaaacactgttgggattgtaaaatggtacaatcactttgaaaaaagttcagcggtttctttaaaagttaaacgtgtatctgtcataatgattcagccattctgcttttatttgccaaaagaaaacaggaaatatttctatacaaagattcgtactcaaatgtttatagcagctttgtttgtaataagacaaaaactggaaacaacccaaatatccacctgcaaataaatggataaacaaattgtgtgttcatataatagaatagtaactaacagtgaaaaggaatgaactggatccaacagcaaggataaatctcagttttaccaagtgaaaaaaatagatgaaaaaagcgtacagtatataattcaaattatataaaactctggaaaaaaaaactaaagctgaaggaagcagatgagtggttggttgaggacaggttgtttgagagagggattgattaccatggggcatgaggaatcttgggggtgatagatatgatctgttcactattcttgatttgggtttcccagttgtagactatgtgaaaatgtgttaaactttcacatcaggtactacactttgaatatatttagtttattgtacatcatttataccttaatgtcatttgtaaaaagctgcattgaggcacaatgactgtatagttttaaacacatatttctgtaagcgaagttggtagaagtgtaattactgggccaaaagtaattacacatttaaatttcacataggtattggcaaattgctctacaaaaaatattgtgccagcttatatatttgaaaatgcccatttttgcattgtcttcccaatactaggtaaattaatcattcttccatcttttccagtgatggattaaaatgacattattgttaactttattttcatttctttgattggtgaaattggttttcttatgttcgttgattatttttatttcttctgtaaattatctttgtcttttgtgaaatatctttgctcattttcctattggactgtgtttttacttttaaatcatgaaaattatttatataataattatatttccatgtacttattcagggatgctcaaaaaacattgctttaatgaataaatgaattaatgtctttccagttagacttctaactttatttatggtgactatccatgtctagtgaaacccacaggtgaatgcttcagttagcacctatctgttggaggttataatgacatcagggatgtcctttaatgtatttcctgtttgcctcttcctgacctgtccatcctctacccttagagttatctttctagcaaaagatacaaattgcaggtgaggagtataaaaaggagtggaaataggtaacatgggattttcatgtcagttttgaatcatcttcccccttctgtttttaggtgggatgcatccccattttcatctctggcccatattaggtactcccccctcataacaaatcttcctgttgacttgagttgcagctagggattcacctgtagtcacagctttgcaagtgcatccttggccaacagctatgaccacagggtaacacaactgctattgtcctttgattatccctccaactaacctactgcctactcctaccttcagcccttcatgtctctggcatgggttttgttttgtttgtaatcccagtactttgggagactaaggtgtgcagattgcttgagctcaggagttggagaccaatctgggcaatgtagcaaaatcccatctctataaaaaaaaaacacaaaaattagccaggcgttgtggcgcatgcctgtagtcctagctattcaggaggctgaaatggagggcatggcttgagcctgggaggtggaggttgcagtgagtcaagatgatgccactgctcttcagtctggacagcagagccagaccctgtctcaaaaataaataaaagaagaatatgaccatttcttttatgaaatagtataagatttaaggtaatattcatacttaaataattttttttactctttcttacacattttgtcatttaatcatcggagttctgcaatataggtggcatgttttaaggataggaaactgacgttcaggttgagaaccagcccagaatcatagttatgggtcttctggctttatcgtactgcctctaagtaagggaagggctcatatgtactgttaactgtgcccttttttttttgtagtaaggggccttgtgtgtcaagctaagggctttctgtgggctataagaatttttcagagtttcagagctgggtactaacataattacatttctatttaagtgaatgattgtggacactgaaatggagggatactggggacaagaatactgataaataggtcctgcagcaattttgagaaacagcagaagtgtcagagcatgtcagctattttcataatagaacatataggatttgttttgctctgagcacctagttgtttgctgaataatacagttttatctaaataaactttatactgtgtgggccctcagtggaccctaaggaagcaataataaggctcagcttgatattggataatctgttagtttattaataaactgagtataagcagtgacataaaattaataacttctctgctttaatcaaagcaaatttgtctttatcttctttctcttcagttggaagatgctggctcaagtagtttagataatctactaagtagatacatctcaggcagtcacctacccccacagcctacaagcaccatgaatccttctccaggtccctctgccctttctccgggatcatcaggtaaagcaaacgggtattaccttattttttaacaccttaaaaaaacagtgtcagtatctgtcttagtcagaattctccagaaaaacagaataagtaggaggtctacttgaagagagaaagggagattgagagagatttattttaaggaattggctcatgtgattgtgggtgttggcagggaggtgaggcaggctggagacccaggtaagagtattgttacagtcttgagacaaaatttcttctttggggcatgaggaggtaggggagagaacagggctccgtcttctcttctctcttaaaagggctttacctgattatatgaggcccacttgcattatggaatataatctacttttctcaaagtcaacttgttgaaatgttaattaatcccatctaaaaaaataccttcacagtaccatctatactgatgtttggccaaactgctgggtgtcatatcctagccaagttgacacaataacatatttttttcttgattgttctttgtaattatttttgttcaaatactattggtactctttcagtaactgaagccatattaatatatatctgtagtctacactatttggaactccaaattactcaacccttagtatattcacagtctttcatgggtttaatcttatattttacaatacagagtcagttgaagagttctttggttccaagtcaactttaaaacacttagtaaaataatgaaacattgaaaaattatttaaaaagtaagagctaaagaagggcaggttaattttcaaactgtaattttaaaataaacattttgctgaaaactattaaaatagccatgatatgtagctctcttccaaaatcccagcggttttattaaccctattactcagtgattcaattgggactcttgaatacatgattgaagcaactccaaacaggttaacagtctagaagtgttattgaatgtatttttctaacgtaaattaaatgttatttttttcttactgaaacacaccacctacttctttctagaggaagaacaattcacatgtaaatatggattttccatgagatgcaacattaacatatttttaaatcacataatttttaaggtttaataagaattatttcaggacttctgaaaataattaatgggaacctaagtagaatattttatcaaataacttgttgagggatggcagataacgttttcttggtctgttttgttgactggatagtggtgccctgaggaggattctgaggtgatgtctggacacagctgagagaaactggttgatgtctgctaatggttacacatgcgtccctgactttgtgactaggtctgatttccaataattttttagctgggttataataatcttgagttctgtgaccggtaggtagaattccaaatattcttatatgcattgatattcattttgacttactactttttaggtttatccaattctcacacacctgtgagacccccaagtacttctagtactggcagtcgaggcaggtgagtatattgataattatttttttcctttttgttaagaaaaatagcaaatatgtataataaaagtagaatattacagtgaacccctttatacttaacactcagctttaacagtgatcaaataatggccaatcttgtttcttctatacttctgccaattcctttctggtctgaattattttgaaacaaatctcagtcatttcactcgtgactgtttcagtatatatcacttaatgaaaggaactttaaaaatttataaccacagaaccatgatcacacctaaaaaaatttaacaactcattctttaatatcagtagagatccagttaatgtttagtgttcccaatttttgcaacaaatgcctttgaaaaaaaaaccagatgatttctttgaatcagatgcaaataagctctatacattgccatcagtttatttgtttacatcactatcagttaatttgttgtaaaaatgtagtttctcctacagtgttttcccgatttctccatcttgtcatttaagtacattgcctcctgtttttctgtctattttggtatttaggtcaagagggttgatcagatttaggtttgatttgggggaagggagagcaagaagacttggtagtgtagtggtggcatatacttcctttggggcgaattatgcctggttgggggtttttgtgatggcaaccgttaataatcattgtttagctctattatttttctgctggttgaaatattacattttaattattgtatcattctttatttctttagaatatttctgtaaagagaagctttctgtcatcaactattgggttataggaaagataggataaattctttctgtttatttccctgcttttgtggtaatgaattgatttccaacaccctccaacagtgacagttttattgttattacctttatggactgagatatttaaacatactttatatattttaatccattatatatgttacgtctgtatgtatgtatattgaacactgaacattattccatctttgtcctgtcaaagctttctcaggcttgctccttagtccttttgctataatcacagcagtcttttttaagcttccatgtttcctgtgaaacagcatttcgggttcattttgtacatttcatgcttcagacctggaatcagccactttcccaggaagttctggtagtgttagcaggaaagcaggaaaatagtgtttgaggataatattctagtactaatagcactcattgctactgaattgttcattgtttcttaggccttttcagtggacagagctaagaaataggagtgtgtgtgtgtgcgtgtgtgtgtgtgaagaaagtgcttcaaaccataaaatgtgtttttagggtcttctgaaagttgctgcataattttaaagagttttaagctaggctttataccacattccccttaactacattatgaggtatccttatcttctgtaaagttaattgtctattgtcttcactttagtgaacattacttttcatataattgtttttatttataccatatagtcaaacgtatgtgatctttatttgttgtttcttattagctgtgggtcatcaggaagaactgctgagaagacaagtcttagtttcaaatctgatcaggtgaaggtcaagcaagaacctgggactgaagatgaaatatgtagcttttcaggaggtgtaaaacaagaaaaaacagaggatggcaggaggagtgcttgcatggtaagctcccactggagtctgacagggacttaaggacatcacttcattgattctttcagctctgagtatattaagactaagtagtgggtctagaaacatttatttttgaaatttcatgcctggcacaagccagatatctctttttctaactcaacttttttgtctaagagtcagctgtaattaatcagaaaagacttaattgtattaagtactcatttgaaattatctttgaatttgtatttagtcaatattcttcccatgatgctaaatcagattgtatcttgtcctgaaattattatttcagtagtcacattgaatctcaggccacaaaagatctttgggattctcctggacctgtgagctcagcattaagattgctgacatgaaagaaatttattgatcagagttttgtgataggaagtttgtcttttggcttacgtattactaatcattctggagttccttgagtggaacatttataaaatttctaatacagaatgaaggaaggccaagcccctcttggtttaaatattttgatttttgttttctctttctgaccgggcttctttttccttttttatatggttggcacatgggaattcatctcaaggtattggtatatttaacacagtatatatagattcagagagcaagagattcagccttggttttggagtattgttacgtcttcatccagaacttggtttagaaagtacccccataaaaaaaatgggtgccaaggttggtgaacaatttcttttatgttgttgcagccttcctacaatatagtagaatgataggtgagcagaagaatattatagaatgcttctaaaatgctatgcaaaagattctgggtgtgaaaaggggtgtgccataattagctctctcaaggaaaagtataaccctatgctcacttcccaatcaatagcttaacagtttaattaatttacttattatttgagtgagacattatcagaggagcagaccccttaaaatcatatgttagcgtgcctgaataattttggggttattgtcatttctttatggcactattgtgatctataaaataaatttgttacgtcagtatatctatatgcatattcacataactgttaaatacacatatggcatacaataaagattaaatgattcttcaagaatttgtcatcgttttgttttagttgagcagtcctgagagtagcttgacaccacctctctcaaccaacctgcatctagaaagtgaattggatgcattggcaagcctggaaaaccatgtgaaaattgaacctgcagatatgaatgaaagctgcaaacagtcagggctcagcagccttgttaatggaaagtccccaattcgaagcctcatgcacaggtcggcaaggattggaggagatggcaacaataaagatgatgacccaaatgaagactggtgtgctgtctgccaaaacggaggagatctcttgtgctgcgaaaaatgtccaaaggtctttcatctaacttgtcatgttccaacactacttagctttccaaggtaccagtgaaataattgatttttggtgttgattttcataagctaaaaataaataacagaagaatgttcagggcagatggccttctaaccagtgcacagtatttctataaaacagggagcctgttattcttttggtattagcttccagagaaactaacaataaaatatctaagatctaagtagtacattaatgttaaagagtagatttcatctcctggcctttagtttatattcagtataaggaaaatagataaaactctaaattaatagggggctaaggttacaaaacctgcagtctggttctaattctgtagtaagcttgagcaattcactaattatcagggatcagtttttgcatctacaagtggtaggttttggtttagcagagctgtagttcttcccttccatttattattttatgttcatgcaacctcttgtctcttgatttcagagaccataaaatagtagagtcatacttgtttttttcagtcttctccttcctctcttgtcccccaatttctttttggtgaaagtaagtcagtattcttggggtaaacccagcttttttcttgctataaattgaaaaaaaaaaaaaaaaaagatatatcttctcaaattcctgagaagcagtaactttaattgaataatagtgccctctttgaaagtgttaaccttttggattagaaaactagtagatatttaaacagtgccagaatatttttctgaagaattgtaatttcttacctaagtctttggagatagagttatttgctagagatgtaataagggccttctttttctttactcttatttagaaaagaaaagcattggcactttgatcttgaaattaagaattttcttttctttgggtagtaatatttactggaatgtcagaattttgccactgaatgccttctttcaatagcaaatgctttgaaagggttgtaaaatgttggcgtaaattagccaggtgtggtagctcacacctgtaatcccagcactttgggaggctgaggcaggcggagcacttgaggtcaggagtttgagaccagcctggccaacatggcaaaaccccatctctactaaaaatacaaaaaaaaaaagaacttagccaggcatggtggcacacaccttgtagtcccagttactcggagagctgagccaggagaattgcttgaacctgggaagcagaggttgccatgagccgagattgtaccactgcactctagcctgggtgacagagcaggactccgtctctaaaaaagaaaaacaaatagattggttagtacaatccctagatttaggatctatgtatatatctctctatatatctccatgtatctgtttatatagagagagggagtgaatcattttagaattcatagtttgataagaaatcctgataaaaacaaagtatatacttggcagggttaaaagataggaggtagccgggcatagtggcttacacctgtaatcccagcactttgggaggccaaggcaggtggatcacttgaggctaggagtttgagaccagcctggccaccatggtgaaaaaacccaatctctactaaaaatacaaaaattggccaggcatggtggcgggtgcctgtgatctcagcactttgggaggccaaggtaggcagatcacctgaggtcaggagttgcctggtcaacatggtgaaaccccatacaaatattacaaaaattagctgggcatggtagcaggcccctgtgatcccagctacgtaggaggctgaggcatgagaattgcttgaacccgggaggcagaggttggagtgagccaggatcgtgccactgtgtactccagcctggaggacccagtgaaactgtgtctcaaaaaaaatagaaaaatctgccggtcatgatggtgcacgcctgtaatcccagctcctagggaggctgaggtacaagaatcgcttgaacccgagaggcggaggttgcagtgaaccaagattatgccactgccctccagcctgggcaagggggagattctgtctccaaaaaaaaggaggtatatatacatgtgcttgtgcctgcaggtatgtgtttgtgtgttctaggttttgaccacgaaaaaagaactgatttacttgtggcattttaatacatgccaaaacagtacaagatacctgagaaactctgcaacctgtgctcttcttcttcataaataactgagtccacataatggtgatactgggatctgagagaattggtcttaggccttatgctgcaagtactgctcatcactactaagagacccccttttaatgcggaggtgccatttttataatgcattccagaaagtaatcaattgatgcgtgactaggaaaatttagaggagtttttaatcacatgacttcacctgacgagatttcacaactataaaacctcccttttttcaaaaaattattaagaaaataaaccaggccccagtccagggaagtagcttctctagagcaggctttcttataattacgtggactaattgcctatttccctgtctagtggggactggatatgcacattttgtagagatattggaaagccagaagttgaatatgattgtgataatttgcaacatagtaagaaggggaaaactgcgcaggggttaagccccgtggaccaaagggtaagtgtcaaataagttgatttgtcactgggattcagtagttgtctgcctatatatacacctttttttttcctgtgtagcatacacaaaacctgataacatttaatttttaatcctgtcatctgatggtatattgatgatttctgaagtctttttttcctctaaccctgaactacagacccttctatccagattcctcaaacttaacatgtcccaactaaaatcttaatttctaatcctctccctccaagcacaaaaccaagcaaataacgacataaaaaactgtattcctcccccagtattccccttaattgaatgataccaccattcatttctgttgctcaggttagaaacctattagaaatgaaataataataactataatatgattttcttaccttacatcataatttctcatctggactattgtagtgatctcttaactgctctccccgcttctgctcttgacctttatagtttgttttctgtattaaacagtgttctttttaaaaaagtaaacaagtctatcatttccttgcttaaaatcctctaatagcttctcatcatattaaaaatggaaactctctccttactttactcagatttttaccaatctggcctgtagtctgattgccaaagacagactcttttgcattgtcgtgtggtcattagagttaagtttggctctactctggtgtatatactggtaaaaaccctcatccactatctgtgaagacaagatacgtgtttagggtatacaaacttgtattaaaagaagtttagataaatagaagactgtgaatgtaaaatgcatttcagtttactcatgattgggtaaaaaaatatttttggagttagactgagaaggccattttcattttgaacctgactggaatcatttgaagaaaggggatgataactttcaacatttgtcttgcctgtctaaggaattaccatgaggagcaacagtgataatttatttacttatttatttattaccaagtaatttataaatttttgcacaaagtgttagatgttgcttttgtgactcccttccataaattaccttagttatcttccattcttacttaaagtagaacaaaagatagtctgaaaacaaaatgagaagcaagggaattttctttgggtgtttatgtttagttgagtatctagtaaacagggggcttgtgttcagtttgttgtaatcaaactttgttgtgatatagttctcattctcgagaatgttttattaggagaaaaatatttcatgtgctttcctttccttgtttgggccagaaatgtgaacgtcttctgctttacctctattgccatgaattaagtattgaattccaggagcctgttcctgcttcggtgagttgcctaccttagtagctcggtggggaagtctcataatacttaagagtatgggctctggcggccgggcgcggtggctcacgcctgtaatcccagcactttgggaggccgaggcaggcggatcacgaggtcaggaaatagagaccacggtgaaaccccgtgtctactaaaaatacaaaaaactagccgggcacggtggcgggcacctgtagtcccagctactccggaggctgaggcaggagaatggcatgaacccgggaggcggagcttgcagtgagccgagatcgcgccactgcactccagcctgggcgacagagcgagactccgtctcaaaaaaaaaaagaaaaaaaaaaaaaagagtatggccttagactaagttgtattacacctcagccttctggaataagctcttcaacctctctaagactcaagttttctgacacgattttttacctcattgggttgttctgaggattatataaaataacctatgtaaaatatttagcatagtctatagtcattgagttttgtaaggaataaaggctctaaaatgctgcaataaaaggaagattagaggtgtttggtgcctaataagtggggtaagaatattctacacacattttattgctagccatcagttgttgaatagtacattattacataccaggcctgttagagaatattaaatggtagttgacttgtttactgggtagcctgagaaatgaattttaaatcacaaaaggtatagacagaaggaagatgttttgtacaagcagtaatcatctgtttctggaaaatttgtctcatctttaagtgcagggattttaaagtagaaaatgactttcaaatgttttctttttatggactattaaagtagcttcttggccgggcatggtggctcatgcctgtaatcccatcattttgggaggcctggcaggcagatcacttgagttcaggagttcaagaccagcctggccaacatggtgaaaccccctctctactgaaaatataaaaattagccgggcgtggtagtgcatgcctgtaatcccaactgctagggaggctgaggcaggataattgccaggggatggaggtggcaatgagccacagttggcgccactgcaccactgcactccagcctgggcgacagagcaagactccatctcaaaaatcaattagtcaatcagtcaataaaatagcttctctaactttacttttatcccaagggtagaaatttttcgccagagttggggtcagaattccctagcgtgaacactaaatggttaataaagttagtaaatttttcttatgttcttagtcttacttcctctgttactaagtcaagacttcgtgatgtaaatgatattccctgttatgttttccaaaagacatcatattctaattgtaacattaatatattttgtaaatttttttctttaaaaaaaaaagaaaaactcctaaggagtcataaaattctggtaagtcaaatgttgcctcaaggctactggttggttacccttgctaattgctttctttccaaatcttattattaaaagtaggactttggggacttggactaaccatgaagattggcacatatgccacataagatttggttttcatgaagatgtaaagtacatacgtctatactcaaaatttgcaagcagctggctctataataatttttttccctaaaattaatatgctatgcattttcaaattaaacagtttggcatttttggagaattcttatttgccattatgtgcttattttagataccaaactactataaaattataaagaaaccaatggatttatccaccgtgaaaaagaagcttcagaaaaaacattcccaacactaccaaatcccggatgactttgtggccgatgtccgtttgatcttcaagaactgtgaaaggtttaatgaagtatgttaacttccaacctatagagtcttgatttgttagtttttgtttgtttccttgttttatttttctgctgactttaattttattaaaatttttttttctgctaaagtcctgtcaaaagtaacatctgattgtattaacagctccagtgaagaaaatttattgtgtataatttggagtatatacttaaatataataaattaagaatattatcaaatatccttttctaaatgagttgaggattggcataagtatggaaagtactgtcagtagttacgtatattttgtggaatatgattataaacagcttacgttttgggtactattaggaaagttatctgtacccatgtccttgcattttattattgacaacatgaatgtagaaccttaaaataacaaactaatctctggtgacccatcttgaatagtagcccagagtatataatactaagttttcttatttcagcagtgtgactttgattaattttggttatgttttttggtttggggagttttttgttttttgttttgttttgttttgtttttttttttttttttgagggtaagtttgagttagccatgccttgagaagaaatgtattatatacctgtttcagggaaattgtttttattagggataaaatcgattctattattgttatggaagagtttcattgtaggagaagaaaatggaatttaatgagaatccacaaaatcttttaaaagattaatactaaagtctctttattgctggtgtaatttgggtgccatatgattattactaaaataaatcacattggatcctgtaacgtattcctatagctgcctctggaagcatccagatggcattttaaaatcaaaaacaaaacaaaatcctcataaggtgaaaattctaagtcacctttatagcagtatggcacagagtatattagtaaaatctcactagtttgaagttatatttagtcccaaattctgtcttatttttcagtgcagttaaattattttcaaataaatatgctttcatgaactatagttgataagaagacccatgtttcctgcctcagtaataaatagtttatgattaacatattgctatacagatagaatttttattaagtggtttgttgaaagtttgtcagttttttaaagcaacgtttcttgtataatatgcttcacaaatatttttctcttggatagattgatgtgttcagaccaattcctattcagattgaccttgataattcaaaataagacaattactgaggtttcacagtagctttagtaacagggctttgtaaagaaaatggttccatgttctgtagaattttagaaaagcactttatctggttatagcaatttgttctccctagtatggctgacttttcgtcgccaatcctatgcagtctcataactttagaaaggattataatttcccttttttttttttgactctggtatcctttttagatgatgaaagttgttcaagtttatgcagacacacaagagattaatttgaaggtaagcttttcagaccatgcaaacttggtgaaggaatatgcattaccaataggtgaatattcctatcttttgcttgcaggctgattcagaagtagctcaggcagggaaagcagttgcattgtactttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttaaatcaattgttt

SEQ ID NO: 37708 - DNA, 11259 bp, Homo sapiens
agttgtttccgggaagcgggactccaaatgggtcgcagtcgcagccgctctccacggaggggtgagtcctgtagcaattcggaggatatggggctctgttggaggcctgtcccttttgttttattttgttttgtttttggtagccgcgtagcagagaggcgggcccttttcccaggcggagagcgaggggtggataaaggaacgtagacctgggccctgccctcttcagcccgccctctccggtttgaaggcagttgtttgtctctgaattagtttcattaagtctttgtcaccttcatacaataacttttattacactgtggccggtgggtttagaattagacctcagttcctttgctgaatttctgggcgacggtgggcaagtcactactcagcctttctgaatcgaattcccagaatgagtcattgagggtagtattgccaacttttaaaaactgatgtgagaattaatgtcacatcccataacatacagtatgtgattctgcctggttcttaaatacttaataaatgttagattcctgcccaggtcattacagggaaatcgatattaagaattttgagtcctgggagctcacttcgtaatgttttctggctaccagccccataaatgaggcagcgcgacgtaaagaaccctggacttccattaggagatctaacttagaccctcggttctgcccctgattcgttttttttttaaatcaatttatttatttttaatgagacagagtctcgctctgtcgcccgcccaggctggagtgcagtggccgatctcagctcactgcaacctccacctcctgggttcaagcgattctcatgcctcagccttccgagtagctgggattacccgtccgtgccaccacgcctggctaatttttgtatttttattagagacggggtttcgccgcgttggccaggctggtctcgaactcctgaccttgtgatccgcccgccagcctcacaaagtgctgggattacaggcgtgagccaccgctcccagcctctttttacctttttaatgtgactagtaatggtttgcattatttttctactggacggcgcagctctagatatttgaggtaattatcagttctgcaatttgtgtgcgtttgcattagaacgtaggcgttcccggtccacatcccgggagagagaacgcaggcgccgagaaaggtccaggtctcgggagagagatcggagaaggagccgctcgcgatccccgcaccgaagacgctcccggtaagggcagaaaataagccaagagttttatttaccgaaagtccctaagaaactggtcgcagctcttaactttgttttcatcgcttataaggggatttacggtttcctgaaatggaggaaacttaatccaaccttattctaaagctaacattcaccttggttaaatggtgctaatagtactctacatcacaaagttgtcttgaaagagtaagtaagaaataatgcatgcaaaccccagagcatggtgcttggcaagaaaaagaaataagtattttatatttttgtttctttcttccgttcctttcctttccttttcttttccttttcctttcttttcctcttttttgagacggagtctcgctctgtcacccaggctggagtgcagcggcgcaatctgctcactgcaacctccgcctcccctgcaatctctgcctcccctggttcaagcaattctgctgctgagcctcccaagtagctgggactacaggcacatgccaccacacccagctaattttttttgtatttttagtagagacggggtttcaacgtgttagccaggatggtcttgatctcctgacctcgtgatccacccacctcggcctcccaaagtgctgggattacaggcgtgagccactgcacccggcctgttgtttcttttttattaactttttggtgataatgatttattcaagtatgtaatcaagaatggatgatcttggaagaacattagaaatgggctctgagtcttttttttggtttgttttttttttttttgagagagagggtctccctgtgttgcccaggctggtcttgaattcctaggctcaagcaatcctcctgcctctgctttccaaagtgctggaattagtagcgtgagccaccaagccccacctggctctgagtcttaataaccatcaattgctgtttaagtcagcttttttgtatatttgtgtgtggttgttagaaacttttaatttacatttttctgccttccagaaagctttctagccctagttgtactgaatgcaactgatgattaagcagtaaactacattaaaaaatttttttgttaacaatcaaggccttggcagaacctttttcctcactttgctatacggaatgactcgtggttctgtggagctcacctcatgtatatctgtgctgattgatacaaagttgatatgtctgtctgtttctaacatctttgcttataaatattagatctccaagacgacatagatccacatctccttccccttctcgactgaaagaaagaagagatgaggaaaagaaagaaacaaaagaaacaaagagcaaagaacggcagattactggtaatgttattagataaataactgtaggaaaagtacagtgatgataaaattataaaagtttaatcttgaacatttaaatgttaagccttttatagtattcattgcatatggttttgagttttttttggtttttttttttttgagatagagtttcattcttgtcactcagactggagtgcaatggcacaatcttggctcactgcaacctccgcctcctgggtttaagcaattcttgtgcctcagcgtcccagagtagttgggattacaggcacccgccactatgcccggctaatttttgtatttttagtagagacgggttctcaccatgttagccaggctggtctcaaactcctgacctcaggtgatcctcccgcctcggcctcccaaagtgctgggattatagacgtgaaccaccgtgcccagcctgagattttgttttaattgcaccctagcaagttgctggttatctatggtgctcctgatatagaacgatagttaaaaacatgagaatattctattttggaagtgtcttcagaactatatagtgtcatgcctgatattaaaggtagtccttaatatgaaacccaggtttttttttaaaaggtaatcctgtctaaaggcttcaaggagaggactttttttttgtaccataagttacattctgtccaaatgtaagaggaattttttcattagactcatcttcagctaattgttttgtgtgttctctgctagtgaggtggaatgactattaatctgttaccacctctctttttatttatgtatatatttgaaatgatagagaggtcacaaaattattcttttttgcagaggaagacttagagggcaaaacagaggaagaaatagaaatgatgaagttaatgggatttgcctcctttgactccacaaaagtaagtaaaacgtgcaacattctcatttgaattaatatgttatgactgtcctatctttccatgttcttttccatttatacaaatttatttggttataagacaataactatctgtttgaagggctttgagaatacaaaggaggaaacagtgaactgccattggaattcagggagtggttgccagggacgatgtttgaattagattttaaaggacaagtagaagtgatcagacaaagaagaggaagaagattatttcaggtagagggaagagctcatgaaaatgccatgtaggtgtaaaggagcatagtgtattgtgggaatttcagattcgaccagggataaaggggtgctgatgggctagtgacttaggctagaaatagaggtaggaggcaaatcacagagggcttttgatgcccttagtcatgctaaggaattcagagtttattcttttggtgttgaggagaggaagtagtgatttttaaataagggagtggcatggttatatgtgtgttttggaataatgactctgggggcagcatggaggacagatgggaggtgggttagattgaaggcagggagaactgctgatttgtgcaagtgaaagatgataaaggcctgaactgagttgagaatgattcaggagctgggggaagtgggagtgagtagttagtaatgcctctcaggtgtcaggctgggaccctgagtgatacagttaacccagaacagagtttctggaaggggaactgctgggaaatggaagaacaaaatccagctgccagatagagatgacattgggcagctgcatacttgtctcatagcttagaagtggggtggataggggagggaatgctgtctagccttcataatagcagagagatgagggaagaggaaaaagagggagggattatatagaggagggagagcatagagcgagagatgggggaagagagagatgggtatagagagaggaaatgaagagaggagaggggatggagagagggagggtgtgtggaaagaaaaacatattttttaaaatctcttttctagaattttaagtctttccatttagttttgcaaatggaaatagagatgtttgagaaaaagttgtcaaaaataatccactttcccaagtcttgtattccattgagttgctaatggaatggggtaatctcagtggctgtaagtttctttctaactaatgtgactgtgtagggctcacatgttttaaaatgacagtgtgtaacttaggagtactgaggcatgactgttttgaggtgagaaattaagaacaagctcttgttcttgcaatggttatgtgagctctgttttggaatttaatgaagtttatttatcagcttttttcccttgaatgccctaaattcttatttattttccaaagactattttataaatgaaagtttattaagatatatgttgggtgaaatgtaagtttattaagatatatgttgggtgaattaaaatatgtcaaaagtaaagcaactatagttttattgtctttagaagaatggggagggaactttttccccaaagaaaatggaattattttctttgttttttggttttcctgttgctggatgttaggtttaaagttcctgaaagtcagatctaagggtggtgccacccatcacttaaatgtagtcagtgaagaagatgtttgcttataaaggaaaacttaggtgaaaagtcatagatcttaaaaaaattatggagtaccatcacactaattgatgtcagttttttaaaatgacatctacaaggatgtcaatttagtttatatgcagttggcttcatggctatcagttataacgtcagctcatttgtgtttttaagtaatgtgtgtcttgtgatgtttcatcattgatctattgtgggacctcttcatatgccagtatagtcacccattttcctttctatttgattgtattttcatttttttatttgtattattttttattttaattttattttttcgagacagagtctcgctctgttgtccaggctggagtgcagcggcgcaatctcggctcactgctacctccgcctcctgggttcaaccgattctcctgccttggcctcccaagttgctgggattacaggcgcctgccaccacgcctggctaattttcgtatttttagtagagatggggtttcgccatattggccaggctggtctcgaactcttggcctgaagggatccacctgccttggcctcccaaagtgctaggattacaggcgtgagacattgcgcccggcctcattttttagttttttagagacagggtcttgttttgccacccatactggagtacagtggtatgatcatggctcactgcagcctgacctcctgggctgaagcaatttccctgccttagcctctggagtagctgagagtaggcacatgccgccacgccaggataatgtttttattttttgcagagatagggtcttgctgtgctgcctagattggtcttgaactcatggcctcaagaaatcctcctgcctcagtccatttttttttttttatttttgaagagacagagtcttcctatgttgtccaggctgtactcaaactccttggctcaagaaatcctcttgccccagcctcccaagtagctgggactgtagcctcacagcaatgtgcttggcttttccctttcatcttattagattggtggaaaagtaattacagtttttgccattgaaaataatggctaaaactgcaattacttcaataacatttttctagatggtttcaaagtttggttttgtttattaatggataattttctatgccagcatgtaaataaatgaggatagggctaataatatgcaattctgcaaatagtttccagaaatcagtaaacctttaggaatcgaactttgtaaaaaggttatcatcatttacttttttgtgcccaagaccagtctttctaagtcatgcttacttcctattatagggagttcaaaatcatatacctcacaagtaatttgttcaggacttaccttccacctccaaaaaaatacatgaaaataggaatagaaaagtaagaccaaatacatttattttagccccacttcaaatatactgttcgtctgtgtatgccttttggccagtgggtcagaatcggtctttgccctgacaccaatatctaattaagtacactacacagataggctaatcttgcataagtagtaatgggagagggaggaggtgggggtcacttgtatgtgtcacgacgttagctgatgatactcatctaagtcattttctgaatatctgggagtgcagtgacctaggatgtgagaatgcaaaggtgactctcagacatatccctccatcaagaagcttgcagtctcatagggaaaataactttatgatgtacatcatggttttatagggtagaaaatagagggtactgggctgggtgcagtggctcatgcctgtaatcccagcactttgggaggccgaggcgggggatcacgaggtcaagaggtcaagaccatcctggccaacatgatgaaaccccatgtctactaaaaatacaaaaattagctgggcgtagtggtgcatgcctgtagtcccagctattcgataggctgaggcaggagaatcacttaaacccgacaggcggaggttgcagtgagccgagattgcgccactgcactctagcctagtggcagagcaagtctccatttcaaaaaaaaaaaagaaagaaagaaagaaatagagggtactgtgaggaaggcacagttaacatttttcagcagttagagaagagggcacttcctggcacctggaatgtttgaattgggccttgaacaatgggtaataaccagatagttcaagttggaggcagggaaggcaattcaggcatgaggaacaacatgggggaaagtgggtatgttgagttgacttggctgatcagaagacctgaacaagaatttgtgaaaaagaggatgggtgctacattcagaaaggtcaagatggagtaacacataacaacctagcatttgtgtctgttattctgttctgattcttgatttaaagatcaaaattgggctgggcacaacggctcatgcctgggattccagcactttggaagaccaacacagcagaattgcttgagaccaggagttcaagaccagcctgggcaacatagtgagatcccatctctacagaaaaaaaaaattaaaaattagcccagcttggtggcatgtgcctgtagtcccagctactcgggaggctgaggcaggaagatcacttgagcccaggagtttgaggctgcagtgagctatgatcacgccactgcactccaacctggcgacagtgaggccctgtgtctaaaaaataataatttttaaaatgaacaaaaaattgcaagggttgtacaagaaatgggatttagatgaatggcaaccattccagccatgatatgagaatattattagctaaggttgtaagttaaattttgtgtgaatgtgagtttttctggagattataccttttatctggtttcaaggtattctttgaccagaaaagattagattctgctaccctactttctcagcatgctttgcacatagtacatacactgtgaatgtttgttggtttgaatattaattgcttatacacgattgtaaaaatgtgagcagagagttataccacttgggagctcataggatctggaaattatctctgcctcattggactctcctccttcctccttcctccttcctcctccctccttcctcctcccttctttcttctccttcctccttccttctttcttctccttcctcctcctccttcctccttcctcctccttcttcctcctcctcctccttcctctacttccgctgctgctgctgctgctcttgctgctgcttctgtttgtgctgcttctcctgctgctgctcctgcttcttctggttctgcttctgcgtctgcttcttctgctgctccttctgctgctcttgcttcttcttcggcttctgctgctgctgtttctgtttcctctgctgctgctgctgcttgtgctgctgctgctctagcttctgcttctgcttctgctgcttctgctgctccttctgctgcttttgcttcttctgcttctgctgcttgtgtttctgcttcttctgctgcttgtgctgctgctgctcttgcttcttttgcttctgcttcttctgctgctccttctgctgctccttctgctgctcttgcttcttcttctgcttctgctgctgctgtttcagtttcttctgctgctgctgcttctgtttattctgctactgctgcttctgcttcttttcttcttctgcttttcttctgcttcttccccttccgctgctgccgctgccgcttcttctgctgcttctccttctcctcctccccctcggcccccgcttctcccctacttccctcttccttcctccttcttcctttctcctcctttcttcttcttcttttttttttttttttttttttgagactggatcatgctcagttgcccaggctggagtgcattggtgtgattatggctacttgcagtcccaaactcctgggctcaagcaatcctcccaccttagccttccgccaagtagctgggagtacaggtacatgccactgccaccacacctgctttcatgtatcctgatttaatgtatccttcctgttttttgtctgtttgtttattgtttttcttcagggtaagaaggtggatggctctgtaaatgcctatgccataaatgtctctcagaagaggaagtacaggtatgcatagcccccattattatgtttgaactaataaatcagttttttacttcaaactttattatgagataatcatgtttgtaggaaatgtagcagttttccatactgttccttgtttgaatgaaatattcattgcttatattctggtgtgttaaaattgttttcccatttacatgtaagctaatagctattagagagagggtagttggcttaaatattttaggactatagatagtaatttcctcagaaaagcataatttcaagtctatgggctttgatttcattataatttaggtataagatagatccctcctaaactagattgattatgtaaggatttcaactgtaaatatattcttctgttaagtataggcatattttatttgtaccacagttttggagcgaaccaatccatacatgaaatctcactgaattcttaatgaatgaaaaagtcaagatattttcaaacattgcctttctctctaactttgtcgctgataaaagattaatagtccagttaatttagattatgaatcatgtgattgaaaatgctataagctaaggtactagaatcatcttggacagtcttttgtaaaattaccttcaaataaggtcttagggggagaatcattacagtgtgcaattgaatttgctcaatgggtgcctgttttggaactcttttctatttctaaattatatgtttcgtgttacctaaaataaataaggattttcaattgattttttttttaagtctgtaaatcttctcaaataatttcaaaattaaacttcaatactgctatctggagttaaaagaaatctgaaagtctttggtttattttgaaagtaaaataatctctaaatatacattaaattaccttgaatagtttctaccctagactttgctattataaagatggtttatagttttcatctctgatgcatgtttttttttttataagaggagtataggattaaaaaaaaacaatgaattttctcttctcatcataggcagtacatgaatcgaaaaggtggattcaacagacctttggatttcattgcatgagaattgaagtgttgaaggatgattttttttcccctcatcttggtcagagagtggattttgtattttgtatttaacttgcattcaaaaaacaggatctcagttctcctttcttgtaaagtaagaaaatcttatttatgatatatgcagttaacttaccttgcctcaacagaagaaaggttaaatattacatttttttcttttaggaaatatcatttgtggcaggcgtcaaccccattttatttgtccttattcctgtggaagcagtatatgttttcttcctgaatgctcattaggacttcttaaaaaacatgaaagtaatttggaagtaagtttatccaataaagcagtatttctacccttttagatttgataaatatttttattactaaagaatctccccagacattttcttttttttttcacacatagatttaagtatcttgattgttagtagtctaaaaatgggaagaatgaaaaagcataactagatttttctatcttctgtggtcgcccgcccccccccaaaaaaataccatttatggttctctccgcaagtataaaagcattacatgcaaaaaaaagatctcagagaaaacaaaagtaaaagaaaagcagaaaatcacctgttatctactcccagaaataatcaatttcaacattttggtatatgtttttccaggcttctttgggttgatcccacctatgagatcagaatatgtatgcagttctttctttaacccttttttctcctatgtactgtgaacatttaaaaagtacttttaaatattctttggaaacttagcttttagtaactacttggttgtatcataatttattaactaatgttttattggtaaacattggcttgcctcccatgacttgccattataattaaaactgtgactact

SEQ ID NO: 37709 - DNA, 353771 bp, Homo sapiens
gccgccgccgcgcgcagtgagaggcgccggggctgccgcccggtgctcggcgcgctctcgggagccgcccgcccgctggtcccgcagccttccgggaggaagcggtgccggcagcgtccagggcgcgctctcgggcaccctcacctgccggcgcccggccgcttacccggcagggcgtgcgcagggtagggtgcgggaccggggggacctggaggcagaggggagaaccggccgtccgcgccgcagcacagccgctgggagcgcctcagaccccgcgcggggcgccggctccatggcgaccgggctcggggagccggtctatggactttccgaagacgaggtgagtggcacccccttcctgctcgggactccccggggagttcctatcccgcgccggcagggggaggggaaaggggccgtccccggggtgctcgtgcccagcgtctgcaggggagccccaaagcgggagcgccccggagcgggatccaggggagcttgggtccttccgcaccccccaccctccgcaagccgagctcattgtttgtaaataaagcggcgcgacgcccttggagctgggggttcactccgcagctcctcgctttcgggaggagagggagggggcatgcgtgcctctcttccctcttcctctccaagcagcgtctcccggggctgttgggcaactttccgcctctcgcccctgcagcccgggagtccatgatgcatgtcacgtctgggtcgcgcggctggagacccgggactgcggagaagccggatcgtttccccctggaactttctctctcatgattgtgtggatcagcaggcgctcagaagcctgtgcgtgcttatcccggcgggaatgggggacacgctgcgtgtgtccctcccctcgttttgcaaagtctacggccaggattgtggatttcggagcctcggtgggggaggtgttcaaggctggtggcaggtgctcctggaaacttggggaggaagcttgcagccctgccattttttcctcccgaggattcaaagcccggcacctccagggtgggtggggagaggaaagcttaattgatctcttttattaataaagcgactgaataagccacgcctcccaggcggtcggtttcactggaaagggctttgtttttaccttcattctctcttccgtgtctcccactccccccttttgaaacaatcctgctaaatcactgcctagtcctctctcgaccagccacgctcggctcttattggtatgttgctctgccaaaaaggggggtgggacgcttgtcgcgggcgcggcgtgacaggcaggctggatggagcaggtaggagtggtttgccatctggcggggtgcgcgctcaggtctggctcccctttcgagaggtgaattttacaacccaagaagcattactcagcagggaggtatttcctatcctggttgtgcatttcatgaaaagttgatgcctggaaattcaggcgttctcgatttctctttcttcccctccctcctttcttttcagaggttccctctttctctcgtgttgggggtggggttggaagaaaggctattatctgagacaggctcgcgttatggctccgctttctgcggctctcctaccctggcatggtgtgtgtgtgtgcctgtgtgctacgtaagtgtggaatgaaaggtattttggggtgggaagggtgtttagggtatgaatttttttcttagcggtgctaggcaaagcttgatgtatttatttgatcaaagaatgatcacagtgcaaataatgtgtgatttgtgtgtttattttgcctcgctgtgcttttgtaaaataatttcccgttttgtgtaactacctggggataggtgacagtagcattgtttcattgacccggggggcttctcctctccctcctggcttctctctttgaggagctttcccttgcatcctctacttctccatttaattagtggcagtagagggcaggccctgagttgcagagacgcagacattcctaaacaaaggggctgcttgggttgacgtattgtggggggtgggggtgaggacagctgcatttcatcctaggttcttttaaaaaatgttttaataacatgattatttgtaaaaactcccccgaaaaaacgattttaagagtgttttgggaagtgcagctggataaatgaaacacgttaatgtcactgttgtttgtgctttatttacattggcagtgagtgtcagaatctacctagagcacatcttgccacttttgtccacaggagtcactactaatcatcataactgatgtctagtgtgaaagtgaagcttggaatgtaaacagagtccgagtgtgtgttggcatgtgactggattcactcctgcatgttgctagaagggaatttggggctgtataggaaatagcaagaggtgatgaagacaccttttattatctatttattgccatgtcgctggtagtatttagttccacacacattgtatttcacaagatgagtctcagccgtcttcctttttcaactttctcctaccagtgaaaaaataagccagggcagttctgatgacttcacatttcattggtatttgtttttcatgggcagtttcatgctgtcacgttgcccttcagagaatcagggaatgccttcgtagaatattaacgacaaattgttgaatttgcacagcttgttttgtctccctgaattagtatgtgtaagaaaaaccaatggaagattttagcaggctctgaaagtagaatgcccgctgaagcaaacggcagggttgttcttccaaggcgtattaaatatgggtacacttagtttgcagacttggtgtgctgcagaatatcacatatgaagatattttgaccgctatttagaagagtgacctcataaatcttttagcaaagtagacacacatacctaccacatttcttaaaagtagattcgtattttgatttgagattgttgaaaagcatggtatgtttggagtgcacttagttatgtcccatctcataaagactgttgagctctctgcactgctgatgatgaagcattgcatgaacccagaaaacggggatgccaaagcacagggcttaggtgctgttccttgcgtcatcagcagaggtctgtccactttgtagaaggtaaggggttgagatgtgggctttgcttgtgtgaatgtatgtgctgtttaattttttctgtgtgtttcgggcggaggtttctctggtgagttataattcatatttaccctgatttaagtcatgtcactttaggtagccagattcaaaaccatcagatgaaggacttttggtgttagagggattagcagtttaacaaaacttctgattcatggcccaagatcagatttggtttggaatcagaacactttggactagtttctgcatctggcttgagtccttgtggatttcttgttttatttctttatttttggcaatctgtagtgcattttggcatagtttacttatgaatgttaccgctaactttctgaaatcttttattccattttagaaaggtatcatttattgaaaagatttttctactgaacaaaatactgggattgaatggcagcttcttatcacattagatatgacattaagtaatttcgttagtagttaaaatgaagcaaatggcatagaaatgaaggccaggctgacataggataaatggcaccttctctccttatcctgtacaaacacggatagttggctacttttgaatgcctcttctataccaatggtaaaaatccggcttaattggggccacattctagcctagtcacaatcagtggcttgcattatgtcctttgagatgtggcagatctgcttataggtgccagtcaccacggctccctgctggcttgggggtctttctactcatttacatataattatctacttcttaatcaaccattaaggttaacttttggcatggatcctgtatgcttttcagtttaagatgctgtcacttttaagatgcgccatgagagcaaagtgctaagccttgtgcacatactatgtcatttagttctcatgagaactgtgtgaggtaggctgtgatttacagatgaggaatgaaagctcaaagaggttacgtgacctgcataaggacacaaaacaagttaagttatggagccagctattttgaatagaaaggcctagtttttaacatgctgaatatcctccccttctgacaaatgccttgaaaggtcttactatctagattatttaagataatgtaagagaaataaacaccactggttgcaaactgatggctgctgggcccgatttgaccaggaaccctgcttaatgtggtctctagagtgttttaaagcttggaaatttcatgaaaatggtaaaaatctggcttaattggggccacattctaacctagttacagtcagtggctggcattatgtcctttgagatgtggcagctagttgtgctatggttgcagtcaccactactttctgttgtcttaggggtctttctacttgtttacatataattatccacttcataacaaacctttaaggctaacctttggcgtggatgccatatttctttcactttagtgtgctgtcacttttaagatatgccattatttcatgtaccacgaagaaaaaattgctgtcaagttatgacatactgtccatcttatgaagcatccttatttcagagaagttgaaatatgagaaaaaggatattttagaattgatgaattacagtgactagaaacctgggaaaactccatgccatcagtttcaatatccccaatcattcagtacttttaagtcaacgagtagtcagatttctgcttttctgtgtttgaggaaagtgctagaaaaagagaagtgctcttaaataggcattagcacagaaggaactgggggcctagatcatagccaactggatggccgtctgtaagtgattaagaatagttgttagtttttaaaaagtggcctgtgtgtattttcaagagattacttgggaaaccctatgtgccatctttgcagctgtgcaaaacggtgaggacaagattgctttcaaaaattgtggtttagattttgcttggatctcaaggtgaatgctgacaggccgttttctgaagagagagaaggcttgcccagtcatgccaagtccaagtgcctgtgtcgggcctagatgctggatggtagactgtatacccaggacatataggtaatgtttgagaaacaaatgttaaaaggacctagttttcatggtgacatttaaaatcagtttttaaaattcatgaatataacatgttgttttaaaatttgattatagggaccgggtgcagtgatcactcctgtaatcctagcattttgggaggccgaggcaggagaatcacttgagttcaggagtttgaggccaggctgggcaacgtggtgaaaccccgtctctacaaaaaatagaaaagttagccaaacatggcggcacgtgcctgtagtcccagctacttgggaggctgaggtggaaggatcacttaaacctggaggcagaggttgcagtgagccaagatcatgccactgcactctagcctgggcgacagagtgagaccctgtctccaaaaaaaaaaaaaaaaaaaaaaagactaatgaatagaatttattttcttcaatgatgtagtgtctgtggaatttgtagacattgacatttgaattttcattatatttagttttattaaatcagaatgttatgattgtttatttcattattgaacatcagtttccttaatttaaggaataaaaataattttgctcaggccagacatagtggctcacatctgtaatcccagcacgttggaggccaaggctggtggatcacttgaggtcaggagtttgagaccagcccagccaacatggtgaaaccctgtctctacaaaataaataaataaataaatgaaaaaaaaatcagctgggtgtggtggtggacacctgtaatcccagctactctggaggctgaggcaggagaatagcttgaaccctgaaggcagagattgcagtgagccgagatcgcaccactgcactccagactgggtgacagagtgagactctgtcacaataataacaggctggggcagtggctcatgcccgtaatcccagcactttgggaggccgaggctggaggatcacctgaggtcaggagtttgagaccagcctggccaacatggtgaaactccgtctttactaaaaatacaaaaattagctgggcttggtggcaggcaactgtaatcccagttactcgggaggctgaggcaggagaattgcttgaacctgggaggcagaggttgcagtgagacaagttcgggccattgtgctccagcctgggcaacaagagcaaaactaaaaataaaaaataaaaaaagaatagtaatagttttgcttaaagggtgaggacagtgacaaatggtgatcctcagatgactgtagtttctttaccattacagaatgcaattcaaatgaaaaccattgcatggtactcaggcatttcttcaatgcagtgtgtgcccacatcaccaggaagcttacttgggaaagtttgttttgggattctggagtacctcaatatatctggtatattttcccaagaaaagtgaataatcttggggggccgaggtggacagattgcttgagcccaggagtttgacaccagcctgggcaatgtggtgaaaccccacctctacaaaaaatacaaaaacttagttgcgtgttgtggcacgcacctgtggtcctggctgctggggaggctgaggtgggaggatggcttgagcctgggaggttgaggctgcagtgagccatgatcatgccactgcactccagcctgggtgacagagcaagacactgtctcagaaaacaaaggcaaacaaacaaagatcaccccaaagaagaactcccaacatattaaaagtcattgagttttgtacccttcaaatggatgaattgtgttgtgtatgaattacatctgaataaaactgtttaaaaatattaagaatgattgagtgtgacattattgcagcagtacattggagtttctgctaaattacttttgcattcatttcaaaaggaagcaactatgcccattgctaatttaataacctgtttgcttgtgcggtgtttaaaatggcatcatgaaaacatggcaatgtgtgatagattaagagccaattaaattttttattttgagttacaagatctgcattaaacagattttattgttgcccttgaatttccagtcttagatgagtagcagcagtgaaaaaaagagatcctaacttaagagttttcaagctttttgatgttgcaggtatttgaataagtgggtctgtcttactgaaatatttgttaattagcgataaagcaaactatatgttgatcttttggtagtccatgctaaggaggattagaataatatataaataatataatggtaataagtatcagggcaggaggattaaagaagggtggaagaagtgtgacaaaatgttactttctgtttttacattgtttctcttccaggtcacaactgtatttcaaatgtatttcattttcagactataggtggcaatgtttgtgctgttcactgtttaatgttactgttggctcgggtgttgcttgttgctggaatatggaaatgatagcataatttagagttgagaataaaaaaaactagatttagaaaactagaaactagatttagatttagtagagactttctaaatagtcctagttctgctgtgtggacccttctgtaactttctgttactctgagaaggagctgataattatcacaactactggtgtttgattagcagagacattcttgattcctgatgcaagaccgtggctgaagttgtagcagggcgtttggtggttggcgatgtaaagatctgggcctcttgtttcatgaataatagaatctcactatgattgtaatattttgttttgaactggagtgctgattattgtaatccctttaggtgagaaaagccttattatataagtgtatctggggtaactagcttaaatttgacactccagtcaactttttgtccctgacttcagtcctgcattgattcaaaacgcaccaagttaaatgtcaaggctctcagattcccttgctgtcatcaaattcagtgtttggtgacttcttggcaggcagacatctaccaagagattttgtattctttttatacctcctattcaccaaaagaaaagggccattcaaaagtgagtttttctttttttttttttttaagtttaaaaagctatgatgtggccacccatggtggctcatgcctataatcctagcactttgggaggccagggcaggcagatcacttcaggccaggagttcaagaccagcctgaccaacatggcaaaaccccgtttctactaaaaatacaaaaattagctgggcgtcgtggcgtgcccctgtaatcccagctacttgggaggctgaagcaggagaatcgcttgaacctgggagatggaggttgtggtgagctgagattgcaactctgcactccaccctgggtgacagagtgagactttgtctcaaaaaaaagctgtgatgtgaaacctgttctgtgaaggtggaacttggaaaggcttgtaaggatggtggtcccatgaagaggatgaacaaaccaagggaactgtcctcttgctggtttgggtgatgtcccatcacctgtcactttgtttgtttgggctgcagtggaccaatggtttcccaggcacactgaagtgacatgtagatggattgcttgagtggctccggcatgtttccatctcctgtctaccaggcagagaccgtgttccctgttttgaggggatccagaagtgcagtgacaagggcctgatttgcatctccagctcctggtcttgcctgtgttaacaattttttttttttctttccagatggagtctcactctgtcgcccaggctggagtgcagtggtgcaatctcggctcactgcaagctctgcctcccgggttcacgccattcgcctgcctcagcctcccaagtagctgggactacaggtgcccaccaccacgcccggctaatttttttgtatttttagtagagacggggtttcaccatgttaggcaggatggtctcgaactcctgaccttgtgatccacctgcctcggcctcccaaagtgctgggattacaggcatgagccaccgtgcccggccaacaatttttacattctaattaatttccagtttccaacctgactcaaggtttagctcttcgtctcttgggtgcagttttggatcatgtcttataatgtatatttaaaagtgtgttgtaaagctggaattcccattgtgggtaaatgctgagattgttgtaatactgagaagtgcacttgggaaccatggccaacactgccctagctgaccggaggttgcactgagttgtcccctttgaacatctgttatgaatgaatgttggaaaatgcaaagccaatcatttcttttacctgacctatgtgatgttaagttttagttttatgttttggcaagtgagtgttggatgtcactaatgtgaggaggccggtgagggcagactttgggtcagaggtaatgtaggagatgaagaccctttctattaatttttcttgtttaattgaagatgttcgtgttgaatgggttttatttacatgtataagttctttttttcttaatgctggaagttactttggtttttcagaaaatgcaagtaaccctaatctatttagagaattactttgcttagtaagcactcagtactatttagtaatggggaaaaaatgtgtttgtgtcccacagcgtgacaggctccacaaacttacttacgaatctcctaactaccctgagaacctgaagaatgggactttgtggagaatcttctgctttctttgctagtctctatttttccttctcagttattaagtgagttgtctttgggtgtcctcatcatgctgacttcatcttgcccagtttgttttgggtagaggaaggagtgcaaggtttaaaggaaaagcaaagcctgtacaacatggtgagaccccatgcctgtggtcccagctacttgagaggcccaggtggaaagataatttgagcaccggggttcaggaatgcgctgagtaatgattgcaccaccgcactcgagtctgggcaacagaatgagacctcatttcaaaagaaaaagaaaaagcaagactgaatcatttcactttgtattctcctccttgctctcattccttttgtgcttcatgcattgtgtgtgacaattggatgcagccgtaattattgtcagtaacttggtttttaagcttcagactgtatttcctcctcacttgttaacaccagaagataaatgaatgtggctcttggattgaactacatctacagggagctgaacttcccatgttgacgttgaattctagagtatgcttatgctgattcttgagaaattggtatgtgccgtgcctttggaattgataccttaattttcagtgaatattattggtattattattaaagagaacactttaagccaggagtaagagcttttcctccttttgagaagtgaggtacagaagagtatactgcagctgtgggagtgatgggtggggtggggcagtgttgaagaatatttaataccacgaagatgtcaccagtataatattaaatagaaaaagtaggttataagacagtggatccagtagaatcctattgtggttaagtgtttatatgtagagaaaatgactaggggctaggcacagtggctcacgcctgtaatctgaaccactttgggagatagaggtgggaggatcacttgaacccaggagttcaagaccagcctgggcaacatagtgagactctgtctctataaaacaagaaaaaagaaaaactaactagggatatattccagcatgttagtggaggttatctttgagcaaaggggattataggtaattttttattgtcttgtgttttgcttacatgtgttttctatatttctacaataaacctttttttcttaatataaaagtaagtttaaaagtgagtttaaaaatccctgaaaggcatgtacttcaagcttcaagtgaaagttatagtacttgttcagcacaaatactgatatagtgtttgttcagtggaacacttatttagggtctgccttgtgttttgtgtctaaggattaccaggtcattttcatattaggagctcaccactacgttgggagttggagagatagagcaaggactattttaaggaaaaaatgactggtaaattgtatttctttttccccacttgcagtttgcaaaatagatgtttcatttctctccactgtggacacttaaagtttgaatttccatccttctgtgcactccagttgcgtgaaagtaatttacattgctagtagtggtttgggttctctgaaattttttgtgtgtgctatggaaattgtctcctgtgatcagactcaaatccatttctccttattattgttttcttaggttttgagttagagaccttttcatgaccgtataaggtgttgaataggtttagatatcaaagtgatagctatgcatagctatactcacctgtgagcggtcagctcttcagtgtttctttcaactgacttgtaatatccagccactgttgggtgtgacctaaagtgtatctcttcccaaacagaagggaggagttgacaaacaccatgttacttttaatcagagacttgtccttgtcccccttcccccagccttttaataattctgaattcatgttgcagtcgatatgtgtttaaagtgttggtaggtttcttgtactcacaccatcctcctccactcctctcacccccaaaaagtgacagctgacagttgatggcatcttagaattgtgaggcttgagttggtctgtctcaattcgtgttttatggtggcccataaattgtgaaagataattgatagttgtcatgggaactagttatgttgttcagctatgatgtctcaattaggaaatgttcacctagacagtagggaaatgggccagctcagggatgtcttcaggaaccaggttcattgttttttctgctttcccttctacagcctggctctttccagggcttcttggtcctaggctggctgccactgacagagctatgcctttttttatttttttactttttttcaagacagtctcactctgtagcccaagcaagagtgcagtgacaccatcttggttcactgcaacctccacctcctgggtttaagcgattctcctgccccatcctcccgagtagctgggactacaggcatgtaccaccacacccagctaatttttgtatttttaatggagatggggtttcaccatgttggccaggctggtcttgagctcctgacctcaagtgatccacctgcctcggcctaccaaagtgctgggattacaggtgtgagccaccatgcccagccagagctatgccctcttttttttttttttttgtttgtttgtttataactgtgtacttgtaaaggaaagagaacggcctcctgtgccttaaatcttctgttgtgtctcagggcccacagaggctgagatctgttcatcctgcaaccagtcaccgtggcaaggaggagatagaattacctttttttcttaccttttgagccaggggtaaagtcaggcacggtgaccctgcattccacaccttggataatccatccaccttcagaaatgcccctggcttcgtgaaatgcacatgctccctttctccagggaggtgacccgaatatgcagctaagtattgcaaggatttctgggtaatattacacctgaaaggaggttttttttttttttaattatctggtgatttatgactaaataggctatgtctctcaaaacattgaacctgcaatgggcaagaaagaacaggatgactacaatgaaccttctatttggaaaaggggaaaataagacactcacagtggggtagctggctgaacaggaacagctgggagcgtttgctttggtcagccggtctggcagcttgcctctgctgaagtccgtccagggtgagaatctcgcttggtcattgtcctctgcagctgcacctggatggggtaggcactggcaaagctccttttcttgggtgctgcttggcattagtctggggcttcaggattggttgtcttggggttgaatagccacaggcttgttccagccttactgagaatgtctttggcaaaactgctcccaggaaaactcaggctctgagttttgtgtctagtcaattccatgggctggtaatggcagccagtgatctcacctagatgaggtctgtggttctgggaattcctgggtcttaacagtaagtcccacagccctgctaatccccaccacatctgccttgaggcaattttaaaatagcctagaatgaagaggcacacagttttgggtctaacagacaacaggggcagtttaacccactctgcttttgctctctggtgtatcaagaatgagcaacttccccacactgggattgtgggactctgagtacccacttcccttcactcagccattccaatttcttaaagcaatttttaaaaaatggtggtaaggccggccgcggtggctcacgcctgtaatcccagcactttgggaggctgaggcaggtggatcacgaggtcaggaggtagagaccatcctggccaatatggtgaaaccccgtctctactaaaaatacaaaaattagctgggtgtggtggcacgcacctgtaatcccagcctctcgggaggctgaggcaggagaatcgcttgaacctgagaggcggagattgcagtgagccaagatggtgccactgcactctagcctggcgacagagcgagactccatctcaaaaaggtggtaaaatacacatgacaaaatggactctcttagccacattaaagtgtatggtttggtggcattacatgcatgcacactgttggcagccatcacccctgtctagccatggaactctttcatcttgcaaaactggaaatgccttactcgtgaaccagtacctccccattcccagccattccagtttcttgtagcgcatcttctctttgatacaaaatctttgatagggttttgattgcaggcaacagcaattgaatctgatgaattcaacagagaaagaattaactgaaggaatttggggtagcactggagtacttgtcacactggagagacaggcctggacaggggtcagggaccaatgaagcctgggcatccagaatcacagctgttagtgtgttttattatttaagagtgagctcagaggtcactgttcaaagctgggcactctgtctccaactatccctcttcacatcccagactcaatagcacctttctgcatagttacttctactgaatacttcactgacagcaatgaaggattgttggtttatgtgtctgtctcgtatagattaggcacctcttcagagccacagccacatcccaatgatttatctccagtcccaagcaccgaatcagaccccttgaccgtttactccattcaagtgatgatctcaggttagataatcatgaggtcagttggtcaaagcaaaaacatctttttaaatgtctttttgaattctaatttgtttatgcaatatagattactcctcctattttcttcttctttcttttttttccttaagagatgggatctcagtatgttggccaggctggcctctaactcctgggctcagcggtttctcccaccttggtttcctaaagttcagggatgacacgtgtgagccaccgtgctcagcccctcctcctattttctagtctgtgtcattactgagaattttactctttattctctttcctcaaattctaagtgaaaagacctctcctctctaggccccaagaaaggcaaatgtgttccacggaagaaggttgcagacccatgtttgattgctttataccatatttcccccccagaggctcttaaaagggcaaagaaggtgttgaaactgccactgtcaataccagagcatctgcttgaaaccaatgtttcttttgtgactccaggatccatgctgcctggctaagaagggcagtgtcctccttgcccaggtgttaaaccacaacagacctagaaaactgagatgtcactcctcccctggagtgacagcagtgttaggaagtttggaatctgccaacccacctcatcctgtccatgaagttgtcacttggctaggtgttgatgtaaatgtgctacagaaacaaactcacctcttgtgggacatggtgactctggttagtaacaatgtattcttcaaaattgccaagacagtagattttaaatgttcttcgtatgcaaacttggtaagtatgtggggtaatgcataggttaactagcttgaattaaccattccgcagtgtgtatgtatttcgaaataacatgtacatgacaaacagatacaattttcatcaattaaaataaacatttagaaaaataacataaatcctcacaatagccctttgaggtaggtgctgtcattttataggtggggaaactgaggttcaaggaggttaaataacttgcccagggtcacagaactacttagtaagtggctgagccaggacttgaacaagcagtccggttgtagacacccggagtggaaccatcacgctgtggtgtgtccgggagtgcttcaagcaggggttggttgggggtggggttggggtggggaaggcacagctgaggcctgagtggccagactgtaaaagccaaaggaagaagtggctggatgtgaacagctttgtggacctcatcaaggagctgggactatattgtttgaggcaccttgagaaacctgttgagatctgggcttttcttattagtaagtatgttgcccagactggtctcgaacccctggcctcaggtaatcctcccatctcagccttctgagtcgctgggattacaggtgcaagtcgttgggcccggcaatctgggcttttctaaagctcaccatgcagctttggggagattggatttgagttggacaaccctaggcagttgcagagctgtccaggcagaaatggtgatgacggtgaaaatgagccaggggataaggcaggaggtatttaggaggcagattccattggatttggtcactgattgattaggtacaaaaaaagggaggtgtctagaataatccctaggtttcttcagaggactaggtagatgggaggaggggaagaagcctatctctattaaatacttagtacagtggctctaaactggggcctgtcttgcacccttccttctcccctaggggacatttggcaatgcctggagacttttttttgagacggagttttgctcttgttgcgcaggctggagtgcaatggcgtgatctcagctcactacaacctccgcctcctgggttcaagcgattctcctgcctcagcctcacgagtagctggggttacaggtgcctgccaccacacccagctaattgttgtattttttagtagaaatggggtttcaccatgttggtcaggctggtctcaaactcctgacctcaagtgatgtaccggtctcggcctcccaaagtgctgggattacaggcgtgagccactgtgcccggccgcctggagacatttttgattgtcacagcttaggagatgcctctgacatctagaaggtggaggccagagatgcagcagaacatcttacacggcacagtacagctcccacaacgatcatctcgccccaaatgctgccgaggttgagaaaccctgctgtagtgtagtatcagttttacgtggttatctaattggatccgtgagccagtcatgttagatcataaatatgatttttcctgtttttcagataaaaaactgaggcatagacaggatgggtcacttggccaaagctctgcagctagtaagtgttagagccagaatttgaacgcaagtcttccagatgtcagaatctactccttctgcttaccctgctgcttcatatctcacagtgatgccaaggaagatgcacattggactgtgggttgttttttttttttttctttctgtcatggtggctccagactagaggaggcaggaaggaaggtggttatttatagtcagctgtgcataggatcgatttttttcaatcctgaaggacttgcagcaggtagttcaaagaaacctcctttagacgttgactttcccttgcagttgtaaatatgggaacatttaccatcttttgctttaaaatatactgttataattaaggtaaaatgtaaaacttataacttaaaaactttactccctgtgcatatgaactatggcaagcttctcaaattaattactatccctttgggataaattaaaatattttgatttgctagaggtaaggagcccttttgagaattagtttgttttagttgagaatgattagagggctagaatgatatatagctctaaataggaaggtttctgattcttttggctactctccacttttactggttattttccagttctgggaagattctgcatgtatgtagcagcctcccttggctatccatggtattagagctctagggacagagttctcctagttgaactcttcataatatctcattattggtattttcaaagttatatgtgtattttaagatagtctttggatgatgttccaaagaaggctgctttgttgagattgagatagttgttttgcagttgtgatttctctttgtaaaaagaagtctttgtgtcggtcccaggtcttattttttgcttgatcacccagtacgtgggtgcacttgggctgttgggaccatctggtgagtgtgaggtctctgtacttcacctgtggagtctgttgtcctgaaaggtgccggctcaggtggtggtgctttgaggggagcttgtttgctgcaccttccagtctgctagaaaatagatgcttagaggggcatttcggggtggaatctgatcatggagtttggtgagcaaacagggcctcaagttttatgttgtgagaaataaatactgagtttatgttttaattatggcacagattaatacaaaatctggtgaaaaatggagaaaaggagagcttaaaacttagctgtttgttgctgtcatctaaatgtagttggtagccagcctagatgggaccacagcatggcactaaagcgcggctgctgcttttcagatcccatgttcatattcgcatgtgtggagcatgaaagtaccaatagaaaattttgacaaagaaattgaagggttgggccagggacggtggctcacgcctataatcccagcactttgagaggctgaggcaggcagatcacgaggtcaggaaattgagaccatcttggctaacacggtgaaaccccgtctctgctaaaaatataaaaaattagccgggccttgtgacaggcgcctgtagtcccagctactcgggagtctgaggcaggaaaatggcatgaacccgggaggcagagcttgcagttagccgagattgtgccactgcactccagcctgggcgacagagcgaaactccatctcaaaaaaaaaaaaaaaaagaaatcgaagggtcgataatttcatttatttgttcttttttttttttttttttttttttgagacagtatctcactctgttgcccaggctggagtgcagtggcgttatcacggttcactgtagccttgacctccgaagtccacacgatcctcctaccacagcctcccaagcagctgggactacaggcactcgccaccatgcctggctaattttttatttttatttttattttttgtagagacaagttcgtgctgtgttgcccaggctggtctcgaactcctgggctcaggcagtcatcctgcctcagcttcccaaattgctggatttattgtcatgagccaccacacctggccagggtcagtaagttaaaagataccttctaaactcagcccaatattgaagagtaaacataaaaatacatgttttgtctattatactattactgttactcaatgcttaactaattgtgcttatgtttttttctttgccaaaatttctcttcaaggagcaagtttttctaatattgcttttcttgggaagaacaattagtcacgagatagtacagcttttttttttttttgagacagattctcactctgtcatccaggctggagtgcagtggtgcgatctcggctcactgtaacctccacctgccgggttcaagtgattctcctgcctcagcctcccgagtagctgggactacaggcactcgccaccatgcccggctaatttttgtattttttgtagagacggggtttcaccatattgtctcgaactcctgaccttgtgatccacccgcctcggcctcccaaagtgctgggattacaggcgtgagccactgtgcccagccgtagtgcagtatttttaagcttcggtaaggtagaacccctttagagaaaaaacatcagtgagaagccatgttgccttatttttactataatgtttctttttttttttttttttttttttttttttttttgagacggagtcttgttctgttgcccaggctggagtgcagtggcgtgatctcggctcactgcaagctccgccttccgggttcatgccattctcctgcctcagcctctcaagtagctgggactacaggcacccgccaccacgcccggctaactttttatatttttagtagagacggggtttcaccgtgttagccaggatggtcttgatctcctgacttcgtgatctgcccgtctcggcttcccaaagtgctgggattacaggcgtgagccaccgcgcctgacccaatgtttcttaaaatacatccaaacataaaaagaacaaggatgtttatagctggtatatcaccatagccatcactataacaccgtaacaaacatgcaaatttgttacaaatctaattctcaaatgaataccattcaaattaatagcatgattttaatgtgacaggtgatgctattttattaaaactctatcatctgtgctcaggaagtcatggctgctagggtaagttttcctttcctaaccaattatgtgccagttggtggtaacataacaccgttttcctttgtttcctttattcaaacttctcttgtactatgtactagagcatgaaaacgtctttgacctacagttatgttagctggagacacagcagaactactgttgtcatcttgatcctgaatacaagggccgattgaagccccagaaatcatggggaagtactcgtttacataaagtggtcatgtagataatctaaaatatgcccgttagtgtattaagatcataactgcctaaagcttcctgtgccaggagtggtcttagctctcaaagaagtcatagtctggccaggcgtgatgactcatccctctcatctcagcactttgggaggcgaaaggattgcgtgaggccaggagtttgagaccagcccgggcaacatagcttgatcccgtttcttaaaaaatggaagtgatatccaggtggggaaaccttcctgctgtagtggagcctcttgagatggcacacgtattttgctcacaggtgctatcaatatatagctctggttcttcagaatataaataactatcacctgaccccaataccttatctatattgagattgttcattagatccaaaacatcttgtgcatttcttgctttttagtcatgcacagaccttgtctttactttcaaagacagtttggtactgaaaattgctctggtaaattaacacaatttatttaatccctgctctttccaatctttagcaacgtttttttcattgtcaccatcagatgaccttgctgagcttccaagtggcaattgcttttgttgtattgtttaaaggcaaacaaaaatcaattattattggctctagagtgcctggcgaggtggagctcagttctttgtgcattgcgcactatgctgctggtgtctcagctgccatgcttatggttgcattactttcctgtctagctttggtattcttgcctttaaaaatttctttttccatttgcttttcttagccagtgatgacagtaaaataaggaacgacctatttattgttttaagagatacgctggatggtgcccaggcagatgagcattgccattcaaggtggcttcttggtagactgcatttactcttaatcgggtgcctgtgggtcagtgcatttcttggtcatccttactctgtcaaagctgccttgttagccaggttactagccatactagtctcattaccttacgataacacctcattcaaatggccttaacgaagttgaacacttatcttagtcactatggttggctttgaaccttttctagaagttaagtttattccctgggaaaaaacgtgtttgccaccacacagagtgctgggtgtactgggaacccggcttcaaaggcaactactccagtagggaaggttgaggagggtattgaatgatagctcactgcttaaataagtgtttagagtcccaaggtatatgtaatggcatatgaaatgcctagtgtttaaagaatattcagaaataatcagtcatactctttaatattcatatctcatagagttagcatcaggaaggaaacttggtagattaaataaaatagcagaaattactgctggatttttgtacagtagaaatgtatgcacatttttctcccctagtagtcacttaagttgcatatccatttcctgttacatctcatgacatgttttgggtaaaccgtttttggaagcgtccatttgtgtagaagttaggtggttctgagtttaactttgtacacatttctaggcacaaggaaattaaataactggctgagtgagagtgatctcgttgaatgctgaggcttgtttgggaattgggtttattttggtgaaatgtaaatttagatccactctgtattagtttttttttttttttttttttttaacggagtctctctctttcacccaggctgaagtgcagtggcatgatctcagcttactgccaccatgccaggctaacttttgtatttttagtagagacggggtttcaaccatgttggccaggctggtcttgaacgcctgacctcgtgttccactcaccttggcctcccaaactgctaggattacaagcatgagccatcgcgcccggccaagtccgtttttacactcctataacgacatacatgagactgcgtaatttataaagaaaagaggtttaattggctcacgattctgcaggttgtacaggcttctgcttctggggaggcctcaggaaacttacagtcataagggaaggtgaagaggaagcaagcatgtcttacatggaagaatcaggaggaagaggggtggggtgccacatatttttaaataaccaagcacagactcactatcacgagagcaacactgaggggcaaaatccactcccatcatctcatctccttgtaccaggcccctcctacaacactggggattgcaattccacatgagatttgagttgggacacaaatctaaaccatataaccctcatacacatgtattgtaattcagaatttgtcattttaaaaaaaaatttttaagattagcttatcaatttaaatgtttccagccctgaactctcaaagtcaactttaatgagttttgatttttgccgagaaagatcaacagcagaagaaagagaagtataacaaaacttagctccacaggagcaaactggagaattggagtactggtttatgattttggtcagttaagcagaatgcagtcctagtttaaacaagactggataaaagtccaaattcaaataccattcttacaagtgtttgaatttaattttgtcagtgtacatacatatatctagtaccatagtgatctcaggctttgaagaatgaaaagcaaaagaaatgatttagagtcctggtccaaccactcagctatctgatatccttttgctattttcgtttaaggggttatcagggaatgagctaatttgacattttctgcttaaagcaatggttggggctgggttggggtggagagagctgctctgaggaggtggtgtggggggcctgcgaggacacacttgggttacctggtacatctgcagttcccatggaattgggtctcaaaactgagaaatggaagtgtgagctaggaagaggagtagcttaatggggactttgccacacttttagtgctcctgtagctgcacacatgttgttctttgtaatgtatgatttgtgtcccagtggaacacttgaggagtgggagctggagaaaggaatgttgtacagtgttgtgcagatgtgggtgagatgaggtgatctgggaagctggcagtcttagttggcccaggaatgccaggacctgagatgacagctgctggtggcagcggggaatgcaggtgtatctgtgtcgaggttgggaattggactttgaagggctgggacttccagaaggtaaaatgggattgcactgtttgggagaaggggtacagatttttttgtttgcttttgagataaggtctccctctgtcacccaggctggagtgcagctgtgtgatcatagctcattgcagcctcaacctcctaggctcaagcaatcctccttcctcagcctcctgagtagctgggactacagacatgtgccactacacccagtgaatttttttttcttaaagatgaggtattgctatgttgcccagactgatcttgaactcctagaattctttttttttttttttttgttttgttttgagacggagtctcgctctgttgcccaggctggagtgcagtggcatgatcttggctcattgcaaactccgcctcccaggttcaccccattctcctgcctcagcctcctgagcagctgagactacaggcgcctgccaccacgcctgactaattttttgtatttttagtagagacggggtttcaccatgttagccaggatggtcttgatctcctgaccttgtgatccacctgcctcggcctcccaaagtgctgggattacaggcatgagccaccgctcacagccgaactcctagaattcttaaacattaaggacagaaacatctctgttcttaatcatgatttgcttttagtctcagcagatggaaaaatgatttacttgcaaagtgagagagctagatgaggaaggaaagaatatgattttgtaccactcagagaaaaatgtgagcatttctctactgtcttgggttggttattttccgttgattcaaaattgctctgcaggagacataggagaggcttgagagatgtcagtgggtggccatggctcagccttgatcctgagtgggtgggaatactctgttaatggggcaaagtggaccctccaggtccttcatgctccttttggaaagaagcgttcctggccagacacagtggcttacgcctgtaatcccagcactttgggaggctgaggcaggcagatcatttgaggtcaggagttcaagatcagcctggccaacatggcaaaaccccgtctctactaaaaatataaaaattagctgggtgtgatgatgtgcacctgtagtcccagctacttcagagctgaggcacaagaatcgcttgaacctgggaggtggaggttgcagtgagccaagatcgtacccctgtgctccagcctgtgtgatagagtgagaatctgtctccaaaaaaaaaaaaaaaaaaaaaaataggaaagaaaatatatgttcccctgtggttccctgttataccctcttctcttgaatagtttatcagaagggacaaccagctcctcatgcccttcctcagcaagtgtcaacagtgtgggagtgcagttgataaagcttgattttcacaactctgcaagtagctgagctccaccagtgttagaactgaaattgaggttatctcaccaggaaccaactttcagatgttgaagccagtagaaatttagtaatgtgggaaactgataactaaaagtattccaggttctaattattttgtcagctcagttttaggaagcagtcctagggattcccctggaagaaagtttggctggatagagggcagtgattgtgaattttctagatcttttgtggactgcttctgttgttaaaaaagcagcagtctctcagcacacgaatgggaagtgttaatgctgtaactgagtaacactgatactgagtttaaaataatggtaaatatcccactgaaatttcacccccagtacagattagggccttggaatgctggatagtggattaaggacatctgaaaatctacttcataaaagcagtgagaacattggcaaaacctattaatttcaagtttttcagaaccatggaaattagttaaagatttctagcaatctgaggaatgattgttcaagaaaacactgggatctcagtaggaacagtgaaccttgtgttttaacctgctgcaatcccattcccggcccctgaccacctccttggtggccttgaaaaccagcagcctcacagccatggcagctgtgaaactcagaagtctgttaaaccactggaagggacagaacagaactggagctcttgaaggaccatcctcaaagaaatgtcacaattcgaccatttggcagcttgcttgaaagggcctttctgagggctttgtctttgtttcacccaacacaggtcagctcacattgtgcaaacagctctacctgctgagcatttgttgaaaacaatcggtggtagttgtttaatcacagctgtctgaggtggtgttgctaattgaggccaagtggctgaccaaaaaattttttatttttattttatttatttatttatttatttttttgagacagggtctctctctgtcacctagcctggagtgcagtggtgtaatcgtgactcactgcagcctcaacctcctgaatttaagtgattggtcctcccacctcagcttcccaagtaggtgggaacacagatatgtgccaccatgcccagctaatcttttaattttttttgtagagatggagtctccctatgttacccaggctcaaacagtttttttaaaatggagaagtaaatgttccttgacgacttcaaaaagctccaacatattcctgggaatctagaaggctctgagcattctgagaaggctctaccttctctgctgtggcgatcttgaggctttatgcaagcctcaaggaagactaaggtagaattataaaccattcagcagagtgttgaaggcatgccccaatacccacacccacacgccctctcacctacccacccacccacccttagtaaaggctggaaaatttattaattcaaggcatgtaaggaaatctctgtgtagttactagcgaaccactaaactaagagtcttcagtggccatacatggcaaacaaaaaacaaaacaaacagactttatagaattagttcctgaaaatcactaatcagatagcaacaaaacaaaccctgggatgggggaagaatttgatttttagaattgacacattgtattagataaaatttctagtctttgacaaaaattagaagctatctcaagaaacaggaagatatgtcccatatacaggttaaaaaaacacacacacacacacacctcggtttctgcctagtttctaggatagaaactgtccttgatgaagcgcagatgttgggcatacttaaaacttaagtcactatgaaagttatgttcaaataactataggaaagcatgtctaaagaatcacatgaaaatatgcttgtgaggttgaagccaggaggattgcttgagcccaggagtttgaggctgcagtgagccatggtcatgatcaggccactgtactccagtctgggtgacagagcaagactctgcctcttaaaaaaaatattgggtgaccaaacagagaatgggaataaagaagtagagattataaaaaaaagaaccaatagaaattctggagtcataaactctagtaactgaaatgaagaattcactggaggggcttagcaggtatgaactggcagaagaatcagtgaactggaagacaggtcatttgagatagttcagtctgaacagcaaaaataaaagaatagaaaaatgaacaaagccttagagacctgtgtaacatcatcaaccatacccataatgggagtcccagaagagggaagatgtaaagggaaaaagaaggtatactgtgaatagttgtgtgtttgttctcatgccgctaataaagacatacctgggactgagtaatttataaaggaaagaggtttaattgacttacagttccacatggctggggaggcctcacaatcatggcagaaggcgaatgaggtgcaaagtcatgtcttacatggcaccaggcaagaataggagttgtgccggggaactcccatttataaaaccatcagatctcatgagacttattcagtaccatgagaacagtatgggagaaacttcccttatgattcagttatctccaccttatcctgcccttgacatgtggggattacaattcaaggtgagatttgggtggggacacagagccaaaccatatcaagttgtatgccaacaaattaggtaacctaaatggaatttatacaaattcatgtagatgcaaatggccataactgactaaagaatttgaaaatctgaataggccaataacaggtaaagagattgaaatagcaatcaggaaaccttccaccaaaaaatactgggtcacatggtttactgggtaaattcactgggtgaattctaccgagtattattataaactctttcaaaattttataattaacctgataccaaactaaagacatcacaagaaaactatggaacaatatcccttataaatacagaggccaaaatcctcagtgcaatgctagctttcctcccattctcactacttgtattctgtcataaaaaaaggattgtacaccgtgacaaagtggaatttatcccaggaacaaaaacttggttcaccataccaaaaccactcaatgtaatctgtcatgttaatagaataaaagacaaaaaccacatgatcatctcagtaaatgcaggaaaatcatttgataatattcagtactttttcttgatgaaaactatcaactagtaatagaaggaaaattctacaatttgataaagactgtctatgaaaaactcacagttaacatcatacttcatggtgagaaattgcatgctttctcctaagattatgagtgagacaaggatagtcattctcaccacttctatgtagcattgtactggagattctatctaggacaattagtaaaaataaaatagtaatataaataaaagcattgagattgtaatggagattggaatagaactataactagaaaagtatctgtagttacagttgacatgatcttgtatatagaaaatcctaaggcgcgcgcgcgcgcgcacacacacacacacacacacacacacacacacaaatcttgaactaataattgagtttacaagcttgtacatacaagaacattgaagcatccagaaatgaaattaataaaacaattccatgatacagtagtatcaaaaagaataaaatacttgggaataagtttaataagtttatgatttgtacacaaactataaaacattcttgaaggaaagtaaagaagacctaaaaaacaaaagaaaggacattccatgttcacggattagaagacttacattgttaatacggccaatactccccagattgagctgcagatggagtgcaatacctacaaaatcccagctggcttttttttttctcagaaattaacaagtttattttaaaaatcacatggaaatgtaagggacccagaataaccaaaacaaccttgaaaaagaacaaagctggaagactcacacttctcaatttcaaagctttgctacaaatctacagttatcaagacagtgtggtactactgtgtggacagccatagagatccatggaattgaattgagagtccagaaatagacccttaactttacagtcagttgtgtttttgacaggggtgttaggacatgaatggataaagaagatgtggtatatccatacaatgggatattattcagccattaaaccactaagctcagataaatgcatggatgaaccttgaaaacgtatggtaggtgaaagaagtcagacacaaaaggccacacgtttatttgaaaattctggaataagcaaattcagagacaagaaatagatgagtgttaatatgtgctggaggctggtgggaggggagaatagggtgtgatggtagtgggtatagagtttcctttgggatgatgaaattttctgtgattagctaatggtgatagatgcatagttttggagacacattaaaatcaatgaattatacatttgagaggggcagactttatggtatatgaaatctcaataaaacgtatttaaaaacaatatacagttaagagcgcatccagatacacctaaggtattagtaaagcggtgcattaagctgaaatatctggcttgtgcaaacttggggcatttgtaccttatgtagaattccaaaatctgcttaggattttccctgtccactggactgccactggcagggtctgcttccctgttcctgggttgagggagcagcattggagcatccctcaattcctgaatgaggaagttagttaaaagggcaatgtgagctgtagggccacactcatctaacaggtgagcttaagtttccattgatggcagacctatcagatgtttcctcccattctcactacttgtattctgtcattttgctcttatcctcccaaaatcatgctaagattttttttttttttttaagacagagtctcactctgtcccaggttggagtgcagtgatgccatctcggctcactgcaacctctgcctcccgggttcaagcaattctcctgcctcagcttcctgagtagctgggattacagttgcgtgccaccatgcctggctaattttttgtattttttttttttttttttttaatagagttggggtttcaccatgtgagccaggatagtctccatctcctgaccttgtgatccgctcacctcggcctcccaaagtgctgggattacaggcgtgaggcagtgtgtctggccactaagaatttttaaaataagtgacacaatgaagaacaaggccatagagatgatcttgggtaatttgagggtatcaaaaagtatctgcctgatggatggcttgagacactaaaaatgagtaaatgattacaaagtaaggaatgataatttgttttgaagaataaaacagattcttgtctctggtggttgagggatacgactgatgctgtatattaagacaagaagatgaagcccaaatggcagggaaattgaagagaagatacaggggtatctaggcacagggttggctgtgaaagtttcaatatgtaaaagatgataggctgaaaggaagaggatggtggaaaatacaaaagaggcattgataattcaggagtgtggagtgtgagagaagcttctccataggtgaagagttggatggacagtggttgttaggtcaaaataacaataataataacctagcacatatgtcagatatctgtttgggttcatcttacgcaccattctcttgggagggagcatgctttgaacagatccaatttatgatggagttttaggaccagaaagcgtcgtagtagcagagacttctcgtcctagagagcaaaggggaagtcattttttagttagttagtttgtgttttagacagtcttgctctgtcgccttcgcctcctggatgttcaaacagttctcccgcctcagcctcctgagtagctgggattacaggcgcacaccaccatgcccgactactttttctacttttttagtaaagatggggtttctccatgttgtccaggctggtctcgaactcctgaccttgtgatccaccctcctcagccccacaaagtactgggattacaggcgtgagccaccgcatccagccttagtttgtttctgagatagagttttgctcgtttcatcacccaagctggagtgcagtggtgtgatcatagctcactgcatcctcaaacttgtggggtcaagggatcccctcacttcagcatcccaaaatgctgggattacaggtgtgagccactgcatctagctgggaagtacttttaagagtatttttttcaggctgggtgtggcgcctcatgattgtaatccaagaggtttggaaggctgaggcgggagggtcacttgagaaaaggagttcgagaccagcctgggctaacatagcaagacccccatccctacaaaattttttttttaaattagctggtggtggtggtgtgcactggtagtcccagctactcgggagtgaggcaggaagattgcttgaatccaggaaattgaggctgcagtgaaccatgattgcaccacggcactccagcgtgagtgacagggcgagacccctccagatgatagctggagatcatgttattttcttactgattttcccccggtttagcaatacaaagtgatcgttaggttggcacaaagcacgatggaaaataaccattgttggcatcaagagaaatctcacaccacttgataaatatagtgaactagattactaaagagtgatttccctggattgcttgaaccagggctcagtgaaaatgttgctgtttgctttttttgtggtcaggattttttgattaaatgagaagcctacaaatatgcaagctagaaggtgttgtattttgggattaagccagactgtagcaggatgttagtaatttgagttgcataaactaatctggggaggcagagtgagtagctgatgtcacatgaagagcaaacccttgattccattcgtaatacataatagaacaccttcgtttctaaaactgggtgcagtaaagcataaaaaaacctttagtagctgatgaaagattctgccccaggcttgagtctattaaccagaaaaactgaaacaaaattaggcaaggtggtaagttttgctttcttttagtggaatattaggatatacagcaaatggtagcaggaccacgttgggaaaagggccaaaagactttttaaaaatcctgtttgaggtttggatccattttctttcatttttggacatacctttgagtagtgggtaaactgagagctcagtgaggtgagcctgtgtctttcagcgggcgggcgggctggagttggaactcctgtttcagtggttttcagatcctgctgatctccagaatggctccagttcccccacccctaatgctttattatgaaaaatttcaagcctgcagaaaaggtaaagaatgtacagtgagcacccatataccaaccacatggattctgcaatgaacattttaatatacctgcttttttttttttttttttgagatggagtcttgctgtgtcacccaggctggagtgcagtggtatgatctcagctcactgcaaccactgcctcctggattcaagcaattcttctgcctcagccttctgagtagctgggactacaggtgcgcgccactatacccggctaattttttgtatttttagtagagatggggttttgctaacaggccagtctggtcttgaactcctgacctcaggtaatctgcccgcctcagcctcccaaagtgctgggattacaggcgtgagccaccatacccagcctcataacggctttttttttttttttttttttttttttttttgagacagggtcccactttgtcactcagtttggagtgcagtggtgtgatctctgcagccttgacctcctggactcaagtgatcctctggcctcagcttcctgagtagctggagctacaggcatgtactaccatgcccagctaatttttgtattttttatagagataggcttttgccatgttgcccaggctggcctggaattcctgagttcaagcaatctacccacctcggcctcccaaagtactggaatctctttttttggaatacgtttcaaagcatgtgatagacatcggtacagtacagtcctaaacactgagtgtgcacgtcgttaactacagtttaatatttgttttgtttctggatcttttccagggatttttttcaagattaaattccaagcgccatgatagtttctgagttagaaggatggggcaggcccaggaatcagtactttgaaaagctcccaagtgcttcttgtgatgcatcgggtttgggatcttctgccccagggagcgcttcccgattacttcatagctaatcctcacctaaaatgcagaggtgggcagttatctttaacctgaccatagagctccatttttggttttcttggaatcttttgtttaaaacagtggttctcaaccaggggcagttttgtgcctcgagagacattggacaatgtctgggatggtttggttatcacaccagggggcatctagtgatgagagatcagggatgctgccgagcatcctgtaatgcaccggacagccccacaggatggggagttatctggaccaaaatgccaatagtgctgaggctgagaaacgtatttttttttttttttttgcctaaaagaaaattgcttgctccagatgactccagacaaaccaaaataaaaataaaaagtaaaaactaaaatgacaacatgaaatgaatttttaagagccaaatgagacctttagagacaatctcatcactgcctacctggtttccgtcaaatacagatttatgctccagaaagtacctaatttattaaaataagctgatttctaaaagcttgttagatggtcagtaatctcaaactttgagtgaatttacttgaaaaggtaatgttgctggtggcctttagtttcttttaatatatcttaaatatgatatcaaagaaaaacagaacatgatgctttgggatgaatgtaatgaatgaaaagcaggattctttggcaggtaactgtgtcccaggccctgtcctgcagggtggcagggatgtgctgagctgggtgaggggggaccgctgagggcttctctcagtagttgctctgtgtagaattttctgagtgtcttgggagaatgggggcatttttcctgaaggtctcacttgactccacagtgaatggctttacctgtctcttgagtaagatgcatttctagtaatgctctgactacttagtccacgtttgactagtttttaggaaaacaatatgtacaatggaacagaaagcttacagaaataaagggcagttcttttcttgaggtgaaagtgatgtggggagccagtaggtgacaggatttgctctggcccctccgagggaggaggaagatgaaggtgaaacgtggtattggtcagtccgtttcctgcttggttgatttcagggacctgatgagacaatatggtggtgaaaacagactgctggattgcaatgggcggaactgggcttagtctctggataggtgtcagttcatttcacacctgtcattgagggaaaataatacctgtatggctgttggaagattaaatgagactatgaacgggagctgtgtggataaaatgtaccaggcactcccagtgccagaaggtgttcttgttagttctgggtgtggcgatgtgcgaagacacccgtgtctgcggggtgtgtgtgagctgcagataaccagcaggtcctgctgatgaggcaaccttcttgggagtcttggctcagttccggggtttaattacgatgtatccttgggcaagtggcttaatgtctctgattgtaatttccttcattttttcatatctaaaatgaaagaggtgcttggatattcctaagggttcatctttaggagtctgtacttctggtgtggagctttctggaaaaaggcttctgggaatctgaaatggcagtagtgatgggcgtggtaacagcagtgttcatacgcttcctcagtaattttatgtaacaaacactcacagtgtacttactgcccctgagatcttaaaaactctcactttcaactttcacgacaccctataacttaggtaactgctattatccctggtatacagatggggaaactgagcctcagagaggttggtgatttgccccaagtcatagctgggaagtggcagacctcgatgggatgcaggcaccctgccctctgggctccgatcacttggccacctccccgcatgcaccacatgggctgtggagttggaggcatttgtgggcttcaagaatgagagttggtggggagtatgtgtgaggaaccggaggggtcatttccctgggactgggattgtggaggttttgattttgcttttccctttttaaactgggtgaggtatgagcatgggaactctgtacggaatgtgtcattggagagggacagcagggacaatgaaggtagtccccagagaagtatgagaaactggcattcagtgctcatgcagaattctctttgttttaataataatacaaataataacattaatattatttttagaggcagagcctcactctgttgcccaggctggggggcagtggcacgatcatggctcactgtagccttgaactcctgggctcgagccatcctctcacctccctcagcctcctgagtagttgccatgcgtaacaccgtgccttgctaagttttaaattttttgtagagaccgggtctcactgtcttgcccaggctggtctcgaactcctggcctcaagcagtcctccaccacagcctcccagagtgctgggattaaaggtgtgagccactgcaccctgcctaggattctctgtagatggggagcccacctgggtgagatgccagacacctggctccggcatatgcacagcagtttcacacgagcgtctcttactcaggtttcagagttctggtaaaagatttaggtttgacatccaccctttgaggtttttggttctcacatgtttgataacctgaagcttgtgggtttgatatgggcagtaaagtgggattatttctgttagagatccttattccctagagactttctggtctggaaaggtgagaggctatatattcattagctggaaccaccatgtggatcatttgttggaagaactgttaggaagaagacagatattgctatagagagcagggccagatgagcgagaaggcaaatgtacttcattcctgtacctgcaggcttattagggacagatgccctcaggcggggatgtgtagcttcacttgactgctctaaataaggagcgagagggtggtgtgtgtgttaaccatcaagattaagcaagcaagaaaaagacaaaagaaagccatcatttagtaactggtggagtgagttggagcctgggagctgccccaggacaactgttatttcccttgatcttcctcaaaccctaccaggaagtgagggcaacagttccctaaagcagccccatcaagctcttaagaaagcagtttcactgggagtggggagaggtagaattgggaggtggtagagggctggggggtatgaaatgtgagggccggagtcctcagcatcggaactccagaaataaaaagttgtctgggtctttgaaagcctcctatatgataatgttacagtaacagtgttctctgctactttcaatgaataaaaaacctagggtttctcagctacagtgtgcattaagagacatttgtggtctagttttggcacttcatttctatttgggaacatgcattctgagttttagacaactagcttccaaatgaaattttggaacaccaccctttttttttttttttttttttgagatggagtcacgctctgtcgtctgggctggagtgcagtggcgcgatctcggctcactgcaagctctgcctcctgggttcacgccatgctcctgcctcagcctcccgtgtagctgggactacaggtgcctaccaccgcgcccggctaattttttatatttttagtagagacggggtttcaccgtgttagccaggaaggtctcgatctcctgacctcctgatccacccgccttggcctcccaaagtgctacgattacaggtgtgagccaccgcacccagctggaacaccacccattttttaaagcagagaatttattgttatttgcacaaaaggacgtttgaacactttaggaaatctggatgctggaattaactcggtcaaaacaaagcaaaacacacagaatctcgtatcttttcctgccctgatgctgaactgcagccttgatttatgttttgtttttccacttttgtttctgaacctatgtggtacaggctgaacccttgtccctgcttcggagcacttaccttaattattatagaaaaaaattaagagttggctgactctgtgctgaactttctggtttttttccaggcagtttctccataacaaatgcgttttgcatagaattgaaattgcctatttacctcaatgacaccatcctaatagttggtggtaactacctaatctaataatctctcattgtgtgtgatagggctatttattgtattttagagtgaaataatgcattttgtttgcattttaaaaaggaatggtacaggaaatgattgtaatccaggactaaatatacagtttgcagtctttttattctaattgctttctgatgaatatatatatatatatatatatatttttttttttttttttttcttgagatggagtcttgctcttgtcgcccagactggagtgcaatggcatgatctcagctcacttcaacccctgcctcccgggttcaagcaattctcctgcctcagcctcccaagtagctgggattacaggagcctgccacaacgcccggctaatttttgtatttttagtagagacggggtttcaccatgttggccaggctgggctcgaacttctgacctcgtgatccacccgcctctgcctcccaaagtgctgggattacaggccttctaataaatattattttacacatcgagatagtactgtttatgcattttgtatgctgcctcttaaatctataagcattttcttttcttaaaaaaaagctttgggctgggtgcattggctcatgcctgtaatcccagcactttggggggctgaggcaggtggatcacctgcggtcaggagttcaagaccagcccggccaacatggtgaaaccccgtctctgctaagaacacaaaaattagtcgggcatggtggtgcatacatgtagtcccatctacttgagcgtctgaggcaggagaattgcttgaacctgggaagcggaggttgcagtgagtggaggttgcagtgagctgagatcacaccactgcactctggcctgggtgacaagagcaagactccatctcaaaaaaaaaaaaaaaaagctttgataaatattgtacatgattgcaaagcgtcccatcgtgtggatgttcacttagttatttgatacatatttttgtgttcttgggctgtttctaatatttctgtattacaaataaggtgatgggaagcagtttcattcatcaatcattctttttaaatgtcccttcctatcagtttctgttaatcagtcaaaagcgtatacattcttagcaggaacttaaattcttagtaggaatcttaacaggttaagatttctaagggtagagagggtacctgttttgttaaccggtggcttaataccatttaataccagtaaaggctcaataaatgtttattgactgaatgaacagaaaagatcagtgatcatgaagaatggcccagttagtggtatatatacgagaagtgctgcagtggttcacagtaacatgataataactaattgtgtaatgatttggcacgaggtactgatctaaatgatttatacattgttgcatgggattttggaaggggagggagtatacctctaaattagttcatgctatgggatggaagtaagactttaaatttaggtgggctcaaaaaacagaaacaaaccaggggccgggtgcggtggctcacgcctgtaatcccagcactttgggagtctgaagcgggtggatcacgaggtcaggagatcgagaccatcctggctaacacagtgaaaccctgtctctactaaaaatacaaaaaaattagccgggcgtggtggcgggtgcctgtagttccagctactcaggaggctgaggcaggagaatggcatgaactcgggaggcagagcttgcagtcagcagaggttgcaccactgcactccagcctgggcgacagagcgagactccatctcaaaaaacaaaaaaaacaaaacaacaacaacagaaaaaaatcaaatgttcgtcagctgatgagtggataaacaaaatgtggtatatccatacaatgaatgctatgctatgctgccataaaatggagtgaaacattcatacatgttgcaatatggatgaacctgccactcaagtagctggtactacaggcatgttccaccatgcctggctaatttttgtattcttagtagagacagggtttcaccatgttggccggcctggtcttgaactcctgacctcaggtgatccacctgcctcagcccctcaaagtgctgggattacaggcgtgagccagtgcgcccggcccaaagcttttttttaagaaaagaaaatgcttatagatttaagaggcagcatacaaaatgcataaacctggaaaacattatgggaactgaacgaatccaggcacaaaagaccacatattgtgtgattccacatattccacatattgtgtgattatatggaatgtttggaacaggcaaatccacagagacggaaagtagattagtggtggcatagggctggaagaggaaggaaacaaggactaactgctaatgggtacaggattttttttcctcaagtgatgaaatattcttagattatgaggatgcttgtacgactctgtggatatactcaaaacgatttaattgtatactctaaatgggtaaattgtgtataaattatgtctaaataaaaccatgaaaaattggatgaggtttagcattgtagaaggaaagatgggggtggtggtgtgttagtttttgagggctgccatagcaaaacaccacacactgggtggcttaaacagtaaccatttattttctcacagttctggaggctagaagtccaaaatcaagatgtcagcaggtttggttttccctgaagcctctctccttggcttgcagatggccacctggccaccttctcactatatcttgtggggtttttgtgtgtgtgtgtgtgtgtgtgtgtgtgtgtgtgtgtgtttgagacagggtcttcctctgtcacctaggctggaatgcagtggtatgatcatggctcattgcagcctcaacttcctgggctcaagagatcctcccaccccagcctccagagtagctgggactacaggtgtgtgccgcaatgcccagctaagtttcgtaattttggtagagactgggtcttcctatgttgcccagcctggtcttgaattcctgggctcaagtgatcctcccacctcagccccccaacatgctaggattgcaggtgtgagccactgcgcccagcctggtcttgtctttgggcacaaatatccgctagtgtctcattgcgtgtccacatttcctcatcagctctactggattagagcccagcgtaatggcctcattttaacttaatcacttctttaaagtcccagtctccaaatacagtcccattctgaggtagtgaaggttaaggctccaatgtgaattctgggggaacatggttcaacccaatgagaacaatggttatctgttgggagtgaggactgatatgagtggagatgcatcggtaaagatgcgcggaccacagatgtgacgcagcaggtgtgcacagaggtatgggatggggtcagtgtggagggccgtgtgccaggcagcagtgtggacttggtcctctacccagcgtaggggggtcattctgggggctgaaccgagggtgacactgtaaaaccatgcttcaggaaaattcatctctgcgccctggaggatggactgaggagggaagaggctgagggaaatgagtgtgcaagataatgaggcgatcccaagggaagtaaaaggattggaggccttgcaaaagcaaagcgaacccaagcttcagaacggaggcatctgagatgatgtcacagttttgaaccttatttatagaagaaagagggtgaaatggggaattaggtaaatgaaaatataggtcccattgttggtaagatacatggagtgtcattgattcagtatttagtgtgcttttccttattttaaacagctttcatagctcacttccaaactgtatttttgcaaccaactctttttctctctctattaaaaggagaatcttttattttacactaattaacagctgattctcctaagagagttttcaggaacctaaacctcagagttagatggagacaagtgtctttgttaatcatttatgtgaggtcagattgtacaatttgtaacagattttacagctggttcctttattaagggatgggtaggattcctactaattattattttgagttttactttgtttttaaccattgaaacttgggggatgtactctttggtttgggtagattttgcttatagatattgaagtttgagttgttgaatttcatacatattttattttgacttttaatcctttaaaacatttgactctgactccattgagctctgtagaacatctgtcatccagatcttttgccagaatatagagccttgattggacaccttgccagctaatttaaagcttcccaagatgcagaatactgtgtaaaatgtcctacctgttgtgtcagaagggagaaaataagacgagattttcatatttgcttgtagatccataagaaacttgggaagaattcctaagaaactagcagtagtggttccctgcagggtgggggctctggatgtgggtgtggcaggggatgggagagactggcaggttgaggagcagggtgagagggatgtttttatgatgtacattctcatatatttattttgaactatttgaatgtattactcatgtaggaagacaaacctttactttccaaaaatattagggaaaaactttcaagtctctcatttttagcctttttgttgttctgatatttccacacaggacagacggtaacatgcccgatacattttaagtacaaacaaggctgtaagttgccttacttgactttcttcactattttctattcaaaaaagtatttttgaatccaagggaattagaggaataatcttgaaatgattatgttttgggggaaaagtatattattaatatgatagttatctaatgttgtgtaacaaattgcctccaaatttagcatatgaaaacaataagcattcattgtgtcacacattcattctttcttttcagtgaaagttaacctgtttccatctgaatagatttctcactctgtatcctgccagtaatcattttgtactgtttctgtgcctttcaatccaagagtccaacctgatgaggttctgctggtgtaattcttttaaaagcattgtggatgtcctgtgaatctcactggagttcactttttaaacattagacttctgtggagactgctgaaggacaacacccttacttcttagggcctttggtttgccagaattgttctctgagccattgccttggattttttcctgacttcttaacaaaggattttataggtgggaccttcaacactctggaaattgccttagctacattcagccatctccttaggtacattttccatctcccacattgtagcaggcaatggcgttgctaaactttccatcaggaaataacaaagatctccttttccagtttccagtaacattttcctctctacaccatcatccacagtctcctgaaaggccctccaggttctagcttttccagggctcttcaggggttttcgaactctctttttacagtctttccagttcctgcccattgccacgttccaaagtcactcacacattttaggaatttttctttttttctttttagcaagcataccaattccagttaccagaatctgttagtttttgttatgtgttgccgcagtacagattgcctcaaagcttagtggctgaaaacaaggaacattactggccaggcacagtggctcatgcctgtaatcccagcactttgagaggccgaggcgggcggatcacctgaggttgggagtttgagaccatcctgaccaacatggagaaaccccatctctactaaaaatacaaaattagctgggtgtggtggtgcatgcctgtaatcccagctactcgggaggctgaggcaggagaatctcttgaacctgggaggcggaggttacggtgagctgagatcgcaccattgcactccagcctggacagcaagagtgaaactccatctcaaaacaaacaaaccaaacaaaaatgaacatttactgccatacacacttcctgggggtcagggatcccagagtgtctccgctgtgtcagtatgtctcagggtttcctgaggctgcagtcattatgcccgctagggcttgggtgggactgaagcacctgcttccaagttgcctcactcacatacctggcaagttggtgccgttgctggcaggaagcctgcttttcttgccaggtggacttctctgaggggtgcgtgaatgccttcactacagggcagctgacttccctcaggacacatgattcaggagaccaggggaaagctgcagtgtcattttatcacataatcccagaagtaacactctgtcatttctgcaatatcctgtgggttacacgtcagcattattcattgtgagaggtgactacatgagggtgagtccaggaggcaagaattattgggggctatcatggaggtttgataacataattggtaagaaattcagatacacctcagacttgattgtggcataccagtgtgttgtaaaacttgtgagaatggcttgccttagaaagacaagtagtccatccagtgtcttattcttatgttaagttgggattgctattttgttacccttgggcctctatatacaaagcctctcatagtaatagatctaattgggttgaagtttagtattatgtatatgccctctgcttttattagtagattttactttcgtgaaaggaacatataaacttcattattgcatttttgtataaatgcagctggggacatggttttattacccaatgtccattttgtaaatatttagagaactttttttttgcatcataaatcagtataaatagaagcttggtttccattgttgccctggctatgaggaagctgagagtgaaatttgtcgttcaagtgtggcagttatgttactgactggcgtatttatattctcctttatttgatattttgctatgagatgttccagtttacttgtgggaaaaaaagccaggtgttcttgaactcaacaaatatttattgaattccacttgctggccagacagcattccatgtgccccagatatggcactggacagatagataaggtccccactcgcctacagcttccaacctggtcgtaagaaaataccttagcttttgctccataatgtggaagaattggcctcagagaaaacctaattcatatgtaccacgtttctacccattcaagttttatttcataatttttttttttttttttttttttttgagatggagtcttgctctgtcacccaggctggagtacagtggcacaatctcagttcagtgcaacctttgcctcctgggttcaagcgattctcctgcctcagcctcccgagtaggtgggattacaggtgcatgccaccatgcctgactaatcttttgtatttttagtagagatgggctttcaccatattggccagcctggtcttgaactcctgacctcaggtgatccacctgcctcagacttccaaagagctgggattacaggcgtgaaccacgatgcctggccgtatttcataattctatctttccatagaaagaattggctggggcacgtataactaatgtgagttactgatttcagaggaagcttttggaagtggttgataggcactgaatgggatggggtggtgagtggtttaaaataacacttgaacctttggattcaaatggttttaaatgcatctcagaaaagtgaaaggtgaatgggagagctacatccattgagagcaagggttcatcagctagggctgtggcttaaactaagcagatattctttcctggcagttctacaggccagaagcctaagatcaaggcgtcatgagggttggtttctctgaggctcccagacagtcatcttctccctgtgtcttcacggggtctttattctgtgtctgtgtccaaacttccttttccttttttttttttttttgagacagagtcttactctgtttcccaggctggagtgcagtggcactatctcagctcactgcaacctccatctcccaagctcaagtgactctcctgcctcagcctcctgagtagctgggattacaggtatgtgccaccacgcccggctaatttttgtaattttagtagagacggggtttcaccatgttggtcaggctggtctcgaactcctgacctcgtgatctgctcacctcgtcctcccaaagtgctgggattaccggcataagccaccatgcccagcccaaacttccttttcttagagggtgggctttatctgtggttcttagttagcctcaccttcattcttccttttggtgttacggtcttgcttactgctttgggaatggatttgttgaaactacatgtgactagtttagggacccagtaggaggttttactataagtgtaaattaacatgtgcctttgggggaccttaaaagtttttgtcattgggccatgagatctgagtgcagctggtagaacctccttgttttctttggtatgagaactcctgggcttttgttggttccttccgttttctccggtgtattaccatttcacatcacagtgatattatccagataacacccatgatttgtttttaacggagtttcactctgttgcccaggctggaatgcagcggtgcgatcttggctcactgcaaccttcacctcctggttcaagcgattctcctgcctcagcctcccaaatagctgggactgcaggtgtgcaccaccacgcctggctaatttttgtatttttagtagaggcggggattcgccatgttggccagactggacttgaattcctgacctcaattgatccacccaccttggcctcccaaagtgctgggattacaggcacgagccaatgcacctggccacacctgtgatttattttatttcatttgagatttcagactttgtcgcttgttctttctgtagaagttttttcatagaagtatgttgtttcaaaagcaaccttcaaatagtagacttagcttggatgagaatctaaaagtctttgagtccaacaaccaagcaggtcccctgtccaggaagtaccttatagctgatgtttgagtatccctgcagatgggaactcactacctcctgaagcaccttacttctacccttggaatagtaacagagattaaaatgtccttccttaatttgaggtgaaatctgccttcttgtccattttacacacactaaccttccttccaccatgcaagctgagagagagccaggttgagcctgtgtttccacaacaactcttctcagacctcctgctgccacctaccatgcacttgctcttcactggctaggttccagttgctctgtacctttcctaaagtgtggtgaccagaatttggcacagtgagggaaggttccagagccctttagtgttatcgggggcacagagcttgggctttggagtcgctcagatcttgagttgatatgcacttctttgtccttgagcaaatgattgaaccttcttggactctcagttcctcattaataaaatgaagatgaaacaagatgagatggactgtgcacatttcctgatgggggctggtatgtgctggtgcccagtgcaaagtggctgctggcagaatggtgagtcaccagtacctgctcccttcactgagtgcttcctgtgtgcctggcaccattgctcagggctttacatggacttactcatttcattttcactgcagcctagagcgtaagtaagtatttgctttatccccatcttatagatgaggcatttgattctcaaaaaggtttcatagcttgcccatgttctagcagctagtaaaaggagaagccagagttttcatttaggtgggagtcctcaacctgctttcttaactgctgtgatctgcactgtggcatgagagtttgtcttaatgtaaatgcacatgtaatagcattattcacattgcctgagactgtggaagctcctttggcaaccagatgccacaggggactcatttcatgcttttagaagacttgagccactacatgccctgggaactgtgttgcttccccactggccatcactcttgcttttgtaagggatgtcacattgagccattaagtgtcatctctggaactcatgactctgttattccacatattaggttttctttgtagctttgtgtcaactccaagccaggtaaataaatcttggaagaaccaagttacagatgtgagtaaaagaggggatggcagggggcagaagtcagggcaggccctgtgacttgccaccagcatcctcccttcgggggaggtcctttcatctgggtgctagctggaggaattggcaacgtcggagataaaggtgtagatgcaccagctgaacgtcttgctctgtttcccattttacgtataagatgggtgatggcatgctgcattcagatccccatgggtgtatttgggatttggggtgggggattgtgtgtagaaggcaggaaagattgcccagcaactctcatttgaattgagggtggaagcggttctcgggcacagtatgccaaggcccagggcgtccaagggacagagcagagatcacagatgctgaacgggtggggaaggagcactaggcagggcatttctgatgagactttgatttgggaggtacgaaagttgtatgaggaatcttgataaactgcttagagtgaatggagatgagtaggaatcaccaccattcacatactggctctgcaagccactcagcacagctctgcacctgctcttatggaggagaagacaagcagaagagaatgttctgatctagaagagttcgtgtaagagcatgaaggcaacagcacttgagatgtggtgcacatgagcaaaatttcagtttatgtggaatttaagattaacagattaaaaggtaaaattctctccctggtaccaaaaaaaaaaaaaaaatccatgtactccctctctctcttttttttttgtttttttttttggagatggagtctcgctctgtcccccaggctggagtgcagtggcatgatctcggctcactgcaagctccgcctcccaagttcacgccattctcctgcctcagccttccgagtagctgggactacaggtgcccgccaccacacctggctaatttttttttgtatttttagtagggacggagtattccctctcttgactgatgtttcagcagtatgtggacagattcttttttaaggtaaatgaccaggggcttgtaatatgagtgtcacttaggcaacaggacatttcaatgaaatggtgatggaaataggttctttttgtagattgtgagctcttgggagcatggattttgctaaatatactgatttttaaatttttttgacatctagcatggtgcatttcacataggagtttttcaagaagtactcatttcacaggcatcttgaatgatagatgtttggtaagaactgcgcaagacagtgtactaatcactcattctcattcagcctctcaagctatcatggttggttagtaataacatttcaaaattatatttgtcccttaggctagcagagaatactgtttaacaggtttttcttgaaaagtaggagtagcgagctagagttgtctctaggtggggtaaataaaacatctcccaccccacccaaattgaagctgaataccttcaattcactactgtgcgcatattcatgtttcatgctgagcagttcacttgagactttctcacggaaagaagtgcgatacagttggtggtagtcttatatttgctacgtgctcatgtgttgtctgatgatagaatgcagtggtcaaatattgcacaatttacgccagaggaggagaattcccatcaactctccaaccatcataaatactttattccacacaataaggaaattgaacttttcagaagaatgatatagaacatctaaaataggttaaacttggaggaattatactgtccattgtaaaattggagccactcttgaaaaattgctgcatgccccactgaatgctagagcaagacatgcagtcccagctccaggggcttccagagtgattgaggcagggctgtgggctgctttcctgaagcctgactcctttctttcctcattacactgccacagatggtggcagatacagcatggattggcataagtcactctctactacctgcagaataaaggcccaatttcctagtgcagcttgcaaagtccttctcatctgccaccttcctgcctttgtgatttctcctcctgggactcctgcacccccttttttttttttaatttttcttttcttttttttgagatagggtctccatctgttgcccaggctggagtgtggtggcgcgatcatagcttattgcaggcttgacctcctgggctcatatgatcctcttgccacagcctcccagatagctgggaccacaggcacatgccaccccgcctggctaattttttgtatttttttatagagacgggatttctccatgttgcccaggctggtctcgagctcccgggctcaagcgatctgcccgcctcagcctcctacagtgttgggattacagacgtgagccactgcacccagccactcctgcacccttaccttttcgccgccctggccggctggacgactgcacccatttcacccggcattcttgtgcctgactgtgctctggccatttcctgtgtctggaatacccccattctcccatgctcagccccgtggactgtgtttattcgtaatcacacctcagagcccttccccttctccatggactccacccctgctgtgtagatggccccaacatcattttgctgagtggagtgccactgcaaggcatggcatggaggagcctgactgcataggtggcggcaccttgagggccttacagacctggcagttgaaggtatgggctagaagacagatgattccaaattacggctaagaaataggtaggctgtaaggcttgattgccgtgaatgcctctagaaagagcacttaaaaaaaaaaaaaaaaaagaagggatttccctgttcatggcctatgagtttaaaaacaagcaccccatgtcattagccctttgctcaccacagagttgctgacacattagacgatctagatatgtgtctgagattttggatgcctattgattgtgtattcacttagactttggtgcttttctagatgtttcacaagttaagatgttgttaagaggttctcattgttttattcctatgttctttccttccactcccaactcactccgatgtcactcatctgggttcttctgctcctgcctgggctgcttagtatttattgagctacacactgtgcttggcacccagggccatggaggcaggcaaagaggggggacatttattcagcagcttcttactgagggtatgggtgccaggtgctcgctctgggaaggtgcaaatgaaatggatgatggctgagcctgaagaattcccagggtgaacagatggggggaagccagttcgggcagagggagtggcaaaagctgctgcttaaagtcgttgctcccaccgcgtggggagtaattggatctgtctgcagcactgaggcctggacaggaagatgggactggaatgcagaggggccttgcagggctcagtcggggccaaagggcagagaggcagggcacagagagaagctgtggccgccttggttggtcccatggaatcctcgcccattggggccatgggcattgatcgacactgtggagcttgaaatctcaccaggtggaaacatctctgccagccctgtaatcatttccatagtttcttctggttcttttcatgaacattttccaatatttttatttgagcattaataaaaggtttgcctatatacttaaatttctgccagaaagctttgacttccgtgatctagagcaagcttgtgcaaccacaagcaggtcacatgcagcccaagatggccttgaatgtgacccaacacaaattcgtaagcattcttaaaacattatgagccttttgtgtgatttttttttttttaaactcatcagctgtcattggtgttagtgtattttatgtgtggcccaagacaattcttcttcttccagtgtggcccagggaagccaaaagattggacacccctgatttagagttttaggacttaggttttgggaatgccaaatgtttacatggaaaggctcatccattaggatgagcatggttttcctcatgaactccttggtagaacctaatgttagtgtgtggctcttttcctttattattttcttctgtacagggtactttataaccaatagctgtttctgaaaatatgggaaaactatttttgaatattgaatcaattacattttcagggtagtttgataaaaggcattctgtggtcatctttatctaaaacgaatcctcctggccttagtgtgattattttattttatttattttattttattttattttattttattttattttattttattttattttattttattttattttatttatttgacagagtcttgctctgtcacccaggctggagcgcagtggcgcagtcttggctcgctgcaacctgcacctcccagattcaagcaattctcctgcctcagcctcccgagtagctgggattacaggcatgcaccacaatgcctggctaatttttgtatttttagtagagatggggttttgccatgttggccaggctgatcttgaccttagatgatccacccaccttagcctcccaaagtgctgggattacaggcatgagccaccccacctggccttagtgtgattttgtattttatgttgtgagttttgtttttaaaaaagaacatcagtaagttcagaaaccaactccatgcttatttgctgtaatgaatttttcccttacattggaaaaacacagttccatctgtcctgaaggcccataagtcacagaatgcggtgtgttggaatgtgaaatcctttcagccttgcagaatctttatcattgtgctaaattgccatgtggaagaatggcaggtggcagttagaacttagggctttctatttattctctttctattttgcattagtcagttaaggttctgatcttcagaactttgtatgaaagtcagtgcttcatacaatttcacatcaaactgtggcattgcaagaggcaaaccatttggaattcttccttaaattacaaaaagaaaaaaaaaagtgaatgcacgaagattgttttgttcgcaagacttatgacacagccctccagctctgtggcttttcattctgatgggaaggaaatgagaccattgtaaatgactgttcagaatattagtgccagctccatgccaagtgctgttaagaacatggagagagcattcgagtgtttgcctctgaatttttgcccaggccatagttcgcagttggccggcaggctgcaagggccattccaagtgggagaagcattccatccctgggacaagtaaacagaacctaaaacaaacacatgtttagttgaagtgatacagcaccaggcaaagtgttctacttttaatgagtgaaggacatcagaaacaaaggatcagagccccccacgttgcattctcaactaattatagcactaaggcaggaatccttggccctttatctggagtgagtcagagagtatatcatgccttatctaaagtctaaagttaattgagcccaaggcccttctgaatagacacacactgtaatcagatatacagatggagtgggaagaggtaaatggtttcagatgccagcctggtgtagttgcatgccggaggggacttaaaggaaacagtgagaagtattagaaaactgtagttgaccaggtatggtggcttatgcttataatcccagcactttgggagactcaggctggaggatcgcttgaacccaggagttcaagaccagcctggacaacatagctagaccccatctctacaaaaaataaaaaattagctggatgtggtagtgaacctatagtcccagcaacttgggaggcggatgtgggaggatcgcttgagcctgggaggtcaaggctacagtgagccatgatcacgccattgcactgcagcctgcgcgacagagtgagattctgtctcaaaatagcaacaaaaacaaaaaccaaaagtatagttgcagagaatggctttccctgcttagttttatccagatgactgttagaatagtggtgaagaatctgacaagtggcagaatgcagggccatgggaagggggagagttcatgcctaaggtcagctgagcagaggagacttggagaactgagaggggatccctctcctgtgtttgttgggagggacagagcctgttgcccagcctgcaggtgtgggagggaccctgcaagaagtccctttggtcaccctcttcaggccccacattgcctgatgaggttcagactcctaggcctatgaagggtaataaggcccgtctgttcctgcctttacttttcttctatcagtttctaagcactctcagcctccgggcctttgatcgtggagcgccatgatacagtggcgttgtcctgagtggttagaggtgtgaattctcgaggccgactgcctgggtttgaatccttgcttggccatcttccagctgtgtgaccactctatgcctcagtttcctcatccgtatgataggaatagtggcagtacctatttcatggtgttattgagctgtacagttgctagctgctgccatcatcattgtcatttcctcatttcttttagacccaaactctcacactttccggaattatttctggagccccccagaaggaattggtctcttttattctagattccctaagaggcacagagggatactagggtgagaagatagtggtggctcacagtcatcactctgtacttactagttttgaaaatgtatcaaattgctgacgtctctgagcaccagtttcccaatgtgttaaagaaggatggtgatacccaacccatgtcacagggtttcgtcagtaaatgctaaaccatgtggtaagcagatgttctcagtgagcaccaggtcactattattatgttacttgtcatgacgagttttacttgccaccttgtattatagttgtgatgactatcttttttctagctccacattgggacacatgaaattatagagttaaatgaactcatttgtagatacttgaaaattgtaataatctttgaatatctgtacctgtttgtgtccagattcttctggttattttgacttccttataccccagtgtccttttttttttggagacaagtttttttctcttgcacaggctgaagtgcagtggtgccgtcgtagctcactgcaaccctgaagtcctgggctcaagcaaatcccagtgccttataagcaggcttcctcaaggcctgttgtcttactcatctgtattttccttatagcatctaggtcagtgccttgcttataatgggcatttggcaaatgtttgttgaatgcatttatcattacttagtaataaatactaaactattttttaatgggaaaataggcaggtttgggttctcatgcacatgacccacatttgtcgaatgtctgctgtgtaccagccagcagctttcttcctttagtgctatttcctgttagagtgggatagtggtatttcagtccacctgatgaccatttaggccaatcacatgttaatgggaattgaatgcatgcattaaacacaacaccagcgggtgctgtccacattaaaaccaggaggtctgcttcattggttcttgactatattgaaagagttggaaatctgacctgggcatttgaggtagactctaaggggtgtaagacggccctttgttttagagacttaggattggtgtgagtgactggcagggactgctttagtgcccagacctttagtagcacagacacaatataggaaaactcttcaaggaaaaccagccccaaataagagagtaggtaatgttctgcttctcttgctttatattctgcttgctttacagaataatctgagatagctaataatcaaagtgcaggtcccccaaaatgaaagtgatcatcatagaaccagaaaagaagggataaaatactgatttcaaggactcctgaagccaatggcagctctgagtttcctggcagccaagacaaagacagaagcatgctgggatgatgcatcctcgggctcggtaaaggaagcacaggacctgcctgctgctgtgggctcagggaagtgagtactattttccctgtctggagtggggaggagcacttgtctgtggtagggtgaggaggaccacttccttgggctatcagtcattaaggccccttaacatcatggccgattctgaaattacctctgaaagttgagatttatgttagactgtagctctcaagccagttcccttagaggccagagtaatgacagtgtaatttacttgccacctgcttgagagagacaattggtggttaagggactttcccaaggtgataaattgttttagcaaacagatccagaggacagctcctttcccctggtctatgtatgccttttgaacgccaagaccttatcctaaactcaagtttcacgaataggattaaaataccctttggggacctttcttacattgagaacagaggctgggccacagcttggctaaagcattccagatctctcttctgagcaagagattttgacttgttcataaaccaggctctctctcatagtgggcaaggccttaaaaacaaacaaacctgcaaaacctgaggaaacatcttcctcctacgtacttagctgatgtaggcattaatggaaatggatattggagtgggaggctccttttagggggcagaaaagaaagaatgtttttatttttaattaaaaaaatattttcttttgagacagggtcttgctctgccatccaggctggagtgcagtggtgcgaatatggctcactgcagccttgacctccttgctcaagtgaccctctagccttggcctcccgagtagctgggatgacaggcgcacaccaccatgtctggctaatttttgtattttttgtagagatgaggtctcactggcttgcccaggctggtttcaaggtcctgggctcaagggatcctccctcctttgccttccaaagtgctgggattataggtgtgagccaccgtgcctggatgaaaaagaaataacttgattatgggttatggaagtttagcaatggcttcaaaaaatgtcagcagggaatggatgtctttttctatcagatgaaatttcagtagtcatctgatacagccaaccaggagaaggaaaactactaagtagaaagacttagataagtggagtcgaacatctctgggcttaaaaggagcatcactcctggcatattcagcgtggcccagctgtgtttctctgagggcgatgtcctcctcagggtctgtgaatggctgaactcagaacaaggcttttgcaatctgcgccttctgaatacagtttttgttctgttggtttaatttgcatttggtgtctggagtgcctggtcatggaaagagcccgttctttgttttgggtaatgagggctgaggtttccaataagtatttctcggttccgtccgtgtcgagtgtcatttgagtagcaagtgactgttgctcattgcactgggcctgcgagcctccatttgcacattagatttttgcataccctgcaattagtaaattacagaatgacatcatgaaatagaaaactgtattcccagatggaaatgctttccgtattctatgcatttttattcaaaggcagatgcatttgtaaacctctttggatggttgttctgcctttgtcagttacttcatagcaaatgtcaactgtaaaccaagagagagaatgagccaggatggagaacttttttttgtttaattgtgtcatgttgggtgctttttggaaagtgggtgaattattcatgatgacatgaatgggggtattattttaaattagtatagaagcaaatggttcacaacccatttattaagaccctaatgttgatgtggctaccaagaagctttaccagcaagggccagtgtgttgccttccttggttggttagtttttctacatccacttaactcctagcctaattttatcttttttttcctctgtttttctttccctgaatgtttatttaagctctgataaatcattttgaattaaggtcgggtatgtatttcctttcttctcatcttcttccccctccatgactgcctgcatttgaatacatttccattgtgtgagaggcagtaatggtacagaggggtggggggtggtgactgcttggtgagctgtggctcacatgtctccagagacacagggcctaggaagactgattaaaaatcaacttttaactactataacggctcactttcctgaaacttgttatgctgtaaccccacctattgaagacataatcagaaccagaaagtgaacaaaattgaccctggaaatatgtggcaaaaattctgtgcaataagtatgataacacttttctttcagtgaattctctctcagggcccactcacagaaccaattttgacatcaaattttcttccttttaaaaatacagttaacccccacccccatctgcaggttctccctctgcagattcaaccaactgcagattgaagatattcagaaatttagaaaaatgaaaaataacaatataacaaaaagtaatgcaaataacgcagtatcacatctatttatgtagcacttgtgttgtattaggtattatatgtaatctagagatgatttaaagtatatgagagggtgtgtgtaggttatatgcaaatcctataccattttatgtcagagacttgaggatctgtgaattttagtatcctcaggtgtcctggaactactccaccatcaatgctgagggacaactgtatataatataaaataaataaaatatgtactgtaaaattgtaatcttgaaagtttgatcctgtggcagctgctattttcaggcagctcagcctttgtttgcatgctcaaaaccagcttgtgatttggtttctaagatcacggctggcttattatctgtgctggcttatcatgacagtggctcggtgttatggacacagtgagcatttggtgtcgatactcccagaatgaactgagtagaatggacaggagactgacctttgtctatttgtctatgtagcagtaatgccactaacttgttgcagtgctctttatcctcaaactatttgctatatatagtaatgcttaaattacatatattatatatattacatatacatattatatatgtggatatattatatattataattatatataatatatataattatatattatatagatggttctgactttgcacagttctgatatgcatgagttgcaattaccatgatttaaataataccagttccccaacaactctagtcaaatctcagttacccccgtgtgttaattgagtaattgcatgaagtacacaagcttgctgctagtgcttcagtatacaactcaccatgtaaataacagatgcatgtcagaatccgtggccaatcacagcacttctttcaaagcccatgggtgattggtcagtgcacatgttccttagttcatgcacagacagcagagtgtgtagttctgtggccttcttggctattggggataaaccagtgtgacattttacaaaaataccaaaaatcgagagggaattggtgaacgaagataaaagtgcagcaaagaagctgaaagtgataatgctagaagtgaaaccaaaacctacatggaattatagaagaaatagctgactgtgggaatattggcagtacagctgttggagagactgcctgcgcagcccgaggaggagaatgcaggtttaccacataaacaaggaaagtggttgtgaagaaaagaataaagctgtcctagaggacatgaccttggcaaaacaaacaaatttcacattaaaggatctctcagaaccatttcccagcatagaaaatgcaaaggatgaaatgtatgcttattcaaacttacggctcctagcagcactgttcacaatagtggaaaggtagaaacagcccagttatccatcagtgggtgaatagattaacaaatggatgaatagattaaaaaacagattgtgatatatccacgcactggaatattgatttaaaaagggacgaagtactgatacctgctacaatgcggatgaacctgaaagataccatgctaagtgaaagaagccagatacaaaggtcacatatgataaggttctatttatatgaacgatcttggtaaatctgtagagaaagaacacagatttgtggtttggtttctaagatcacagcaagcttatctctaagatcggggctggggcgcggtagggaaatgaggaacaactgcttaatggatgtggagattccttctggggcgacagaaaatgttttgcaaccacgcggacgtggtggttgtatgacattgtgaatgtactaaatgcgcttaattgtttactttaaaatggtgatgttatatgaatttcacctcgattttaaaaacgtgacatttcaccaagtcatagaaaagatgcttcgcttgtataagttatgcgacaaaaagataagcacttttaaatatttcttgataagttttttgtttccagggttttaaatggcaacgtgctgaatatttcactatttttcacttccttgtacatttataactgacagtaatagagtttttaatgctttgacaaaatttttaagaagtcacagaacaattgcattttttccttttcatcactaacattgttttgcaccgtttcagcttctatggacattcttatggtttcatactgagtactgcctgtgcacatgtatttcactacacccccgccccccaaccaacccctccaccccccaaacacatcccatacccattacagcacgttgttgcagggaggattctgagatgcgtcttctacaatagaaaaagatgtgctgggcttgctgtgaaaaagcagaggaagttagaggtgggatattagtggtgaagttggtagaacctcagctgcttctagggaagagggaaggtaaagtcagcaggtattagggaccaggggaagcctgtaacttataaggtatggtaactatcagagcagtttgtgggattggctagcagctgtgtggccagtagctggaagaaccagtggtctggacatgtcctagttttgagaaatctgtcggcaaggagagcgctaggactgaaggtatgatgcctgaagcccagaaacgcataatgggctgtgacaatgctgtttcacttgagctcatcggatgctttcgaggattcaatccatatctccctgttctccctgcattttgacacaggccgtgcttgcatgacagttgggttagtgtattcccctctccaccagagacttgggagggtaggggagtgtgccttagtcattctcgagactcctgtgcctggcagtgcctagcaacggcttaataaatacttgctaatgaacctaattattatgacattaagattttaatctaaatcttctaaatgactatgggaatctgtttatttttgcttaggatcattggtaatgttttctggccaaagctgcttttttgtctgagctgtgtgtttatttttcattcctgtctcttatttatattgtgaaaatgattaagaaaaataggtggtatggctcatggtctgatatcacgagtcaatgtgttgttttgaagccaactccacacataatggttcaagccctctgactacatcttagttttactccagattttctccatcaatgttgcttgcatttttcagtggtactttttggaaggaaagaatacgaaagccagcccgcaaaagatcactgggtgggggtcatagtctgtgatggtgactgaattatctggtaaagcatatttttgccgttttcagggtcaggcttcagcataatgagattccagaaattgttatgaaaaaagaaaccttaggttacccagcagctaaatgattactgcatcagctagcagctccggaatggccatttggccctgtagaaagatcattcttgggcaggctgttgatgtggagagtgagaggagcagctgttctttcacctgaggccccatctgggtagcagatggtccccagctaggcacaagccctgtgtagggacatccgtgctgcccaggatcctgggacactgcccaaatcaactgtcaggctgggagcctgtgtccagaactgtggatggcattcactttgggttgtggaagttggtttgtacctactcttaagtcttgccccttcaactccagctcaggctttttaaccctagtagaagctttcttatctgtaggtatttaagataagtttgaacctactggtctgtgggaaggtaccgaaaaagccaaaagctgcagctcctggggagcttacaggctcccccttgttgagagtctcccgagtgctaggtactgtgggtttaagggagaccctgcagtggtcaaaaggctgcctggtgaaggggggccggttcccatacttctcagatgtgcctttgggcaagccacttgcctcctggtgcttctcttttgtcatctgttaaaggggttagtgaaggacccttctcatagggttgttatgaagattaaatgatttaaagtatgcagagtgctaagaacagtgcctggcagatgattaaaaaaattgttacagaaatacagtacaataacatttttggtcacatttaatcctcaaagcaatcatgcagaaagggcaattgtcatacctattttgcatgagagactcaaccactcgcccaaagtcacagtgctagaaaggacttgagccaggatctgaacctgtcccctgaaatcttcacctgctttgcttcttgacacggcaggagaatgatgaggaagtgggttagtctgctagggctgctgtaacaactgcagatggggtggccaaaacctcagacatttatttatttttttaatataatcttggatgttggaagtcgaagatcaaagtgttgacaggcatgggttcttctgagacatccctccttggcttgcaattggtcaccttcttgcttcttcacatggtcctccttctgtgtgtgactgtgtccaaatttcctttctgtaaggacacagccatattggattaggcccaccctattgacctcatcttaacttatttactcctttaaaaaccctgactccttatacagtcacactccgaggtactggggattaggatttcaatgtatgaattttggaggtgagaggacacaattcagccaataccagtaaatgattagtaatcaaacacagggattgaatacgcagatattaaggattggaatgaagccagaatttggaaggattagaactgatggaggcaggtgcttggtctgggtgatttttgaaaatgattttcaggccaggtgaggtggctgattcctgtaatcccagcacttttggaggccgaggctggcagatcacttgaggccaggagtttgagaccagtctgggtaacatggcaaaaccctgtctctacaaaaattacaaaatatcagccagaagtggtggcttgtgcctgtaggcccagctcctctggaggctgaggtgggaggatcactggagcctgggaagtcaagtctgcagtgagcaaagatctgtgcctctgcaccccaagctggacaacagagcaagaccctgtctccagaaaaaaaaaaaaaggctttcaacagagtcagtcgtggacaaagaggaaaggacttttttcctcccctgcagctttaacctcccaggctcatatgatcctcccattccggcctcccaagtaattgggactacaggtacgcatgccactatgcccagctaattttttttttgtatttttagtaaagatggggttttgccatcttgcttctgctggtcgtgaactcctgggctcaagcaatcctcctgccttagcctcccaaagtactgggattacaggcatgagccactgcacccagctggaaaggactttttgtgcggtgagaggaggatcctcagaatacggagatctggggtccgcagacccattgtgggatgcacattgatttagttagatcttgagtgaagagatactgtgttagctgactgcgtgataaacgttagcctgagaaattagtttgttattttgataggcatttgagtcatttattgaactaaaagctttggggtgcctcatgtactaggcacgaaatcacagtacagttcttatcaggggagagatcatttgggtctcagtttcctaaaagtagcttttaactccaaaattgttttaatctatgtttgtagaggaacatcatgaaaatattttgaaattaaacttcttaagtataccttaattttatactgttattattttatttcatttttatgtttattttttgagacaagtttcactgtgtcgcccaggctggagtgcagtggtgcgatctcagctcactgcaacctccgcctcctgggttcaagtgattctcgtgtctcagcctcccgagtagctgggattttaggcatccgccaccacgcccagctaatttttgtatttttagtagagacagggtttcatcatgttggccaggctggtctcaaactcctgagctcaggtgatccacccacctcggccccccaaagtgttgcgattacaggcatgagccaccgtgcccagcctactgttattattttaattagtaaattttggtataatagagactggattttgacttaaggctatctgggtttaaatcctggctctgtcacttaatagctttgtcagatataccatatgacataaataggcagagtttccatcttatcacctgtgaaaagtggataactgtacacatcacattggattgccacatgcagtaatggatgtggaggttctgtccagcattgtgtctttcccatgataggcacttgtgctaatgctatgcaagaaggtagaaagttgaaagtggatagctaaaagtggaggcaaattaagggacttcttaaaatatttttatttaatagaaaacaatatatagcaagaaaatttggatcaattctttcatgcattcaacaattgaagtctgagaaccagccgtgattaggtgctccaaattagaataaggcaaggctcctgccctcattgagcttccaggcaggcgggaagcccaggagggcgtgataagtgctacaattcaggtgtgttcaggttgtcatgcaggtattgaagagggctacttttggatttatgcccacagaagagtttcacagtttctgaatttttgccccaggatgggagcaggcacttgcattaacatttgaattaatcacccagagaagagtggaaaagttatttcaggcaatggtaacagcatgtgcagaagtctagagggatgggagaggccacatggcatggttggaaaatagcagctcaggaatccatttgctgtgggggtggtaagtggaggactagatttgtgaaaggggacagatcacacaggctttgggaacaactaggaggttttttttttgtttttttttttttttttgagacggagtctcactccatcacccaggctggagtgcagtggcatgatctcggctcactcaacctctgcctcctgggtacaagcaaccctcctgcctcagcctcccaagtagctgggattacaggtgccccccaccacacctggctaattttgtatttttagtagagacggggtttcgccatgttggccaggctggtctctaactcctgacctcgtgacccacctgccttggcctcccaaagtgctaggattacaggcatgagccaccaaacccggctgactaggagatttttaagcagggaagcaatttgatgatatttacagttttaggaagaccaaactgacagcagcttggaggctgatttggaaaggaggcagagtggaaggcagggttgttgaggggggatgttttagaaagattttgtgatgattctgctgagactgaggttctgaacttgggctgccctagggctgccctacagcagcccaggaggacagattgcagagctttgagatagttggcatcaagatgggtgtgtctggggtgggcatgactgggtttctagcttgggtgtccaagtggataaatagcctttcatgtggaggctgagggcatgggcaggttgagtactgtccttcttccccaaaggtagctggccagccatgggagtcaatccacatgggatggaaggatggagaatgccagctcctctttaaagacttggccctgaagaatagagcttgcaattttgtatctagggtagtcattaagatccgttcacacaggtttggatctttaatctccagaatagagggtgggatgctccctgctccattgagcccaggtcatcatgtgacaacctgtgactaattaggcagtgagctgatgagattcgtgtggctcttgagctaagcttttgaagccagggtgagactctctggccctcattatctcagctgtggtgcttggcatgtcccagaaggtagccgtgctgtggacctcagtccccgagggagcgctgtgccaccgccacccacgatggacctgccctgagagagaagcctttgttttaggctctttaagatgacatggggattttggtggtgtttttctagcctaatctagcccttcctgactcaagtttttgtgtaagagaccaaaccttgctcattttcttttccttagctacaaatcagttttgaacttaccctttttcagtatatgcctgtgcatgtgtatgcctttgtgcgcaggcagacaaatatagctaggaccaaaagcatttctgctgttaccattatccttttgtccaaggtatttttcaatgaactaaatgtcagaaacacacacgctttcttaaaaaagcagctttattgagatatgattcacataccttacaattcacccatttacagtgtataattcaattacttttattatattcaacgttgtgcaaccatcattatgatgttaatttttttgtttgttcctcttgttgagacagagtctcactgtcgcccaggctggagtggagtggcacaatctcggcttactgcaacctctgcctcctgcgttcaagcaattctcctggctcagcctcccaggtagctaggactacaagctcatgccactacacccagctagtttttgtatttttagtagagacagggtttcatcatattggtcaggctggtcttgaactcctgacctcaggtgatccacctgccttggcctcccaaagtgctgggattacaggtgtgagccactgtgcctggctgatgttaatatttttattacccataaaaggaagcctgtacgatataaccatcaccccccagttctcccacacatccctctccccatccctaggcagcctctaaactactttgtatctctacattttgcctattctggacatttcatataaactgagtcatgccatgtatggttgtttgtgactggcttctttcaattagtggagtgttttccagggtcatcaatgttatagcaggtatcagcacttcattcctttttattggtcaaatactagtctgttgtatgggatacattgtgttataaaaccatatggtttctagagatggaagccatgctgacccctgtagagttttgtttatccatttatcagttgatgaacatttggattgtttctgctttttgcttctatgaacctctatgtagtacattcttgtacaggttttggatgaatatgttttcatttctcttgggtttatacctaggaatggaactgccagactgttttccaaagcagctcaccatttgacattcccccccagcagtgtctgagggttccagtgtatctgcatcctcaacaacacgtgttgtctgtccagtgatagccatcctactgggtgtccctgttgttttatgtcatttaacaccaaacttagatcacatttctgcattactgactttgcacataccgtccccaacttgcaacttatgctgtcattaacttgtgtagatttatccatgtttggctgtttatgaggatttgtccgtgtcaacatgtatgtttcataaggacattcttaccttccattaccagacctacattctcaatttaagatttgatattttttcagtgtttaggttttcaattgaatcaactgacaagtttagtggcttaaactttcaagcttaaactgaaatgccaatcttgttttagaccaaaaattacatcctatctcttctcttaattgaggaacttaggtggtggttcctatttgtctttatttatttatttatttatttatttatttatttatttatttatttatttttgcctacttcagtttggtcggtaaactatcaattgtattttcagtatgtatatatatatagagagagatttttaaaattttattattattttttgagacagagtctcactctgatgcctaggctggagtgcagtggtgtgatcttggttcactgcaacctccacctcctgggttcaagtgattctcttgcctctgcctcccaagtagctgggattacaggcatgtgccaccatgcccagctgattttttgtatttttagtagagatggggtttctccatgttggccaggctcatctcgagctcctgagcttaggtgatctgcctgccttggcctcccaaagtgctgggattacaggcatgagccaccatgcctggcccattatatatacatttttaatataatgtgaaatcatgtggtctctactatagactgaatatttgcatcctaaaccccaatgggatggtattaggaggtggggcctttgggacgtgattaggtcctgagggtagagccctcatgaatgggattagtgcccttataagaagaggccaagtgagcttgtttgctccttctaccatgtgaggatacagcaaagaacgtgctttctgtgaaccaggaagtggccctagtcagacactgaatttgccagcaccttgatcttggacttcccagcctccaaacctgtgagaaataagtttcggttatttataaaccacgcagtctgtgatagtttgttagaggaacccaaacttaaaggcagcttctaaaggggagcaatgctgaccactctgtagtttgtatatttggtcaacacactttattgagtgatgagtctgaatttcatgcttgattgatgatgattggtgacagagtagacaaggtccctgcttcatggagtctatggtctagttggggaaatatacctttattgaatcaaggcagatgtgattacagattgaacaatggctgtagaaggaaagggatttccaagagagaattagaggggcttctcaaattgagtttgactttctctttggtgggggttgagtcaggaagaacctttttgaagcaggaaaaatctttagctgagacctaaaggaaggggaggagcttgcctgggaaggacactgtggtggctggagggggtttcccaggcagggacactctggcaggttagagtaactgaaataaagtctgtattggagtgcagagactgccagaagaggggctcatagaggccaaagtgggacggccttacggacgagctgataatttgggcattattcaaggtggggtgctatgtcattgaagggttttagcagaggggaggcattatccaagttaaagaacaaaacaaaacaaaacaaaacccactctagttgctgtgtggcagatggattgggattgggggtgtggggttggtggcaagaatagatgcagggggacaagttatgaactgagactgggacctcatgggtcttcctgcccaagaccgagatggctgggggtgggggctgcggctagggacatggggcctcagtgcccacgttttctgtcctctgtcccctgtgagggtatgtgcgctctcataccagccgcagggcactttggctcgcttgtgttgctgggagagatctcctttaatgtttttttgtgtttttaaaatatgaacgtaggccctggcagagacaaggcagaaaccacttttgagtttttagggctgtgcattcttaaacaactctgagtgacccttccatcattacaatttatcaactaaattagaaaacgtgctttcacagatttctagtacttgggcaaatttgttatttacgctcaagatgaagtgttgcttctagtgacagttttgctgttgggcagcatttgtagggtaaaggtgtttttgcttttggaatccattgggagatttaaaaaaaatatatatatatatacacacacacacacacatacacacatataaagtaaaaagcaggaagtctatgtgtgtgccaggggatcccaaactcttggcctccagcagtcaagagattttttaaaacctttatcttttaccgtcttgctttttaaaatccattatgtctttgtatagtacttgacatacatgggcagaagtcatgctggaacgtgaagatgggagcatggactttctggagcatcccaggtggggttcctgtggctgctgtaaggcaggaccgcagagcggtggctgcagacagcacggatttgctattatatctcatagtcatagtcctgtagggtagagtctaacatgggctaaactcaaggtgtcgccagggctgtgttcctcccggaggctctaggagaggatccccttgcctttcccagtttctgcaggacatctagcagcctcagctcattgtcccctccctgcgtttgcaaagccagcagagtagcatctctgtggccattcccacatggtcacatctcctcctgggatgctctccttctgcctccctttgcactttcaggagcccttgtgattccattgtgtccatctggataatccaggataatctccctattttaaggtctgctgattagcaactttaattccatctgcagccttaatcccccttttctgtgtaagctgacctagtcacaggttctggggattaggactcgcgcatcttgggggaccgtcattccacctgcggcagtggtaggctaaaccttaggcgtctgatattgtgaacctggctcactggcctttgtcttcttgccgactcctattggtatttgcctgagatgtttttcttttctttttcattcttttttcttttctttctttctttcttttttttttttttttctggttctgggcccacagtaggtgccttagaatcatgcagtccagttgccttctgggaatccattgtagtaagtggtagaggtttttaaagcagtcctaggggagatgcaattccctgcttacattcaagtttttcgggaagacaagtctgtttaggaaacataggaggttagttgcattttcctcattaatgcaggatattaaaatattcagagggaacccaggagtcctctcaagatgagtttaaatttctcatacttgtagaagttgttgagaaatactggattctaatttccagaactctggtggggaaggagactgtgaacctggtctgaattgagaatggggattgaggatttttggacttttgaaagattgacttactctctcccgttagttctgttgaactgctgcctaaatggagggaatgtgcatcctctcttgtgttgcgtggcaatgccgtggggacacttgggacatgagcaaaacgttgacagaggggagcacttcccggaatattattaatacagagttagttttaacttcaccttttgggcaaacttgacattatagatcttgaaataggattatttttcccttgctaagaggttagcaaaatcagtacagtgtgtctctttgacaggccctagaaagcactctacgtttgttaactttaaatttgggttggaaattgatgttattggaggagcaaggcgtgtttaggcctgatgatttttggatagcttgaccaaacccggtacagccaactttcccccaaaactactgtgtccttctcagtggttcctgtgcctgcacagggacccagcgcacaccccagtgtgcctctttgggctctggctaacttaggctgacatcctgatagaacgcagtgaccacctggtcatttgattacagcgcttcttccagacagcacgctcagaattgcgtttcttacttccagtcttcttgccctgtaagcattttctgtgagtcaccaaatcaaccacaaaatcatttaattttatggaagtggaaaatcagacttattaaaatactgtgtttttgttttaaagctcagaggtatagagatccatgaatttttttccatgccttctcataatgtggttttggtttagctgcggttcttccaggcgcagatgtcagccctctgcagatctgctgcatcagagtttatggcctgggtcttaggaatttgcaatttaaaataaccccttcaggtgcatctaatgcagcctaaatttggggccagctcatgggttgtaaactgtactgccctatacaatagtagcacagttctaagctcaagggactcaagggggtccagtaagtacagttcaccagagaaataacaaaagcatttgcagagggagaccagagcatcacctttgttagggcaaaggcttaacatagaggaatgtggcttctatgtccaggccagtgggcttcctaacacagaacatggaattaggcagacttaacatcccccatgcccaccctggtgagtgccagcatgggcttgagctgctcttcacactgatggtccatcctttggactgatctccttgtgaaggatacaatacagcaaggagcgggggcttggcttggcacagccagttctttacccaaactcctgccaacgctggcccttctttcttaccctggttggagtgtgtgagggtgggagaggcaggaggaatatgctggacagagcttcttccatctagaagggaatttcaggagtaagaaagcggcagctcttaacatacctgggagaaagcaagtgcttagtaaacagttgaggaatgaactaagaattttcagacagattttcctcttctggagcatttgcagaaccgcctctttgctcaagtgctttgttttttacagattcatttaaggtcatggttccagacactaatgtaaatcagcacatatattattgaagaagtagaatacctccaggcccagttgccttggagcaggaaaaacagttcatcctcattaccatccagaataatttatgttcaagataatacacaatcaatttactttttatcatattcgaatttgatttgtgtacacttttgagtttggatgtcagccacattgcttctgtgtgttaatctttatttacgggaataaatgggaagcagtcagccattttttattctttattggggaactgcattatagtggaaaaggtaaaattataagctaatgagaccagaggtctgtatgtatgaaaaccatcctcatcgcttcacagttgtctttgaaccagtttccctgggattgttcgaaatgtagcaaacgtggctcacggttaccctgacggggccagagcaatagggggaggtgtgggcacctgtatacatttgcgttgaaaaacgtacccgggctattctgaggtcctttcctgcccccagcctggtttctgggcctctctggagtctctctttctggcacttgtgttctggaatcgcttatcagcctggactccttcagcagcagctgccacagtgtctttgtagtcacactacacacctatatactccatgacatggagtgtatagaatgtttcccgtcttcctcgtcagtgctgccaggagaagcttcccctctcctaacctctggatagtggctggctctgctttattcaggcattgctttcattttttagaacagctgctccagtatgcttagtgtgaatgacagcccagcagaaagaatggacttgacactggagactgcaccactccacatttctttgtcccctcaagatgacttaactagctcccttcccttttccttcatgcaatagcctcagaagttcggctggcattgccaagttgttagagtgaaccttaacctgtgtatgactcagaattcacatctgctgtgtcagtgaacacacagatctctttgtgaacacatggttatcaagaggcacatgctcttacgtatcctgccggattctggtaaggcgctgcttgcgcagtaagcacttgtcaggtgcttatgatgcctgtgacgtgaggctgtggatgcagaatttgtggtctgaacatttttgagtagataaaaatggaaactgaaattggtgaagcagacttgtggcttttcctactttctcatctcttttatggatataactagaagctctgcttcatcaatgagtgtgttaaaacaatttgtttacaaaatcctatttattaaaataaaaatctgaaagaactgcgctgctgcttttcagtgctcgccactctaggaacctgtattcctcctcttgttcatcctcccttttcttcttttttgttttgttgttgtttgtgtgtatgtatgtgtctgtgtgtgtgtggcggggtggtgggggcggtgttgccaaatcttttgcactgaatctttgaagatgtcctgaaatacttaccaaatcactagagcgaagagaagcccatctgatttcttcatctcccagctgaggaaggacacactttctcccactctccagtgaaggcccctgtgtcctgtgggtgggggagctgacatcacactcagtgctgacatttcttgttccctgggtgggcgctgattccagatcctcttcagccccccaagcggaactgggtttctcttgaaggtcctaacctcagctcacaccacctgctactacctttctgggtcttggattttgttgttacccaggcccggggtcatcccaaaggctcttgatagccctgtggctgtgcttgctaatacactgtcctcatcttttgtcagcgaagtaaatccaataatgtttccttctctttaatccaagccagtcttcattgaaaacacttcacctctaagctctcaggctctgcagtctgccctctccaaccttacccctcatgccccaccttccctttgtccccatctttcccttctgttccagtcattctcatgggccatggagagtggaagcctgggagggctttgccaaagtccagttgcctgctcactttcctaagggccagagcaatgggggaggtgggggaggtgtgggcacctgtatacatttgtgttgaaaaaggtacccaggctattctgaggtccttttctgcccccagcctggtttctgggcctccctggagtctctctttctggcatttgtgttctggaatcgcttatcagcctggactccttcatcagcagctgccacagtgtctttgcagtcacactacacacctttaccccgatccactgacctgctgtcccggatggccctggtgtgttctctctgttcctagccgcagaaattgctggtgaatgtcaccaagctaagcggtgtagctttataacaagtggattcagccagctgggactggacgactgagagtttgcagcccctgctggaccctgtgtaactgtccagttcgcctagctattggtttggcccagtggttttcaattttggctgcacatcagaatcacctgggggaggtttaaaaccctacctctgcccccatgccctggggttcacacccagaaatgctgacttcattggtcgggggctggcaggcctggacattggcggtttgcttagaagctgcccgggtggttctcatagcagccagggtcaagcaccacggcctgttcttacctggctccccaggccccctttaatctccctctgcagcagattggcacacatcgcattgtggagcaagccatctgataattttccttaatcgtctttgaagatcttccctctgcctgttgatcctttaaggaagaagtctccttgccaggatcggcctctccagtctctggatcccttcttgcttgctctcttcagaacccatgaaacctctctggctgccttgacgtcagccagattggactgcccaaatagaaaggcagaaatccctgtcgaggccagacagcaaggatggagagaggcagggggtgaaatgaaacacaccaggaggagtaaagacaaggccttctgatgtcagccaagagcaggtgtggattaggcagtcctaagtttgagtcctggttctgctattcattggccaattgtattctccctccctctacgatgaggttaattacagttacctcactgggatttgtgaggatggaatgaggtaacaaaacataaaatactatcagtacaatgcccagctcataatgagtatgcagcaaatgttcaccctttaaaaaatgccacggccgggcgtggtggctcgcgcctgtaatcccagcacgttgggaggctgaggcgggcggatcacgaggtcaggagatcgagaccatcctggctaacacagtgaaaccccgtctctactaaaaatacaaaaaaattagccaggcgtggtggcgggagcctgtagtcccagctactcgggaggttgaggcaggagaatggcatgaacctgggaggcggagcttgcggtgagccgagatcacgccactgcactccaacctgggtgacagagcaagactccatctcaaaaaaaagaaaaaaagtccctttctaccttcaaattcaggaaaattttctttagtccaacagatgtaatccccccctcactcccccatccccactggtatctttatgtactcaggtgactattaccatattctgcttggactgtttttatacattgcagataatttgaagatatggacttaggtaggtttttagatttataataattaagtgatgtttttctatcaagtgatgaaagtttcaacagatatttgttaaaatttaatttagccaaaggaagacatgccatttcagcaatgtgatctaagtaaaagtgtcttctcttttttttggtggggagaacagagtgtagaatgatattagtaagatagagaattgatgaccaaaccataactgctagcattttagtagaggacacaacagagaaaggattctcacgtgtgttattaggatcttggatgagagtgggctgttattttaactttggcccctgttggagcaaattactctttgggggcccggttttcctcaggaactacctacagaattcagtgagatagattttagaacccttctgaatgctgctggtttggagattctgtctgtagcaagttttgttcagttgttaatctttctttcttttctttcattctttttttttttgacagggtctctctatcacccaggctggagcagtggtgtggccctggctcactgcaggctcaagcgctccttccacttcaactgcccaagtagttagaaccacaggcgagttccactacagctggctaattaacaaaaattttttttgtagagatgaggtctcactgtgttgcccaggctggtctcaaactcctgggctcaagtcatcatcctgtgttggctttcgaaagtgctgggattgcaggcatgagccaccacacctggccaactatatgttttctatgtttattatattttctgatttgtaatgtattttaaaattatcccaataatatatgaatgcaatcttgaaaaatactcagcatagcctttaggctaaaaagtggaggtctgccatttctctgccttgccccattcccttcccatgtcttattttccctgttaccaggttggtgtgaagcctttgagacctttttctctgcacacccatatatgtgttttttctatgtttttatagtattgtttcatttaaaaaataaactaggtttttgaacttgagaaatttcaactcgttctgctcagagctttgttttattaaaatcagtgcctgggagttgctcaagtctttgggctgtgtcgccctctagtggtagccctttggcttacagctgccattcagccctagggctggggtggaagtgatggttttgtgcccacaacctgatggcagggttggcagtgtttagttgctgacaagtgtctaaaactcaatctaggccgggtgctgtggctcacgcctgtaatcccagcactttgggaggccaaggcgggtggatcacctgaggtcaggagttcgagaccagtctggccaacacggtgaaaccccgtctctactaaaaatacaaaaattagccgggtgtggtggcgggcgcctgtaattccagctactcaggaggctgaggcaggagaatagcttgaacccaggaggaggttccagtgagccgaaattgcgccattgcactccagcctgggcaacaagagcaaaattctgtctaaaataaaataaaataaaataaaatataaaagtctagtgagccctggagtggtgtttgccttgctacctccaacttgccctttttaagagacttaaaatttgtggtaacttttcacatgatgtgtatttagatactgctgagttaatgaggctgctatacctggctgatttattgtttgctttcaaagcagttgtcaagtggtgtccacccatcccactgatggattttttttcttttttctttttcttttttttttgagacagagtcttgctctgttgcccagactggagtgcaatggcatgatctcggctcactgcagtgtctgcctcccaagttcaagcaattctcctgcctcagccccctgagtagggattacaggtgtgtgccaccacgcctggctcatttttgtatttttagcagagatggagtttcaccatgatggccaggctagtctcgaactcctgacctcaagtgatccacccacttcagccccccagagtgctgggattacaggtgtgagccactgcacctggccccactgactgtttatatctgttatactgttcttgcctctgtgccttttgggttccctgtcatggcagcatccttacatcctccaccacctctgaatgttcccgcaccttctctttctaatggaagcctggctggcccttgaagacaccgccaaccctgctggtctcttcacagagtatccacccagcaacctggcctgtccattcttgacttcttctggtccagctgcctttctgtacctcattttagtgaccctttttagatctcgtccaggttagcctctagaaccctgatctcaggcaccccactctgcgatcttccgttcccagccttcccacttgaaatcgtcttggaaatcccgggctttgccaatctgtggacccaccaccttttcaccccctttccggtgccctcaggggactttgctgtagcctgaacctcatggtcccttcctgtaaacagccaaactgctttgtactccctgaggagacccccgccccggttggacaccccaccctggttaaacccactttcacaattattccaaaactgccaactggacttgcatctcttcagatcggctgtcatcactcattgtatcaggaatcttattacacttttgcagcagtttcatcggttcagagaaaactctttcataccttctgctcatcagttctccacacctcccatcattctcctagctgatgactttgctgcttgtctcattgaggaaagaagccgttcagtcagtgagaccccctgtctcgcctccacctttccacctgctgccgcggaggcttccccagctcctgtctcactcaggccccttgccactctcaaggcatcttcttcctgcttcccaaggatgtcactcctgcagttaaccctttttcctcctgcattattcgtttcttcctttcttccgcatccttccaaatagcgtaaaaacaggccttatgacgtttctctttaaaaatgtccttaccagtgccacgtccctcttggccactgcccctgttgtgcctcactccgtagaaagaagtgacctgtagagactatatcctgccctctccagcgcctgccttccgattgccccttccagtctagtaactgtgtccattccttctccaatgaccgggtgacaagctgtcccttctgagagtgccagagggtgttccccgggtgggaggccggatgtcagtgccagctgtgctgtcctgggtgagcctgtgagggaccacatctggtcagactcgtgcatggcctgccctcatcttcctccgcctgcggtgcctttgagagcattgactccactaagcccgatttctgtgtggcatgttgtctgttcctccccggcctcctcgatggctcctccttggtctccctctggctactcctctgcttctccgcctccaagtgctgctccaagtgccttctgtgctctgtctccatccatcccaaaccttccaacactctctgtaagtggaatctcaccttgaggctgccagcccagcctcctcacctctgtgctccatctttagagagtcacctctctgtctggcattcccacttgaggaccaagatgattctcaaccttaacgtggcccacatggagccgctgctcttcctgcccagatctgccttcaccaccacatcctgcccactgtcactaaacggcaccagctcttacctggtttctcagtaaaaaaacaagtttatcatcttccctcacatactttattcaataataatcactaacatttattgagtgcttcctatgtgcctgacaccattctaagcatttgaagaagagtgtattaacctgcatgaggaaggctattaaaacctatgtaattaattaattaatggatggatgtgtggatgaatgaatggcagggtcttacactgtcacccaagctggagtgcagtggtccaatcatagctcactgcagcgtcagactcctgggttcaggcagtcctcccacctcacccttttgagtagctgggactacaggtgcttgccaccagctaatttattaaaaaacattttgagagatggggtttcatgatgttgccaaagctggtctcgaactcatggcctcaagcgatcctcccactttgacttatagattgtggggattagaggtgtgaggcatcgcgcctggcctgtaataacctatttgtgaatgagaaaggtcaggcacagagaagttaaataatttgctcacagaaatttcctgtgttgcagctgagatttaaatccaagcaatgtgtttctaagcctgggctcttaactgtaacactgtcctcttccccccaccaggagggtgtgtgtgtgtgtgtgtgtgtgtgtgtgtttctgaatctgaccagttgaggcaggctttcatgtcattctctctggccacccccttctttgttcacctccagtctttggaatagtcagagcgatgtgttcatggtagaaatgaaatcacatcaggtcctcagtggcccatcacatttagaactaaagctcactcttgcctcatgcctctgagcccttatatgatctcgagtcaccaccccactgccagcctctccactctcttctctgtgcctcatgcagcccaggaaatataatttggaccgcaaatgccagccacctatgtacggtaacttttctagtagtcacattaaaaagaaaacaggtgaaatgaattttaatgcattttagttaactcatgatatcaaaaatatttcaacatgtaatcagtattcacacaaagattaatcaagtatttaacagtcttttcttttgatccggggtcttggaagtttgacctaccacctctcaatttagccagccacatctccagtacttggcagctgtttgtggctacctcatggacagggcaggtcccgccacccgggcatccgtctgcctggcgcacgcaccaaacgggttccagtctggggaagttggcatctgctgttgttacttttggtcagaacgcccttcgcctgcatcctcacggggctgactccctttagccttgaaggggaccgttgctccgagaggcctgaacactccagctgcagctttctccccagtcattattgagatcaaattcacatctcttacaattcacccatttaatgggtgatgcaatgcggtggcttttagtatattcacacacatgtgcagacatcaccatagccaattttagaaaattttcatcagctgaaagagaaaccttgtatcctttagctatgactttgtgattccctgttcccctgagcccctggagaaccctatctttctgtctctgtaggtgtgctgattctgaatattttgcataaacggaatcatactagggggtcttttgcttgggacccctttcacgtggcgtgtttccacggcccatcccgtgtgatagcatgcatcagtacttcattcctttttatggcagataatagcccattgtatggatataccacctgtttttttaaaaagtccattcatcaattcatgagcatttggtttgtttctactttttggtagaatgatgctgccatgaacacttgtgtgcaggtttttgtgtggacatagacttaggaatggaataaccatggagttacggtaactctacatttaagcatttgagaagctgctggcctgtttttcatctgcaccatttgcattcccaccagcatcaagtgggagctccagtctctccatatcctccccagcagtcggttacccttttctgttgcctctgtagcactttctaaacataaaattagcttatttctttgcaggtgtctattgcaccccccaggaatgtcagttccctgcagactctcactctgccttggcacccgcaccccagcacccaggggtgaggtgcctgcctgggcagccctgtcctcacctggggttgactgaccagagaacccttgcgattctctctctgggtttctgtctgcattcctgtcgggataggtgagactggggtgacggctgctcgcggcttggtcaccttcttctctgcttacctgttcatgctctcttgcttttctctgatagcaaaccccgtctcctgtcatcctccctcctggcggaccagagctatactggcccataaaggagtgctggccacaccaggctagattccagttgagcttaaataaaacaaatagaaaggtcctccgtggtattagccatattgtaggtgctccgtagacacatgcggctagtggctgcccacaggacgctgcagatgtggacgtccccgtcatcacaggacgacattctgtgggcagcgctgtatttgtttacaaacacaattctttggctgtgtgaaggttcaggatgatacctttgccattatgattcatttattcatttcaggctggacacggtggcccacacctgtaatctccacactgggaggccgaggcgggaagatcgcttgaggccaggagtttgggaccagcctgggcaacatggcgaaacctcacctttatttaaaaaaaaaaaaatcggccgggtgcggtggctcacacctgtgatcccagcactttgggaggccgaggcaggcggatcacgaggtcaggagattgagaccatcctggcctaacacagtgaaaccccatctctactaaaaaataccaaaaattagctgggcgtggtggcaggtgcttgtagtcccagctactcaggaggctgaggcaggagaatggtgtgaacacgggaggcggagtttgcagtgagcggacatagtgccactgcactccagcctgggccacagagtgagactccgtctcaaaaaaaaaaaaaaaaaaagaatcaacatttatttatttattatttatttttttgagacagagtcctgctttgtcaccgaggctggcacgatcttggctcactgcaaaccccacctcccagttcaagtgattcttgtgcctcagcccagtgccaccatgcccggctaatttttttgttttgttttgttttgttttgctttgctttcctttgttttgttttgtttgagacagggtctcactctgtcgcccaggctggagtgcgatggcacgatctcggctcactgcaacctccacctcctgggttctagtgattctcctgcctcagcctcccaagtggctgggactacaggctcccgccactgcacccggctcatttttgtatttttagtagagatggggtttcaccacattggccaggctggtctctaactcctggcctcaggtgatccacccgcctcggcctcccagcgtgctcatttatttattttagcatcccttcttgtgcctggttgtaaagttcttcttatcccaggaaacttaataggtcaaagaaccctccccttgaggcagtttggatggggctggctgggaattggtatgtccagctgcccatatcgtggcctctgagtcaattatacaggcatctcggcaacttgaagttttgagtcccaaaacaacagattccatagcataaacagtgcaacgtaaatcctgtcccttgtccctcttccattggatacccttgtttatgttctctctggcaactgcctgtagcagggacggatgctggaaatcctggcggggccacgtcttctgtgctttgtaggcagctatggctggatggtgcttgctgtttctgtgtgtaaatgttgggatttttaaaagcccttccccgcttaatgcgttgtggttgagcagcacatttaaatgcctgaagtgtaagatgaagtctcttggatgtagagggcagtggtggtttttatttttcctggttgaacttggcctttggattgctgactgcgagctcacggtactgttaatgattttctacctacagtcacctgctgtgctgagcacatcaaatacagtgcggttagttccaagctatgaagcgcctgtcacgcatgtataacaggcagacctcattaggagggggccttgcataggggtcacattttccagcatttgttttcaaaatggaaatccagatcacgcatttgagattaaaataaaaaaagcggcctgtgctttatcattttctttaacttacatgcctgctggtccagcccagattgctgatagaggaagccctgagaaagttgcccagccagttgcccgtgcttcaagacacaaagggctgactgaggcatccgtgcctacccttggctgctgctgctcagcctgcttgcatctcgtctgttttcagttatcagtggtgtgagaaaaacacaacggtggattcagaaggagaaaccaagtcatctgcatttggcctcagtgtgtggactgtcctgaaatttgagtacagatgtgttcatgtcctgggattagataaaaagagaggaaacacacagtgaattcttatggtctgtcatttcagttggccatcttctgcccctctgttctggaagcttctccactaaaatagagcacccaacttggttttctacttgctttctggcccatcttgagttggaggaatcatgtgtttcagaactcttgctggtggtgggtgggagatcaacaaatgatttcattaagctgtgtgttcttaataaactttgggaagatttgtcgcagagaaactcagatagggaccttgtgatctcagcagtcatgggtttatcttgtccacacgcgtggcttcattgggatttggttggttgcgatccagcagaactgtggcggtgttgggctctgttggggtttggttgtgagcggaactgtggtgttgggctctgttggggtttggttgactgtgatctagtggaactgtggtggtgttgggctctgttggggtttggttgactgtgatctagtggaactgtggctgtgttgggctctggagtttggttgtgatctagtggaactgtggcggtgttgggctctgttggggtttggttgactgtgatctagtggaactgtggcggtgttgggctctgttggggtttggttgactgtgatctagttgaactgtggctatgttgggctctgttggaatatggctgtgatctagtggaactgtggcggtgttgggctctgttggggtttggttgactgtgatctagcggaactgtggctgtgttgggctctgttggaatttggctgtgatctagcggaactgtggcggtgttgggctctgttggggtttggttgactgtgatctagtggaactgtggctgtgttgggctctggagtttggttgtgatctagtggaactgtggcagtgttgggctctgttggggtttggttgtgagtggaactgtggtgtcgggctctgttggggtttggttgactgtgatctagcggaactgtggctgtgttgggctctgttggggtttggttgactgtgatctagcggaactgtggctgtgttgggctctgttggggtttggttgtgatctagcggaactgtggcggtgttgggctctgttggggtttggttgtgatctagcggaactgtggcggtgttgggctctgttggggtttggttgtgatctagcggaactgtggcggtgttgggctctgttggggtttggttgactgtgatctagcagaactgtggcggtgttgggctctgttggggtttggttgactgtgatctagcagaacagtggcggtgttgggctctgttggggtttggctgtgatctagtggaactgtggcagtgttgggctctggatttggttggttgtgatctagcggaactgtggcagtgttgggctctggatttggttggttgtgatctagcagaactgtggtagtgttggcctttgttgggatttggttggttgtgatctagtggaactgtggtggtgttgggctctgttggggtttggttgtgatctagcggaactgtggtggtgttgggctctgttggggtttggttgtgatctagcagaactgtggtggtgttgggctctgttggggtttggttgactgtgatctagcagaacagtggcggtgttgggctctgttggggtttggctgtgatctagtggaactgtggcagtgttgggctctggatttggttggttgtgatctagcggaactgtggcagtgttgggctctggatttggttggttgtgatctagcggaactgtggtagtgttggcctttgttgggatttggttggttgtgatctagcggaactgtggtggtgttgggctctgttggggtttggttgtgatctagtggaactgtggcggtgttgggctctgtgggtttggttgtgatctagcagaacagtggcggttttgggctctgttgggatttgcctctgatctagcagaactgtggtggtgttgggctctgttggggtttggttgtgatctagcggaactgtggtggtgttgggctctcttggggtttggttgtgatctagcagaactgtggtggtgttgggctctgttggggtttggctgtgatctagtggaactgtggtggtgttgggctctgttggggtttggttgtgatctagcagaactgtggcggttttgggctctgttggatttggttggttgtgatctagtggaactgtggcagtgttggcctttgttggaatttggttggttgtgatctagctgaactgtgatggtgttgagctctgttggggtttggttgtgatctagtggaactgtggcagtgttgggctctgttggggtttggttgtgatctagttgaactgtggtggtggatcccaggagctgctgctgcttgtgcgcttcaaagttggattttgtgtttttttgtgtgcagatgcttcttggaatcttgcgttgctgtatgcctgtatacctggaaagttgtgggaagaacagtttaggattttgaaccaattttctcaacaagtttgattatttcatttgagacatgttctgatgtaaatatattctgaaaaggtgagatcaaacatccactttttactctaaagcaggtccccttgctcctctctgctagtgcattctctttcctttacagctccttctcctttctgaagcaggaattaagctgaagtaactcagaaagtgccagcgttaaccccaggggacagaaaccacagacccagggctgagggattgagtttttaatttccattattctccatcagtgcgttcagtcttttgaacttaccctgactggtattatcacttgaaagttgttgttattgttgttttgatggtagtggtggtggttttttgccacccacaggagagaggggattagaagaaaaagaccaatggagtttccttgggattaattaaatgtggggctgccacacaggaatgggtccaagggctgctgtatttaaataacttacttattttgcagaggtgaatttaacctaacatgtactacagtgatggagtaaaccttttcctgtttggaatatcacaaaaggtacttcaataattgcggatcttcctttgaaccctcctattgtcagatggggtagtggtacagttccttgttccagaatgctcttagcaagttgattaatctgtcacataccccagtttcctcattcacaaggtggcataataataggacatagagttgccgtgaagtttaatgagttaatgaatgtatgatgcttggcaaatggtaggggctcaagccaaccctcgttgtcttactgagcttagtgggccttggacctgctgaggactttgaactgagcattccgtgttattctcttttttgtttttttaaggggatgagagtgtgtgtgatagagttcatgacaatattttgtttaagaaaattgtcaaaacaaagttcaaatgcaatggatggaaagtgatttttaacatgtagggtaactagagatttgagatcagacaaatcgattaggagatcaccaaacccaaacagagaatgtgagttaactcatacttaggagatgaatgctggctttgaagaccatagcgtgcattttcaaaccagatggagaggccacttttctctgcagatttcagttattcgtgatgttaaatgactcgtcttctcttacttgcctggcatgtggaactgagtaaattctgtcaaaagaactcactgaaggaatgtgtaacagctgggaattggatgtcttttcagatttgggagagcctgtgttttgactgtgatggaattcttatggtttaatatgcttaaatattactgtttaacattttgacgtttttgaggacagggataattaggagaatgcacttataagtttctatgccaactgtttccactgctcccctgtttacatggtcccagggtttatacagggctctctgtagccccacaatgaatcttgccccagtgagcgggctctcacctcccttctatagatgaggttggagctcagaagaacgtagagaaacttgtgcatagttattatgccagatttagcagctggaacaggactggaacctaaatcttttttctttagataatatgttctttgcattaatgagtttgtgggttttttgggaggcgagaaatatgtgtaaataagaagtaaaaatcctaaattgcaagttgattttttttcttaatatagtaatacgtataatgcagcaaacatatcatttcccctccatgcttgctagactggcttatgcacacatcatgatgataatgaaggagctaacatagcaagcactcactctgtgctcattcataaggtggcataataataggacacagagttgccatgaagtttagtgagttaatgaatgtatggggcttggcaaatggtagatgctcaagccagtcctagttgcctttctgagcttaggaatcatggaatcatgctctaaaaacttcatgagtatgagctcgcttcatcctcataacaactctaggagatagacgttactttatgtccattgtagggatgagagtgtgaggtatgaaaggaagtgagcttaatattctttatttttattttttatttttattttttgagatggagtcttgttcactggcccaggctggagtgcagaggcatgatcctggctcaccgcaacctccatctcctgggtttaagtgattctcctgcctcagcctcttgagtagctgggactacaggcgcgtgccacaatgcccagctattttttgtatttttagtagagacggggtttcaccatgttggccaggctggtctcaaactcctggcctcaggtgatccatccgcctcgggctcccaaagtgctggcattacaggcatgagctaccgcacctggcctaatattcttaatttggctgtcggttgtcacccaaatcagttaaagcaattccatttcttttttttttttttttttttttttttttttttgagacggagtctcgctctgtcgcccaggctggagtgcagtggcgcaatctcggctcactgcaagctccgcctcccgggttcacgccattctcctgcctcagcctcccaagtagctgggactacaggcgcccgccactacgcccggctaattttttgtatttttagtagagacggggtttcaccgttttagccgggatggtctcgatctcctgacctcgtgatccgcccgcctcggcctcccaaagtgctgggattacaggcgtgagccaccgcgcccggccgcaattccatttcttaagtgaaaatcagaatttcttttcttttttccccttctattttttcttttaatcttttttcttttgtcttcaagcaattttcatttttttttttttttttgatattcagggaacctgaggcgaatgaaggggaggaacctgggagctactgactgtgattacagtggatattcacaaaggaagacctttagtacagtgtgaagtagtgagggaaagggtgatggagtaggagggatttaagtaaaacctttcaggtttaaggtcaatggaaagcgaaggaacattctagaaggacattagattttccttagagtgacattagagtttctataattggactataccctttagtgcctcaaatcaagggtttcacattttctttttttttttggaattgcctgctcatgtatttccatctccttaaaggcaagggctggccgccttatttggctgatactagcctccatggcatcagcctgtccagtggaagtcctgaaacagtacacgatgaatggataaatgaatgaatgaatgaatgaaatgaatgagggaagaaatgaatattgtgcttccagaacgaggagagaagggacgatgatgtggcaaattggcccagcatcttaagatctgtattgactttagcctcatgtggtagtttaatgatactctctcttactcagggaatgtgccttttaagctgtggtctgtggtcaatgtgtgtgcacatctctgagagtcccggctgtgttgtgtttgtgatggctcccatatgtggtttgcctttgtatctgattgtaaattaaccttgacatgtaggtcacctgaccgtgtatggagagagaaaaatcactttcttcttctctacaagctatgtgagtgcagactgaagttccgagttgtgatctcaagcagtctgcagaaactaacctttggcatacttggccacagccgacttctttctagtaaattcccactggttcttggcttttcttgtagaattaacacatttgcaaagttttcttcattggtattcctggtacgtggactggaatattcttcatcccttgatttgtgggatcgttttgtctttgggccacacttgtcatgggaggaaagtcacagctagactgggtatggaaagaatggaagtgtgtctcctgcagggagagcccaggttattgagacagtcttggcccgtgtttcttgaagaagacgttgggttttgttttgctcattgatggccataccccttgtgtggttggccaggaagctgaacgcttgctcccccttgtggctaaatacaggtggttctgctggcaaacccagtggtcaattactgcatctactaaggattaagaagattataaatgtaaactcagcttgaaactttttgtggcttagaggtaaagcaagaaaataattaagataacaactcacatgctgagggtgtttcatgtgttattattgtggatgttaataacaattttggctctctgtgggaagccatttccttcacttaatcagttggcaaagaaagtacatcagggaagattgttcaccctgagccgagaaagtggagtttcaagtaagaaccctgctccgcatcctgccactgagttgagatcatctatttgatttagctactgataaagtgtttttaattacaaattgtctgcttgcttggggactgacacaaacacttgttttgttttcaaagtgccttctctccccagtgttgggtttggagtagagcaagagtaacacagaggttgcagtcagtgtcttccagcgattttcattttgtttgatatgcggggaacctgatgctgatgaaagggaggaacccaggagctactgactgtgactacagtggatattcacaaaagaaggacctcagtacagttccaagtagtgagaggttgatggattaggacagatttaagtaaaacttaacaggtttaaggtcaaagaaaagtgaagcaacattccagaaggacccagaaaagccgagcaagtcaggcactgagatcttgggattgagaggagttgctggttcagacccagcactgttctggaactttcttttgggtactctttttttgtttcatcgattcctttaaaaggtacaatccagaactgaacatgtcattccacaagtggcccaaccagtgttgtatacactgactggacaggttttgccactaaaatggaataatagtctggttttcctaattccaggaaaggaaaatcaaggaatagatacattttttaaaaaagcatttaaagaatttctcctgtagacattatcttaaacttttggtccctgccattgtatgtgtatcttgaatccaagggtaatacgatacgcagtctggcaaaagcagtcattttaaatgattgagcaatatttagtgactttcaaagagcagagagcacaacttggctaccatagaagctccaccatgatgggcgcagggtttcctctaggctggaagttgtgttctggttatcttgtgagagaaatgcatcctgtgtgatttatgtggattcatttattcttagaggaaatcagacaaaaaccatattgtaaggcccaacccatctaaaaagacaatagaaatgagttctgtgtgtttttcagcagggcctcatgggcaccactcgtaagtccagaatctcttccaagaacaggaagtttctggagggcagtggagaaggggagtgagggctcagctctgtgaggtcgaggtgggtgtgaggaccagcaccagtggggagtgggtttattagctgggaaaggccataaggatgaggaagagaagcttgtgtttgagaggataacagggaggaaaagtcgccgagcccagagtgtgtattcactgcctgtcctttggaggcagccgcttccacctcttttgactgattcttccaactcgtatcctccagtctccaaaacatgattgtggtgcagctgcttgaattttcaaacttgatttccattttagaagttaaggatttgtttttttttccaaccacataccctgtcgctaccacatcaaatacaggtctctcatactgttggtcagctccgttttccgtgttgacctctgatactctgtaaacactcttgacacgtaagctgggtggtttatataccaccattacttttcctgcccagctttgtctttttcttccttgtattttatttgtaaagattccccagctcgtccccagttgtgtcagcctcttttcagtgtgctcagacccattaggtataaggcctatccatgttcctgaggaagtctggcccagagccgtccaggtggtctgacctgggcagggccccgggtctgccatcacccagcccatgctctcctgccgccccactgaagacttccttcacctctcttggacgttagggtttctctttgatggctcctctctttttctgggtttctgatattttctggttgagtggtgctactttcttctaacctatttttatttcattaaataaataggattcactaaatggatttcatacccatgggttgtatgatttgcactttgaaaggcactgggctagatgaccactttgagtgatgctgaggcattgctgggtgacttccttctttccttcttccctcccctcctcctcttccctcccctcctcctcttccctcccctcctcctctttcctcccctcctcctctttcctcatgaagcatgtgcacaggtgcatccctgatgctttgatcaggtatggcctgaaagacaagccattttagttagtttttggatacattacgaagtaatgtgggaagtaagcatcttcacctgtccctcttccctccttggctgagggacagtgtcctagtcagttccatgtgctgtgacagagtaccataggctgggtggcttaaacaaaaaacacttaatgctcacagttttggaggctgggaagtccatgatcaaagtactggcatatctggtctggtggggacctgcttcctggtctgcagatggccgtcaccttgttatatccttacatgatgagagagagagaaagcaagctctgttgtgccttttataagagtactaatttcattcacaagggcgccatcctcatgacctgatcacctcgtaaaggctccaccttccaataccgccatcttggggattaggatttcaacacatgaattttagggggacgcaaacattcagtccctgacagggttaggcactgtgtggctggcaatcaccaggatgcctggagccctgccgggaccacgctggctcatttcagccaccctggatgaatcatccagcctaaggcccatgcctggacattctgggtcctcagtgccttgcctttattttacctgatataatccttcaaacgaaaatgcttgtacttatttttgatcacttaatatacttggccatttaacaatacagattaaacttgtgttattctgttagaaaactgagagattgttttctgtagtctttgactgcatgcatagtctagggctggacttgggaggagaggataatttggccacaataggattccttattatctgtctcttccctcccaacccctcccccgacccccgccccatacaggagaccctcagatacatttctgtcagtaccctcagttacatattttgggagacgtaatacttaatgaaccaaaactctgttttgctggcagggaaaaaaattgggctgatacaatcaagataatcctatcaactttaggattattaggaatgttgataatcctatcaacattctatcaactctgtaatcagaaaaatatatttaaaataatgcgtgtttgttaaaaataaccaaacaaaatacagaaaaaagcaaagtaaaaattgacaatcccctaactccagtgttggtagttagggacagaagaagggtggaggatgtcttttgtctgtgttacatgattacagcaaaagtcactcttcattctggtagagccatagaaatctggccgagcagaggcagctgtgcctgaggagcctgacttcgaatcagctgtgttcatctttgctaacctcccaaagggaggaagctcaggaaaccaccgtagaaccccctaaaaggggagggtggctacagctgagcaggtgggggcaggcaggagtggagagaggcgaggatgatgagtcaggcaggtgagatggaggctttgtaggttatgttaaggctcctagacttagcatttcaagcagggatgtgacctgatcagatttatattttgcttgcattgctgatggacattggttcagtgctcattgtactggaagggtcaagaatagaggcagggacccaaatttagggggcttcccagggaatccaggggagaggtgttgtggcctggactagatttggaacatccagaaggggactggagcaatgacatacctatacctagtcccagagggccccgatctagctaaggacagagcgtgcagtcttgcagctgctgggctgatgacatgctggggagtgtatacctgggaaattctggtacagagataaaggaaatgctcaagcctccacctatgaatttgcccggtgattaaaatcatacttcctaagctttatagaagccctctgtttgtcccacaaagggccactagcacaaggaaatacataatgtgttcccttgtcattttataaaaatgtagactggtgctgcctgctgtgaaaatgccagtcaggttgcttccttcatagtaatcagtggattcttttgtccatttctgagtggaggattagccctctgtttgccccacaaagggccaccagcacgaggaaatacatagtgtgtccccttgtcattttataaaaatgtagactggtgctgcctgctgtgaaaatgccaatcaggttgcttcctttatagtaatgagtggattcttttgtccatttctgagtggaggattcctttccataacgtggtgtatttgcagtgtttctctcagaggaggagtgcctttctggtgtcatctgtcctgttggtggcagagttctgctgctgaattaaacctttgtgtcggccttggccactcttatggctctgctggaggtaaagccagtggagtggccttgtggcatttgctccgagttgttgctcatttttctgagattatcagaggccttagagggaagcattgaggatttcattatgctccgataactatcacgttgtcaataatatggttctgataagagtgatgggggatggtggggttttgtgagttgacagacgtgggtttgagacccagctctccagtcagaagccagcgccaggcctgtttctcttctctgagttttagtgtcctcaggtggaggggaggataatattaataacaccttcctgatgtggctccactgggctggccacgccatgggcacccagcacggggtggctgccctggttcgtgttaaccatcagcagggttggagagctccctccttactggtgttggaggtcattacctggcgggggatgtggtagataaagcaccttttattgtccctacacaaggcaactatggggtaacacaatataagttattcagattagagaaaatatgaactcttgctacagtgttactgcagacaggcacatatggtttgttaggatgacatttaaaaaaagtcattttgagttacagaataaaatcaaacaaaattcctttaatcaccagggctgggatggaaataaggcaaaatgttgattcctttgaaagacaatttttgggttttttttgttttttttaaaaaaactttatgtgttgatggtttactctggtctagtcgttcctactcctattctgaaagcaggccttgaattcctgattgtgtacaggattgtgtacaaacaatcaggaattcatcattcatatgaagaagttctgtttttccctctagtgtcatgaatattttcatgtacgtatatgttatgtgactagtgttaagaatgcatgtattatatatgtgcatgcgtctcatttacattgaatgtagctaaaaggaatatttgaaaagtataccttgcctgtctccaatttctacatttcaagttaaaaatgggaaataatcttagaatccatgcctgtggttcataagcctggctcagctcttgcattcccagctactgtctgacgaaactcacaggagctgtgaaaacaacgctgttttgtgaaagccaagtaggagcttagggtcatggcaaacttcagagaaatgtaaaggagcaggcactgtgggttttgtctaccccacccccccgaccccactgccttccaaaatttctttcttttttttttttttttttttttttgagacagagtctcgctctgtcacccaggctggagtgcagtggcgtgatctggggtcactgcaagctccacctcctgggttcacgccattctcctgcctcagcctcccgagtagctgggactacaggcacccgccaccacgcccggctaattttttttttattttttgtagagacgggatttcactgtgttagcccgtacggtctcgatcttttgacatcgtgatccacctgcctcgacctcccaaagtgctgggattacaggcgtgaaccacaccgcgcccagccccaaaatttctaattgaattttaaccttccacttttaagttctgatcctgatttataaaaacctatgtaattttcttcagctttcagaaggaatgtcttgtatcttcctatgggggtgttgggggaactgatattgacagaggtcctctgacatttcatagcctggcaaatagggtcaaacatgttccagacctcagaggattgctgaggatagctttctacttaagctagataaaagaagttttgggaatcttaccttgcactctgttttgtagaaacaactgtgtttaatatatttctcattactggctgaatgacctgtatgtgttcaggagatctctctatttaccattttaatgccacatatttaatgagcattcaggcccagactgtgaagactctggaaatgagaattttgtttcctatctcctgtgctgtaacaaaagcagcttaaaaattgcagtgtatagacctcaccttttatcatttttttttcagatttttaaatattaatattaagggtctttatctcagatgtttgttgtttaccaggtcatcagtatctggacgctggcagggtccttagcaatggagggagggagagggggtccagcctgcatgattggatcagtgttgaacctgtcccacctgtggggaagaggcagcatgcggagcagacaggtgcctgctgcaggtcaggagagctggccccaagtcctgacttggagggaaatggtacatattaatatcctttagtgccaggtactggcgtagctagtttatatgcatcacttgagcccccttgcatcactggcatcacttcaagatagacaacaaggggaatgcacatcatatccctgttcactggcgttcactggtagggaaactgaggcttaataatgtgcccaggtacacacagctgataagtaaccctgcaccctcgatctcacagcatgacattggaatccacctcattagacagagctcagctgcctattctgtcaaaaatgttgagttgtatcagctgcagtgtctgtagtattcctagacatttctgtgattctcataagtatctttgaaagggggccatttagtttatttctgcatttctcccttatctgccgaaatgcccgcaggctctgggacaagctataaagctctccgtgttatgctgtgttgcaaacccagtgccagtaatgatgcagtgctatttaaagataagaaagcaagctcacagagggagagcgcagcaggatgtttatgttccagaagcataaacacatgacctgtgcccgtcccgtgttcttcgtccatgtccccagagaggccgtggatgggatggtgcaagaaacccatcaggaagcagaattaatccttcctgcgggtggtccctgtgaagaagacacagcggccggtggtgtgacagcccacagctgtcgaaggaagggagaagagagggaccgagggccagcaatagggttttacagctacgtgctaggttgtctcacatctaggaaagagaatgttcatattatatagaaatgggcattttccctgtggcctgatatgaggtatccagaatattcctttaggtattattaagtcataggtttctgttttgatagaaacagcaggtggttcagttagtatttttgttgttgtaatagtagcttagatctcttgtttttgttttctttggccaagacagaaaacattctgccacacacattacttcatgactctggttatatattgagagcagcattaaaaaaaaaaaaaagtccaatttagtccattaggccattcttgcattggtataaagaaacacctgagactaggtaatttataaagaaaagaagtttaattggttcttggctctgcacgctgtactggatgatacaggatgcatgatgctgacatctgctcggctactggggaggcctcaggaagcttctaatcatggtggaagatgaagggggagcaggcatctcacgtggccagagcaggagcaaggggttgggtcacacacttttaaacaaccagatctcatgagaactcaccattgccagaacagcaccaagccatgagggatccacccccatgacccaaacacttcccaccaagccccacctccaacaccggggattattgtcaacatgagatttcggggacaaacatccacactatgtcgtagccttaaggggatcttacctctttgaagcattgtagagttcagagagtaggacattttgtctactgtattttaaaatactaaatgttctgattatgaaagtcagtcctggaaaaaaaaaacaaacaaacctgaaaccatagatgaagataaggaacaaaataaaaattacccacagtctccctcgcgtgtaccgcacagttcatgttttagtgtgtctacacaccatttaatgcaggtggacagactcaggggcaggtgtgccttgctactgctatgtccacagcacctggcagagtccctggtacagcataactgctcagcagttgggtgctgagtaaatattaatacatgtgcatgtggtaccagtcagggcccaacagagggacctcatgcgaggagttgctccacaggtgtggaggatgaaagaacaagttggggcgaccctgagagagcccagagacaagctctgcaggaagcaggcaccaccactgggccaggtgacctgagcccaggagccaagaggatgccctccactgctgatactacctctgcagtgggacgacatcggaccccactgccgatgctgggacggtgcttcccctccccctgaggctctcctaccagggccccctctcatcaggccccagctggaagccaactggaaagggagtcggggaagtttcatttgtgggggtccaagtgccaagggacagacaagggaagggtggatttgcagctaagaagatagtaaataaccagactacgtgacagtctgaagaatcaaatctggaatcaaattctactctgctctaatgtaaccctgtattttactgtgaataatataccgtgggtatcttccttgcttgatagatacagctccacataatttttctcaatgaaacagattctggagtaggcaacgttttcctcttttgtaaaatacaccaaattgtgaggattgaatgagataatgtcaaagtattagtactttaccctagctgattgacagtatccagtgatagtgataataagggtaattactactctagccaattttatcaaacctatggatgtttaaggaattgggttttttttttttctcctttgatgaatactcctgtaaatacatcgttgcctgcttgtctgagtctttctgtgggtttttagaagtggattacttgcagcaaagtctcctctacttaaggctctttgtatattttgcctaattgtgctctagaaatacatcaatttccagtcctccttctctcagaccacctgtccctcacattttcaccagttctgggtcttgttattctttttactctttgtcagtcaggtgattgaaaaatgtacatttttttaaaattggcatttattagtgagcttgaggatgtttttcacagtcatatggaaacagttctgcttcatgaacaagaccttggggccacatactggcttgttcacctggatgcattttctcagtctccctcagaatcatttttctccctgaaaaatgggattaaaagtattaatagtagtgcccatctcacagagtcattgcgaggattaaagagaggatgcatagacgtattgaatcagtgctgggttctggtagatgttcagctagccctagagattattagccatttgatgtgctgatcctcaggaaggtgggcgggagagacctagacgcagaaaaggagctctggagttgaggtttctagagatgaggtggtgcgtggtggcccagtccagcatggctctgggtgtgagcacaacataggcagatgtgtctggggctcagggagtcatttgtggattgagggtgctatgtgggtgtggaccacggtgatccaggatgatgcaggatttgggccggggaggaagatggcaacccaggttccatgccatctttaaagaggggatggttactagggtgtccagcgaccagccaagtggcctatagataataaggaggactcttcatgacatggaggctgaggtggaaagtcccagagtagggttcagccctggccctaaaaagtgccggagaacctgtagcctcctggaagctgtgctgtgtgcagagccaagcttcagtgtgacaaggaatggtgggagcaatttggagaagaatgaagacttggtgcagtggctagggaggcaggcagggtgaggatgtggaagggtgcagagctgctcaaggtcagcttcctgagcctgcggtgtggtcccttgctccacactcagaagggccctgtgtttgatttaatgctcttttcttgccatcttgaaattcttgatagtttttgaacaagggatccatgttttcattttgcgctgggcctggaaattacgttgctggtgctgaggggatgtgcagagcagaggtgggcagagaactgacgagaaggacacgtgggtaagggtgggatgagctggcctcaggactccgagcagagctcatgtaaaggtgtcgggcccaggatgcgttctcaggctggggtgggaggcctgatgatggcagatttctctggattacaaatagaatatgtagcagggtggttcatagctttgtgtgtctgtgtgtgcattggtaaatttttattttgaaactaaaattatttcaaaattagagaaaggctgtgagagtgcggttgagctggtgttggctctggaacagggtttcccaatgcaggcggcactggtaactatgtgccttgggtcattctttgttgtgggggctgtcctgtgccccatgggatgttccctgcacccctggcctctgccttctagatgctggggggcactttccctggtgtaatattaaaaaaaactctccacgttgccacatttggggggcagaatcaccccctccccgaattgagaagctatgttattggaacacagtgtcctgtattttgtctagcctctgctgcttagagctgcctgagcttggagaagatacttgttctctttccaaagcttcactgtccctttctgtacattgtcaggacggctgttaataccactgctctaaatgtgctcagttttgcataaacatcagctaatgttaaaattttaatctctgctaatataagaggcatcgaagtacacgcgagttcagtttgcatatggtgaggagggagacggcctcatatcgtatgtgtgtatttgccgattctatattttgaggttgattcctgttgtcttttgttcagttgtctcattctgttttcttttggggctttgaatgcccttttcatgcctgtgacctctctttactatgccttttcttctctgccagcaaatctcatccattcttccagggcaccttactgtcccccaaagccccagtgactgctctgtccacagggcttggtttctgtgctctggctctgcaatgcaatgcagaaggggctgggctcggaatggggttgctggtcaggccatgtgcccaggggaaggacacaggactcaaggagtccacccctctctcccccccttttttttttggtcactgaaatattttctttccaattctactagtcctgctagagctgccataacaaaatacccaattggtgacttcaacaacagaaattgattccacactgttcttttttttttttttctttttgagatggagtcttgctctgtctcccaggcaggaatgcagtggtgtgatcttggctcactgcaacctctgtttcccaggtttgagcagttctcctgcctcagcctcccgagtagctgggactacaggcacatgcactgtgtctggctactttttatattttttagtagagatggggtttcaccatgttggtcaggccggtctcgaactcctgacctcaagttatctgcctgcctcagcctcccaaagtgctgggattacagacgtgagccacttcgcctggccatgatcccgcacagttctgaaggccagaagccaagatcaggagaccagtggattgtttctcccgaggcctctgttcttggcttgcaggtggccccttgctgtgccctcacatggcctttgccctgcatacatccgaagccccagtgtctctctgtgtgtccaaatttcctcttcttagaaggatgccggtcatattggattagggcccacccgtgtgacctcattttaccttaataacctctttcaagtttctgtctccaaatacagtcacattccaggggctagagcctcaacatggaagttttggagggagacacacttctacccataacaccaatgtcatattaagctttatggaagaatagaccaatatgtggtgggttcaagaatcttttcttagaagaaaagtgaatctgtatatttgatactttatgatttccttatttgctctaagcagttggtaagaatctcagtgtcacttggctgaatgatacactactggtgcctccagacctatgaggagcctaatatttttgtcttggttgaaacaatgcaaatcctgggttttggagatgctcacagccagctgtctgattacgtaaactgaaagtggcagagaggaagcttttgcgtggggaaaacatgaaatatacaagggttcctttaaaacagagtgtacttctgaacatttactgaaggtggagggccctggacacctgatgttatcttatgtggcgttatctgggtcagatttcattgcatttcctgaagaggtaacttggcagtcctgggagaggctggaccttggtgtccaggtggcaggttcataagacacctgtgatttgatgtgagccagtcacagaggaagccatttccagagaggaacaaccgtgtagactgctttcctgggagtcaagttaaaacttctctcctgtgaccttgtcacccggcagtggaaagttacccttggctgcagccacgacttccgcatactcttcagaacttgctctgcccttgagttttccagctttcctttaatgcactaaacctttaatattgtattctcctaaatgagacgtctcgcatttgagcaggtaacactcggtaagactttgcttggtgggggaggaggttttaccttcctgtggcattctgaagctctccacatccacccatagtcatgattgtgttatatgacctcaagatgctggagctgttaattcatctttaacataattgacctgattacttctttcttgaaggattttgttcaaacctcagggtttatttaggaacaagtctaaccaggcctgattggttttcctaagtggagatacagctttgggaaacaaattaagaaaatgaatggattgaaaatgtaggaacaccgtgacagttgtgaatttttcttattgagggaaaaaatgggtatctgtgaatatttctcttacactatatagtgagaaatgacactctgctgtggatggtaatttatttctgtgtaattgcctgagtaaggctttctctgatattgaatactgagtagaactcttaggttatttttggaagaattatggattttctcttaggttttagaatattttttgtttgcctgttaagagaatttgatgaagatttcaatgtaattaaccaaataaaatggcattctgtatcctgggaagggacgatgtctttcagttctaaatcaatgcatcatttacctcctatctctcttgctggccgagccatcaatcctgtttttattaaatgttgttgttattgttttgagacggagtttcactcttgttgcctaggctggagtgcaatggcataatctcggcccactgcaacctccgcctcctgggttcaagcaattctcctgcctcagcctcctgagtagctgggactacaggcatgcgccaccacacctgactaattttagtagttacagggtttctccatgttggtcaggctggtctcgagctcccgacctcaggtgatccgcctgccttggcctcccaaagtgctgggattacaggcgtgagccactgcacccggccgttttttgataaattttaaacttctggtttgaaacttttgtttcctgtgcttaaaaggagacagttaaaagcactctgatttggactgacagaatgttttttagatgttagatagatctagctttgaatatttatttgcagagaagtagcagggaggactaggaatgactttttcttaggaggtgctatgcattccatcaggtgactgacccctttgtgagctgtagtggtcagtcccagcatggcccacacttgttggctgtcttagccatggtggctgtggttggcgggtacccagccaagggttttccatactgggggccttggtccagtgggggcgggtcgtaccatgacccccttctcctgtgatcttgcctcactggcccaggtaaattggtggacgtccttgactcctccacctccaaaaggactttgaactttggcactgttgggagtttaggctacacctcaaccaggcagagattgggatctaacctacttttaaaagccctctacagggaatttcataactttcctgagtgttaggttttggtgattaacagccttgactttttggagcccttcctttgccaaacatgcattcctcaggtgctcacttaaaatgattcttcacaatatgcctatagacgggtctgtctggtacagcatcctggagtggtgtcaagggaaagaaacatgctgcttctgccacagacggaccatgcatgggaagaaactatttgagaatggctctccaaggggctggtcggccttgtctgcccactccctctacctttctttgttctgtttctttctcttcagtgttggtccattttccttttttcactgttgcgtgttagcacatcattactcttatctccatatatttggatgtttcctgcattatggtgagcttcagtaggtcttggatgagttagttgttctcattccaaaatgtaaatttctggtgtttagtaggtgctcagtaaagcttgagaaagatgaaagtgagagcccagaactagtataaaaatacggataccaccatagcatggtaattaaaggggtgattgtgaagatgaggtagctgtgcctggatatgtgtgtgtgtgtgtgtgtgtgtgtgtgtgtgttggctggagaaggcttaccagtggtgctggacatgtcgggtagagtgttaatagtaacttaattgactgaatttggaaataatctatggggttagagagcaaggaggtagctgtgtaagaggatggggtcggtgaggtggggtggtgtgagcaatggagctcaagggctcaaggtgcaggcctggactgatggccactaggaccaccccaatggcttcagggtcaggacaggaagggaatgtgattattgcagcaggtagtagggcagtatgagtgtattattcatatatgtgtgatgaaatggagcatcaaataatatatcccataggatagaaaggcacagtgagtgagtttgggttaaaaattcgatgagataaagtggttgtacctcctatgaaaacaatttaatttcttattatgaaggcattactcatgttcttcagaaaaattaaaaaaaaaaactcagtcattatagacaattgtactcaagatgaaaacaccctgtactgtcgcaaccctgaagcacctctgttaatatgtgtgtgtcttctcacggggtgattcttgatcagagttactgaaacagcaaggcttgggaacaagaggcatgagagcaacactcaggacctgttcagttttctgcacagttccaggtgctcttccagcattgctggctccgagagagtcaaatattcagagcttgcaagctggggaggaaaggggttagggtggagataaagatctgggagatctacagatacggatcatctgcatttggaaattttgtttgcccttctcacacatttccatccaagttttctttggggaagaggggatccctgcagaggagtccagttgcaaatgtgaaatcttaaaaatgtatgtaaatagcatctttcattccgtgatacttgtttgtttgaatagaacattgttaaattttattgtgcttcagaatcatctgggtgcttacaaacatagattgctggactctggttctggagattcggattctggaagtctgaagtggggcttgggaatctccatttcttccaagttgccaggtgatgctgatgctggtagtcgggagtccgtactttgagaaccactcttctacctaccaagacttccaaaaaattggtactctgggaagatgccctgtgccagtcctgtggcttcttaggcacgtcttccagcatagactcctgcagagaacctggtacctgcaagtacctagtacctgcaagtacctgcaagtccagtgtgggaaatctcatgacaggcatcaacattccgtgacggttgacagccacctatggggtggctgatgccttttctgtgtcttcagggttttaggggaaggagagtctaaatgagtggttctaggttgtgggaagagcctggctttgatgttcagacacctggcctcaggctgcatcgcccatacttcctgtggaatggttatcatgagtcctgttgtcctgtaggtgaatcattgattcctgtctttgcataacctctcacttgatgataatttttttttaaaaaaatgactcttggaaacagaacacacagttgtagagggacctacagtacagcagaagctttgtggaaggatacaaaatgtgagggactgtagtcgaagagatttaaattggaagtgggaagagattgacttttttttttttttttttttttaaagacagagtcttgccctgtggtccaggctagagtgcagtggcacaatcttggctcactgcaacctccgcctcccaggttccagcggttctcctgcctcagcctcccgagtagctgggattacatgcatgagccaccaggcccagctaatttttctatttttagtagatatggggtttcaccatgttggccaggctggtctcgcaaactcctgacttcaggtgatctgctttgtgtctcttagggagcatgtttgaagagtcaaaggaaaaccaagtctgttagctttgcgaaacgtttttttttttgagatggagtctcgctctgtcccccaggctggagtgccgtggcgcaatctcggctcactgcaagctctgcctcatgggttcacgctgttctcctgactcagcctcctgagtagctgggagtacaggcgcccgccaccacgcctggcaagtttttctggaatttttagtagagacggggtttcaccatgttagccaggatggtctctatctcctgaccttgtgatctgccctacttggcctccaaaatgctgggattacaggcgtgagtcaccgcacccggcccgaaatattgttaaaaccaagtacctttgtgaaacattgttacaaaaaccaagtaccaagtgtgtggcattaaagtcaaacattaatttcaagttacagaaagaaatagcactgagtagaggttgatcgataaaaaatgaataaaatattcaacagaaactccttaaaaataatgtgagaaatggacatgtgacatgggcgtttaaaaagtctgtaaggccaagaaaagtttcctgaaaggaacactgtgcccaggcagtcctggctttgcaggattccctgataaccgagctcaggcatcctgcagagtgagtactgcccagatagaaccttctgcctctttggggtaaaattcgatttcaaagagagagaactgtggggtgagaaaggaagactgggacccaaggggccaaactagtgacaatgactgctgtcatgaagggtgacaaggacaatacctgctgagctcaaaccaccctttggacccagtgaagctcagatgttgcttccagtgcaggagtagttaagctcaactgttttacaatatccagttatttggctgggtgtgatggctcacacccacactcctagcactttgggaggccaaggtgggtggattgcctgagctcaggagttcgagaccagcctgggcaacatggcaaaaccccatctctactaaaaatacaaaaaattagccagacgtgatggcaggcgcctgtaatcccagctacttgggaggctgaggcacgagaatcgcttgaacccagggaggcggaggttgtagtgatccaagatcatgccgttgcactccagcctgagtgacaagagtgagacttcgtctctaaataaataaataagtagcaaaaacaatccagttattcctcaaatatttatgagcacctcttaatgtttcagatactattgtgacaagagaaaaatgtgtttgtatatgtaaatagaaaaacaaaagtgatgtggaagcgattacttctgtcattttggaactaccttcctcccatattaagtccatattatgacaattcaaaaataatcaaacttcgtaagatattacctgtgaaaggaataagtatttaaaaatgtattttagatggccttttagaaatctagtccatggacacaatctagcatcatgcagttgccttcaaaaagaatatcctaaagttcttgtttgttttctttttcctttcaaagtgttctgttgaaaataacccatttgtcattttagttttgatatgacttagttatacatgccttttgaagcagtacccacccacatagtaattgcgactatcttgtgttttgaaaaaaaaaaaagcgagacaatttgactttgatagttttaagtttaaaaaaaaaaaaaaacgctccaagttagactcagatgaaatcctttgatcttaggtattttatgaggaaactggaaaaaataatttcacaaatttctattttgctttataaaaattttatgattcataacacagggaaaatccagtaagctaaggcgttttttagtcgtttatcttgctagtgagtctttgatgtgagttatttctttgcagtaaggtggcatggatgggtgatgaggctaagctgaaaagttaaatctcataatggacatttgcaccctttaaggaagtaaagctctcaaagcatgattatggccaagatgaggccggtggcatgtttgtctcctaaatgtgcagccaggaatctcgacggtttgtctgaggtatgcaggtgcctggtagataaattagggtgagcatcattcatggcgtgtggtcagttgcaggccttcagccacagggatgacagaagggaagtgaggaatcagggatgggtttgaactgcggcgttgctttgggagtctctagacatgatcagttgcacatggactgttctccttgtcaccctcaggatctactgtcctgtggttgaagcctgcagctctcccaagttggtggcactgggcttcctgacttctcgatgtctaatgagacagtggaattctacttgcagccccactgcaggccaggtttatctctcctctgtcttcccagctggtgatttggtttctcagtgctgttttgggtgcacttttgtggaggattcaagctggtccttagccactccttgaaccagaacctcttttactttcttatgtagttcttctcttcctgtttttatatcctaaaactagtccagcgaccagcccatcgtagtagaagcgttggtgttcttcctaaaaggaattgtaaacatctcttggagagtgggttagccaccataaattgttttgggacttcggatacccccttccgcaaatgctatctagagatgctttaatttcatttcaattggttattgcatccctgatattttgaaactgttatgagtagaaaacattctggtttatgaacaatctgcttttcactatgaaatagatgggaattttaattattcctgcgctttgtcttagagaagttacatgcatgcatcaagtgttgtgtgatcttgtgcagttcttcttagattgagtttttggctcctcgtgtgcaggccttctaaaatcacaatgtccctgagttgggaaggaacatcaggggctatctggttcattatcctaccccccaccgcctcccacgccccacatttctggcagcctacgagtctttggtccctccccagtgctacctggccagctctcagccttgggaggccacctgcccgtgtttgacctgggttaatgaccgccagttcctttcccttaatacgactcatctgctctcctgcatgctcgctccttgggtgagagctgccctctgcaacctcataacggaaaatggcttgacttctgccacctcctcctccttcccatgaaagaatctggtcttttctatctctctattatttttaaaaccagattaggttggttgtggtggctcacacctgtaaaaatcccagcaccttgggaggcagaggtgggcagatctcttgagccccaggagtttgagaccaacttgggcaacatggggaaatctctaccaaaaaaatacaggaaaaaaaaaaaaatagctgggtatggtagcacacacctgtagtcccagctacttgggaggctaaggtgggaggattgcttgagcctgggaggtcaaagctgcagtgagccttaatcactccagtgcactccagccggggcaacagctagaccttgtctcaaaaaaaaaaaaaaaaagaaaaataagaaaaagaaaccagattaaacattcctaagtaattctttttgtgacttttgcctgtttattaactatcctggctacttaaaatgaatttttgagttatgaatacatttagatggttttaaattcaaagaagtctcttttttctcagtcacttccatccccagccaaacagttcttatccccagagtcagccagtgttaccagtttcttgtgtccatgcagtttgctttatgcatttacgtaagcaaatattcgtacacacacacacaccctttctatcttatggaaagttatttcagtggcacatgtaagtatctcagcatctcttgattgtcattctttttggattttttttttaaatttcatacttacaaatgatcatgtatcttaagttttctgaagtagccttggtttcgcattttgactgtatttattatggtatcaggttccatatttcttaaaagtaatactgctgctgcacttacattgaacaagtcaccaagctctgttaattttgcctgaaaaatgccactgctttgacatgatagaaaacacaggcaatagtctttatttctcactgctgtttttttcttattttgaagaatcaccctaatacataggaaaatctcgacttagcaaagagataaatgagactgtaattattgcattgggtttttcacaatgtatgttagttatctattgctacataacaaattagttttagagttagcagcttataaagcaacagatatttattatctcacagtttctgtgggtcagtaaatcaaaagtggcttaactgggtggttctgacatgtgcctttccacagtgactggtatgtagcaggcaagggtctcttatgatcctgagtgaggatgtcagccaaggctgctgtcatctgaaggcttgactggaacagaaggacccatttctaaaatgagtcactcacatggctggaggcaagaggcctcagttccttatcgcagagattgctccttggggctgactgagtgtctgcacatcatagcaacagctggctttccccagagggaatgatccaaaagagaggtggaagcctaatgtctttgtgacctaatctccaaagtcacacactgtcacctcttccatattctattagaaaggagtcactaaatcagatacccatgggaaattacccacctcatgaagaaagaaatatcgagaatttgtggacctgtttcacaaccacacagcatcattttttgaaggtagagtcaccttgagcatttaaattagggttctgctctagaagtctatccctttattttttcccatttgttaaccctttttctacttggcataatagcagccattacccagtagaagttgagagatttaggttgcacagaatcccacagtcttttcagaaactcatatccttagggtgtctgcttgttgacagcattgtagaattgaaacttgaccacgtgttatgtgttgggctgccagtggtgatcagagatgacggtgagtagtccgttgagttagggctgtttgcctctgtcggtgtcatctgggtttgaactggacttgcagtcctggtgggctgctttcatttccaccctgggtctttgttctcaccactcacatcttacgcctctgttccaccgctgtgtaagaggcaactgtgcacacaccttgcctctgccattgactgtaagctcctgagagagagagagaatgtgtctggttcagttttgtggccctcctttttgctagcataatgcattgaacatagtatcattctgcatttttgttgagtgtataattagatggtcaatgtggagaactcagagggattttaggagggggtggcagcaatataaggttgtgggacccaacattaagagagggaaaggtgtagcgggaaggcgttggtgtggggagggagaaagtcaagaggattcaacctggcaagagttggaagtgacaggaaggtgtgtggggtggggacgcaataggacagtgtgtgagattttttaaaaaatgcaggcaggggagggatgagtaggcagagcaccgaggatttttaggacagtggaaatgctctgtatgatactataatgggggatacatgtcattatacatttgtccaaactcaaggagtgtacaacaccaagagtgagccctaaggtaaacgatgggcttcgggtgatttcgatgtgtgaattgtaacagggatactactctggagcaggatgttgatcatgggggaggctgtgagtgtgtcgcggtagggggtacgtaggaaatctccgtgccttctgctcaattttgctgtgaccctaaaactgctctaaaaagagtagtcttaaaaatgcatgaaataggatcctgtctcaggactggggcaagagcaggtagaaatggaaagagtgactgtggctgctgtgtagcaggcacacaatggtcatggtccatatgctggcttagttattttttaaagcaactaaagttaagtaatgtatacgtaacttacatatttatgtggtccaaaaaacgttggtcatctgttttaatgcagagagtgtttaccctaagcctgcaaatgtgatgggtaatagctagaactagaaaagtactttagaatatggaaggtaaatacatgaattaatttaggtaagagtgacaaaacagtggaagtccctgacttagaacttattgtccgcttggacagctggtgtacgtgatcctggggtcacagtggctccctgtgcaggaagaacactatttcccagctcagataccatctttttaggagagtacctgccattgtggaaaataaggataaaggataacaagttacctccttaagacaaagtcataggagaaatggtaaattccagtatcttgagttttgagttggaacttgaaatttattttactacaagaacactgttgatggattatgtattttatagactttgtgggtggctatgggactctagtaactgcttatgcacagtttatatgagtagggctgctggatttccagatgacgctctcgcaactgaaccttcagattaccacctgtttctcagtttggacactattagtgtgctgctgtcacttatggctcgggcaccttatcttgttttatgtcttgatgaagaagtacaaaattcagtgtaaaagaaaaacatatgtaaagcttatagaatcaccccgttacacaataacaatgcagaacaatagattaataacaggaagagatgctgaaacttctcttcagcctagtttctactctgatgtttcttctctgcattgtacagccaatctatgaataatattttcattgtctaagcaaagccaccttagctaaatatttaattctactggagtcataaacagggttcaaaatatcacacatagattttatgaaagtaataaaatgcttcagaaagtacagtggctcagcctggggccactgcatctgataatttggttacacaccttgtcatgtgcttcctaaaagaatgacgatggttgcttatctgtgtttaagcttgtcattttgaggaaacaaagataagacatttttgctgtgtctctaaaatgcatgtgtaaactatttttatagagtaatgcttcagagaggagtaaaatttcctgcaacaggtgcttgtaaacagtaattgctcagtaaaggtcacctcccagctgttgcctacatgttacataagagaaccccttcacgtcttccgtatttgcagctctgtacctttgtgagtcacctaaaaaataactcatagggttgtttttctttctttcttttttttttctttgagacagggtctcactctgtcgcccaggctggagtgcaatggtgcgatcccggctcactgcaacctccgcctcctgggttcaagcgattctcctgcctccattctcctgcctcagcctcctgagtagctgggactactggcatgcatcagcacgtccagctagttttatatttttagtagagacagggttttcaccatgttggtcaggctggtcttgaactcctgacctcaagtgatccacccatcttggcctcccaaagtgctgggattacaggcatgagccaccgtacccggcaggtttgtttttcttatgacaaaatcaagcctggatggtgtcgttaacggtgaagttaaaatttttcttttgctttccttaatatttccgtgtttttttctttttctttttttttttttttttaacaaaagtctggtttctaaaccaaaatatttaatgcttcaaaaggaaaaaaatgtaagtcagtccaaagaaatgattcattttgcagaggtaattactactaacatcaacctttccaggtctttttctatgcagctatatcattgacatttttttaaaaatgagattacattgtactggagggtagactgctataacaacttttggttttggatgggaataaacagaaaaagtctcatctccagttcatttctggggagggtcaggaggtggggggtgcttggctctactcccttcgtatgattttcccttctttatctccaggatcttccccatttcacggagagacatggatgagaatgaaggctgctgagtgggaggggcttatggggccagttttgaagaggcctcataccttttggccacattccattggccagaactttgtcatatgactgcacctaactacaaggaagactgggaaatgtagtcaagttgcatgtccgggtagaaaagggacacttttctgtggaatagctagcatgtttgtaactcaattttataaaccattttgaaacttttcttaaaaaaagcttatttcagacacatttttatatgctggatctgctcacctctccatctctatcttattaaaagttcttgccagaatctctctccaattgttctccctccttctgccctgttccctcacagcagccacagtggttctttcaaagactgaagctacattttatcactcgcctgcttaaaactttacagtgcttctcccccagtggtcgggataatgttcaccctctcctgaagctggcctctgtggtccttgaccccatcaggtcccacggtgccctgcatggactctgccatccttcaccagcttccccccatcaaacggggcttgctgtcagctcttcctgcaactcccagccctgccgcaccactcagccttcttccttcaggcttcagctccagtgtcttttcgccaaagaagcctttcctgatctctcagccataaatgttcctctccccagttgctttttccctctccctctactcagttgctttatttaactgtcatattgtctttggagcacttgccaccatcagaaattatcttgcattatgtatttatagtctgtcttccgcctactagatggtgggttgcttgaggcaggaactctgtcttgtttacatctctatctccagataacgtgtctggcacgtgatgggtactcagtaaatacttgtggaataaagaaatgtcattacaggttctctatgcattaaaattttttagaaatggggtgttgcagccgggcgcagtggctcacgcctgtaatcccagcactttgggagactgaggctggtgtatcacctgaggtcaggagttcaagaccagcttgggcaacatggtgaaaccccatctctactaaaaattcaaaaattagctgggcatggtggcacacacctgtaatctcagctacttgggaggctgacgcagaagaatcacttgaacctgggaggcagaggttgcagtgagctgagatcccgccactgcactccaccttgggtgatagagtaagactctgtctcaaaaaaaagaaaaaaaaaaaagaaatggggtgttgctatgttgcccaggctagagtgcagtagctttccacaggcttgatcgtagcgcactgcagccttgagctcctggactcaagtgatcctcctgcttcagcacctccccgagtaagtggtactataggtacttcaggttttgaagcatgtgtaaaaaatactctagcagggacatcatttgagctgagcaggccatggaggcatcaaatgattagcagtagggtacaacttgttgtgagaaccagaaaagagccttggcctacataacatcctgtgctaaagaaagaaccctgactcccagcctgtgagtgttccagagatgggcagagcagtccctgcagcgcttcagggaacagggaagagcagctaacccctgatgcttctgtaagcactttgggacgccctttgctatagtagggtattgtcttagttatccctgacttgcctggtgttactttacatcccttaatcctttcatgaagactggcaaacacattcagtcctgccaaccttgaaagtaggccatgtttgaaagaacattggcacaaacgagttgcgaacatcttctttaccatattcatgttctttaccgtattatgaggacactgtgcttgccacatgggcagtcttgttttggggatacgtggttggatggacggttgggtggatggaagactcctggaatgtgaagtatctcaaggatgtgtgtccattgcatgaatgtatgtttgatctatgcagctaattgacaaagatccaccatcctgtaccctccatgttttatttttgccctgccattgttctcttcgacattctataatcatcaaggttttcttgccctcacctaggtcttgactaaacatgttgggtaaatgaatttcatattactactttcttgcgccgtcagccattgtgttcttggggactccatcctgagccttttttttttttttgagaccgagtctcaaaaacaatgaaggcaggtgactggtgaggagagttccagccactggattctccctcagtcccctgtgctgtggcccttggtgacccctagatttcagtgcccctgcctgacactggagtccctctgtaaagaagcccctttctagctagctagctgttccatcccgcacacccccacagaagccttttgctgccattagtaagcacgcctctattttctcacctgtgattgatcatgcatgattgagttttgtctattaaagcaattgataagttactaaaatggcaccaaaagaaattagaaaaaaattgttgcaaatgtcagtgaaatcttttaaaaaactgttgtactttagaagtgcctcaagtgactaatggaggcttaggactctgagtggtgtcgcaaggaaccttatgcacagggacactgacattagcctgtactgtcacccaggctggagtgcagtggtgtgatcttggctcactgaaagccccacctcccaggttcagcaattctcctgcctcagcctcctgagtagctgggattacaggcacatgccaccatgtctggctaaattttgtatttttagtagagacagggtttcaccatgttggccaggctggtctcgaactcctgtcctcgtgatccgcctgcctcggcctcccaaagtgctgggattacaggcataagccaccatgcctggcccctgggccattttttattcttactcttaggctaggtttctgcagaccttggttataactgcaggctctacattgataactgctgagtctctaagtcagaccagacgtttctccccatttagtgatacatgttttccatccaattgcttcatagacaccttggacacagtgctctatttcaatttatgttgacagttcatgacccaaactggaaacctgagttatcctggacttctgcctaccaccttctcctaagccatctcacctgtcctaaatgtcgtagcccttatctagttctctaagctgtcatagggtcctgtactgctgggctgcttgttgccttcaatagagcctggagcatattcatgtcggtatttcaaggccccgggcataagagcttcttaggaaatattggaatgaatgaagaaatgatgaataaatgaacaaatgaacagttgattgatttccaagacactttggggtggtttccatttagaatggtttttatttctttttactggaactaaggaattatttttgcttgttgatgccaacattttaaaagcactataattttgaaatgttttaccacattaaattcttttctattgcaggtcacatacaaatatgtcaacttcaaaggaggaattatttgttatatttatgcaaacttgtggcacttggacatttatctagatggttttttgtgtatgattgtgttcttggtacagctggaaaagctaactttaaatggcaggagtaattgatcttaatgacttactttgaattaaacttgtgcttaattaacttggatgttctaagtttctagagtcacagacttttagagctggaatattgctttttgaacttcagtgtaaggaagaattgcttatgctcgaattgatttgttctgtatcccaatactggactgagtagaaatcaattactttaatattggatgagagagtgattgattgaagatcaggtttttaacctctttttttgttctccttctcacagggagagtcccgtattctcagagtaaaagttgtttctggaattgatctcgccaaaaaggacatctttggagccaggtatgttggctttgtttttatttctgtggacttctgaaaaattgacaagcagttttcaaattcaggcacgcatcagaatcacctggaggacttcttaagacaaagctggctgggccccacctgcagggattctgatttaggaagtgatgctggcccagctggttccaggagcacattttgcacagggcttctggacttaccatcacaacagtagttaacagcctgttcttcacatgggctaatttcatgagattagcttctggtgttgtattctcagtagaaaaatacagtgtgggactatggctctgcttattttaatacttcaaaaatatttcaaacttagggaaacataaaagtgtcattttgtttctaggagaactggatattctggacatgtataatctgaattaagagatttggtgatttggggcgaatgtggtgatttctgtggcatttctagaagtaccagcagggaagcagccagatctttctgtgtgtttcagcttttttattttcagtattgcacttggatattcctgtatctttaaatcagcccttttgttcctattggctgtcagcaatgtgttgcatgaagttattggactgggagcagggtgagggtagccgtagagccacctggcactagaatttagccagattttggagaccaaagatcttttgaactttaaacctggaatggacatgagtgatgttctagtccaacttttccattttatggttgacaaagcttgaatccagaaaggttaaactacccgtgcaggtcacgtgggccagtgatgtttgaggagtgacaggaacactcctcctgcctctacccagtacattttcctttgtggcatggtggcctgaaaatactgtgaggtttaacaatgaaggcaggtgactggtgaggagagttccagccactggattctccctcagtcccctgtgctgtggcccttggtgacccctagatttcagtgcccctgcctgacactggagtccctctataaagaagcccctttctagctagctagctgttccatcccgcacacccccacagaagccttttgctgccattagtaagcacgcctctattttctcacctgtgattgatcatgcatgattgagttttgtctattaaagcaattgttaagttactaaaatggcaccaaaagaaattagaaaaaaattgttgcaaatgtcagtgaaatcttttaaaaaactgttgtacttagaagtgcctcaagtgactaatggaggcttaggactctgaatggtgtcacaaggaaccttatgcacagggacactgacatcagcctgtactgctggtaatgtcagagtgaagcaaatcccacctgaaggcactctcttgcttgaccgtgaagtcacactgagtggttcaccatgtgcctgcactcatgcaaggataagccaggtctctaggcatgggcagaaggatccctgcttcccttctcttccctttcagagcaacactttcagccatttccatgagtctgggctcttgttacccagctgaaatactgtttcctgaaactcacaaatttgctctctaccaaagcccaccttatgccctgcctttccatgaagcctgtcaagaaaattccaagaaagaaaatttgatattcctatatcaaagcgtgtgtctttcctctcctaatccctcttagctgccacagtaggtgcaatgtcattttagcttttgcagatgcattacctggtggtttcctagtatttctttcacttgcctcgattgctagattagaaatttactggggacagacatctttttaatatctttctcctactacttaacatatagagcatcaagggaaaaaaaaacaaaaattatcttttaaaaatgtaaacatttgcatgccaaccggtagtggattgtgcccttaggttaaaaatatgtattctcactctttccaatgaaatctgtagtgctgaaggagcaagttggatttagaaaattttggtgatttctttttaagcttgattgggtttttattttgttttatccaaaccctcccattaaaaaaaaaaattgattcacattgtatttctaagccagttaagtagatttaaggttgaatttgtagtggaattaggctccaaatcttagaagagcaaattcgtaccttgaatttttactgtttagataataacaggcagggtcatttctaagggacatggtggaaaggaatattcgtgatattaattagaaagataaatcgtattgtggccaagtggaccaagtgccagaaaatgcatcagaaactctgaatcctgcttctggtcttcattttcctagattgataagtaggcgcacacattcctgctttcctccctcctctgaagtgctgtagttcttcagggacacatttgccagtgggtctgagatgcaagtgtgaggtggcagtgtgggttaatgccatcttggtgtctcactctggagtggcactgcttattgccttaaaattttgccagatgacctgcattctccctccatgctatcttgggcaaatcccttaaaaccactcatgccactgtgtattagtgtacaacaaggataacagtttctttgtaactggcatgtggggaagaaccgcaaagtgacttctgtcggcagcagctctgtcgtgttttaaggtagtagtcaccgggcagaggtttggtagtgtcctctctggcagccaccgtctccttcagagccctgggccactgacatgccttttctccaagtctcttccctgagtattccccgcacctctgtgcctgatcagacacctcattctcccttggcagcaagaaggccgggtaggcattggagcccttgctgtagacaggataatgggtgaaagaggaagaacattttcatgagaggcatttcagagcctttaaagtggtagaaatcctgtagacaatgatgtttttaaaatcagggatttgcatctctgggactccaactcctttgtttccaagggaggttccctgggccacttggcctgaggttgggaaggggtcggtggttgcggggcagaatgtgatgcttggggatgcaggatggtcaggggcgggtgacggtgggaggagtggagcacgtcatctctccttgcccttccgaggtggtgatggaagctgcctacagctccagctcagaggccgggggtttctggggcccttggtgtggggcctctctcctagctggaggtggccccttcccccttgagaggcctgtgcctgaaatgcccttgtccttttcggccgtctcggccccagtccagtacttaggatccaagatcattttcagctccttccagccaagtctcactttattaaaggagctttgtttggagcagattggataaccgagccgcgactccacttgaacatctgagcagttggcccgcgtgggaaacagcaatggcagagaaagatgcttccctttggatcataccttgaggacaaaaaagggcagtcatataatctgtcatctaaactgggacgcttttgtctggaatgaatgcgacattgaatgggacgtccggacataagatgtaaattgagactgcagtcaccctaggtcagagacatccagcctttattatccatatcatggggaaaaaaaaatggaatgtgattttttttccccaaaacagcttaaaaaaaatgctaagtaaaagaaaaaaataaaaagcaccttttaaaaaagcaggcctcacataaaatgccactaagacatcaaaagagaagtaaaaccctgctcaaaacgcccacgtggggcggccacagctcacccttgtgtgcctgtgtcccgtttctgctgtcccctttcccaaggacgtactctgccctaacctcaccctgatctggtgactcctccagtggcccatcctatgttcaccagctgggtcctcatctcctccgccacacaggctgctgctctgtcccccagcagacctctccctgtctctggggtgcccatgacccctgggaagtgctgtgcatagttctgtgagtgaggttgacttgttgttttatgcttagaattgtttctttctcctgaaattagatttttctcctctgatgactaggattctattttatttatttatttttattttccacgacctattatagcacatagcacctaacaggtcctcaggaagtatttaccaacagattgcatgaagtgagcccgttcttcctccctctctccttccctccctttcccaccccttcactggaaactcacagtcactaaatatgccatgaagttgctgccttttgcctttgcctgtgttttcccctctgcctggcatctgctcacatcctttctggcagctgccctctcatctgtcagggcccagtttgggtggcaacactcctgctgaggcccctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccacctcatcaccccagcccaagaggacagaacactgctgcccgcctcatcaccccagcccaagaggacagaacactgctgcccgcctcatcaccccagcccaagaggacagaacactgctgcccgcctcatcaccccagcccaaggggacagaacactgctgcccgcctcatcaccccagcccaaggggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaaggggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaagaggacagaacactgctgcccgcctcatcaccccagcccaaggggacagaacactgctgcccgcctcatcaccccagcccaagaggacagaacactgctgcccgcctcatcaccccagcccaagaggacagaacactgctgcccgcctcatcaccccagcccaaggggacaggacactgctgcccgcctcatcaccccagcccaagaggacagaacactgctgcccacctcatcaccccagcccaaggggacagaacactgctgctcctggggctgtagtgggtgtacaagttccctcctcctacggccccttgtcttagcggacttgggaggctcagaggctccagccctgtcttattggtgtttgcaggtccagaaatcttggcacatgacagttgcctggtaaactgccttgaattcattgagtggaacacaatatggtgtgctgtggcacctgatggccagcctggaggaaggggtacttttttctcattgtcatggaggtcccattggctcttcaagcatctctcccaagcatctaggagaggtgcttatttctcattctcacaaaggctctttgtggaccagcacaggaggcctgcctagggcttggatgaaaaatgagcatagagagaagaggttaagggaagcaagctcaagagtgggctcagagaaaagaatctgggggagtcaatgagatggcaggcaaggaacagtctccatttgatgctgatgtttgtgcagaatgactactttataccgtacagaaggagcacactctcttcttgtggtaggtcccagaaacttctacttgggggtacatgaggcccagctgggattgggcacagaaggtcatggctctgcacctgaccctcaccttaggggtcaggagagagccaaggacacgagtgatgggttagggaggactcaggcaccatggaatactgtggccatccttccatagaggagaggtacaggtggcaaggcaggcaccaggcagccgccgacagggtcaggaaccaaggcaggtccaggaaacagaggccaaaacagcagcaggaacctcaggcttagcagaccactgactcttctggaagtcttttagacgctctgtggtggggcagggacaagtccttggtgtttggccatggtgaagtgtgcagttagggtaggtgagtcgtgctttcttaacacgggggtaaggaaggagggtagagtttcagcagctcctgtttcttgagcacttgctatgtgccagatgtggtttgaactgtttacatgggagctcgttgggtcctcccagcaaagtcctatgtagcaggcactgttgttctttttgcagataaagaaactgaggcaagaaaggtttagtaagttgtagagctaggtattgaaccagggcctaacctcttaacagaagttagttagaggctgttacttgagtgctcacaggttggctggcaatgtgtttggaacccaatgtaatgtcattagattctgcctaaatcttgtgaagaggggatttccatttgataggtaagaaaattgagaagttatcatcagcccgagatcaaacaagggtatagggagtggtgggacctattaagttcagatttatgtgacttctgatgctatgctcagtgatagatctcttcttgaggataaaagtttgagaattagggttcctcgaaaaccctgagatttctttttttgaggggtacctttttgtgttagcagatttaaagagctggccattgtatttgatggtagctgagtaagccttttgaattggagtatcatcaactattactagatttagaataggtatattttgctaagtaagatcttaaagtttttcctttaaacttaggatagctgttcaaatttcaaactcttcttttttcagtaagctggagacatttaaccttttgtcataggcttaaagcagtcattaaacagggtcatttcaatgcaactttttaaacctaactcccctccctttttctctttaattatgatcagtggcttcatttgagcttacctaggatgcatttgagactataaagctgctttcttaaaacttagcaatgttggctgagacaaaccaactgtagaatctcatgctttcataaagaaggttgcaagacattcattcacagttgctcctttattgtgtgtgatgagccattggcatcaaacctgcttgggttgctatcagtttttcttttgagagctggtgacttgcaatttaaaacacacatgggctcaagggtattggagggacatggcagaaagtccttctgctgcctagtgattgagagtgatggggtcctaactctgtgtgaggatagctctttgacacagctcacctcagtcccctttacctaggtttaagttgttagcattttgctgtatttgctccatctctttttttccctgaagtattcagaagtgaattacagacatcatgacgtttagttcctaaatacttcagcccaaacctctaaaaaacaagaacatatttctatataactgtagtactgttctcacaaaattaagactaattgcctaatggactctattacctgatccattatctgaacttccccagctgaccttaaaatgccttttacagctggactgtttaaaccaggattcaattgagaattctgtattgcatttaatcggtgggtctattaagactctcttaacctagaatagtgataaaagctttttactcttggtctctttgcaaactggggacccccagccagcaacaccccacctgggtctcactctaccatgctggggtgccctagctcacctgtgttatagcttgtacctgtgttcagtggttcccgagttcttgcatggcacccaagaagaatgaggatatgctggacattgagggtgaggagggcagagtagaattttactgagcaatggaatagctctcggtggagaggggctgcagtcaggtgcttctctccttcccgtgtggctgggcccagggctttttatgggctcagaataggggaggggcaggctgcaggtagtattggaaaaggcaacatttgattcattaaaaggcattgttcagaaagaatcaatcaggaaagggtgggcagacaggaacagaagttctcgctctggttcgtgggtttcatccgggaccagcagtccagtctttcagccttcaggctgtttttggctcgaaggtggggtttcaccggggacccgcccctatctgcccaggcgtttggctgcttcctatcactatcaatagtccctccccttcaatgacttgtaggaaggttgtttcgcttaccacattccatcgtgtcctggtggcatcatcaatgaatgaacatgttcttttccccatgtttcttgtacgtactgtgtattagaagttggactaaaggcttgatcaaatttgaggcaggaatgggtgaggctacgtgcgactggagggacacaatgactggttctgtcataatcagtgattgaaattgatccctgggtaaatgtgggggcagtctcatccctccactatcaaaaattaacattttttttccccaggtgaccagcaagtaacgaggggaggggctgttttggtactgtatacctgcaaattttaaatattgatttactttacttccaaaggattggaaattttgtttttttctttctttgcccttctttgaaaacattgtacaaagtaaatctccttattttactaatggagaagcttctgaaagaggctgaacatacattgaagtacctttgctcagctgtaagcccttctggatcagaggtcagaccaaagtttgcagacagttggtccctgtggaccagactgaatccacacatgagtttatttggcctgtggagcactgaaacaaaaaaatgcaaatcctgagccaacgtttgggagatcccatattataatacaaatcgagatttccaggtttctggaaggtcttggcaatctagccacactgggcctgcatctgtgcaaggctgcatggctagaggtgtgtgctgggcacacccattaggtgggactgcgcctttctggccactagggaccgtacacctcctgttgttttcatgggggctggtttcccttgctgacacgtggccatgaggtccctcgaggtacaggccggcatttggacttgtcctctgcactgtttctttgttagcatttagaactgacttctcctcttcctcccccattgaggagcagcaccttactctgtgcagagtctgtctgtgatctgcaggctctttgcagagctacatttctctctggaggccttgctgagcagcctccgctgtctagggcattgctgagaatcacaacatcaacactaatggcccttgggccaaaaagtgtttgtcttaaaatccctgcaccaaatagcttgtgcaattactcctgtgagagccccagaggatctaactcttaggctgtttgttctagctgtattccttcccaccccccaaaccgaaatgacattaaaggatagtaactccctcccgcaaatatagataaaaacctctttactccctaacaaccacacaactatttacatttttgtgtttacctcctagtctttaagtatatgaatgcatgcaacgtcctttaaaaatatgtcaatcctagcctccacaccacccagccgaccaggtttcccagagggaagcattggaaatggcagatgggtaaatgcacagagctggcaaatctccatcctgcgggaggcttgctgtgcaatatagccatcgccacaataatggatcttcctaatgatccggaatcactgagcaaagactgtgccatgttcagtatacactaagtgagcatgcagggaatatatgatcagtttacaaacatttccacataagcttttttctctctcccactccagttttggtaaataaaagagcaaactagactgctttctttctctctctcactctccccctgtctccctccctcttcctctctgtccctgtccctctctcctgcctccctcattcactctgtcgtcctctctctctcctcctcctccttccttccttgcttcatttcccccctcatctctttcttcctcaccctttttaaaaagagacaggagtcttgctctgttgcacaggttagagtgcaggggtgcaatcatagctcactgtaacctcaaactcctgagctcaagcagtcctcctgcctcagcctccccagtagctgggagtacaggcacactaccatgcccagctaatttttaaaaatttttatagaggtgttgtcttgctgtgttgcccaggtgggtctcaaactcctgacctcaagtgaccctcccgccttggcctctcaaagtgctggaattacaggtgcaaaccactgtgtccagccagacaggtcacttttctgtaccattccctgatgttgtgagattagtgagagtccctactgtggaaccttgttcacgttgccctgactcctgatgcatggatatttgctgttaccaaagacacctctgctttaccaaatgttttgacagagtggaaggaaaactacaagacttcttgccctcgttttcttcagtctagaatgatgctggggtcactgagtctgtagggcagagaatctgatgtgttttttaggaagcggaaggtgtctgacacatagatgtttgacaaattttgttaatctggtcagagtgcagcctagaaaattaaattaaaaagctgctgaggagtgctggggtcgcattttgacatagatacaaaggcaccaatagggccaaaagtatgaggccagtcctagggctggtgaagtttggatcccctgcctgacattgtgtcctgagcccctggccccttcctgcacctctccctgagccgccggcccctcctcattccttcctctcctttatcttccgctgtctttgcctgtgcccccacgcccgtgccctgaatctggagtctttgtcttagtgcattctgtttgtctcactgtcttcctctgttttccttttcttgcggggaggaagggtagaaagagtgtaagaagctcaagtatgaggaagggaaggttgccaacttgagatgagtcagaaatgaaagcagttctgaatgtgtaagacaatgaggaaaatatttatttaacaaaaattgaactaccaaccaagccttcaggaacacagccagaaggtgctgtgtagggagaggtgtgcattaggatgctggagcgtggctgccggcgtccccaccccaggaggaagggactcgtttctctgaacctttttaatggttctccccattgtagacaggactggctctccaccccatcctcagtgggtgcagctttggggaggccgtgaggctggtgatcttggggcctcctatgcatctgtgttattgaaggtaacaatgtcccttctacccaaaagtcatgcttttaaaaacgcacaatcttgaatccatttgggaaacatctttggaactccagaatgttgtctttctcagatatgtattgccaatgttgtattacttcatttgctaagaaacattgtcatcgactttataaaattattgaataattctatttgggggagaagcctggaagctaagattttaaaggttatttataagttaagtgaactggcaaattcttaaatggtaaataaaacctttcctacatgctataggtagttatctaaatcagggcctaacaagcttttttatttattttcctgtaaaaagccagatactaagtagttgaggctttgcaggactgatggtctctgacatagcactaaagcagccttgggcaatacataaacaaaggggcatgtgtgtgagctgatggtccacgggctgcagtctgccaacctctgatgttataagccattgattttctacaacatatatatttagaactgggagtgtcagtgttattttgtcatggtttccagattaaactctttcatattgctgctggtcggtcaatgacagactaattctgctagcattgactttctgggccagggaatggggttcctagatagtgcagtagctttttatttattttcttttccattcaagggtaacatgcttaaaatacagcgtatgaagcttttggatatccactgtaaattttaaggtctaaaaatgaatgcaattgtgaaatgtttttgccttagagaaaacgctctcactgctttgtgttaataaatgcatgaaaaataatgatgaattaaatgcatacaaacagatgcagacataatttagatgagtgtattgcaattaaaatattgcccactttcgctacggaatattcgttggacttatgaccttagtgtaagtaatgtttaataaggaatctgcaatgtgtaactcctccgtaaattattaaaaggattggcattcctactgtataatatcaacacaagggatagaaaatatgcctggattcttaatgaatgtgtgctaacgttccttctggcataggaatgtgtagtaaatacacttcaagggttgttcgcatttttatccgtcattgttataggcatgttattgtgtgtctcctattgaagaactgattgatcattgttttaagcttctgtgacttttagatgcttaaaactaggcgttcatggtaggaaagtagagaaacatgtggaagaaatactgcgtttcaagtttgggagtggctggtagaaaaatcaaactaggctagtcttacagctttatcgcagttttgttttttttcctagtaggaaaatgatagtattggttgtatattaaaacactctctctgacactgacttgaatcacgtgcgagttcattgagaacagggattttaacttggttaggtgattttaaacattatttagcaaatctggaaaacaaaagagaaattttcaaatatctttcttccacggtggtgtactggctctctggagtgtgatttcatcttctcttattattgcatatgtagtcaagccatcatgttcttgaagtgagacttcacccactagtggggccgtataattcaggatcttttgtttgtccttacatagtttcttggcctggaatgtcaaaatatcagaaactgttctttctctggaatcatctgtctccgtgatggcctcgccatctgtacagtcatccaagctagggaccaaagagtcgtcctttactctctcatccttccggctgctgtgtctggctttcagtgtttgtgtagagcaggggtctccaactcctgtggcgtgttaggaagtgggccgcacagcaggaggtgagccatgggtaggcgggcaaaacttcctctatttacagctgctccccatcattcgcattgctgcctgagctccgctgcctctcggatcagccaccagcattagattctcataggaccatgaaccctattgtggaactttgcatgtgagggatctaggttgcacactccttatgagaatctaacgcctgatgatccgtcactgtcccccatcacccctagatgggaccatctagttgcaggaaaacaagctcggggctcctactgattctatattatgaagagttgtataattatttcatcatctattacaatgtaataataatagaaataaagtgcaccataaatgtaatgcccttgaatcatctccaaaccatccaccccactcctccaacccccaaaccagcctggagaaaaattgtcttccacaaaaccagtccctggtgccaaaaaagttggggaccgttggtgtagaggactcctcaagcagcgtccatatctgccctattctctctattcctccacctaggtatagaattctatctctaagacacagacagaccatgttcctgcctgggcaaacacttcggtgactgtgcattgccctgggtgaacgggggcacagaggtctttgtgacgccctgcaacgcatccctctccgagccgcggtgcgctcttcctcctctgtgccttgccggtgcccagaaccacccccttctccctctttgcacaagtgccttgctctctcctttctcaggccagtgctgctgatctgtctgtgtgacccgggtgcacagtccttggctctgtgcctggccctgtgcaggtctctgtggtggcacttagcacatggcgctaagattctccctgataggccttcagcgccgcaagggccagcaccgagtcctgcacatcctgctctagtcccacatcggcccaggggcgttgagctgaggacagctccctaccccctttctgtgcttggccgactccagcgcccgttcttctgcccctccttggctctgcctccccaccccttggctgaatctctcctcctttcgtgcttgttctccaggtgacttattcaggtccatattttcattacccttgcatttcattaattttctcatttattttattctgtaggtttaggacattctttaaaacatgcaggttctgaattttaataatataaaagtcctctgtgagtgcccatcacattgcttttctgtcctccctacattaaagttagcactgatgcctttatgtttaaggaaagcctcctgcagaggggctctgcccatgtaagttcattagaaggcaggtgtacagcctctgtcacctgaagacctcttaactgtctattccttctctggtctatcgaggtgtattgggggggttacagcaccctctggtggccatattgtcaggtgcatttttgttctagccaaataaaatgataacacaaatcgaatagtcgattggagttctttttcagaggacatcgttaattcacattttgtgtgtttcagcaggtatttaagccattctcgaatagtgacacttatgcagaggagagaatgattttatttaagtaatttctactttttacatagctagttttaaagtagataatacatagtcttaaactttatttcccctttatttctttcttttctgttagagaatttcttaaacttgtagaattatccaaataaaatgccagtcactaaaaaggaataattaaccaatagtgggaaaaaattaaattcttcaaatgaagagtactgtattcatttcatatggtcccagagataaaatgtttaggattcatttttagttttaaatgtttatgaatcagagcttcaacactcttccaggtttctttaagaaaggaatttgtctatctacggattaattaattagcagagcctctctgtgtcaccaagactggagtgcagtggtgcggctgtagctcactacagccttgaactcttgggctcaggcaaccttcccacgttagactcccaaatagctagaccatggtgcatgcaaccatgcccagctaattttttttttcaatttttctgtagatacagggatctcgctatattgcccaggctggtcttgaactcctgaaggcctcaagcgatcctcctgtcgtggcctaagaaaggaattcctcatatagaaaaatattgttatataaatagttgcctatatccatgctgtttatggtaacagctaaggttcatctcaaaagtatttgtatttggctttggaataaaaagaaatttcccctttcatagggttctgagattgtaggagtttttagtatttcaaaaagttaatggaacaatctgtgatgtgaaagagactcagaagaggctagagaggtctttaacacattttttttttgtattgttatcccttccctatagctaactttgtagatgacattgtttttcagactgatgattgtgaccctcaaccatggcagcaacaatttttaatttaaattttttaaaatgcaaggttgggtgattttctctctggatgcttgagttttgtttttgataaaaattctaccaggggcaggggaaagagtccattaagtcttggtgcaagaaacctgggcagattgcctaagtggatatgcatagcaaagaactgaaaacagagtagggggtgctgaaaacacccacagaggaaaatgcggggcggggggtgaatgcatctgctcattttgtaataaagtccttcctttcctttaacatctcttaatgttacaaataccaacaaaaaccatgcatgtcttcagtgggacagaaaatgagggaggcatttagggagaaaaaagtgtcagttgagatgatgttaaaataaagtttattttctttgcagttgcagacattaagatttattctctgggctgttaggacagttcctgcagctctctgtggtgacctgagcattgataccttttttttttttttttttttttgagatggaatcttcctctgtctcccaggctggagtgcagaggcgcaacctcagttcactgcaacctcagcctcccaggtagctgggactacaggcacctgccaccacacccagctaatttttgtatttttagtagagatggagtttcaccatgttgcccagagtggtctcaaactcctgtcctcaagtgatctacccaccttggcctcccaaagtgctgggattacaggcgtgagccactgcgcctggcctgtgccttggtttctcagatatttctgcccctgtagtgttctatgcactatgcagggaggtcctgactgctcagagcttaaattctgcattcctttattttaagtgtttggccaactgcagaggaaggtaccttgaaagatactccctctcctccctcactgctgggtcccctgtcataggagacctggcctgaggaggcttcttcctggtaacctgggttgtcactgggaccacatcttcccataagaataatgcttcaggttgtatgggagaagtgtctgacagcagtaacttcagcacaccctgagaatggcccttatggcagacacaccggacagcagtcactgaagaaatgagggttgccacatggaggttgctgggaggagggtgctaagtgaaggtgctgtataagctgcatgctttttacaagcagttgaagttctgctgtccagcccagagccactgggccaccctataaataagttcctccaaataaaccctgtgccttgtttgttagctctgggtctcttctttggcttcttcaacttggtgctgtccctgttgaagttaatacgggtttggcacaacacaggagtagacggttacctgtaccctgccagctgtccttgctacaaacatttgcccagagagtggcatttgtgccggttcttaaagtgtttcttgagctgcacattaataggccatgtcctctttcaacctgccctctggctaggtagaacaaacactcttcacctgggctctgagccagctgctcacctgcagcacccccctccttggagatagcttttcatgttgcatcttaccgagttgattgagtattcacttcgaagctccatgctgcacgcatgggcctgtaaatagctttttcgtgcacttgtgggtgtcatttcagatcgcttcatcggatttcagttacccaagtttttacttggttcaccgtaagtttgcaaaaaagactttttgttatcctgaacattgcaggtggaaacatgattaattttgaattatttttgtttaacttctaccctctttcctatttacagcctattttgtttattttaacttccgctgttaagacttctaaggccaggcatggtggctcacgcctgtaatcccagcactttgggaggccaaggcgggcggatcatgaggtcaggagatcaaggccatcctggctaacatggtgaaaccccgtctctactaaaaatagagaaaattagccaggcgtggtggcgggtgcctgtagtcccagctactcaggaggctgaggcaggagaatggcgagaacctgggaggtggaggttgcagtgacccgagatcgcgccccattacttaaaggaagtgggcttgtgttttgtggccttaaggatgtaatctgttggtaggagggaatgagggtgtcctggtaggggtgtctggctttagtgtcaccattcttttaggaattgccatgttgtggggtcacgtcttgtaggagaaacgttctgaagtcatgggattctctaccctcctctcctgctcttggtttccaccagcagcctgcttggtgtggttttgaaatggagcagagatggttttgatgagcctcactggaggtgctgctgagattaccgagaggccttgctgggcacctggagtcaatcatgccgggcactagcatccgtcatcttaggaggtagggattattatcctacctcctaagccatccctggagtggtggcttggagaagttttccagagaaaccgatcagttcataaagtttctgtaaaggattaacacagtgtagtccagaaatgtttgttcatgaagtcttggtttttgggtttaagaaagtgttctcctgtctgggcgtggtggctcacgcttgtaatcccagcactttgggaggctgaggtaggcggatcacgtggtcaggagatcgagaccatcctggctaacacggtgaaaccccgtctctactaaaaatacaaaaaattagctgggcatggcggcgggcgcctgtagtcccagctacttgggaggctgaagcaggagaatggcgtgaacgcaggaggtggagcttgcagggagccgagatggcaccactgcactccagcctgggcgacagagcgagactccatctcaaaaaaaaaaaagaaaagaaaagaaagtgttctcctaagtgctgctcaccctttttcccaaacaggacctaaccctgcgagggagggtgaattaggccatttgtttacagtttcatcagcaccaggcgtgcacggcgttagtcatggtccttgctctcaaggcactgtacttgtagcagcagtatggtgcaaatgtgcagctgaacagtgggcacaggttcctggttagcatttagtgccacaggaatgacagggaggtcttaattgtgatcggaccgtgggagctggattaccccagactgtagctcacttccctgtaagcttttggtagggagcttggaattagcaccattagtagaaacagatttcaaagggaatggtacctgttccgtatgaaacactttaaaactcccggtgtccacacgtctttaaaaaagaggcttaaagcagtttcatttcatcaaccccaaactggagaagctatgaatgaccacactgatgaatatgtcctaaaatatatgtatattatataaagtgtaaaaacagacaagcaggaacatactaccagtttctatcacagctacccttaaactatcattggagggcaattaagtgggtacaacctctagctatttggaaatatgtataaaaatgacaaatgcctggttgggtgctgtggctcacgcctgtaatcccaacactttgggaggcctaggcgggtggatcacctgaggtcaggagttcgagaccagcctggccaacatagtgaaaccccatctctactaaaaatacaaaattagccgggtgtggtggtgcatgcctgtaatcccagctactcgggaggctgaggcaggagaaccgcttgaacccaggaggcagaggttgcagtgagccaagatcgcgccattgcactccaggctgggcaaaaagagcaaaactctgtctcaaaaaaaaaaaattaaaattaaaattaaaaagtaaaataaaatgatgaatgcctgtactcttagacccagcactcccagttctgccagttcatgcagcagatacatatgcacacgtacagagaaggatgcaacagatacatatgcacacgcatacagagaaggatacgtatgcacacgcgcacagagaaggatacatatgcacacgcacacagagaaggatacgtatgcacacgggaacagagaaggatgcacaagaacatacattccctagttgacggagtcgcagattagaaacaacagaaaagcgtccattaaacaacagtttgaacctgtgttgagatatcagcatcccttctccttctctcccccactccctctgccctctgcaggttttattctcagcctgattttctccattggatgtcagccctaggctggcatttgcagagagagatggtggctcctgcagagcttacggcctgtattttattgggctgtgttgagttacccctgatgtgagcaggagaatgggatgttctgtaaattggcctctagcccatcgtgaattcatattttttttataatgtgtgagtcacactcccttctgtcttcatttccttttcacactcccagcagatcattctctctattctgattggcattttatacatgaggcagcagaggctgagacctactgtattttgagacactgtagctttatatggcataattaaatcatagtcatcaatcactcttaggaggtaaggattattattggcattttccagatgagaaaaatggaggatgagaaaggttaggcatcttgctgaagtcacagcagacttaagtgccggagttggagctgcattccggtatgcttgcatagactctcttctcatgctcactgcacgccagtcacctggtatgctgaggccctgcctccaggccttctgattcagctggtctgcagccctggcatttccagctcctcaggtgattggaatgaaagccagagctgggagccactggtctacaccaccagtaaatgatcgggttctcacttgatcatttaattaagaatcttggttttctgctttcagtctgagaactcttgttcatgctctcaggcatgtcttcacgcaggaaagtgatctttgaaattaataggtgcttggaaagcctttaagcagcaggcagtggagaaggccactcagtaggaagggccgagcatgaagcctagtgcacaggcttttcaagaccccacggagggtcttcagaaaaatgggtttcctttgtctccgtggcttccagtctttgttggccagcagttgtctgcttcaaatgagctggctctagaggggcctggagaacccagaaaaactttgtgacaacctgacaagtttgtgttaatcttctgggcattggctttctgcacttattgctcactgaatcactgaaccaggcaggtggggtactggagggcaggggatgggtaagaagggcagcctttggaaggaaaatcagcagagggcagggaccggggaagaaggagtaagaagggaaacccttttcttaggttcttataaatcagaagagcaataaagaaaaaatttaaatctaaaaaatacatgattaggatttaaatccagtatgcttcactacatataaacctttgacttaatattttctgtagtagatgaaaataggactttttttgtttcccttctcttcacatggtattgagtttttttgtgttctgaatacgtgttaagattaattatgaaaatcaaattaccagatacttgaaatataaaattagtaatattcaaagacgattaaatgcacgatttccttttctcataaaaaaagaagcagacggaacttgtattctgaaagcaaatatggaaatcacattaaacatcagaaaatcctcaccaccgccccccacccccatgtgcatttcatttctctttggtctgagttcaagggagagagaatatgaatgtgctgctagctcaggaagcttcagttctaactttctaaagagctgggaatgtgcttgagtctctgttatctcttgtttgcatttttcgctactttgcctccatttgatccagggaaaacttcatggtagggatgtgagatgtattttgagggctaaaagaaaggagtttgaacaaaagcaggacagtgttccgaatgtggaagcaaagagtccttccaaggggatgtgcggccaacgcctctgttcagcgatagtccagctgagaccaggacctgtgcctgatgcccaggccaccccacaggacggtcctccagcacctcatttctcctttcatcagacacctcttcactggcctactgggagaaaacggagatgagtgaaaatgtgcatacagaacatagggctcaaagggaccctagcaccagtggtgctcaagcctgtcccagcattagcgtcacctgggagctccaaaaacatattgttgccaagactcagtccaaagcaagtgacttccttggcctggagtgagatgtgggtggccagggtcaggaaccaccgagtgggtccacctctgcagactgggaaacagagtctgggaggctgcttgttccctcaaggacctgaagtgacatggggaggcaggactagccttggggctcctaattctgtcctggcctgtattccagtgtgccgtggggcacgtccaatttgaatctggccccagtacactctcaagccctgtgttgctctggtcccacagcttctgcccttgactttccatataacagcacattggtggccagggctttgcactaacctacctgcctccaacattgtttttgaataatggaagctaagcagatgcatattaatgcctgcattatggagaagactgtctcttcacaagtaatctgtagttgttagtcttgaaagtgggttaattcattgtctttctagagaaaatgattgcatggcctaatagtcttccagttagtctgtgtggcaaggtagaagccaggagtggattcttagctcctgttgagtgctgctgtcctgaatcagagatcttctctcccgggccactttgtcatgagcaggattttgaaccaagaccttttcttcacctgtctcgggggccctcaccgtgggctttgtgatcccctgacagctccaaaagcctttatcctcatccaatatctggtgaacagctgacacctcctgggaatctttaaaattgttctctaaagaaaccattctgctgcaagtacctatttttagactttataaagcccacgtcaggttgtcgctgcctttctctctgtctgctaagcctgctgtttgaaaggcagcaacaggatcttttgtctttaaaagttcagccccagctggtgcattccccacttgaactccatagccctggtgtgctctggggtacgtctcttccaaaacccaaaccacaggcagtgacctttacaccccaggagttgaaataatacacctggaggaagaaaataacttacaaacaatgagcctagagtataaatggctatgttttaaaaccctcgattttccttgggcgtatttaacctgtacagctagactgttgtgagttttgggctctctagggggctgtccaagttcagaacaagtgcatctgctggcagccagcttaaggagttagcagccctcaattccaataacgaacgtgtaaatcagaattcaggtgtgttgaagtggggccttgcacacatcctggtcagcccagggtgatttcctctctggccagtggttttggcttttttcttcacatgaactcgtctgttgtaactaatggtcactgagtgacttcagaggtagtgatagctcatagtgaagcccgtgacccacagcggtgggcacacctcgatcccttctccttttcctccatccccacctttctctccttacttcatcccttcctctttccacattgggtcatccagcagaagtcaagtatcttctatttcatatctttattgaataagagttttacgatccatgttattgaagtaggtaaatggaatctcttatgtggaattctctaaaaaagaatcaaaactccagtcaaaccaaaccaagtattccaaatcgtttttagggaaaaaagatataattagaaaagactggagagggtatgcaaactattaacattatgttagggtggtaggagtataagttatatttgctttttctgaatttctaaattttcttcaattaacatattgttcaaagtatcaaatacatagaaggaagagtgtgcatgcctgttatctagcaaacacacttcatgcaaagaaactctcctaaggaagtatgaagttatattttatccttatctatccaaagagagtgtgtgtgtgtcatatacctaaagaattagttattaagatgaagcattgcttataatgaaaaagttgaagcaccctaaattagcttaataatggtatatctttataatggaatagtataaagccattagaaatgatgttacagataagtatttaatgttatggaaacattttataacatagaatgaaaagtaaattgtagattggtttgtataatttgatctcatcttaggaaacacataatacagaaatatagatgaaggtctgaagggtattaatgccctaatgtattagtagcattacctcagagaagcaggctcatgagtgtttattttcttttcttctaactaagtatgtatatgtgtaagtgtgtctgtatacaggagatgtacatacacttttcttgtgaagaatctgtattgcatttactactggaagggtttattttagatttagatattaaagttacctctttgagtgagaacctatgatttatacttcttagcttaccttttacctccattatttaaatctgtctttttctgccatcaaatagaagatgtaacagtgataaaaaggctgggtatggtggcttacacctaaaatcccagcactttaggaggccaggggttcgagaccatcctgaacatagcgagtgacgtagtgagaccccatacctacagatttttaaaaggttagccagacgtggtggtgtgtgcctgtagccccagctactcaggaagctgaggtgggaggattgcttgagcccaggaggtcaaggctgcagtgagtcatgaatacaccactgcccttcattcagcctgggtggcagagtgagactctgtctctaaaagtataatattttaagaaagaaaaaacaaaaactagtgataaaaagaacttacaacaaactgatttttaagtggactgttgataattataagggctgagatttttaattgccatttgtatcaatgaataacccccctgtcaccacattttctggtgtgtttggtgtgtctggttcctataggagagacagtaatgctatttgacatgctttattgctgattagaagcctaatctctgtaatgggaagctcagtaatgaagcttgttcagaattgtgttacagtcggttaatgaagctctgagatcaagggcctggcttttgatggcccctatttcagaatccagaggtttgtttctatttatttgggttttgcaggtaagttccctggactgaggtgatctgaaggttagctctgctataataggtaaattgctaagaaaaacattggccttggtatgtacaacttaaaattttattggtgagatagtcttcttacaaaacaatcacgttaagctagaacttggtgtataaccagcatatatactcctgccaccctcagtgtgtagccaaagttctaaattgcatgcacagataacaggcatataattggtgatttcagaaaagttatacctggtgggcagtgagaggcgagccctgatctgggaaaccccagtgcttcaaggggaagcaatctgggaaactccaatgctgggattgggattcaatctgggaaaccccattgctgacaaggtacatggtacaagcttgataaaaacttgcttaatgtcacacttgtaatcccaacactttgggaggctgaggcagctggattacttgagttcaggagtttgagaccagtctgggtaacacggtgaaactccatctctacaaaaaatacaaaaattagcctggtgtggtggcatgcacctgtagtcccagctgctcgggaggctgaggtgggagaatagcttgaatacaagagttggaggttgcagtgagctgagattgcaccattgcactccagcctgagctacagaaaataataataatttaaaaaaacttaatgatgatagcatttgagttggcttttcaatcctggtttcctaaatatgtgagcctggaccattaaactgtgtgacaaggagctgtcatcttaacatacagacattaaatgcattgttcaagatcagaaatgatttcttggttctgaggcactattgactgtgtgtaaggtgccatcgttaatttggtaacaaggggagacagtggcagggaagttccttttgcctgtcttgtgataggcttcctattttctcaaaggttaagatattaaattgtcttaagcaaagaaggtatttaagggcatcatcagggttagttctcaggtctcctgactcctagcttctctagtttagtgattcacgttagcctttcaacagtttaccactcactttaatggtttttcctagctgtcttgacatgcttttcactgcttacatggttagtttcctacctagctgaatgcaggcatctgtgctgtctgctgggttcgctggtggtgatgcagcccacaggtacctgtctctttgaggggagttcagcaaccatctatttatgtcgaaaggcactgtactgggagatgaagaacacggagttctaggcctccaggaatttatcatcacttgctaatttgagctgagcctggcacttgaacataggccatagatttccagatgtgaaaaaaagaaagaaagaaagaaaaggatcctttaatgtatagacttgtctttctgcctgctttcttcacttctgatcattttaaacaattgatatcctagtttgatgtgatcatgttccaacacagcacaacagcatgtatggtttggggcatgcacctgtggcagttgcaaaggtttttacagtgaagtggctaagaggagagtaagaccagtgtatagggtgtggatgaggtcagatgcgagactatttcttgatttgagtcattttatttaggagctatttctttggaatactttatatatgagaatgtacatctgattggaagacagaaggtactgaaatttacctcttgatcaaattattctggtataaaattaaactaaataccaatcatatacttaatttcacagacttgcaaataatatactggggtaatggaagtaagagacaggaccttttatgtggtatgaagttctgtgataattcctatcttcctttgtacctaaaagaggcaccctctcctgtcatactgcaaacagatgccactactacgtgtagacacatttgccagctgtggcacagctggtcacccagccctcatcacagctgcctgtaaaacccagatttattctcttccccctgatcttttttagaaattactggtatcgttttagagagtatccaacttacacacaccacttaaataatgaattttccaatttcttctttttccacggccttcacgtcatctggtaaatattcccctcaggttggcatctgcttctgagaccctgctggacctagatatattcaccagagatgggtgaaggctttggaagagtgaagtggttaggaacatttcttccgatatctcctgctcattgtttttgacctctctgatttccagtatattctctgctccagccacacagctttcctgaacagctaagtcttgctcaccggtcagggaccagctcaaaggctgtccctttttaaatttatttcctgggtcttctcctggcctcttccctgcactcggtggagatgcctgccccatggttttcagtagcgttggctcttagctgttccgttctggggaaggattggttgttttccttttctccatgtgtgttgtgaatttcattctgtgtcaccgcatcacgcgaggtgggtagggaagagaacttttacgctccccgctgtcgttagtggcctgattacgagtctgtgggaaagaatgaaggttggaaagaagatctggtgggaaagaacaagggttgtccttgagcagccaaactaagctgtgagaatgttaatgtaataaagcaggaattctaatgggctgcctgctacagaggagatgggagatggtgtagggctcatgactgtaaaagcaggagccaccagcagatggtgatgcggcctcttggcccaggtgggactctgcatctccccctcccatggacattcacttgataagtgttgggccggtcacccatgccctggtcgttcttatcttatcgaagagtgctaatataagtaagctgtaaattcccattgtaagaaataattgccttttaaaagggagcattcaagaaaaagaccttttggctcaataaagcctttattttcctcaacactcttggctcttaaaaggggcctgttcttggccttgaagtgggaatttacacagaactttaaacagaagaaaccccctctgccttgggctgcaacttgttgtccctggcagggtttgggctgtggggtcatgggatctgtttgtttgaccgttgtatgcaaaaatgattttaaaattggcctccctaatctgttggagacattagttaaaaaaaaaatgagagtaaagaggaaaatattttgctattgggtatgcactggatccatttttaaactgagagaaggtgaaaggggtgactggttgatttcggataatacttttagagccacggggaactgtgaaagacaagaaaatgtaaaaaaagcacattgattgcaggaccggtggtccaaaagcagcacgtgaaagaggtttcaaggctgtttctacaaacaagaatgccaaaggtggcataggacaagaagcttgctggatgtcacgaagctagtggagatgggatccaaagctagttttggctgatgaaaatacaggctcatgccctgtatgtgaggacagtgggacagtaatttaaacagaagtatctagaggagtttccttattgccttgaatgtatttctttttaacattgctatggacatttaggaaaagatgccactgatattccaaaaggggcattccatacacctgagagggatccctgaggctccagggtcacctgggccaagccaggtatacacacgtctcatggcaagttggctgttatcataacttccctggtgttgttttgttgcaagggcagcattgtggggctgtggtttgaattgcttttttgtgtctcttgaatacacgaagttcctcctatagtcattggctctgctgcctctgatgaggcacttccgtgttccccacatttgaatttgctcccgattcgagagaggcaggcatccgcggcagcagcttccaacccagacaggcttaagccgcgcgagggtgcccgggtgggtggctgcgcagggccctacctgggcgggagcggctgcagagccctgtccacgcggtgcctccccagcacggcacctcccactccaggctgttggttacctggccgggagctggcggagaccaggatttctcctcgccgccgttgctgttgttaggggaaacagaccatctgcatctagacctgcctctctctccgctccccacttcagacgagctcttcctgcctggaatctggtaagtgccaccgaaggttccgttccctttattactcgattagtgcccacagcatcaggagaaggttctcttaccgtgaatccattagctttaacccaaatgtgcaggattagggggattatttgaacttgcttgctttctttttaaaatgtccattagacattttttgcatgcttcaaaatcaaaaggcggcacagtgaaaacattttaattatttatgtatttaacctgtatcatcttgtttctaacctcttttcttcagggtggtgcagtcaaaaattacacagatattgctctggtgcctctccccccttttatgaataaattactgcatttgtcatcactgtgttcctgaaatgtcaaaaatagacactgtaaaggaatctgtcatgcagagttcagaaattttcaaatttctgagttcaaaacctcaggtgaagcgaggacagatcttttatttaaaatttgattctttgtaggcttcactgtgaaataagttcaatttagagcatagctaatgcaatcagccagctcgtgatgggacaacatacttctctattgttttacattcacctcctgggatacacacactttctcatttgttttataacctttacaggaaatacctggggatgagtcacatgacccctaacttgagtttttacatgtattcacccagattaaatgattttgctcttatatggataaacgtgcagttaggaactttaaaaaattgtaaatgaggtgcataatcattactcattgtcttttactgcattcttcagccctcaaacatacaaactgttattccctttaagagaaaataaaactggcacttatgttttcctttactctaagttaaagactacccatgttatgtgccattaaaaaagatgtagaaattaatctgtctttttctttgacctaatcttactagcagggatattggggctctacttttctgttctctctctctctttttttttttttttttttttttttttaacatcagccacaggtaatactctccggtaaacatataacttgaggaaaattgaattaggttaatgctggaatagaaaaccagggcagtgcctgctctttttggataattctgtataaacaatgagaaagtctcaggctgccttagacaaaggctgagacgggagctcctgatgatttttatgagggggaagaggagatggtgaggaggagggcaccgagcatgtgcagcaacttgaagcatgtcagaaagaacatttgccagaaatcttcaaaaccgtggcggtcggtaatgtgtgaaattgaacttctgaccctgtttgcttgatggcgacttctcgttgtgcttgagaattgtgtggcattgggtccctggatgtgggaggaacagcaaagtggtttagtgaatagagagggaagtgccttcctttttgggtgggacttgccatgatagagcctgggccgtcaccttaaaaggagatgtttctgttgagagatggaaaattggcaagacaaacgccataaaccttaacctgtttataattccttacctgtaagctgctttgcacgcaaggtgatggttctacctcataagggacaaggaagaacagcacataaacctgactgaatggagtgtggctgtgggtgggagcagctttacaagaaggaaacggggccccctcctgagacacccccgtttgcttctgctccttccttgccattgacgtgcccttctcctgaaactacccacacctgtgtttggcaacaagcggctgccccttgatccagatgcatttttcaacttgcgaactctcacctcttgccaagggacccaagtacctggttaatgatctttaatgtaaatgatcctttgccttgattaacattgagctgggttagtatgcacaggccgagctccgtggtcctcccatgtgatcccttccctgccagccacctgcccacctgtaggaactgggcatggccagttttctctttatgtgctctctttgccttggatggaatttgggctgagaccgatgaggtggaaccaaagctgttcagcagaagagagcaaccacagagcagcctgttgggtggagggcttgagggttcctaaaatccgaggactttctggtgagcctctcccctgagcctgcttgagggaaggcgctgccccacacactctccagtgggtgggggtgggggtggcagcggctgatcaaaggttctcacctgcaagtgataatagcctgggtctctttggcaccaacctgccttcttcacctttctgctcagacaccccttggcacccctacataaaggaaagagctgtctggatggcctagtaactgtaggataggtaaagttagccctttcttctgacctagatatgtgatggtggtatttctacatgtttatgtcgagaactttacaaagatgaaagaaaagctttcagagctgcagaaatgagaggtggcccttttttaaaatttattttaagaaacaacttttaaaaccactttttgaaaaattggatggcaccgtcctgcagcctatcagatttcccttgagaactggggattattggcttattccttgctacctccaatcccaaattaagcagagtgacatgtaagaagctggggacatcagcctaaagcgtttatcaggtatgtccttcccaactggatcttttctactccctggcccgaattttgttttagggaatggggcctattttaattgctggtggcaaaaggatccctgggcagtgtttccatggtcctctaaggtggagtgtcggggagctgggggacacacagtggtcatgggttatctgtcttggcctctttcccagaccaagttctgtctcatgcttattggtttggctgctagttatagaatctgatgtttaccttagaatcctaggatggaaagggttaagaatgatttctaatttgaattccttgtttctagggagttattaaacctatacattacatttattattttacaaagcactaattcataatagttgacaggaacaactattttttggcttctttgtttttttgtttgtttgtttgagatggagtttcactctgtcacccaggtctggagtgcagtggcgcaatctccgctcacagcaacctctacctcccaggttcaagcaattctcctgcctcagcctcccaagtagctgggattacaggtgctagctaatgtttgtatttttagtagagacggggttttgccatgttggccaggctggtctcgaactcctgacctcaggtgatccgcctgcctcggtctcccaaagtgctgggattacaggcatgagccaccacgtccggccttctttggttttcatattgattatattttctaagacaaatactcatttatatagtctaataaaaattgttaaatctaattaaacaactaataaaaatagttgtttaatccacgttgacatcttcttacattgcgatagaaattttgatatatttatccatatgatgaattgcttaaagccggtggttctcaaccagtggcagttttgccttctctcccacaagggacatttgacactatctggggacatttttcattgtcatattcaagggagtggggtgtgaagctggcaagcatctagtgtgtagaggcctgggtgctgctccactttctacattgcacaggatggcacctgacacacagcctaaagcgtcggtactggttgaccgtatacgaaatgctgtggaagaccaggcacggtggctcacgcttgtaatcccggcactttaggaggctggggcatgaggattgcttgagcccagcagtttgagaccatgtttaagtttaagttcatttaagttctctgaagtggtgattctgatgctatatagatgaaggttggtttgttgaagagctgactctggtatttcatccaacatctgcatttttctttagctaaggatgccttgagaaacattctagtctcttaggcctgaatttgttattagcttaatagctttcctctggttgaatttaaatggaaagaaaattgcatcttgcaacaggaaaaagaacattagggaaaaactgaggaaatggaaataaagtgtggaattttgttaataataaatcaaccttgatgcattaattgtgagacatgtcctgaaccaatgtagatcttaataataggggaaactggcttcagggtacgtggggactctatcttatctttataataattctctaagtctgaaacaaaaaagtttattaaaaaagcacaaacaaaattgctgccattttgttaacagatatagtagtcaatcttactgttttctttttctttgaaataggctgctgcaaaggtatgttctttgttatctcggctctctgctcagggtagccatgaaatggctcttttaaaaatgtgcccagataattttgaaccatttcaaaccatattatgtgattttaatttattttccattgcattcactaactcatttctgggtgatgtatttaaaagactagacagaatttacaggtttaaaaagttacattaacagaaaatgtaggtgccagttgaaatactgtcaactggaagtgctaccagcaatgtgctagctggacaatgggacttgtcccatttttttgctgggtgacagctatcactgcctcagggaggctggtgccatttaatgcctctgataatcagaataagtaattgtggcttctgggtctgtaaagccacaaaatacatatgcaggcctattttaattgacggtaagtcatgaaatacactattttcgtattaagataacgtggatatgttatggaacaaagttaaaaattagcatgaatttttaaagtactactggagattgttggctttaggttcgtgaaccccattcctgcccccacactcctgttagtggggctaccagaggggccagtatgaaaagcactggacttacagatgaaagaacttgagctggaatcaattcgagtcacttaccttcgctacaggtgggcagaggagtcatcctgcaattttgttgtgaaaacagaatgagataatataaaatgtatttgaatacagtgaggtctgtacagatgctgaatctattactttgcagtaggagtcaggtgtggccccacttccccaccttcttacctacttgtatcttagatcttatatatattgatattcacttttggtggactaaggttgtctttgttgcaaacctggactctcttgtattcttgctcagtgtgtgtatgttaatgttagataaagaagattaggctggtgcattggctcacgcctgtaatcccagcactttgggaggccaaggcgggcagatcacttgaggtcaggagttcgaggccaccctggccaacgtggtgaaaccccatctctactaaaaatacaaaaattagccaggcatggtggtgcctgcctgtaatcccagctacttgggaagctgaggcaggagaattgcttgaacccaggaagcagaggttgcagtgagccgagatcacgccactgtactccagcttgggtgacagagtgtgatcctgtctcaaaaaaaaaaagcagaagattatttggaaagctatttttaaattattcttcaaacatatactaaaatagagaagacaacatgagagccaacagcataatgaaaccccatcactcagcctcaaccgttgttaacagtttactatctttattgctactgaaggcagttaaatatttcttggcagtccttttttatttagcatataccatcagggatgacaatagaaacaggtttcaaagtcaggtgaaataatgtttctctatatgagttcaccactaacttgatacacagtttatgtttatgtttatgttcttattacgttcgtgtattaaggcaacctttcatccctgccccctaataggtaactgtctttatttgttctgggattatccctcctccattgccctttttggaaagagtatggatatatttgtattttctcttactcataaagcagcacatggtacatactgttctgagccctggttttctttttttcacttagcgttgtatactggaactcactcaatgtcagtatacagagaattcccttgtctttttataactctgtgctatacgctgacggaagttcattcagtcagtcccctattgatggacacttgagttattctcagacttgtccattgttttgcaaaaatagccctgggcatatgtcatttggtatttttgtcgaggcattccaataaaaataagtaaattcttcctctcttgccttgaagatgtgcagctcctcagtaaccttttattctctaaagctctgtcctcatctttaatccctgatttaagaggtgcagctcttcaggccataaacctttcttcctgcctcaagtttttaaagctacaaaggaacctaagagatcccttgtgttttacagctaaaggacctgagagcaggaaacaaagggagagccggaagcccaggtctcctgttccctgcctggcaggtgatattctttctgttaaactctctttccctctgcctattattggccaggctgtcctccaggacagtgcttgccaaagtgtggtccatgggcagcagcatccccggagctcatcagcaatgtaagatgtcaggccctgccccagaggggctgagatagaatctaccaattactggattccctgggtgactcatgcagtcaggttggagaagcgctggactggtggctttctccagaggagcatgcaacagcggtttgcaaacagggatgatgcagttccttttcaacacgtggatttgcacttcctcctggtgcgctcctccagcctgcctgtcctgttcacaccagcctccccctggaaggggttcagacttgatcctttgggtggtagggtctttcttggatagcgtagccatccattcctgctgcatacattcaacacagccttcatccttcgccatttgtctctgatacttcatactccttttgtttgacaagtgccctagctttatttattttctcatcattgttgttaagggcctattgtgcttgctagtatacacaccactatgtaagttactagttcaatttatttgttttactgctgctgtgaggtgtgtccatgtgtgcacatctacctgtgttaataactgataatattgggcctcagtacatactttttttttttaagagacaaggttttacttcgtcacccaggctgaaggactgagacacacttgtagctcactgcagccttgagctcctggacccaagtgatcctcccaccttaacctcctgagtagctgggactacaggcacacaccaccacaccaactaatttttttattttttgtagagacggattcttactgtgttgcccaggctggtctagaactcctggcttcaagccatcctaccacctcagccttccaaagtgctgggatgataggtgtaagccgccgcacctggccctcagtgcatacttagatatacttaaataaaaacttaattgcaaattacttcttaaattatccacaaactgacttggcagtaaaagtgactacaagtagtgaaaccactgtcataataaaaataaaataaaagtctttattgttagatttagtatttctaatctcttacatttcagttttggaaggtaaatttttgggaagtggtggtaataatctaagtatgtctagattcagtgatgagagctagtacactgtaggaaagagttgagcataacaatatggaatgttggtaaatgtataggggttttctttttaaagacagctttttatacaaagaaacagatgatctttttttttttttctaaactatgttagctatacccaaattagtaaatgttaaaataaccatgactggtaaaaacattttgcaattttttttttttttactttttatataattaaatgaaattctccatttggtagttgatctctcagacaaattaagtcttgccagactgtctgagaagactagtgaatcagaccctaaaaacttgtagcatttgaaaaataacaactgtgtactgcaatttataagggcataattagagaaagtttttcagtctgaagatttatactaatcttatcaccctggttttagagaacccagttcaatccaactgctgtgaaaaagccactgcttttagccacagaaaataaccagtttcatagaatgacttataataaaaaattcaaccattttgactccaaaaacctagctggccgggcgtggtggctgacgcctgtaatcccagcactttgtgaggccaaggcgggcagatcatttgtggccaggagtttgagacctgcctggccaacatggtgagacccccgtctctactaaaagtacaaaaattacccagacgtggtggtgtgcacctgtaatcccagttactcgggaggctgaagcaggagaattgcttgaacctgggaagcggaggttgcagtcagccaagattgcaccactgcactacagcctgggcaacagagtgagactccttctcaaaaaaaaaaatgcctagctgactttatcatagatctgtctgtaccttgtaggcacaaatatatttacaaaataattaatggtgatttacttattcacaataagcagttattttgcttttggtgtatatgtgacaaggtggttatgtggagtacataaaggagtaaagtaagtccgttgacttcaagatgcttacagtctaatagaaaccttgaaatttccactgggcaaggttttcttgggattgctccaaccaaatgaatgagcaggcgtctaagtaaatgaaaatcactctcatcactttccttcacattatgttaactggtgacaggtcatgacgcatgggaattgcttatgtttctgagctttagtcttataaaaataagtttagatagtccatcatgttcttcacattagacactcattacataaaaggttttatatgtattgtagatctttctgaaggtcatctatgtgaatgtttaaaaaagaagcaagaaggtgctataaaaagcactagaggtcaaatggtttgcgagacaaaatgaaactctccagctctgaaatccaacagagtatgatgaagaaagggaaaaaatagatcaaaaaatggcaggggaggaactcggcatcaaaccagtgataaagcagaatgtggatcagatccagacatccagtagtctgtgagcatctccatatgggatgtttgggttgagagttcaacccatcaaatacattttatccataaccataagatattctaagatcgaccaagtagagtaagcaatgtagaatcaaaggtatcatctttattatgtcctatttgtgtttcctgcttttgaggttcttagtccttttaattaactcctaatgaactaatatagttttgtggtcaccagcttctagctagcacaggcacagttgtgggttggtaggagaatgagcagtaaagccatgagctaacacaccaagtaatctgttgtgttcacaaatgtccaagagaataacaagagattaaagaaaggtaaatacagccacctggcaaaaatatttacccttttaaaaatgatggaagttatatatagaagaaatgtttttggtaaaaatatttgaaagtttgttttataatcataagtagcttgggctattttgactagaggggtgtgtgtgtatgtgtgtgtgtgtgtgtgtgtggttggcagggagagaaggagggaggcaggcagctggtagggactgtggagtgtgtcagttgggagagggaaatgagatgattaagttagtaagaatagaaaacatgtaggaaggcggatcttgaaatttcagggctattcattagtcattagttgaagatttcacagagaaatggtagaaaccaccagtaattaagaaatagcattattgtttaaaaaaaaaaaaactcccaaaccctttccctggcattctggtagaatatagttttggtctaacccaggtcccctctcatttcctttcacatccccttggttctagccacgctagactgtctgggttgtctgtatatgttctgatgtttgttttcctctgtgctgttcttctggcctcagaatcctagtgtccttgtgcctccttctgcatatgtctggactttgcttagctgatgagatccagttcagataccaccttctgtacaatggcttccttaattcctttaatttctcttaattgcaataaagctatttgcagaggaatgaaagatgctcccctttgcgctgggtacaggatgcactgaaactttcagcatggggcgcggtggctcatccctgtaatcccagcactttgggaggccgaggcaggcggatcacctgaggtcaggagttcgggaccagcctgaccaacgtggcgaaaccctgtctctactaaaaatacaaaaattagccaggcatggtggtatatgcctataattccagctacttgggaggctgaggaaggagaatctattgaacccaggagacagaggttgcagtgagctgagatcgcaccactgcactccagcctgggtgacatagcgagactccatctcaaaacaacaacaacagcaacaacaacaaaaacccaaactttcagcaggagagtagcttggttcagcccagcaacatcggtttgaagattatatcaagttttccagtcaaatgtaaccagtttatggatctgtgtttgcacggggtctgaacctcccctcctcaggtataagctcttggaggacagcctgctgcttaaggtacaggagaattcatctttgctggacatggtaacgtatgcatagagatctggcaacagaacttaagatatgtgggagaaataataggcaaaaactggaaagagcacaagtaagagaagagaaatccgcagaagtgagaagtaacagaattgctggctgaggttggaggcatttaagtgtgtgggtgtttgtgggaggcatggtggtctcctgttccttgacctcattgggcaaatattacagcacgaacatacaggtaggaatcaattgcatccccacctgggcaccttcatcggcagttggggtacaccacttgctacagtgtgatggaataagggacgatccaaaggcactcagttctcccacccatcctgtgcacaaggaaaagacctttgaattgtgtctcccctgttgtcctttgcattgtgaaagtgcatattagttctcccatccactcttttctctttaagctttagcatacggttgtttgccaagaatggaatcagatagaatattttcaccaggaagtgaaatttaaagtgcttgaaaaagatacaaggatatctggaagttccagccggcgccattttatattttaaccatgacaagtagctgtatatcacggaactttggaaaacagagattgttccatttatttttcacagatgaaaaccagagtgctgtgtggggatcaggaagagggaaatcaaccaaataccttattttagagatttttttttttttctgggaaattggaaacagcgcttgtttatagccaatgcagcgtccttgaaactctcctacttacagttctggagctgtagtttcctccctgaagaatgggttaaggcaggcagggtaatatgcatagatgggagtgagagtggatggcctacagggttgttaacctctaagtgcaacaggaatatatgaaggtacttgggctggtggtcctgtgcagaaccagccagtaggttctaagagacttgatagccgagggtccctgggccctgttccacctttttaaaatttctatgacttagtagcggcagtaccatgcccatcccccagtgatgtttggggtacagctgcacccttggccgtgcctctgcactcactcacgagtgtcatctgacatctggctcttgaccaggatctgaggttgcttaagcaggatccaggtcaggttttttgttcatggaaggtggaattttggacctttcccccaaaaagttgacataacttaaagagaagggaggtatattgagaccagcctggccaacatggtgaaaccctgcctctactaaaaatacaaaaatagctggcatggtggtgagtacctgtgtagtcccacctgctcaggaggctgaggcagagaatcagggggcggaggttgcagtgagccaaggtcatgccactgcactccagcctgagtgacagagtgagactctgtctcaacaacaacaacaacaacaacaaagagcagagtggtattatttcctcactggaacattaaatggttcctactaccaaagagttcctgttctaatgggggtttaatataatagtaacattttattcactgggattcactcgggggaaagtattcaggaacaaagtgacaaaattaaatataggacatatgaacattgtcattttggttctagttcttacaagggcttatggtagcaacccaaatagaagtatttgctctaactaacagataaattattagcacttcagttgtttacatatgagtcagagcatctaaaatttgttcccataagtaggttgagcctccttctcagcctgttgtcatagggtctaaaaatggaaacgtgagtccaaactctttccagatcataaaaataattctgaattagtagagcataaatgaatgtgattttattcgagtgtcattttcaagttccccaggccaggttgagaccttttaagtcatccttaattccctgtagggaggattaagaaaatagtagcagctttgcttctggccttagacagttttctaatgaggtcagagcctctcaccctgggagaagcagattcactttgccccttcagcattggtttttgagaattgctgtctgaagctattgcatagacaaggtcactttttaaaagggtacatttctgaacctggagaaggagtgggttctgaatgactggctcttctgattaacagagctgtatatcaagctgtgctgaaaatactcctcagatatattaggccacatttatgcatgagtgagctcactgtcgtgacatgggagtgaacctttgctgattcgagatcctggggtgccttcactttggaacactgattctagatatttaatagcagttttaaaattaggctaaatgtagtctgactgcaggattcattccagtgggaatttttttgtttgttggttagttttttaagcctgaatatgaacccaaacatgtttcccaaaatgtgaaatgaagagtgaaaacctaacaatgggataagaaagataatagataagagattatagttcaaactcggcctgcactcaggaaatggaagcaattcctccccctcatcctgcccccctcctcttcctccacctcctcctcctcccttacctcctcctccactacttcctcctcccccttcatcctccacctccacctcctcttccacctcctcctccccctcctcctccccccctccccctcctcctcctctccctcctcctgccccctcctcctcctcctccacctcctactgcccccctcctcttccacctcctcctcctccacctccccctcctttacctcctccttctctttctgcacaccccacccccgcccccactagggacagtttactcttccccctcctttcttagaatgccaacaactagcctgttagttccattacttacttgccttgtgactcataacgttttcatcttgggtatttttctttcttggtctttgtaaaaattctaagcatcatagagcatatcacctggagaaaagacctacgttcattatttaatgaaggtaaaaagtaaagaattgagtctgcatcctaagaaattagaaaaagatcaactaagtaaacaaaaaaatataaaaactaggagggaggaattaggagatgataagatttaaaagttatgtaaatccaatagctggttatttgaaatgaccaataaagtaaactctcattatcctaactcaggaacagaaagaaatcatcctaacttagaactagataataggaatgagaggccgggcatgatggctcacacctgtaattctagcactttgggaggccaaggcgggcggatcacctgaggtcgggagtttgagactagcctgaccaacatggagaaacccatccatactaaaaaaatacaaatttggccgggcatggtggcttatgcctgtaatctcagctactcaggaggtgaggcaggagaattgcccaaacctgggaggcagaggttgcggtgagccaagagcactccattgcactccagcctgggcaagaaaagcgacacttcgtctcaacatcaacaacaacaaaaaagaaagaaatagataataggaatgagaaaggagacacaggagatatcaatagactttataagaaaacattacatgcagccctgtggcaacacatttgaaaatatagggctgacttcttaggaaaatacaaattaccaaagttgatccaagaagcatggaaaagttgaatagaccaattactatagaagagataggaaagatgattaaaagttaccattgagaaaggcaccaggaatccatggatttccagctgaggttttgtttgtttgtttgtttttggagatggagtttcgctcttgttgcccaggctggagtgcaacggtgcgatctcggctcactgcaacctccgcctcccaggttcaggtgcttctcctgcctcagcctcccaagtagctgggattacaggcatgtgccatcatgcccggctaattttgtatttttagtagagacggggtttctccatgttggtcacactggcttgaaaaaatagaaaatttgagtgttatttttactcttccaggacatactaaaacatggaaaggttcccagttcattttataaaaccatcaaaattttaatttaaaaatctgatgaattaaaaaaataaaaataaagatcaatattatttatgaaagtaaatgtagaaatttaaaataatttattaacaaatagactcttgggtgcatcaaaacacgaatgcactataatcaatagttattttccagtaacaccagggtgattaactgttagaaactcatcactatcatcagttgttacacaatcatattgaaggagaggaatatatgaataagtcagtagaggctagaaacctatctgaaaaagtttagtagccattcctaatatagtacaatctgagaaagcgaactaggaataaaaataaattacttaaacataaaggccatatatgtgtacacaaacacacacacaccacagcaaatatttcctaaaagacaaaacactaaagccattcaattaaaattaggaatgagagaagaatcttacattttacaattagtatttaatattatcttagaggttcttgtgagtggagtaagacaatgaaatggtcatatgtctagaaatcgcaagagcatctagtaaaaaatctaaaatcaacagaaacaattgtcaaggaagctggataaaagataggtctctagaaattatcttttctgtgttttgaagataagcacctagaaatggaagttaagtatttctttcacaatagcagcagataacctaggaagacattgaactaatacctgtaaccttcttagtgaagaatgtgaaatataatctagagaaattaaaacatgtaatgcctgaatgtatcttattacaaaattaataagtaaatttcttgtgattccggttagaatttccaaagtggtgggttttctctttaattgaataaaataatcctgaagtctttatagaagaataaatacgtactacctgagaggagccaagacaaatatggaaaagaaaaccggtgagggcagatttggcttacaagtaatgacaacatgctaagaataagaagtcttcgtgatcaaagcaatgtggtattgatccagaattacataaatagttcagtggaacagactagagaatctaggactgtgtctcattaagagagtgaatgtataacaagatgatagttcagtactgttgaggttggtactggcataaccagttctttatctggagagggggttgggggaacagcacagacctctatctaatatcataatcagtaataagtcccggaatcttcaaacacttaaatgtaaacaagcaattcaacttttacaagaaaatataagaacctattttgtataatcttggagtgagggagaatggttaagcaaaatttgatacgcacaagctataaaaagagacacactttgaacatatattttatttttatttgtttattttttgagacggtctcactctgtcaggctggagtgcagtggcgcgatcagggctcactgcagccttgacctcccagactcaggtgattctcccacctcagcctcccatgtagctgagactacaggcaagactcactgtattagttctcatactgctaataaagacatacctgagacggggcaatttagaaaggaaagaggtttcacagtttcacatggctggggaggactcacgatcacgggtgaaggtgaatgaggagcaaagtcccatcttacatggtggcaggcaacagagtgtatgcaggggaactcccctttataaccatcagatcacatgagatgtaattcactatcatgagaacggcatgggaaaaacctgcatctgtgattcagttacctcccaccgggtccctcccgtgacacgtggggattattacagttcaaggtgagatttgcatggggacacagagctaaaccatatcagctaccatgcctagccaattttttgtggagacgaggtttcaccatattgctcaggctggtctagaactcctgttctcaagtgatctgcccacctcagcctcccaaagtgctgggattaacaggcatgatccaccatacctagcctgaatatatatttttaaacttttctgtggcaaaagatacgtgattaagtcatagatcaagaagggatatttgaaacagacatggggttactatctataacaaaaaacttacaaattgttaagaaaaccacagaggaaaaatggacaaagaatgttaatatagaatacacagataacaaatgcagacagctagctggcaaacctatgaaaaatagttcatttttgctagggaaatgcagattaaacaatgagacgttactttaaacccatcagattggtaaaaatagagaaaaataacactttttgatagcaaggctgtaatagaagtggcaagtggtattatttctcataatactgatggaaatgtgaattatgggcagttgggaaattgaaaagcagatgggcaatgtatattaaaataaaaaactatcatacctttcttctaagcaacctttgtcctcggttatttgtcttttagaaataaaaaatgtgtgcaaagtcatatgtataaggatatttattgtaccattatagtggcaaaatactgaaaatatgaaaacccatcagttgaaaaacggccaatttatggactgtttgtaccatgtaatattatgagagaactagagctgtatgagagttggctgtggaggaatttctatgagaacttgatgaatgagaagcaatgtgtagaaaaatgtataatatccagttctaaaagacgcattcctcctgtgcccatatgtgtaaatgtgtgagtgtggagaacaagatgaaaatgctcattctgtatgttaagcagggagtggggtggaggttaatgtggaatggtgggagagtggggtggcagggatttccaagtcactcaccagtgatgagtgttaaccacatccccatttttttcctatgaaggaagctgcaatgctgtggtttgaggttaaacatgctggctccttctcttaggtcttgatttggtttttgttgttgttgttttttttttaattctagtctgttcttgttttgctgtgctgatatcctcttagattttacgagcatattaattgtgagtatttaacattcttctttggtttattctgagaccccgtttgcctgccctttggcatcattggcagtttttggtggtctactggtcttcctgtttgtgcctctcgtttgcccctttttcactggaatgtgccaggttgaagcaatatgtagggcccggtgggatgggccaggaggtggcctttcagatgtggctcctgcatggccctgcttgctctcttgagctgcctgcacttcagtcttaggaccacattcctgctttggcctacatgaagtgcaaggtagcagtgggaaaagcagagaggaaatgaagcttcctgataaatcacctgatcgctgccccagggttagtcactctagcccccttggatctcttgactccatctcttgatttgtttcttttgaatttctggcatctggagaatacttgtacagcagcagtcccctggttttgtttttctttcaacccaagcccatcccatatctgttcatgtgatgatactgtgtcttattttcccaagattcttatgactgtgatatttagtctgaatcagagaaagagagagatagaaatgtacactcagagggccacttggatggaaacttctgttgatctctccaagccttagtgggatcatctgtagagcagggataataacagcgcctatctgttactgttagggttactgcaaagattaaaataggtggtgctcttaaaagacttagaacagtgctgtcatatagtaaggattccataaacattagctgctcggtttgtgtgtgtgtgtgtgtgtgtgtgtgtgtgtgtgtgttttgttgttgttgttgttttaaacgggatcatgctggaaatgatagattgcaacagagctttggggttttttctctaattaatagatctaggatgttttctgaggtgtgtcatgtttttaaaactctgtggtatttctgtttctttctttctttcatttttttttttttttttgttgttgttgttgagacagagtctcactgtgtcacccaggctggagtgcagcgatgccatctcagctcactgcaacctctgcctcccaggttcaagtgattctccttcctcagcctcccgagtagctgggactataggcatgcaccaccatgcctggctaatttttgtatttttagtagagacagggtttcaccatgttggccaggctggtcttgaactcctgacctcaagtgatccgtctgccttggcttcccaaagtgctaggattacaggcgtgagccaccatacccagcctggtgtttcgtgatatatctatgtgtgagggtttctgtagttaagttcccatagttgaattcctggttcaaaggacaagaacatttacaatgttcatagacgttgggaaattgccttctgtagtactgcactagtttccactggctgtagtggttgatgagagtaccagtttttccctagttcaatattaacccattttatcagtcttttcatcttcgacattatggaaggtaaaaacatctcattttatgtcttcagtcagtgatgccaagtatctcttcgtgtatttatatttccatttttatccagtgccaactcacatccttctgtcaatttttcctttgacctattaatttttcattgataagaattctttgtaaaatgggcagtttaactccccatctgtcatatgttttttctcatttgatttattgtatatcttgtatagcaccttttaattttaacattgtgtttttaagtgtcttttctttgttgacttggaaagctaacaactacttacagcataatttccttctgttaaaaacaagaaggaatttccccactctaattgtgaaaattatacatttttctaagtctgaaaaaaaatagaggaaaaaacagaaaaaacaacagaaagaacatcagtcactcttaatattttggcattttccttttagttgttttttaggagagaatgtatatttatacttcgcatcataacatagatatagtctattttggtgatttattccaatatgtaatatatgtttctgaatgtacaatatcctatttatcatatctgttaagtttgtttccagtttttcatttaagagagaaaggtactgggaatatctttgtgcaaaacaagaatttttttttttttttagtcagattctgttcctatgatacctccctggaaatgggattcctaaattaaagaatattaggatttaaatacttttggtatagattaccaatttgctttcctaacgtgtggtactagtttatgttgcaatcagcacaaagactcactgtgccatttatcatcagcagagaagagagcagccctgaagatttgggggaggagtgttcgtagagaggcacgtgaaagtgagtttgagaggtttgagaagtagccaggtcagtggggctggggaagggagagagttcatgggggagggctggagatgaaggtaaaggagccatggttctttagggctgtgtgggtgctggggaatttgcatttcctgcttaaggttgtagtaagtcagcctggagagttgcaagaaaggagtggcttggtgtgatttattgtagcaagtgagagtgacccagaggccagttaggaggctgttgcagaggcctgagtgagagaggatggtttaaacaccaaaatggtaacattcagaatggagaggaggagatggtgggagattaaatttggggatggagcccttaggatctgttgattgactggatgtgtaagagagaaagggaagagcagaactgaggaaatgtcctcttgaactggctgggggccactgagatgggacagatgcgctggggagcagtgcagaggtggaatcactgctccttttaggtctaaggcatcccttagatctccaagtggatgtgtgaagatggtggtagaggagaatggagctcaaaagaggggccagagtcatttccatttagatggtctttacagcctaaggaactggcagatttcactaaggttgaggtctttctttcctgtgaaaatgtgatcaggatcctaagtaacagccctaaaaattaaacattaggaatacaaggtttcataaattaggaactgtctgtagctgccagattctaaatgttttgaggatacaaatcttggggtcttttcaaatgctttgagcagaagaggtacatcgtattgtgtttactgaatggcatttaaagatgcaggagacctttcccccttcttgatgaaacaatttgcctttcagatgttttgttatagtgagttgattgtaggaccttatgaagcatgtaaaccacacatttgtaaggcattggaagaaaaagctaacgcgagttaggagggatttaagaccatgtgaggaaattcaagcctatgttgttatcaccaaaccttgcctgtgttatgtaaagatttttgcctgtgtcatgttatcttcgttgtgttcaatttattcctccccctccaagtgtcctagtttctcctctactgtagctggttttgaacaaaatagagaaacttgggtctcctctaccctcagcatctgaattcttctcatttggttactcactgtgttaaaataagtgatatagtacattcttagcagtttgtttatttttaattttattttttatggggctagggtctcgctctgtcacccacgagtgtggtgccatggtgtgattgcagctcactgcagcattataactcttgggctcaagtgatcctcctgtcttagccccacgagtagctggtattacaggtccatgccaccatacccagctaatcttagcaatttttaaataacttttttttccgactgtaacagatttagatattggaaaagataaaacataaagcattgatctacctgtagagccaaatagccacagggatataaattggttaccatttaattttatttccatctatatttggctatatttatatttatgtatatggaaatagtttatgaatttggaatcatactatgatattttttagaatgatgctttttaaactattttatggtaagcattttagtaaagctcgtaatgttatttttaaaaacgtacttttcgaaggctgcagagtatggataaattcatgatgactttttagaggaaaatatcaagatgatctcactaacaaatcctgagattaaaaacaaaagcaaacaaaatacaaaaactgaaccatctttggaatactatgaaattcagattttatgttcttaataaaatcctgttttgaatgaaatcagtcttcatgcttttcttattccttttggctatgttgcctacagttgaattaactgtttttatatacttcctttgctttgcattgaaacaagctgatccattgtgaccctttgtggtatttcataaaaccacaccctaaaaactgcccagtcttttaagtgtagtcaacagtattgagcaattttttgggtaatattgtcggaagtgttaggtgccaaccaacaatggcttattgcttacatttaagtgtaagcaatatacaattaaaggaatgtcatgactttttaacttcattttgaaatttgagtttagaaaaaattccaagggaaatgagcaagaatgaaagcatcctctcctactgccagacttctgggagacccacccctggtcttcccaggtgtctcttcagtgaccttgttggtcgttgagggctgtggaaagttctagggaggctgctcgtccctcctctccttttgcttattgcattctgcccagattataaaactgaagtatctgtcttaagacgccagcagctttttcttcatcaaatccagacacatcgaatcccccacaaccaagaattacccagccacaaaatgtcagtagtgccccggtaaaagaaagctggttttagacttagtctcagaacctggccatcttccatggattatcccgatatgtgcatccttgtctcttttcactatagcctggtgatcatggtggcagttttcattttgggacactggtgaggttagaatagcttcaggcttccctcagtgaatagtattgtgaaggcagtggtggtaacattgtgttggagctggtgtgagggttgaatccactctgtagcctctgtccctagatcatggcgctgctttgattgggccctaattttctcctctagacaaaaggaattgaactaagacttccagcattccctccaggcttaacattttttcatttggtgctgatggtcactgactattttccagttacattttaatgcaagtttggcagaagccgatttctctgggttagggaaaatgacataggtggcagggaggtggatgtacaccatttgtttgatcagtttgcctagaatggaggtggcagaattggagttggaaagatcaaatgtagcctttttttcccttccagaatgaggcttttctatgcatttttttgaggcatgagaacctcatgggacaaggcaaaagtgagcatactcaagtgaagtgtatggttatgggggaatggttattagaaatgtcaattgtctcaattttttagtattaattttcagagggaaacagtggtgtaattagtgttgtgattgtttgccagggcggtcgtaacaaagtagcacagactgggtggctcaactaccacaaatttgttttctcagggctctggatgtccggagcctgcgatgaagcaggattggcttcttctgcggcctctcttcttgacttgcagatgctcctctgggtcttcccaggtcatttgtgtacctgtgtccgtgtcctaatctcctgttcgtataagggcacagtcatattggattgggacccacctactaacctcattttaacttaattacctctttaaataccctctctctaaatacagtcaccatctgaagtattaaagacttcaacttaggaattttgggcaaatacaattaagcccatcacaatcaggtaacatttggtaggacgtgtagatgctttttatctttaagggaataggcaaatcgttaaaaataaataaataaaaacttgttcaacttgtttaggtacattttcttatagtgtattgtggttcttatttttttaaccttccagctagtgtgtaaattggaaacattgtagcttaatttgatagttttagacataatcaaagatgatggaaatcttgttcttaaatttagtctattcagcaacttgtgtatcctcaactgctgaagactgaaaacttgagatgttcctcttgttttaagaatttgactgaaaacgggctgggcacgatggctcatgcctgtaatcccagcactttgggaggccgagatgggtggatcacttgaggccaggagttccagaccagccttggcaacatggcaaaaccccaaaaatacaaaaattagtggagcgtggtggctcacacctgtggtcccagctattcaggaggctgaggcacaagaattgcttaaaccccagaggcagagactgtagtgagatcgtgccactgcactccagcctgggtgacagagtgagaccctatctcaaaaaaaaaaagactgagaatggttggcactgtccccctgtctccaggagggtgaatgtttctagctgaaccctggtgcccacttgctcctctaagccttcagcagtcctcccagcctcaaggggtgatccgttcatcttccccccacctctggaaatcccagcgtttgaacgctggggggaactgcaagtctagtttacagggtttctcagctgagatgccaggaacacttcgcgagtgagcatgccaccacatttgagtgcatatagaaagttagctgtttgctacaactggggacacttcctattagagccgcatctgctggggtggagggctgcatgggttggagagtagggtgtgacttcttccagcaagaggaaagagaagtagcatagtgcccatcgcaggcagagagcacatgtttgacttgctcttggaatttctgtagagtaagggtggtcaggttgccagactacccctcaaacgaggacatggtgctgctgggtcccagggtagagctctgctggcaccttcaaggccctgatttacacctaagggcacacaactgggatctgaaaactgggatgcacagtacagactgcagatttacagggcggggctgtctctcatctgactattgattcttttgggggctgtagtttgtatcatagttatttttgttcctgtttttttcccctcttcaagacaataagcttttggagggccaggaagttgtgttcccatctgccgagtgtggggcctcgagggccagaacctcagaatgtagaagctgagttagtttgtggcagggtgaagggctgacctctactgttggaaatgccaaaatctctgatctggctttaaataagcaaaacagccccgccagacatagagtcatccacaaaacctcatgacctctgttattgcccatcctgtgtggaagcccactgagaacttcacttgaagatgctgcaggaacaactgcagggaacctggagataaggccccgggtgatgatgtaagctaattgctgagctgggtggagctacttaaccttatggtaggaggtggagcttgacgcaacccccttttccaccaacaagcatttctttctacctgtcattgaagtgaatcatcagtataagtagcgagctgggcgcattccttctcagttgtgttaaaacttgctggtattcccccggtatcagcagaggtgtgtacgggcactgctttaaaactgggaaggaggaagacgaggccagggagccggagggtcaccaaggtagatttccagcagcgctagtccagctgaacactttccagccttgtttttcagcagctttgaggaaaagtataggtaagaacaaagacaccactgtatgtttgctatatgaatgcataacatctgttcttggtgtgagtttgatgttggtttaatactgtttttatgtcagcggcatagttctagcatgtaccaagattttcaattttaaatgctttttggtgttcacagttagctataattggtcaattttaccctccttatgcataaaaagaatgataggcaaagaatgagccttgaaaagaattgggatcagaattctggtcccctgttctttgcttcttaactttcttgactgtttagaaaaatgtacagcttttcttccaaaaaccaaagcaataatacttttatttttgaaaataatggaaaacagagaccgctgaagttctatgaatgaggttttctgttttagaaatcacaggttgaggaggaaagaattgtgttttccttcctgttctgtttcgagtctcagtatttctgacttagaaacctcctggagaagagggagataccagctctcctttgtttcaagtaaaataccatcttaggtcataaaatagtttgcttggagaataattcatggcttatatctgaatttttggttggtagcaacagaaatctttctcttcctcggtatgagtaatttggcttacatgatttagactaaattttattatattttttgtttgagaaaacaaaagtcaaagcccagaacatattcaactgagtttttccctcaggttttctatcattttcccacccttcctactcatacatgtgaatatgctgaatgattaacatgtgatttttgtttctttactgtctcatttcatggtgattcataaactgttagttaactggttatagtgtatccatatgttggcaaagcttgaaataaatttgagtgcaggccacaccttcgtattaatgagccgggttactttcagtaaagtatttctgatgtcattaagtgttaagatggccggaattctaaagacaataaaaatgtatcaacaatatgaaatatcaaagcctacagtcaaatctgagttattctttagtacttatttcatagctattctttaatgtttattctttaatacttatttcacattgaaaagtactttacacatgtttgaatgagatattgccagtgaaagaaacaaaaggaagcaaataactctataagggaagtgggattttaaagtatgtttgtgctggccccaggctggtgagtgagtttcattagcaatgaccaggaagagaaagaatgccacagtggtgggtgctgaccttttttttttttttttaaaccttttttaatgtctgtaaggaatacaaggtgaactttaattcttgtgggaatctagtaagatggaagtcaagaagagaggaagaaatgctttttatttagttaagaggaagtaaacatctgtattagttacagatgttatgccttaacctttttcattcctattgtttttatgaaaatttgcctttttaagttaaatgaaggttttctggagtcctgtattgcaactaaatgttgatttaaaacgacacatttgggacattttcttggcactgtggaatataatgaaaagatataaaatgaaggcaggtatgaaattatatgaattctgctacttgagtgtagaagttttattccaaagtggtttgtttggtggatgtggtgatggtggggggctctatgtacttattaaggcaagtgatgggacaggagcttttgtggtcttgacggttctgttgggatgggagggttgtttgggatttttatgtttcattccaggcaatgtttattttttcagcctgtacttcttagggttttaccaagtcagttttcatgtgaagccattttcatatcgtttctttcaccttgatggaaatcttttccttcttatgtgctttgagttaaatatgatgtagtgtgctagtaacatagacggggctttcctttctacaggtgggcttgaagtgagcctgccactcgctcaccttgaatcacggaggtttcagaggccgttggccttcagggcaatggcagaagcacatgttctctgctgttttctgagtctatcttgactgcgttcccagtggcccagaattccccaagggtcactcgacacaccctcgtctacagtaaatatttgtgcttcctctgtgcctggccaggttttctcagtacccaggagcacaggtgggcagtgggatgtgggcaggcggtacccagattccctcccacaggggccacagggaggacttgggcgcttcctgccaagagccccctgcccttcagactaagtggaaatagagatccgggagtccagtggactcagtggagttccgtagaatacatggaaaacgcaccgctttcagtgatgtaagctgtcttgttcacttcacgattactcatctggcctgcagcaggcaagaggatcacatgcaattataaacagcctcctctgactaaggtcagtgactggaaaccctgtcacgttatcagaggtcatttggtcatagattcttgggcagaagccattgagagtcctgggggtgtgatctttgagcctttgccagtgctggggtttgactccttttagctcaattaactgggtccaggagtttattttggccgagatctgccatgctgagttgacaggcttgacactggaaggaagtctctaacttcattagaggaaatggcgtggcaggctttaaggcattttgatatactccactttttctctcttgccctgttttgttgaggttttcagggccataactgtacctgaggttaatcagtgagtgatctatctgaaaggaatttgttctctttgggcaccgtcctgtgtggtattatatttgtataactatttagcttaactcattcaaaaggctatttaagtcacttgtcctgttcattacttgaaaacaagttgtcttctctttattcttttagtcagttaccaaatatttcctaagtgtctcttgtgctagacattgaggggcactccttctccctttcacttgtctgtttttgttgagctacattttttccttaagtcagattgttcttttcctgttacttttgttttcacttgatttgtttatttatatttaaatatgtactttaacagtcttgaagcattggtctgaatgaggatggtgatcagattgggaaaatgccccttaattttggtttaaaaaaatttattttctttaaattatttgtttattgataggggccacccactccaggtgagtggtttctctgtgtgtatggcagaggaatgctctgtgtctggaaaaaaaagtcacttagcttgaaatattatgaaagctgaagagtacaaatgtcagagagaaaggggtattgggggggaagagaatgagaagacaagacacagtcagggccctgtcacccgtgtggaactgcaggtccctggagagatgatgcatttatccctttttagagatattgccattaaaagttgatcttgagcatgacacagaactgaaagctttgatgacaaagccagcatctcagtttagcaataaccaggttagggaaaaaaccccagaaactcaacagtgagattcagctcagcaatgtgggcggggaacccactgtcccgccttgggcagggagcagccccagccgcttcatctgcctgatgctgggttttatccgcttcacaattaaatttcctttttgttatgcttgcgcacatctatatttggctttgcttcttattttttaagaaaggggagaagtgtgggcaaggtaaaatacagcttgcaagctcccaaatggcaaatgcaccagttagagtctaagtggcctcccaaccttaaggtgaaattcatttattcagcaaatatgtaccaagcccatcagggaccactgctcgagataccagtgcaaatagaagaggccaagggcacattattaggtccggagccagtggcctgcacagccatctgtgaccacctacctctctgcttgcagggaacttcagcctggtggaggagacccataatagccaagtcaactgataatagaattagtagtagtgttgagggacataaagaaatcagggtaaggccatcacaattacatgggtggatgatcttttataaaacagcacagttttgttttcttctgccatggtatctcctaacattttccagtgtgtctacttgcagttaatatggaagttgcggctgacactaggttagtggttaaaagaaaacaagaaaaccaacctttagaaatctttagaaacatcattatcatagaaagctataaactcttatgtatagaagggtaagtggccattgatcttggagcagaatgaatggatatttcctggaaaaaaatatttccactcatcaaagatactcaagtctcttctcatctaatcaatattggaaactaggaatatccacgcctatggaatatcctcagagagaattaattattctgccctctaagaggtatagtagtttagacttagaagtaaaggcctgaacttgaggctgcaccattgaaggcaaaagtgccctttatctcccagctttgtcatttgccaaatgcaattgtgttaaattaagtgacctccaatagcagagctctatgttttctcccctgacccccaagtcaaaattgattatagtaatccatcaaaccaggcctggcaaatgatgttttgcaactaaaggataaatactgagggggagggacgaatgtgaacgcatatgcagagcaacacagtcatgagaccattctattacttcctaaatttcttaaagcttttctgtcttttctgagcttctcaagtgagcaggggcatgagttcctgtgttgtgcctggggacagggaaggctttgggacctactgtggtcttaagtctgagcagtgctaatagcctcggctcaccaagtgctgggcactgtgctagagggtgtacaaacctctcatctcatgaggcctcactgctacagctgacagagatgacatccagttgtttttagttgcacatggcagagctagaaaacaaaccagggtgtgtcagactccagagcgcatgccctctgtgatgccgctgtgttaccctagatcaaatcaaccaagccatccgttaaaaaaaaaaacctgatctttgtcaaatatgcaattgttatatttttgttagagtctgcctctccagtgaacgatattaatttccttcaagtggctactcacagatatcacaaaatcagaaagctgcctaccctgcagcctgtatctgcctccacgtccccacatcagtcctccttgctgtgcttcttgtctctttagtttttatcatcttctaacactgtgaactttagtaatttattctggattgtttgctacctgtctccccttggtaaaatgtaggctccgcagaggtagagcgttttgtctgttttcttcactggcatatctcaggtgcctaaaacaaccatgccagacatgtagtggtgccagtgacaacttgttgaatgaagaaatgggagaaaaaagcagaccccggagacttaggagggtctgtgtgagggagtctccaggcagtcttcctgggggtgtcctgaaggacctcctgatcgtgattttggtcagtgtggaggctgtggtttcttctgagctgtcagtatttggaggtgagttgtctgcaggtcacctcatcccacctttacacattagtaaaatggaattcgctgggtgattcttaggactgtgcggtcagtcgaattaccagacgtccctgcatgctctgtctaagggctggagtctgctttccttgcttctcttctagaaagaggtctgtccacaagggattagcctcgcgaagttcctactgttgttcattgacccagtgagtgttttacccactgtgggtttttcctacctaattgcccctctggttttcagtgttcaacatgctgcagttacgtgttctgctgtggttttacttagcttaatcctttattaattgcctcttgttcaaactccctaagagcagattatccttctctttcagcttctgctccattgctgttgaacttttttttggtcgtgacatcagaaaaataaccaagtgtgagtctgataatagcaagtaaggctattttatttctatccaatttaccccaaatttgagcagtattacaccttaaaataatagagctggctcttgcccagcatgtgaaaagtgtatgcttcacgatggacagatattttccagtatctacttaccataaatctcaagatttaccctaccccactccagccattacccccatgtcccatttgcctaacctaccctagggccatctcagtgccctgtaaagcaacctttgttgcagacccactgtgtgactggaatgtgatgcacacaagtgaccaaggcatggccctgttcgcaaggagcttccagaccaatagcagaaatggacacataagtaaacaactgcgctactgataggcttctgccaacaggagtggagcttgagggccaggaagccttcccagaggcactggagcttgttttaacgttacgtgcatgccaggtggggggcaggacatttctagcagaggagaaagcatgctgtgctctgagaactaaaagtcatagtcactccacttggtgacatgtataaggcacatggaatagggccagagctgggcagaccgtgtatgccacaatagttcgttgtaggttacaaagaaccagtgcagagtgggtgaggcataggctatttgattaataatttggctgcattgacaagatacggaaaaggcgaggttgggactttccgtgaattttctcctcaaggtgcttaatcagtgaggttgggatggccggagggggccctcatttgcttgcctggtgctcaagcctgaggtcctggcctttaatagtcagggaggtctgtgtggaggcagggtgtgagccccctccaaggaaagctgcagtgtgaaaagaggcccaggatgagcgttggggagtatccacatacaacttgatattcctaaagtctcagttctttatgggaaagcccatgcactcttccacacttggaattctttgcaaagtgagtggtatttgagcttctttagagtcttgctactcccaccagctgtactggcatcaccagggagcttgttagaaatgcagattctcgaggcgcggctcacaactacccaatcagactacattttaaccagatcccaggcaatccctgtgcacgtgaagtgctagaacactgctctgcggtaaaacgactttgctaaccatggaagagggtgatttttttcccttttcctttggtgttttttataggacctatttaccttttagaactttttcagaattatggactgcagaatatatacagtgtcaatgtcattagcaattcattagtgatatttggctagaatacatagttgtttccacacaaatgccatttcttacattgagatggcacatgtctggttaggacttgggctcatttgtaaggagccacgctgcaggtaggcatgctcccgggacattagttgctcaggtttcaaactgctgccccagcatagcagatggcacggtaacaaagtccctgtgcactctcacattgcctgcggtgatctatcacacattttgtcccctaataacctagctgggggggagctcatgtctctgtttgtgctaatgctcgctgtatccccaagtggcagtacttaatataattgtcattgctctttaatattatctcattccacgtcagctgcacaaaaatttgaggttaatcacaatgaatgttttctcaatccttgttattgagagctgtttaatagtttattttgtatgtgaagattcatatctagattgaggcttatacaacttcatttaaagacagctttttcggctgggcgcggtggctcatgcctgtaagcccaacactttgggaggccgaggcgggcggatcgtgaggtcaggagatcaagactatcctggccaatatggtgaaaccccgtctctactaaaaatacaaaaattagctgggcgtggtggcgggcacctgtagtcccagctactcggaggctgaggcaagagaatcccttgaacccaggaggcggaggttgcagtgagccgagatcgtgccactgcattccagcctgggcgacagagtgagactctgtctcaaaaaaacaaaacaaacaaacaaaaaaggaaagctttttcaggttggaaaaatatcaacagcagacatgaaaaagcatgaaaaatgacgctaagaatgtaagcaactggaaacaaaaattataatggtgcatagtgagctgaagatctatatttaaatgtgaactcccctttcagtttataagtgattactaacagcctcatcaggtttctggaattaaatgttttattatttcctcccaaagttagtcctcaaacattagtatttcttgtgttcttttgatttgaatatttgtttttaacacacaaggatatcaactctataagtcagttaatatgttcatgcttttagttaatcgaaagtggcttatgatttcagtttttggtatcaggtgatgttgcggaagtgaggttcactgtgaagcttcttctttttttttttttaatcattttgttgtttctttgagtgtatgtgagcttataactcaagacactatgtgaaatgaccctgtgtttcctacattatagaaaagaggaaaatgaagcaagttcaagaaaattagatttatgtggaaaataaattctgcatctagttattcattatcaggtatgagattacaggcatgagccactgtgcctggtgacctcatttgaactcgattacctctgtgaagaccctgtttccgaagaaggtcaacattctgaggtgccattgtcaggtatgaggtaaacacactgagaataccacattttggcaactcagacaagactattttccaaacatgtaaccctgggaagaaggtaacctatcatagtgtgtgttaagaagtcaagcaaccaagaaatgttaattgaaggcccgttttgtacaaggttgcatggaaaagacacactagcgtaagacatggacagtggccctgagtgacgtgcagccggtttaggcgaattaagatttacatacttgaaaagggacaaacaagtctggacgtggtgactcatacctgtaattccaacactgtgggaggtggaggcaggaggatcccttgaggccaggagtttgcaaccagcctgggcaacatgggaaaacccctgtctctacaaaaattaaaaaaaaattagccatgtgtggcagcatgcccatagtcccagctactcacaggggctgaggtgggagaattgcttgagcccaggagatccaggctgcagagattgtgccactgcagcctgggtggcagagcgagaccctatctcaaaaaaaaaaaaaaaaaaaaaaagaacagaaaaggaacaaacaacagacacaagattccatggaaaagggagtggtctaagtattcagactgtaggaattcagagagtggagaggctggttattatgggggtgcttcatcctggggagttgagggaaaggaggtgctggctgcctggagcctggaagaatcaaagatttccaaggccatggggggaaagcatgaaggatgagtgaatagacaccagggctgagcaccctgaaaactgtgaagatactagattgacctgtttggaaaaccaaacagatgtggctgttattgacaagtggttttgtttttgttttgagacagagtctcacttggtcgcccaggctggagtgctgtggcttgatcttggctccctgcaacctccgcctccaaggttcaagcagttctcctaccccagcctcccaagtagctgggattacaggcatgagccaccatgcccggctaattttttgtatttttagtagagatggggcttcaccatgttggccaggctggtctcgaactcctgagctcagatgatccacttgccttggcctcccaaggtgctgggatcacaggcatgagccactgtgcctggccaacaagtggtttaaattggattctccatttcccacctaatagaaagtcggaagcatagggcaaaagtaaaggaaggaccctgtgttctgctggttaaatataacagaggtctgactccatggctattataggagaggtgcattttgttctatgtaaattatcttgatgtgtcccctgtgcctttaccccatgattatttagcacttttttctccacggtcacagggacagggagaaacatacacccataaaacagtgtcatctagaggcaaaaacttgtaatgctcaagcatgtgctctgacgaggtggggcagggtgtgtaggaacaacactctactaattattacagagcttgctctgcactctctgtagaagtccttcaatatccagtctaacacacacagtaacttaagagaggattttaaaaaatcaaaatgccctcagatttgtattggatttaaccaggctgagatccctgagatccaaatataataatgtgtcctttttggatgaatcagacacaagcaaaaatctccagtgtgtgtccagctttagaggtgtagtaatggattccacagttcacgctggtgggccagccaagacttttaatgctgatgtgggcttcattctttctataaactccctttcttcttgatagtgcatgggcccaggggttccaaacatgggtacctgccgtaattgatctgtgtaaccggagaaaatacatatcctatggcacccttgtgtcgggatatagggggcatcaccgtaatgtggctctttttctgttgattatagttttttctttctgtgatcacacaattgttttatcctcgcttaaaaaatttcaagaagtgcagcactcagaataacagaaaagtcaggtgtctggtggtttgtttgcacatttaatagacttgaagataaactctctaaacatttattttgcaagttgtttttctgagagttgaggggaaacttttgccctttggtctccctgaggaattctaggatttcacaggtaggcgtgtgttttggactgcaggctgaacgtggttggcagggtggcatgaggagggcacatattttaagcgttcttagggcagatccacgatcctttacctgccatttctaagtccaaaaagccctgaaaaccaaagacatctttacaggtttgtaggaaattgatttgagagcaaaacctgatgtgaacagatttgagagtattctaggcatcttgtataacacttcattcaatgctttgtgcctcttgctgcacagatattaacattcacttatgggccctgccccatcccctactggggatgctatgcaataatcagaataatcaaactaataataataataataattggaataatcactgagtcattgtattagtccgttttcacgctgctggtaaagacatacccaagactgggtcatttataaagaaaaagaggtttaatgtactcagttccacatggccggggaggcctcacaatcatggtagaaggcaaaaggcacatcttacatggcggcagacaagagagaaatgaaagccaagggaaaggggaaaccctgtataaaatcatcagatctcttgagacttattcactatcacaagaatggggaaaactgtccccatgattcaattatctcccactgggtccctcccacaacatgtgggaattataggagctacaatttaagatgacgttgggtgggaacacagccaaaccatatcagttatctttctaaagtgagacaaaaagtcagaattctgtaacacattttttcccaagcgtttccaaaaaaggttggctttaatggagtattagtttgctaggcctgccatggcaaagcactatgaactaggtggctaacaacagaaatttattttctatcagtgttggagtccagaagtctgaaattaagagtcagcaggattctgctgtctctgagccctatgggaatatcctttctggctcttctagtttgtgatgtttgccagcagcgttctctgttccttggcctgtaaatgacaatcttctcgttgtatcttcacatcgtctttcctctgtgcctgtgcctgtttgtttctgtgtctacctttcccctgttcataagaacaccagtcatattggatcagggctcaacctaatgacctcatttctttccttttctttctttctttctttctttctttctttctttctttctttctttctttctttcttttcttttcttttcttttccttctttttttctttctttctctctctctttctttcttctttttctctctctttctttctttccttccttccccccttcctgcctccctccctcccttccttccttctttcttttaaaaatatttttcttttttttcccttccttcctccctcccttccccccttctccttccccttcctccctttcccccttcctccctccttctctccctccctccctccttccctccctcagggtcttgttctgtcatctaggctggagtacagtggcatgatcatggctcactgcagcctcagcctccctggcctaagcaatcctctcacctcagcctcttgagtagctgggaccatgggtgtttgccaccatgcctggctaagtttaaaaaaaaaaatcgtagagatagggtctcactatgttgcccaggctggctttgaactcctgagctcaagggatcctcctatctcagcctcccaaaggggcgagattacaggcatgagccactgtgcctggtgacctcatttgaacttgattacctctgtgaaaaccctgtttccagagaaggtcacattctgaaatactgggggaacatagttccccatcttataagatagagaatggatcaagacgagcagctccattctttgtttgtgtttaggccagtgccaagttcaagatcttgcctcagggctttcctggtacccctgggaatgtgtatcagcagcagctgtgtcactgaatgggtgtcacctggggggctgcctgttcagacattagaagctgccacatcccctgttaactccatgtgagggaggaatcccttccctccgacaatttcgcctgtgagaatcaagtcagattttgcagtgagaactgagctgagtgtagaataagttcccgaggtacttctggcaccgttgttactcccccaccgagaagcccagaatgttcccaggtgtgttcaaagattgtacgggaagggcttaggacggtgcttggctcatataaacactcagtggcaaagaggttgatgcttaagtacacaggaagtgtttaccagtacacataattgtataccagtgagctccaccattcaatttactgtctgtccggtacattgaccctgtgaggcccactctcggtgtggcactgctaacaggttttattgttgcttactcacttgaaaagtgtctcccttggctagacctttgtcctgagcactggacacacataggtgctcagcagcgtccctctctgcaatgcaaaagggataccgtgtgcctctgcatgtcagctctagtcctggcatcccaggagcatacggtgacagtggaagtgaagtgcaagccgagtcctgggaaccaatgtctgccagaattaattaaaagtaagcatctttttttccctggttagttaatccaggatgaattccctgagtagttcctgccgttagaacttgctctcttttttagttagacacagctcggtgttgcctccactttgacatcacgttcatagttcctgtgcttggccagaactgttttcagttgcaaggacatgggtgagactggtcaaggaattgactttcagggttccaagggaataattagttcagaagtctgtccccatacttgttttccagtacaatctgtgtctctgtgggtgttttcttttaaggctgtgtgctttataaactggagatagaaggagccagtttattataaaaaggataaaatataattaaacaattaaaagtatgtctttatagccgggtgtggtggctcacatctgtagtcccagctacttgggaggctgaggcaggagaatcgcttgaacctgggaggcggaggctgcagtgaactgagattgtgccactgcactccagcctgggcgagagagtgagactccatctcaaaaataaataaaaattaaaataaaaataaacataggtctttggccaagtgtagtggctcccgcctgtaatcccagcagtttgggaggcagaggcaggaagatcgcctgaagctaggagtttgagaccaacctgggcaacatagtaacctcgtctctacaaaaaatttttaaaaattagccaggcatggtggtgtgtgtctgtagtcccagctactcaggaggctgaggtgggaggatcgcttgagcccaggaggtcgaggctgcagtaagccatgatcttgccactgcactccagcctgggtgacagagcgagaccctgtctcaaaaaaaaaagaaaaaaaaatttatgaagtactggttgggttaacgtttcttcttctaaccatgagggaagtaggtgggctgttctggtgactcagtgtcctcccagactcactcatgagaggaagtattcacggactgtggtgatcttgtcttggaatttttttctttgcctcctggcctcacagccgttccttttcttttacacatccatgaaagggagactctaagatcttccttgccaaggttgttgtagggatgagcgatgatgtctctgaggcaccaggcacggtgctggcacccagaagctgcttaatgatcctggaagttatgaccattgctcatagtttttcctacgtttcagatcatccttaaataattgtcattggctgggcgctgcggctcacgcctgtaatcccagcactttgggaggccaaggtggttggatcacctgaggtagggagttcaagactagcccgaccaacatggagaaaccccatctctactaaaaatacaatattagcccggcatggtggcgcatgactgtaatcccagctactcgggaggctgaggcaggagaatagcttgaacctgggaggcagaggctgcggtgagccaagatcatgccattgcactccaacctggacaccaatagcgaaactccatctcaaataataataataataataataataacaacaataattgtcatttatcagcttcttcgagctcttaatatatatatcgccacctttcacaaaggcaaaatctgcattagaaacactgttgtctgattttggttcctctggaggaggggtagacagtctttttgtgggcagggtctgtgtctgtttacctctattccccgccccccactttggtgcccaccacagtcccttgtgtatggtggatgctccttgactatctgaggaataaaatcaattgtgaaacagtttccaaaaagggaacagtttttgtttccccgtttccttatagccttgtgagttgctatctctcttggctctattattaataacataaaagaaagagctgttttcttaacctctggtagttgcacatatatggggaaaaggcataagaaaatatgctggcaataaagacaagtcacagattgtcattttctttggtgactgaagggatatttcagtaatttataggtgaaatcttcctttttgtgacttccactgaacaacatttttactaccaaaagataagggaacaaaattttttaacaaactatttaagcttaaatatttaaacatttttattagtcaccacatattaataaaatatttttattagcacatattttattagtcaacacatgtgtacacagctctgatgatctctatgtagatgcctatataaatagctatatagatatcatcagagctgtgtatatatgtgttagagatagatgcacatacagttgccccctgtctcccaggggtctctgtgacccaaggttgggaccctcaagtgactagttatggatggcaaggggggctgcaaggccagagttggtcctggctagagatttcaagactcgagtggctgggaaggttttagaatgcaggtaaaccactagttgctccaaacaacaaaaccatcataatggaagcatccaaaagtgtgttcttcggcagcttcagagactatgcctaagcaataaagttttaatgtcttttttagctgcttaggtgaagaatgcatttgactgtaatctaacccattaatctcttatttttgctggaaaattgtacatatttaagagtagtggctcattgccagtattggtgatgagtgatatattttaaactatgcttcatacctttcagtaaatcttgggctgaaagatatgtacgttttgttttcaaaatttttcagtagtcatctatttaggtcaattttctgggcaaacaaaatatttgaagccctttagggtttgttattgagatgtaggctggccatgaaattacagggttcagtacctcattgaagtgtatatgtaactgttattagttttttgataacttttttatactcataaaagtagtacttgcttacagtagaaacttaataaaaaccataaatggaaaaataaaccattcgtaaacatcatatagagagaatgactattaacattttagcctaacatgattttaggggtttataatattctagtatatgattgtaccataatttatttaattgcttcccaattattggactggaagtttgcttctaattttttcttattatatatgatgctgtaatgagtaccttttaccagtaaatatttacctgcctctctgattacttctttgggattaatccttagaaataaatttgatgaatcaaagggcatcaaccctttgaatgcttctgatacttctgccatgttgtttcccagaaaagatataataattattccttccagtagtagagtattaaatgtctgcctctctttagaaagtattaccttttttcaatctttgacaatttgttagataaaaacttcagtttcaatattattgcatgtattcatggatatttttcttctcacacattctagattttttctatattgtttataaatgttttataagtgttattactttattgaggatagaaattattatgtaacacttgatggtaacagtaaaagtggaaaagaatgaggaaaccttcaacaaaacaagttgtcattaacaaaacgggttttgcaatgcaactttctgtgggttagctaaatctttagtgtgtcaggtagtcgaaagaaatttgctgtatagtgctgtgaaatatgctgcatccatgagccctctgctctttgcccatagggagcaaagacacaatctttttgcaagctgtcccagtgccatattgaccatcttccttttacagcaaaaagttattgcttcctttggttaaggttgggacacccctctggaggcacacttgaaaaatgaagacctttctcgttgttcttctgttatccaagtatcttggaagaacacctctatagcaggtagacaaggcagggtgtcattgcaatctggctgcagactgaatgtaatcccccttgacattttgccccttggaggcaactcctgccctcccctctccccttacgaccctgcccccttaaaatatgtggagctcagcaaagactatttattctgataaaaatgagcaaataataggtgtgaaagaacatggaacacttcagtgaatcaaatggagaggattaagcattaccccaataatgattggtcaggacgactgtccctgtggagtgtgtcccagaagggttgagcaatggagcaaacccagaaaatctcattctcaactctccctgacagatgacctcgtctgcgctgtcttttgcttcatggtgatgaaggtggaacaagacccttgaataagatttccatctctgaattctttaaacccatttgagatcagtgcaggcctgcagtctctctattagaactggagcagaggcccagaagagagaactgaattttcagcactggattctatgttgagaatgaaagagacaataattgaaaagcttttctcttggaaattttgcaaaatccgagtggatttttgaccaggatttcttggtgacctctcctgagagagcaggtgcctgaggatttcctgctgagtatcttggcatctgtcagactccttatgacttcattttagttcagggagtctgtttcctagccattgatttcatgcacaattcctggcatgtctcatatctctaaggtgatgtcacccttgtatttttttttcagatgtaatcttttatgtgacagtgaggtgtcttacttgtgagtgaacagctagaacctcccaagtggtttttcttttggattttgtttactcagtgaaaaatactgaggaacctgagatccttcagggtgcattttggtgtctgcccaaccttgacgtggatttggaggccaggctcaatgctcgaacttcttgttggagtggcactaaatcattaggatccctgaggacagacagttcaggccatcattatttggtaggcccttgcacacttacacacaaatgcatcattatgaacatggagcagaagattctagggccccgtgtgtaatggcacaatttgtcaagaggcctgagacctggagttggcatggattccctctcctcctgacccacctacctgctacattcagttggccaccctgttcttttgagtccacctttggatgagtagtcagtcctttctgatttttgccacctctgcattcagagctttcttattctttggcgcggaggccttccgttgggtcccactgcctgctgtcttatctccttctaatgaatatgatcatgatttttctgtatttagacaactccacgatgaggaggatgatggcggcagctaacatttatgtatgtatgtatgtatttagagacagattctctgtcacccaggtgcagtggtgcaatcttggctcactgcaacctccccctcctggattcaagtgattctcatgcctcagctccccgagtagctgggactacagatgcacaccaccacacccagctaatttttgtatttttagtagagacgagattttaccatgttgtccaggctggtccggaattcctgacctcaagtgatctgcccaccccggccttccaaagtgctgagattacaggcgcctgcctccacacccagccagcagctaacatttattaagtgctcactatactcctgccaagcactattataatttgtcttctaacaggctttttataagggaagtgctactattatacccattacatagatggtaaaactgaggcacagagaggctatgtaagtttcccaaagtcatgtactaattgatgaagacccagggtttgagctctgcaggaatggccgactccttgtggtttgagcctgggctccctctccatctgtcttttctccctgagccctcctgactgcagccatgccagactttttaatgttctgaaccccagctccagcctatcactggagctctgcctgtgatctttccacctcatgcctcccggttctatgtgtgccttcagactccatctggcagtggtatctggatggaccagtgcatagaaatcacatgagacactcaataaatgtagactcctagtgattctgactagcaggtctggggtggggccaggtacccagatttgcacgggaagtcagggaccactgctgctgactgcttttttcctgggtgcttggcacactctgtcacaatcatgttttcatttctctatgttccatttcaactggatagggacagtgtcttttgtttctggaacctgtctcttttcttggcatatagtaggcactcaggaaatagaaggttgcttgaatcctagtaccagtttactatctccttggaaagactgaaaggtagaatgtgatgtctaagcagcttcactaagcagagaaaacaaaaagtttgcaaaatagaatttgccttttaatctacatgttcttgcgtagcattgagcttcctagagagtcatattcatgctagccctgagttgtatcagcagcagccactagaacggtaacttgatgccaagagtgaattctgatgagcttcattgtgagtaagagtcccagtttgatcatctctacccagatcccgtgggacctccacactgtatgaataatgaggaggcgtggaatacgtagcatgctgcagttggccagcacccagtgtgtactgtgaggtaatcagtgtcaaatcagtcattgtagcaggagttgggagtcaaaaggagcaacagagaacctcacacgtctcctaagagaggaagcaaagaacagttaccttggctgtcatttatggggcatttgtattgtatgtttggaatggtgctgggtactagtattaatacatgattttctctggtctttgcaaaaactgcctgagttaggaattgtcattcccatttcattcatgagcaggctgaagttaagagtggttaagtaccagctgaaagggaggaggagcctgagagcaatctgggcacccgttctccccctcttcttatttatgaatgaatgaatgagacagggtctcactctgtccgggtctcactctgtcgcccatcctggagtgcagtggcacaatctcggttcgctgcagcctccacctcccaggctcaagcagtcctcccacctcaacctctgtggtggctgtgactacaggtgcatgccaccacacgcagctacattttttttgtatttttttgtagagatggggtttcgccatgttgcccaggctggtcttgaacccccgggctcaagcgatctgcctgcctcagcctcccaaatggttgggactacaggcgtgagccactgcgcctaaccctctcctcccctcgagcttacatcctactgtcctgtagccagctccaagatgttggcctttggttctctcttcaggctgaactctctttcagggagtttcctaatcgatcttccatagagttgatcataccttagtacctacctggatgagcactcaagatgttacatattcccacctgacttctttattactgctggaagatatggtgtcccacacctaagtatcccacccacagtccccagctgcatgtgtcgattattgtgagctattcaagggatacagactgaggtaaatgaaccaccagtggaagaatgtggatgttctattacaggaaatgcttagctctttattgcagttatataatagccggcaatcatgatagctgaggggcataaaaatgagagcaacagagtttatggtattctttataactgtggattctgtatgtgcgtgtgtgtgcacgtgtgttctgcatgcatctccacggcacattatctggaggtaacatgatcatcaggccttgagctcttttataagcaatagattgtggctggaaattgaaaatttagtttctgtagctagaaaatactcttttcaaatgccatctagaacagtagttctctgagtgtggttcctggatcaggagccttggtatcactgggaatgtgttaggaatgcagattcttgggttctaccccggattgaattcagatttgggagcggggcccagttatctgtgttttaatcaccccctcccccaggtgaatctgatatgctaaagcctgagcctcactcccctggaaagtgacgcctgattcatctgccagcccatgggcacccattaggaaggtgcttatgggagctttgacctgggctaggtgccggctcttgatccatctttttctaaggctgagggtgtccatagaaggagaagtaggtgcatccgcttagatgttatttaaccaaataaaggtttacagcttacagaaaagaggcaagattaactaataccttccaaaccataatgtaaaaaaaaaataaaaaatatttactcataatggagtataactgaacaaatcatgttgctaatttttttaggatatgttttgtagcttccattcagatacatcttatgggtaataaatacacacgtgaacacacatatgtgtactaacaatatttttcagacttttgattttttagatattgagtatagccttgttactaccaaacttttatcatacttccttgtgaaaggatttcatggcatatttattatttgaaatatcaaatagaaatcagtacagtctcagcattttaagatacttgatgtaatctttggaaatatcttagacattgcaaaataagggttaatagtcatagtatagccactaacgggcagttctgaaattacataaagttaatctgatgaactgatagcaatcagtttttggctatacataactagataagtgagaatttagagattgaatacatgagagccctttttatgattttcaggatctcaagtatgaagcaaaataaattcttctataccctaaattcttgcaaagtgatattttgattagatttgagctaccccagggctagcaatacttgaaagtgtgactagacttaacctcttagtagatagtccgcagtaatcctttgaaatatacatcttgctaaaagttcctttcccaaggaaataatgattaaagataatgtgatgtgtacaaggaattctgggacttgtagtcgagaaacctgaactttaatctagactactcaaatttataactttaggcaaatctctcttgactttctaggctttagttttctagggttttgttttgatttgtttttttatgtttttgtttttgtcttttttttggggggagggtgttgagacagagtcttgctctgtagcccaggctggagtgcagtagtgtgatcttggctcaccgcaacctctgtctctcaggttcaagcgattcttctgcctcagcctcctgagtagctgggattacaggcacctgccaccatgcccagctgatttttgtatttttagtagagacagggtttcaccaggttggccaggctggtcttgaactcctgacctcaggtgatccacctgcctctgcctctgaaagtgctgggattacaggtgtgagccacctcgcccagccttgatttggtttttaatctgtaaaatggtaggtgttgggtcacatgaacaatggctcttttacctccactaattacctagacgctagaaataagaatatggataagacctaaaccaaattttctagctaaattttgtaaagtctgaacaaaatctgtgtgcgttttaatctttcttgtaatcttttcagactctgtctttaaaattatatatatttttagcttctaagtaaacattattggcactggttttgataggaactttactccaagtgtattgacttagtagatatgttaaaaaggttattgcttagtttgtggaaataatacaagctgagactttaactgatatttgtattttcatttaggttccactgttttctcttttgaatgaaaagtataatcctattaaatctaaaatattttcttacagtgatccgtatgtgaaactttcattgtacgtagcggatgagaatagagaacttgctttggtccagacaaaaacaattaaaaaggtaggtgtcgatctttaaccaaatgtcatttaagtcataatttaatccaattatgcacagtcatgtgctgcttaacacctttttggtcaaggatggactacttacacagtgatagtcccgtgagattataatggagctgccatatacaagtgcatcactttttctcttttttttttttttttttttttttgagatggagtctcactctgtcgcccaggctggagtgcaatggcatgttctcagctcactgcaccctccgcctcctgggttcaagtgattctcctgcctcagcctcctgaatagcagggattacaggcacctgtcaccatgcctggctatttttttttttttttttttttttgtatttttagtagagacagggtttcaccatgttggccagactggccttgaactcctgacctcaggtgatccacctgtcgtggactcccaaagtgctgggattacaggtgtgagccaccgtgcccagcccactttttgtcttatatactgtattttcattttaagtgtctttcagtattaaatctagaagttttccaagacttttcagtactaacccaagatagtgattcaggtttttacttaaatgcctacaaaaacagtatcctgaaaatgtcataagttgtaacattttttcttgcacagaatacagcaaaaacaaggatttgtttttgtctttgtatgtttcacaaagaaacttaaagtaatttaaaatacatttaatgaaatggagctgtttgtggaattggtaggcacaccaggaatagtttaacttgaaacaactatttctaaaggaagcaaaatacttggttagctacatggaaatagagaaaatatattaataataaagctatacatgtatgtatatatcttattttcctaatttttatgtacatgatttcattaaaaatttgtttccataagtatgtcttttagttatttatttatttagtttgagatggagtgtcactctgtccacccaagctggagtgcagtggcataatctcagctcaccgcaacctttgcctcctgggttcaagtgattctcctgcctcagcttcctgagtagctgagattacaagtgtgcaccactatgcccagctaattattgtatttttagtagacgtgggattttgccatgttgaccaggctggtctggaactgctgacctcaggtgatccacccgccttagcctcccaaagtgctgggaatacagatgtgagccactgtgcctagccaataagtatgtcttaatttgcctatctccatgtatttatagacatatgtaatatatatatatgtaaatattttttaccctatgtttggaggctttattgaagatgcatgttctctattaaaaatacttggctgcatgtggtggctcatggctgtaattctagcactttggaggccgaggctggcagatcaattgagcccgggagattgaggttgcagtgagccataatgatgccactgcactccagcctgggtgacagaatgagaacctgtctcaaaaaaaacccaaaaaacaaaacaaacccctttcatctgtgctttagtatcatttatgggttactatgatttttttccttacctcctttagaggcgggtgcttagatagtctaacactttgctgaacattttctggacagcatgagtgctttaaaaaattgtaactgtcttgctgccatgcaggcacccaggatgcagccaggtccttttgtgtaaggaaccgtaactgcagcgtgtcctccacttggcattgggactggcattaaaaatctgttttgcaaacaggagccagtcttttgattagcagggaggatgcctgcgagggacggaggccattgttccctgtgttaggcgttgttgctggttcagtttctaggcgagtgggggctgtctagaaggctcaccaggaaggcagctgggaaacttggttgcctgctggatgtggagccaggaccaaagccggcgactggggctattgcaatggatttccttccaaagggaggtcctccttctccctccctttccacggtcgagggagtagctctgtagctgggtttgccctccttctcctgctgcccgcctcctggttcgtatgcctctgctgcgttcgggtgcgagaactgccgtcatcctcctctccttgccgtgttgtgactggttcttcgttcgttttgtgctctcctgtcttgttgctttcctcgcctgtcatttcccatgtgcatttccgtgaagctgccctccgggactgcagccagaggcaggccaggcctgctgctccactcccctcccctcgttcattaccatccttggcttcattcacatgggagaaaagtatgaaccccattatttaggattgaattcactgtggagttgtgggtggggaaagtgctgaatttttgaaaacgccggttcagtgttgtgtgagctctgtgtttcctatttttatgttgcactctgttgatttttttcatctccctgaactgatctattaaaggaaatagattgataaatatcattttgactaaaaatatctatcgctgttggtgaagtgatggtttttttttacatacaatttttaagagctgtctttaagaggcttatgcatgtgcagatgcatgaacacacatgtacagtcttccttcctagaacatgcttcctcttagttttgggggatatctggcagtcctttcttccatgctgaggacaaaggtatccttgccatctccttgtgagatgtacatttaagtagactgatagaaagatgaacagatggatgaatggagaggaagactgaaggataagtagacaagtattttttaacctggttatttttggagaaaaaaataattcacttttggcttacatttggtctttttttttcttgttataaaatctgatcctcagtatagctctctataaaatgttaagatttcaatatttatataaacaatgaacacattcaactttcccccacctgcttcgttactctgcaaaacagatttgtagcagggagagggaagtcaacaaagttcatttccttcttggtagaataatcatatcaatgctaatttcttgaagaaattttttatattttcacgatgactctttccaggcctttgatgtttttccttctggtgatagaagcagtttaaggtttcatacctatgaagcatctgtttcataaatacattccctccccctccagtttggtttgtacgctagtctcaaataatcgactaaatgcttctcttagctttttttaatcaaaaaaatgtttaagcaaatatgtagactgtattgtactagtaactgctaatgtttgaaagactaaaagatactacaagataatttctcttccagacactgaacccaaaatggaatgaagaattttatttcagggtaagtttttcattgtttggtaataattgttattgatacgtctaggtcgattatcacagtcaattcatcttgaggaaaagctcttaaatttttaatgagaaattccttttaggatgaaaaataggtagcctcctaatgtgtcccaaattttgaaagactagaagtagtggtcacagaatccggacttgtttcattggggagtgttttggagaagtcaaaagaaaattatccaaacaccatgtttcatcttttgaattcaaacctttctttaagaaataagataaaatatcatttatgagaatggtttaattctatgagacgggttatgaaatattttagagagagtaaaacagtagaggcaacatgattaaaaagaaacataaaaattaccagttatattctagttagggaggaaaattttggtaactgaaacacttgagtgcatatatatgtgtataatataaaattacttctggaatctaaatacaacagaattaggtaagatttcctcaaccttttatatttaatatttagaatagctatatgtcgaaatgactgaaatatgtgaattagcagagatttctgcttattgagcatttgtggttgttgctgtgttttactactgacattttggaactattagactgcttagctatttaattgaaagaaaggactttctcttcaaaacgaaggtatcttaattgtatagctgtgatattaaaaactgcttacctccagaaataatccaggtcttctgattagtgcagatttccaaaggccagtattgccatgaggcccattataattggtcctgatttcttcctctcaatcgcaatagtattttttgtgctccaaacttgggctactacatacagcatctgctttccattatgctcagagctgaaatatggcactgatactttcatacttggtgaaatcctatgtacagcctccaccagatgtatttgaaattaccctgtggaggactgaaaagctaataggagctgatagatgctgttggcctttagttaactctgaaatatagctttccacttgtgaacctccaaagtgtttagactcctttcagtggaacactggcacagttacataaatgttagtacatcccatacttttttcagctaatcttggcagtaggcacatttaagttctatttttgttagtttttctgaaggttttttttgtttgtttgttttgttttgttttgttttttgagatggagtctcactctgtcaccaggctggagtgcagtggcacaatcttagctcactgcaacctctgcctcccaggttcaagtgattctcctgcctcaacctcctgagtagctgggactataggcccgtaccaccacgcctggctaatttttgtatttttagtagagatgaggtttcaccatgttggccaggctggtctcactctcctgacctcgtgatctgcccgccttggcctcccaaagttctgggattacaggttcttaaggtctttatatttattcattttacaaatctttattgagtgcctattatgtgccagctcctgcctgtagcctgtggttgcattggtaagcagtgtgacccttcatagagcttctaaacagatagcaaaccccatctgcttgttctgtcgctaggctgcaggcagaccacggaccagaagcacaagctgagctctctgtgcttgtatggtcaagtgttatttcatgcattccccaccatgaagcagccagggcctaggtcacctctctgctttaccatttagagcctttgtgaccctggaaaggccacctgaggactctcaatctccctgggatccttatctctcacataggagagagaatccttacctgcaagggttgtttcaaggatttgcatgcgatgatgtaaatgagaacatgtagctctatgtcacacatgtggttggtgcttagtaaatgatacctgagtttggaagatgatatgggccattttggtgaggttttggtaaggaaaaggaagcaaaaagatatggaaagcccagtagctctgtcattgcctcacagttccaggtctctctcatggttcacagtctaggctctggagacaggcagcatagacctagtgcaggtcctggttgccctacacattagctgtgggctcttgggcaagttacttcactgaacctcagggtctcggctcctcatttataaaattgcgtgatagttatacatcataggattgctgtgaagattaaaggagatcatgggttgttgatatttaataacaagacagtgcctaaaaagtaagtgcacaggctgggcacagtggctcatgcctgtaatcccagcactttgagaggccaaggcatgcagatagcttgagcccaggagttcaaaaccagcctggggaacatggtgaaacctcatctctacaaaaaaatacaaaaattagccaggcatggtagtccaagctactcaggagagtgaggcaggaggatcaattgagcctgggaggttgaggctgcagtgagccatgatcatgccactgcagtccagcctgggcaacagaacaagaccgtctgtctctgtctgtctgtctgtgtgtttgtgtgtatgtgtgtgtgtgtgtctctctctacacacacacacacacagatacattcttaagctattacaatcttcttcattatttttatcattactattactgctatcaggactaagaaatatcctcaggcatagacattttttgatctacagtcatgagaatgccttgtacagaggttaggaacccgtcaaagctatttacaactatcctttcttattttagaaaaacagctaagagccttctcttcttttgctatgcctaaatttggggcagaataatatagaaatcagtaataggaaatttgatttagtacacatagaattcccagaacagcaggataattgttcatattatacaattgagttgggcgcattgtaaagcagtatgttattctttctgttccttacgtcgctgttcaaatgattcctgctcgtttaaaaaatactatttatgttccttataggtaaacccatctaatcacagactcctatttgaagtatttgacgaaaatagactggtaagtggatgcctgtatttgaattttgcttcatttttttattaactggattttcagagcagcgtctttaaaactctgtgtttatgttgtacttaggacagtatatgtgcccaaaaagaagactgtttttgtcccactacgagtttgatgttcaaaatcctaacaaatagttttatgttgctaggataaaaaatgtatttgtatgtgtgtgtatttttattgcagttaatgttaacgaaagccactggtgatagtaccagcccatatgctcatgctctaatgttgggaatacagaacggtaggcagatctctaaagaggccatcaggaatgtaaacaaactttgctcggtttttaaatgaaagccagaccatagtactgggatgcattcagtagcaaatctatggtaattctctcagggaaaataacaatctaattaacaacgtatagcaaaaagtgaatctacatttagcaggtaaagtcaagccgtattttaaaagtggttgccttcttaagagagaaccttagaaagtacctttaaagaaacaaagatatgcctgaggcatataacagatacaaactaacattttatatatagattgatgtatatataatatgtttatgaagatcgacacatacataactgaaataattatgatttcattttattgtttttaattttttttagagagagggtctccctctgtcacccaggttggagtgcagtggtgcagtcgtagctcactgtaacctcaaacccttgggctcaagcaggactccaggatagctaggactacaggcatgagccaccatgcctggccagatttcattttagaaatggaatttttgaagcacattttgctttcttaactatctaaaacgtgtacatcaagtagctgtgaaccaggtgttccaactatgaaaatgaacactatcatgttaagtccttaaggtaccttcagaagtgacactataattcagtgcagtcattctcaaatttaccctctctgaaacttgtatggtatgttgactggttaaaaggtgttcttaagaatcctttctgcagtattcaattgaaactccagatttttaatagctggacgttaatagaatatttgaattggaggagccttatacaataactcatttaactcctgttgttgtcgatgagaagaaccaggtctagagcctttacataaacacatcagtcagtggaggtgccagggtctgacctgctggcctcctaagtcccagcccagtgatagtttgggaatgtattgaatctcatatgattagtattattctccaaaagagaaaactaacagattttggcctaccatcctagtatcttttccattaaagtatgggatgttgggtgatgaacagtcgtacagtgtaactaaaccacttttgttgtatgcatcaaagtactttcttgtgaaattggatgagagattctgctgagggtgcagttcttgtctctccatctctcatccagtgaggaccaagtgagttaagcagtattgagtagtataacagtacgttcctggagacatgggtgtgtctgtagactaatccttattctccaattattgagtataatatctcttgtttaacatgaggaaagggtcaaatttgaggaaaaatggcctcttgtttgatgtgttttagttcattattctcttctattaagagaaattcactgttaaaaaattgtttcccatttccgtatctgaaataatgactgtagttgaggtgatcttgccctgggtctgaaatcatacttccaaaccaaaaaggactttgaatacaaaacttttaagaaatcttgtatgaatacaagctatatctgaaaaattgtgttttataatattgatgcctagttttgccccaggccatctgcagtgtggttactatgcaaagaatgctggtgttgctgtttttttttttttctttgttggctattaacccagcggagacaatatgtggctatggtagtacttggaagttctagcattacacagactagcttccatttctctcatagaggtcatttttggcatttaaaacacatacttttagaaaacagatttggatgtatgtaaacacagggttaatccaccacactctggatgctagagctgttgacaaagtcatgctttgcagattttaaaataaactttttgttactcttacagcttggtattttcccctcctattttttttacctcctctaaataaacctctttgttaaataattgatgtttctggatcatagaaaatagtaagtttaaaatacagaatatttccaagctaactacaaatctgatgacagttttttgagtgtgcacttttccttttatttcttaggtcctttttggtcctttgcaaacatagtaagattccatatttgtgtcccaactgtggtaatattgctgacttcttactggaaaacagtcagctctaggtagcatttcttctgtgtggtatttaagttaaattattaccaaaaaaaaaaaaaaaagcccacatgcactcccttcttcaattttccttttgttttttgttgtttgtttgttttttggttgatgttttctttcctacctgacatatggaagacaatgttttctccagctgggttcattttctctttgaaaaggagacactttggtgtctgccagtcatatgtgagctacacacacgtatacaccttttaaatgaaaaatgctgtgatagcaggagggctctgcttggctaactggttgtgtagcaagtcgggccccctcccctccacttagctattttgttacttgtagatcctgctctaattatttagcattaaacggacactaactctgtagggtgtgtaatcgtatttatagtactgttttattagtttgcattccatcctggtagtgtagtgatgtcataaataacagaaacatggtatccgatgcttgggaaggggtttacccggtggccaagccatattttacttgtcattattccgtgtggcggaaggtgggaaaataccgtgtgtgctgttaaacatgccaggtccctgcactggttagacagagtctcagtgctgtgctccgttgggaaagaagtgccctgcgaatgtgatgtggtttagatttatagcagcgtggcttgcagtgtgtttgctgccttagtcagctgtgagagcgccctgctggggccactcctttctgatggaaaagcagcagctgggaaggtgctgtttcaggctcttgctgtttaaaaaaaaaaaaaaagagcgagtaggggaaaactcctctaagtccagaagctggcattggagggggagagcgcggtcatgtggttctggccaccctaccctctgtcacagtgtggatgagagctttttgctcttatccaatcatgcctggaatgccgcttgccacttgggttatttctgctatctgtcgctcccggtgccgcagtgctaacagtttggcagatgggacactttttcttggaatttgtgtctttggtttgtgacttctggcagtgtcgggcctgttgttgccgcttgccctagccctcctggcccccctggtcaccatggcccatcggcttcggtttcattttggctctggtcgcagcaacacagcccccgaatcagacatcctagaccaggagagagaagacgacttcttcatggcattccacaccctaccgcggagaagcagcccgcaccccttcgcccagaacggaggggaggacggcggcggaggcctgcagggaggcgtgggtgcgcttaagcggagctcgtccatgttcatcccgcagctcttgaccagcatcgacgcccgccccacgtgcagctcctccgtgcagatctccctgcagcgcaaggccacggacggggccacggacgggtgcgggccgcccgagggcgccgacgatgggcctccatgcgcaacgcccgaccccagggaccaggcctccgccactgccaccacgagggcctcgccccagagtggctcccgggagccctcgccgagggacacccccgggagctcccctccgagggcagcccgggacccagggctccaggtcaacggcacgtgcggccgccgcgtgcggtgctccggccccgtggactgcgcggaggaggctgccccgggcctgcgcatccagcaccgcgcctccagcgccgacgtgcgccaggtgaggctgctgcccctgggccccgatggccagggcggcccggccgcggcagagcccaggcgctggtccctgcagcacgttccagatgcttctggaagctctgggaagcggtgttttgtcttccagttgcagcagccccaacaaggcgcttcggggccaggcagcgacctcaactttggcttcacgggcacaaagggggacaggttggtgaggtatcctcgcattcggctggagaggagcacctcgtaccccacgcagccccgaagcgagcgagggagccccacggaagatcggggagccctggaggcatcgcctcgagctggcaggatggctcctgaaatccgcaggacgaactccgcggagaggactccgcagggccaggggtgcacatttaagatcaggcaggatcagaacgcggggcagcagcattttagaattcttgtaacccgggggccggaagaagctccccagaatcccgaggagaaaagcgccaaaagccctgtttccacgggagctgacaccacggtaagttcacagcgtgtttacatgtgtttactgatttcaacttcgatgcttactctgcggcgtaaccaaaataaaacctcaccctctgttccgggagtttccctgcttcaggccagtggatctgaatgtttggccgagttctggcacgatgatttgtggtccagtgtttggtgcgcaaaacaccatttctgcaaatgtcttctgtaggtcctcaaagtcaaagaactttgtctgtttgggaaatccaagcagaataccttccccctgcttttatttttctgaatagaagaatttcgaataaaatttgttactttaatctgccaaaaaacaagtcagtgccccaacgtgctgatgttggaattgcatttaaaaagctgcttgcaagtatagcctgtgacaatactttaaaaataatcagttctcggaaaggggaggatattgcaaaggacctcagtttcgtctcttaatagttaaaataggtgaacgtaaagtttagtggaatttgattatctgtcatggcctgtttgctgcaggaggtcaggtcagtcgttgttatataatttgctttgttttttgtcccattaagtaatactgaacgagagtagtgtcgcttgtgggatagtgacattactatcccacaagtgacactgctaagatactaacagatgcgtttttaaagcacattgggttatggcccaaggctaggggaaactgatggggactcgttaatggtcagatggcgtggcgtgcaatttaacactgcacacttgagtgtccaagccgaggatgctgtatatagaatagtaagtaccctgtctccagctgtggagaaatagacgccttagaacagattctggccttcctgtttctctgttcctgatcgctccctttcagtgaaatggagtacagagagacagctgcacgctccatcgaccaggcatatgatgactctgcagctttcgtggtttagagtggaatgaaaagtttaatcagtttggtttcttttactagtaatcactagccagtgagtgctttctcctaaagaacaagctccttatattttgaattggatattttttctcctgaatttcatgtgactgccagtttgaggatatgattagtaaatgtctaggggacttttctttggatttcacttatgaattgtgattttgaaaagtgagcgtctgagtattactctagaattgtattgtcttttattgctttgtgttcagaaataagtttcgtctttcaagtaaactttatcactcctccatcattggttttcatcattttgaagatacaatcagatgcttaatgaaaatttatttttcttcttctctttccttccatgtatctcctttctttcattatctcaaactcttctattgggaaatggctaagtgctttgtcttggtctgaacctataccatgtattacacaatggtacaaattttgacagtgttttgatattatagtagcctttaacgcccacccccaacaaattaccatcatgacagttgtaggctttgttcggcaacacaattccatgctgaacttggaccacttaccgcatgaagattgacaaaaatatatttcctaaagtttgataactattcaattatattaccaaaaactgaaatcactttgcagttctgatgtggaagacaaagggattcatacaattaaactcaaaaaagttcaaactcatttggtttgaactttcaaatgtaattagaaaacaaatcgaataaactaaaacttatgtgtaccttgcttaaaagggctattctaacttgcaaggcctatgtagtgaaaaacaagtttctacacatttggagaatataaattctggaataaagagcttttcttggagagtaagttccaactagtgaacagtagtttgcattttcatatgtatgtatttttgtacacatacataaattagtacgtggttagtaagctggttttcttttaagcaaaacgatttttctttaaaaaacaaaaccaaaagtggtcacataacaaaaccgcctgctccattcagcaactttgtatgcatttcatatggacaggggtgttaagtttaggcagcagctgccaccgccttacttatcttgaaggaaaacattcacttgggcgtctacagtctggctgctaccaagcttttttggcgtttcaaatatccactgctttggtctaaaggacattacattattaagtttacatgaaaaattagctagaatctgttgcagtttggtggtggaatgatacggaaagtcttcctagatttgggaataccgctcgggattcatttgacaacgtgctcatatttcataagctatactttagaccttattacaagattaagttgttgagtacttttatctgtgcctcccaaacatcctgccatgactaaatctaaaatgtaacatgactccaaaaaatgttaaccaactaaattattagaaaaaatacaggggaaacccttgtgatgataagttttccacctggtttatcactgtcagtagacaagaattcattcgtatagtcatcaattataatcagttaaaaattttcagaattgttagaatttaccaattcagtctgtggcagtcattagtagtcatttagtgagtaatttagttattttcttataaattagcttttgggttattgggttctgagcctcttaactgcattagagttattctgaggaagttggaccaccatttaccagcatttgtgccccctttgtatgccattttgtgcataataactgtgaaactctgcattttacaagcttgaggagccagttttctaatctcattggtgttatgaagtactcaaggtctactgtgtatataacattacacccgttacttggaaagtttcagggactatctcagtgtcttgctgacacagtttgtaatgtaaacggagggaggagggcccacccggacaaaagcagtaattctaacacctactgcatatgctattggagaagagagcgttctttcagctcaagctctctggactttcctctgtgtcctctcagtggacatgtacttcacaggagtagtgtagtaatctcttgtgattaaaaattacttttattgaacaacaaaggaatatccaaattcttttcatttggggaaactttgagtctcttttacagaagatgtttttaatatacggccattttttgacattaatattagtcgatgtctgttttttaccctaaaaataactcgagtatccaatgtattaaccacccctttattttaaaacataacaacacaggaggcgaaggtgggaggattgcttgagcccagtagtttgagattactgtttctaccactgctctacagcctgggcagcagaacgagactttgtctcaaaaaaataaaaataaaacttaatattgtaatggagaagaaaaacaagtagcattcttttcattgacctggtttctgactggattcaatcaactttctttcttctctcatgtatagtaatgctctctcttaatgtggtcttagaataaaccaatatatatcttcaaatgtcacctgttttcagggatgttttgaaaagttggataggcagtgcacaaggttgacaccgatatgtttgtaaacagaaactgtacatggcttgcagcatagctcatgtttctgtagcacttcacaatttgaagaatgctttgtttatttcacttaatatgtatggctgtcccattgtggaggcattatctcacttgaccctcccatgtgaaatggtgttatttcactgtttcagatgaaaggatgtgataccgttgttaggtgtaataacattatgtgtatatcatagtgtatactatgataccactttgtgcacctataatgggaatgtgtatttatgtgtgtgtgtatatttgcacaattaaaaagtatatgttaagccaaaaagcagtttaatgcttcctgtgatgtgacagtttttttgaaaagtttagaggtggtaacttcatttggtgtcttgcagcactggcctgaaggtgagagaaggcttctttggggatccaaagagccgtcctctgcagttcactagcttttggtcctggagtacttagactccctctctaagcctattcctcatcagtaaatttgaggataaaaatgtccagctcgtaggttcatagttaggtttaaatgaaagtgtccatggaagtacctgattcgtgaaccaggtatctgtaatatacaagtctttcccctagcaggttaattaggttaattgtgaacaaccattttttgatcagtatggcatttaacacaaggacaacatgcatttatggcatacctggaaatgtttaataaatagctttgatgctctttctgttgtcatctcatctttcctaagtatttgtccctaacaccaaatacagtcttggaaaagaattgcttcctgaactatgcattatagaaaaggactcgtaagtatatttactgtgttgattttgaagccttataacattttggcttgcatttctagcatattttttaccatgtcattttgctgtaatatttccagtggttgagtctactgttactttggtatagactgaggcttttgagaaacaatatagtgttatatctacaaaatttccacattgtatgactttaaaatgagggagatatttgggaatatgtcttattttaagatactgtcttttagagagttttcataaatggtgcagctgcttctcttggctaagcctggtggcagaattcctagtcattgaaataaatctctaattttataatacatactgataagaaacttgctatcttttcataaaagttcacagtaccagaataaatttactttatgtaaaaactaccttaaaatgtaataaatgttggatagttgaatggtttctggatagttgatgaatatttctgtatagttgaggcgaatctaaatggtaatgctacttgtgcaactgtcaatgatctagcacattttttaataaaaataattacctgcatattactgtgggcgatacaggttagctatcctaaatacgtttttacctttttaactcttaattatattaagccatttgcaagaatgggaaaaagcaggaaattcataggtggtgttgaaattgctgattctacacaaaggtaccagaatgtctacatttcctctgtaaatgtcaaaggaaactttggaaacccacctcagagttggctggtgattattcggacaggttatcatcctgtctgcaaccttctagttctcttagttcataccaagcagcatgatattccatgtcctgcacaaaggagagcaccaaaacagccttcacctgctgcgtatgccccactctgaataaaaaattaagaaggccaaaggacggaatgtgttaaatattagcaaaagcaggtattgcagaatgtctatacatttctgggcaggtggagattattgaaagatttttagaaataatcttcgttcaccacattccagtgccaggccctggacttctgtctctatttgtgataaaatgtttttaagaaatgctggctgggcacggaggctcatgtctgtaatcccagcacttccagaggctgaggcaggtagatcccttgagcccaggacttcgagaccagcctgagcaacatggcgaagcctcatctctacaaaaaatacaaaagctagccaggcgtggtggcctctgtctgtagtcccagcttcttgagaggctgaggtgggaggatctcttgaacccgggaggcggaggttgcagtgagctgagatcgtgccactgcactccagcctgggcgacagagtgaaactctgtctcaggaaaaaaaaaaaaaaaaggaaaagaaataatcttctctcagtgagcatgttgaatgcataatgttctcactggagttctcctttggaatctcttgattattctgctgtggcttccttgggccaactaggatacagaggagaataaatgagtaactcagtgagacaggtggcctgatgtgagtgggcctgaaagttagcccctgatgtcctggctggtttcatgccatgtcctaaacgggcactttcctggtctctaggcatcaccatgttttgacaggaagcttagtttctttcaggatggaggatggaatcaattgtatttcaagaagcctgttttttatgccctgacaattttagaactgtggactgttctgacacttttgagtacagtgattaaatctctgtgaagggacaggtcatgaaatcaaataaaaggacggatcataattgagctggaagggggccctcctatctctgatttgactcgttgctacactttagtattcggaaactttgtattggttcccttaagtgcctgcacaacctccctatttctggaaaccattcagtgtttgttttaatgttaagcattatgccacgtatccagtaagcagagcagagtaaattcctccaggtagcaagagactggaatttcccccaggcagatcagcttttcacaggttcctagagtttacacagccttcttttgtgacttaatttttgtagatcacagtgagtcaagtgacttttacttccctgtataataactttgaggagcctacttgcaacccacatcatcactcattatcttgcttacttctttcttgggggttagatgggctggggttgttattaagcatgttaaatactttgaaattcaaatcgtttctgatagatttagtttctctttcttctattggtcattcgagagctggtagacttttaaaatacatttaatgactcacacatgtcataactcatccatttccttgacattttcaagcgtgataataaatcctacttcttaggcttttttttttttttttttctctctctcatgttcttttcaaatgcatggctaggtagttacctcatgaaggaaaacaactgttttggtccagattttaaaaattgagttgaatagaaaaggtggggtggaaccagcaatactgaaatgtaataatgtatattaagctccaaccaaacaatccagcacttcttcaaatccaggaggtcttctggctaggagttacattgcagaactaacatggactcttaaactttgtaaggaattagtcacagttgaacactggaaactatcagcatacctctgggcttcttttatatggtcttcctcatgagttaaaatgccttaagcatagtatctgttccataggaccttactgattatgcttttccacttgaataaaagagatattaagttgtaataaaactttaaatattttaatttagtttgaatatttaagttgaattaacctcttactacagtaattatcttttttgctaacttcttactacggtaattatctgcttttataaaatccagaaacgatgttatacacattagcacgcattattaggtgcccaaatgccaaggctaaggacacagcaatgctaaggacacagtgtgcctccggcctgcttgcaccctcggttgaaattatattagcaagagaagctcctgcattctgcagtatggcatttttctccagctaatgtatgcaggggtcatttttaaatgttagattcacagatttgcagagctgtgagttgccttggaaattatgctggccagttcctttaattttaaagatgaggaaagtgagaactttcctttttaaaaattgatacataatagttgtacctgtttatgggggtacatgtgatatcttgtacctgtttatgggggtacatgtgatatcttgttaacatgcatacagtgtgtaatgatcaaatcattacatactgaaatatttgaaatatctgtcactgcagacatttgtggcatctgtgtgttaagaacatcccaaatcttgtcttctggctgttttgaaatgtatagtaacttcttattaactgtcgtgctgaggacatggactactgtgctgttgaacactagaacttactccttcatctgaccgtattttcgtacccatttaccaaccctgagagctttacttttgcagtaatagagaatattctttttctctcttgagtatgaaataattatttttgaataatcactgcacgtgaagccctatccttcttgacgttggacatataaatacttagggagcttggtttatagagctttcagtttcacaaacagatgggacagctgaggtgaggcctgcctagcagaagaagccttactcctgatagcaggcactaagcaaggcattgggtgacagattgcttatgcacaggctgggagggacaggaactgtgtcatggaggggcaagactggaactagatgctgaaaagtgaccagatttgtctcagtgggccagtgggaggggcctcattgaaagactgaaggtagatgtgcctcccagggatgtggtggtcatattggctccaaattgccttgttcattattagcaggtttcagcaaattatttttcatgtgaaacgttgctgaagatttcttgggtgtggctgtcatcacaaacaattcctctcttttccatcaaatgtggagttggatgaattccttccttgctggcctgccttccacaaagctgctctctgaacacctgccaggccatgctgaggacaaggaaataccaaggcacagtttctgccatttaatggtggtagcagagacccaggaatgcaatggattattgtcactttcattataacatcatagtgtaggatcataactggaacagagaggatgaagctttcttttggggaattgagggagggagacagggtcttgctctgttgcccaggctggagtacggtggcgttaagatggctcactgccacctccacctcccaggctcaagtgatcctcccacctcagactcccaagtagctggaccacaggtacatgtcaacacacgcagctaattttttagtttttgtagagatgggggtcttactatgttgcccaggctggtctcaaacccctggcctcaagcagtcctcctgccttggcctcccaaagtgctgggtttacaggcatgagacactgtatccaactaagtaggctttatttatggagtttataaagaaactgtttatatatacaggggagaatttatcctgaagaaaaactaaagaaatgaatattttaaatacgtctctgcatttctttttgttggatatgacatttatgtaagaaaaatgctaatctgtatgatatgagacatgttaactacatatggtacatgtatttaaatatcatatgtatttagatttagcaacaaaaagggaaatataaaccatatttccaccatttgaacaaatcgtattcaattatatgtgcatataaccatttgaaaaaattataatgttgatcggatctgcaacctaaaccaagtgccaaattaaattcaggatagataatttcatataaaatgtttcacatcatagaaaaagcagtgaaaattgagtatcagatctgtgaaggatgatacatttctaaccttagaagcagaaaaggaaatcacagaagttggatagattcagccatataaaagtattaaatttctgaaccatgaaaaaaataactaaaatgagggaaacaccagatgtttttcttagtgattcatgtaagttctcatatgtatatcttttcagtgtctaattatgtgcatattttggccagtgggtttgtatctctgtagaaagttctagtaaatactggagaaatactgaggttcccccactccagctctttcactccattgcaaagtaggtcttgtaggtgaatcacacaaacggattaacaagaaagacagaaatgtccagctcccaggttcttcattatgctgttgtgttgtgccaatagaaaatacaatatatcaaattggagaacttgtggttgaaaataatatacgcagattgctggtggcagtattcatggatgtgactttggagtgatttttaaacacttaagtatttttaaatgataagaccaattataggtactaagagtcttgtgttttgaagtgttggagttaatccagataaagttacaaatctaagcagacaccttattaagagatcattattctctgcttttaaagtggacttgctttctatatagttatgaagaacagatagaaatgttttaagattactggctactattaaaataatctggtgactgcagttatatctgggtctaaggcattagactttttggaaaatggatgcttttaatctttccttccgtatatttgtcacccagaattttaaaatttggaaatttcattcattcagtccagatagagaattgatcaattggcaattttattatttttcgctcatgaaaaactctagggttacaagaatatgctcctgaagttaacatagttacttttaaaatgtctcaattctaatggttaggtattagtcctctgagttccggttgccccttaacttggatcttaatttacagtttacagaaaattgttcatatttcatattttaagatcatgtactctaaaaccctattatacttgaaatgaagacctgttatgttatactagaatctctcatgaaaatgtaacagttcccaaggaactttgtttctgtctccatggaccacactggctactgtactggatggagggcaaggcgggagctgagaggcctttgcagaagtgcatgtcgccttagtatgtggcagatcctggtccctggcctgtgctgtttccctccacaccctttgatttctccgaataccaggaaagatcatggattgtctcgggagttagtctcccccttagtacttagcctgtcattttcatgttgcaatgcctagaaaatgggaggtttttcttctccttaaggaagtgttatttcaagatgctttctgctgcctgtgtcatgccagggcgtgggtggatatatttttgcacttttgcaccagcgagtctgcttctgatttgcagattgcatttattataaggcgtattgtccattgatgaataatgtgtgggcattaaagcaaagctgatacatagcttttaaaatagctcatttatcctgcaagcttcacccccatagagaggcaggcccttcagaagcgttttccaggagcaaggtttctgcatgtttccctcagttttggaggtcgtcgttttttgcccctactgtgggggccaagggaaaattgctctgcgccttctgatggtcccctgaaaaatcaactgtcaaaagcccaattaataggagaaatgccatacaactttattaacgtgcatgcagattgattaccccaaccccccaatggggttcagaagcttctataccatcctgaggttataggaagaatggggctcagagcccgaccaaaaacagggtatggtggtcaatcaggttatggtggcaagaaagattcttggagggagagaagaggaggcctggctagcagaggtggccctgtcgtgtagatgaaacctcctaggtagcagccctcacagagaaggcagatgtttctttcagacctttaaagatgtcagactctcagtcaatcttccctagatctggacaagggagggccttagagaaagatggcctcccatcagtgcagtttcctccccaggtgcaaatctccccccacagacctgccctctgaacagccattcacagtgtatcaaagaggtatattttggggtgaaatatttttattcccttcacccctagtttatcatgtgtttccttgatgggctgagggcttgacagatgagcagatagacacaatcttagttcatggaaaaggcaagaatagagatgggtagcggagagtttttaagttgctgctgatgaaatagacactcctttgtctcagctactgaaaattttctttagaacgtggatttaaataaagaaagaaatagacatcatgctttgtaatgaagtcctttggtcatcgtaagtggtcacagccagtttatcctcaggcttctttaagctgaccagttaaggtttctgcagaggttctgtgtttgagggaggagaggaagtccttggggaggaggggagcgttctatgggagacagtgctcttgggagcattctttcaatctgatacccatgcaagggtgatgacaaggtatggccttcagtgactcagagcctcctcccttcccaagcctcaggcctgaaagtctggtgatcctccctggcagaaacctcactggggatcattttttccttttgaacaagtttcttactttgcctcatatgttccaatcttctgtcagtggccaggtgacatctgttggaatgctgatgtgtgttgccaagcaaaacagatgcaggaagacttgcccaaagtgggggaagagagggaggaaagggaggaaaagtgggaggtagagtgtgttagctggggagatgggatcgagcagtatttatctatagaacagatatcaaagattgggtaaatcatggcttaaaactctcagaaaagcattctaggttcttgcacatctttgcaaggctactgaatggctcatttttatttcccaccctgcattcagagtggtgtttaaatggctcaccgcagcaaaaaggattaggtattacccttgtgctcaacacaagtctgtggtcagcagatttttaactttatcctagtttattgatatttctgtcagtgaacaggtttaactcttaatggaatagaatctaccaagaataatgcagactggataaaaagaatttcactgattttgattatttagcacattaaaggggacccctggccagaagtagatgtattgcttgggagaggagggcatagtacccaggtggtacttcagggattctgattttcagtcagggttgagaaaaactgatttaagaagttaatgctactgacagcctaaatctgggtttccttgataacctttggtgtaaatactgatttaatgcatttttttttctcacccacttttccttcatcaccccaaatctatattgtgttcacatggttcctctttctagaggtgggagatgtccttttatggctcagaggtccacaaaataaacttgcattcaagcaaggttgtaaaatacctatgcattaagagcagtccagttgaatatttgcaaagcatatataaaagagcttctctcctaaaataactgaaatgaaaggattaattttctctcagtttcctactgcaagaagtaagtaaaagtggaattccaattctagccatggcaagaccggtctatcctgttatgtcttgtgtgccaataccacttttctccaggtaactaaagtatctccctgctgtaaatattaactgagtgcatttttgtggcttttgataactccacgtcttgaaagtgttggccagttgtcaaattttcatgaatttcagagaagtgggtaataggtggtttctctcacggtatttaaagcgaagtagtaaagaggaaaaagactgaaaaggtaacctgggtcaactcattttttagggcgcacagaagtgtggtagcggagcctggacatcaggtggcctgaagcccaaaccaccagctcccccagcacaggagagtgcaaactgtagctcagtcttggccatctggggtcttctgcaaatgaactgcccatagtctggccaataattcacactgttgtattgctgtctttcattctctcttaagtagagcgttctgaacatatctgaacaattttttgacacgctgttactctcctagccacaggttattttatgacctagtcattctttacataaataaacatttatcaacagtgctgtctgggcctagtaaggtatatagcctgctttgtttctgcattaaagttcttagaccgccatgatcttgagatgtttgctgcttattgtttctttctgatttctattgcttatcagttactactacttgtggctccaaggatagaggccgattccctcttctaatttgctgcctctcatctgcttgaagtttaggtgtttagtcaagctcactagcattgtttataaaggaagaataaataggttgagagtgaggacttagggtagttacctttttaataatgtatatgatctgtctttggtctttctccctcatatctctgctgattttactctcgtcctcctggaacgtctctggaatcagatagatttttgtaagatttggatgtaagaattcagtggaataatatatactagctgtttagcctagtgctcggcacatattaatgcttaataaatattagctcttattattattgtttttttccctgaaagagaaaatcttaattcctcacagatgtttaggaattggatatgtagcaaccctatccactgaattagtatcagcaaacacatttttagttcatcttgatttttatcttcattgggattatgcctttatccctttagggttaatgaatttcctactgtgctgttatggaagaaccctgaaaaaaaaatcaataaaatgtatccttaaaaaagattttatgattcacttgactaccaggtgtcagcaacttttatttttattactttaagttagaaggactttgaaggttttcgtggtttattctcttcttttttaaaggccaaaccaagatcactttttggtaatggctacctttcctctgaatgtatttctcaaaaagttctttctggtttttattaaacccaaacagttgttataatttaaaagttacccttttagagtgagattagctagaaaagaaattaaggattattttaagtaactcagcaagtaaccttttccaagaagcttagattataaattaacgaaaaccaaattataaaccaaggtgtatggttgattgtgggttaagaattttatcagcagttttgctgttgtatgtaccagtcgtatattttactactgagtagaagaaaagtctaaaaatcaagtgagtagtttttccttagctggttatcatgtttgtttgatcattatattaaagtgctccttttatttttcgttttgtatgttttcccaacttaataatgaatgtgcttctctctaatctaatctctgaatttcaggagtctattaataaagtatgtgtaaagaattagttgctaattttggatgtggctgaaatgagattgtcagcaaattacaacttcaagcctaggactgcagtgttatggattgcacctcatccttggttattgaagatatattcaaaatttatgaaaaatagaaaaaccttattacttctgaatttttccacgttagactttccttatacttttaagatagtgaaagtgttattatataagatcatggaaagtttgtctttccagacctattttatgttaggattttacaatattaaattcataagataatagtagagactagaaaacaaatccttactgataatgaatttcctaagtagtaaatacaaatgaatatttatttgtaaacctgggtgattaagtaatagctgttcagtgatattgatggaaggaaattaatattatttaatccaaaggccaggcgtagtgactcacacctgtaatcccagcgctttgagaggccgaggcagatagatcgtttaagctcaggaattcaagaccagtctgggcaacatggcaaaaccttgtctctccaaaaaaatgcacaaattggccggtatgtgcctgtagtcccagctattcgggaggtaggaggtaggaggatcacctgagcttggggaaactgaggctgctgtgagctgtgattacaccactatactccagcctgggtgacagagcgagaccctgtctcaaagaaaaaaaaaaaaaattaatcccgaccttcctccaaaaaagaataaattaagtccagaaagtttggtgattcacttgctgttgccgcctttataaacataaaagtcagtaaggctaagggacacttctgaattccttctgctgtccaggtactgtgccgagttctagagatgcaagtagtacataagacagatgtggcccctgcccttgtggagactgcagaccatggctctttttcatgaatggtagagacactcataagtcaaatacctacatattttcatgaatgtgccaaaggaggcaaacaggaagctgagacaggaaatcatggggaggcctacttgaagagaggtaaggaaacccccaactcaggagtggcctgtaagctgaggcctgggaaggacccctgtgggcatggccagtggaactgcagcggaagcagccgttcgcccaaaggtcctgcgctgggaagagagtcagagatgctggaggatcagaaagggatcatccaagtgagtggaggagacagtggtccaggatgagcttaggggaaaacaggggcccctggattgttcacgctgtagaacacagtcatgcatctgatatataaatagcatggagataccctcagtagatgcaaaactcaaatgagctcagctgctctgaagcctgggaaaagtcagcaatttgtaaaattatgacacatccacattttcacaggaaaaacaaagactagtatgtaacatctcctttggtatttacagaggatctctctctctctcgttgttactcttacaaatgataggaggccacttttgttttccaaattctgtgccagatatcttgcctttcctgagatatagacacggtagagtcaggagtgtgtgtgagggcttgcagacttctttttatgtctttagaatccttcttcacttttgaatcatttggtccaggagtttaaggccttttcatttggcttttgttgttcatttgttgaacataaataactgtgttcattatgcagacaccgtgtcattgttgacaatttggtgttgtagattaaggcaacgtgaccatgtaacaagttgggcaaatgcacttatccattcagtgagctctaacctacaaggtgttttgcttcagaccaaaatggtagactgcagaaccttcggcgcggattttaagtccatctttaaaaccataggtagagattgtatctgtgtgttcttctttaattaaaaatgggaaaatgatgcgacagagcaaagacggccatggatcctttttatccctctcccatccacacagagagtttatttcccctcccctggagtccaggctggccttggggttgccctgaagtgatgccgggccctttctacacgtagcctttcaaaggaccggcagcttccacttcctgccttttggaaaagcttgctttagggatccagctgccacctaaaggccctgaagtgagccacgtagagagaagttccagctttctagcccatctccaagtgtcaggcaggtgagtgaagccatcttggatgctccagcccatcaccatccaactatagtcacataagaggccactgatgggcccagtccgtctccacactcctgagagttagtaagtggctgtcgtgttgggctctgaagttgtagactagtttgttagtgacgtataaccaaaagagagagtgtacttaacatttagtcctgggaggttcgaactttgcctccgcctgtacgtgagctccctggagtgtgggatgaaggagtgcttggcccagttgttttcccggaagctggaggagggcagccatgcacaggttgtgtagaccaaacagttcagggatgcacttggcttagacagctgataaacagctgcagtgcccccaagggagttgaaagagtgggtattttgttgtcaggagtagaattattcaccttgaagaacagaagatttgtagtttaaggaaattcaccatattcttaaaagttgcagaaagagaagagttcttagcctaggcctgcaccaagatccagttcttttgaatctgatttaataggcagatgatgaaggacttattcccaataataaagaatagttcaataggaggttggtagtcttaattgtcttccttgtcaaatcctagtgaatttcacatcagatactgtgccctgtgaggctctatcaccttagcacttggtaatacgttttttatgtagtaggtgctcaataaatgggttgagtttctataataatttgatttctgtagcatctgatttaactaagtttgctataaaacgaaatctgctattgtattcaacatcacaataagcagtatcagttgtaaatcatacctacatacagttaacccttgaacaaagtggaggttggggtgtcagcatcttaacacatagttgaaaatcttttgactcccccacaatttaactagtaatagcctactgttgacagaagccttactgataacttaaacagttgattagcatatatattttatgttataaaaattaaatactgtgttctcataattaaactagagaaaacgttaaaaatcataagagaaaatatatttgctatttattaagtggaaatggatcattgtaaagtctacatcctcactgtcctcacattgagtaagctgaggaggaagaggaggggttggtcttgctgtcacaggtgacagaggtagaaaatccttgtataataagtgagctcatgcagctcaaacccatcttgttcaagggtcaactgtacttgaatggatttttttccctgtcataattaaccacccacacacatcttactagaccaaaaaagaaaacttgtcaagcaaataatctcccatttcttgggtcatttggagagataacacaggccaggttatatgtcctgaaagatgagaatgtgtgaagtccccagagagtctgatacgaggccttcttccagggagtagtggtctggccgctgcaccagcctgccccctgccatgccctgactcacctgcacatcatgggtgctgctgatgcccaggcttcatggctgagcatggcacccttagcacccctcacctgttacccaacggagatttgtgggtcggaggcatttcaattggagaaggatggaatggctgagggcaggaaaacttaacaagcaggaagtctgcaccctggctgcacatgagaatcccctatgggcattgaaagtagggggagcattgaaggtagggggagcattgaaggtagggagcagtcaggtcccatttcctaagcggctctgcaggcctctaagcttgtcagtcatctttttggtgctgtgtggactagtgccagcaggaacaactggatagttttaagtctttggcctcttctgacactttttaaaccaaacattttattaaattctcattcaagttaatagcaaaaaaatattactactggtttcatgtttaggtctcatttgcagtttttaaaacaacctaacggagtatagtaaatacataaagtactcgatttaatgtgcattttctttttcgttttttttttttttttttgggtggggaggggggtggttttctgagacggagtctcactctgttgcccaggctggagctatctcagctcactgcaagctctgcctcccaggttcaagtgattctcctgcctcagcctcctgagtagctgggaatacaggcacatgccaccacacctagctaatttttgtatttttggtagagatgagttttcgccatgttggccaggctggtcttgaactcctgacctcgggtaatctgcccacctcggcctttcaaagtgctggaattacaggcgtgagccaccgtgcccagccctagtgttcattttctgacaagttctatgaaacctggtgacttaacttttctgaatctgtttccctatttgtaaaatgacaatacttgcagtagagtttatgtaaggaattaatgagggtaactttaagatctttgtaaatgctaatgtgttttacaattgtggtcagctataataataataataatattattattattattattaataaaatgcttactaggcgaagttaatagctcccacccattcccaaactacttaaggaggattttaagctggaaacagttaaggaaagccgcatgatgccatgagcaaagccttccatctgcacttggcatattgcagggtctgtagttgctggaatgcctatgtccctggttacgagccttgatataattgtgctaaggcattttggtggagtggaccgtgtcctgctgttgatcaaacatttctgtgtggagagactttgtttttcccttggggagtatttattttttagtgccaggctccgggttggctgtgctacgcttggcttttcagtgccaggcatacaaccatgtcagaagggggactgcatggtaggtctcaggaagaagggccgaggaagaggagaaaagggacttggctgtggacggggaatcctgtgtatcttggcttctctgagccagctgtgcctcagaactttgatttgatctttgtaccccatgggtcctgccaggtgaggggcacaatggagaagagaaaaaaaaaaatgctctgctgaaaacataagcaacaaataaaatagaggatagtaatcctaggataatccccgaggcagcagagaaaggcaggctctggcttgcatgtcaggagctctcttcctgggggcaggagggagggtggtatagtcccagatgagtgcttggcaggttgtttagagcctggtagcagtgaaaagaaatgtctaccaggcatcttgtgcatgtggtagatcttgacttgtaattgtggcagtctcccctaggctcctcggcagctaggtgacagttgcctgctagttcatgggtcaccttctcaccctctggcttgcttctcagtgggtgtaaatggggtaattaaaacctgtggttttagactttgctccaaagactgtttctggggttctgcagacattgacctgaaatttatttttattatttttaacgtttaccacctgtgaagatactgtacatttaaagatataaaatgtatcatattaaaataaaatagcctgtatgttttacattttgagattctgtttatgctgtttttttaaaaagttagaaatgtattggcatgttctgatagcttatttttaactacttctccattgttgtaatatcataacaggttggactggctaggctatggtcagaaattgcttatcagtgttttatacatacccaagggattccaacacagggtgtccatggtcctctttgagaaaactttgtctaaaagatattgaatgatgcctcattaaaaactcctcagaaatattttctcctggcttgttttcgccttccgtgtcattgtttgagaaatatccaagattccttcttttttacaattaaaaaaaaaaattgaagcaagtccataatcccatgtagttctttgatagaattaaacttcagataggcataagaaattcagataggctttctctccactggaaatgcatgcctttcgcaatcaacagtgtatgatgtggtctgttctggagttggggtctgacccttcagcatggccagcgctatctgaagatcagaaaccctggaagccccttgtctctttttcatcttccacatctgtctggcgtccaggccctgcccctcctgcctcttcactgccactgctgtggccagcctcttattcagaggagtttcctacctggttagacacttaaccacctccagacggaccccttctaatccacgtcccacattatagctcaaaagtatggattttacagatcttatcctctcctgttctgccaaaaccccatacggtcctccattaccaatcaggtgaatcgacttgcatttcccagcgtgtccccacacccacaaacactccatgacactgggcccgtccctgcctttattccctgtggcccctgtgtgcaggagccttccctcccctttctatcagtccctcatgtacaggccttcagccccctcactctgccctgttcctacctccatcattgtgccatttatgtttgcatgtctgtcttctctgtcatatctatctcaaactaggttgaaaattttttgaagatggagattttcagaataaaattgttcacacagttatatatttgactgattatacttttatttttatttatttattttttttgggatagagtctcactctgtcacccaggctggagtgcagtggtgcagtctcagctcactgccacctctgcctcccaggttcaagtgattctcctgcctcagcctcccaagtagccgggattataggcatgtgccaccacatccagctaatttttttttttttattatagtagagatggggttttgctgtgttggccaggctggtctcaaacgcctggcctcaagtgatccgcccaccttggcctcccaaagtgctgggattacaggcatgatccaccatgcctggccgattatacttttttaatgtgttagttaagatgagagagtccaaagtgatacagcccctgcccccacagagcttccagtctagtgagagaggcaggtaccaaaaagataatgcacatgacagaatggactgaactaagtagtagtagaagttcaaacgaagaagaagacacaaatggataaaagctatggattctcaggattgaggatgctgaaaggctgcacaggatgaaaggtgcgaccaagggtcctgaaaaaggcataggatttatacttgcaaaggagggcatttccagcaagaaggcttggaaatgagaaaatctcgggagaataggcccatgttagaaattcggtacacgattgagaggaaaagaagtgccactggggaagtgtgttgaagcaggtatgtggatgttcttccctatgcagtggtgtcagtaggattttttgttggtgtgagatctgggatctgtttgtaagccgtctgagagctgggactttgcattgatcaactttttgttgcacatgctctgtgatgtaattggcactgcatgatttgacaagaatgtgttttatgctctaaatcaggagtgagcaaactttctgtaaaaggccagatagtaaatattgtggcctctatttagtccattctgaatgtacattagacacaagtttctaaagtacattcacaaataagcattatacacttagttgtaacatacacggatgttgagcagagaaaaagctctctgatttttgtggttcctgctctaagccaggctaagtggtgttgtcagggttccaaccccttccatccctgaagcacactcagcaaaccatctagtttataagccacagtgtgctagtaggtgctgtgtgtatttttttgcggggggaggaggtatttattttgtttttgagatggggtctcactgtgtttcccgggctggtctcaaactcctgggctcaagtgatccttctgcctcggcctcctgagcagccactgcacgtggctgcatcgcttttaaaggtagatgatgcctctggcctttctcattgcctctgggtgtgtggcccatgtcactgtccagcgcattccactgtccagcccattccactgtctggccccatgccactgtccagcccatgccactatctgtgtgttccgtgccactgtccatctgtgtagggaagagagcaccaggggctggcctggtcaggagagctttctgggcaggggttgagggaggcacatgtgagctggactttgaataaaaagaaaggaaagccaaggagcagaccgggcgaggctgggtgcgaagaccagatgtggcagggatttaggaggcagagcgagcacaagtctgtgcatattggtaggttctgtagacttgtcggttgtgcagtggattcatggagcctgtcgaggaagctacctgtgtgcttccactaggaaagcacagccacagagagaagatgaggggcagggaagcagtattgtggggaattcggagtgagggctgaatctgagaaatattattttaaaattatgttaaatacattattttttgctgtctccaaccatcattactatgttcactgtagaaaaattaagaaagtcagtatggcatatagtcccataaccaagaaattcattcattgtgacctatttgagggtcatttaaaaatgactgatgtaatttggtaaaagattaatcaacaaaatgacttatttcataattaattactttccactaatgtgacatttctcaaactctgcagtatttccttttcttcttttcttttctttttttgtttcctgagacaaatctcactctgttgcccaggctggagtgcagtggcatgcaatcatggctcactgcagccttgaactcctgggctcaagcgatcctcccgcctcagcctcctgagtagcttggactacaggcatgcaccaccatacccagctaatcttttatttttttgtagagaaggtgtctcactatgttgcccaagcagatcttgaactcctgagctcaagcaatcatcctgccctggcctcccaaactgctgggattacaagtgtaagctgctgtaagctgctgtgcccagcctatattttcaagtctctctccttttttttttttttaaactggaaaggatagctgtgatggaaatggaagacttccaacagaataccttagttagcataactgtgtagtacaagatgtaaaaacctgttgaagtgggtggccttttgttatcattctgtctttctgcccaccctgtggcacagttctcaccatattttctgtcaactgctaccacatggtccccttctttatgttataaagtctcttaattattaggtaattattcattgtcctagctctccatgcttaccaaacaatattaacaagagcacggtattacaaatgagtcaataacaacttccctaaccttatggcagctgttttggaggaaaaagaaaaaagaaaaaaaaactgcctttttttttcttaatgcgttacaattggttgatcagaacagttttaaaactataaaatgttggctgggcgcggtggctcacacctgtgatcccagcactttgggaagccgagacgggcggatcacgaggtcaggagatcgagaccgtcctggctaacattgtggaagcccatctctactaaaaatacaaaaaattggccgggcgtggtggcagtcacctgtagtcccagctactcgggaggctgaggcaggagaatggcatgaacccgggaggcggagcttgcagtgagccgagatcgcgccactgcactccagcctgggcgacagagtgagactccgtctcacaaaaaaaaaaagcaaacaaaataactataaaatgtttaataaacatattttaaattaaaaggtaaggttgtatctagttatttatacagctatttttaaaagtcaggttggcaaaggtctctctgagtttcacaaaatatccgcgtgagtggtgcatagtttgtgctggcttatttccatttgttcgttgtgtttatggtaaccagtagcattttctaatttggttaaaatgctgtcattagctggtaaatgcagtcctgtcacctcagaggaggaccaagaaggagctctttctagaaagggagggatcgaattactcctcatcctcatatctacttatctatctgattttaagacaccactgaaatttatactgcgagcaatttaaatgaatgcagtaattgattgcaaaacatgtttgtaatatcagtgactgaaattaaataaaagataagtcagtactttttggatcaatccagttgatctaaaaataaaaagtagacatccactgaatggttgggtaaatgaacgaatgaattttggcttatgtcagtgaattggcctgactgggccttgatctacatagcttctcttgacattttgttgcccaaattgagtttgagtgtttttagtaggcagggtaaattagcggtatggatgggtataacattctacatttagttttgctactgtatatgagctcatgaaatggacttcccttccctaataatatagaaaaaagaaaaacctaaggaaatatagagaacacattcaatttgggaaattcccgtctgtatcagtcaaggataggctagatcatgttgatcatgctgcgtaacaaaccacatctcagtgaattaacccacaaagggggattttcttgctcacaatacacaatctgtgtcagcaggagagcagaattatctgtcgtcaccaagagtccccaggatgatgacggctaatcccattgtgccttcaccatcactgccataggtgaaaggaacgtgataaattgcacactgccttatttatttatttatttatttatttatttatttatttatttagagactgtgtctcgctctgtcgcccaggctggagcgcagtggtgcgatctcagctcactgcaacctccacttcccgggttcaagcgattctcctgccttagcctcctgagtagctgggattacaggtgcacgccaccacacctggctaatttctgtatttttagtagagacggggtttcaccatgttggtcaggctggtctcaaactcctgacctcaggtgatccacccgcctcggcctcccaaagtgctgggattacaggcgtgagccaccatgcccagcccatacactgcccttttaaagcctgtgttcgaaagtggcacacatcactgccgctcatattttactggccaaagcaagtcacgtggccatgccatttcagattgggaagtacatttttaccattgcccagaggaggagagagatatgcaatatttgagaatagccctaaagactacaatactatcccttagtccacctaaatgatcctgaggctttggggcaattaaaaaatccttactcttaaaaaatgtcaggcagtaagtcttgaagccagctgctggtgctacacaacatacccttgtcttgtgaggaatcccttttgaaaaggtaacttacctcgtcacttcattattgctcattgctacaggttgaattgtgtccccccaaaaagatatgaaatcctatcagtacctctttgaaaatagggtcttatttgaaaatagggtctttgcagaccctcttgcagatggagtcaagttaagatgaggccatgaatgtggaccctaatctgactggtagccttataaaaaagggaaaatttaggctcagaaacagacatgcacactgggagaatgccatggaaagatgaaggcagagatcaggtgatgcttctacaaggcagggaactccaaagattgctagcaagcctccagaaagcaggggagaccatggaatctccctcagccttcagaaggaaccaccctgcccatatcttgatcttggacttccagcctccagaacttttaaaccatcaatttccattgtttaagctactcaagtttgtggtactttgttacagcagttttagcaaactaatatgctaatcaatatatatttttatcatcttctttggacctagcaaggagaaccacttgggaaattgaaacaaggaccctctcgggaaagtttggtgaaatcctggccaacatgatgtctaatgctgattgcagtgaaattgagtactgttgttgatttttttttcctcaaagtagcttttggaagtgaagagtaaaatgtgttagtgggaactcagtattagcaagaagagaaataagggactatgctagcaaaatgaataatctgtctttattatactgtcacaggtggttatcaagatacagtttttgtgagacaaaaagctttgtggggctggagttgcttttgatggtggtggcagagggagagttatacgaatagaagtaacttctggtagtgtcttcgttgcatgtgggtacacccagtcttatgggcaagctgattttatataatcttgttcttttcagtaaattttgtatatcaaatatttaatcttacttctttgaaaaactttttagataagtgatgtttgcaaattgaagcatattgaaccatatatctggatattttgtttgattataaacccatttttacaccatggccatagagaatggtgccgtgggcactatcaggagtgatgtcattaaccccacagggctatgtggaaagcgtgtggctgggactgctgtgtggttgggacaaggcagtggtgcacatgggccagctcctgtaactttcctgtttgtggctctcatggggcactcctgctcctgctctccccgtcctcatccatgatacatactctctctcatctacgtgctcataaatttcagcagcaagaactgcatgatttttaaaattctgagtagatgcttccagcaaaggatttcctaactgatcactgccagagaagaagaggtgctaaatagttgccaagttacatgctttttttcccaaatgaagtacttcccctgctactgcttgtaaagccctgattgtgtgtgtgcgcagaacccacatctggtgctggaagcctaaggactagtgagtggtcatgtggtttatggcccctataaaaggacccattctaaaagtctccaagaagctaactccacaatgagatgatgtgtgtgtgggtgtgtgtgtgtgtgtgtttgagatagggtcttgctctgtcacccaggctggagtgcagtggtgtgatctcggctcactgcaacctccacctcccaggttcaagcaattttcctgccttagcctccccagtagcttggattacaggcatgtgctaccatacagaattcagattcctctcctacccctagcctgatgccctttcattagctatacaaaggtggttgagtttcaggttaggcttattatcgtttaaactataaactaaatattcaccaaagctagcccagcctaagcccaggaataatcaaggcagcttgaaacctaaaagcaagaggaggctgggttagatcagctcactgtataatttttgcaaaggcggttttattgaaacctgttcttttttgaaagctggctctttctaacattcaaatgcttttgatcaacctattttatggaagcagaatattgaaattaaagtaaatattagatgaactttatagccagttgttttcctcattcttcaactctttaccctacaaatcttatttaaacaacatgttcagcaagctgttatcttgcttacgcaatgaatagaacattatgttctaaggtacagtttgctcacctatgaaaagaatttaacctcttttctaagtagctatacacaattgtcataccttaagttcttatttagatgcatttcagaatattagagcattttgcaagtagatgcacgttcttacccagtgtcagtgtttatagacagacactcaccatgggtatatttaagtctagggtggtaaagaatataaatgtcatttattaaaacctgaacatagccaactatgaattatttgtgttaatgtaaacgtcgaatgagcactgcaaacatttgatgtttgaatatttgcctgtagaagtgcagtactatgttctatagaatataagtagatgccaccccagtcctcaaggtttcagtgaggtcatcattgtatcaataaaggtgccaatttaagatgctaactggacattggaaaaaatttgttgtcctattctgaaggatgagtcttatataaagtgtttttaaaatactttattgaaactgccatgttcttttcaattttggtagctcccctgcatttaatttagtcataagcgtctgtattaatgggtgtgttcaatatgaaggcatcctgtgaagacaataaattatattatacttatctagtctgcactctttatcatgttgataaaatggcccttaccagtaaaaaaactgtttcagaatgtgtaagagtaagtctgtctcagctgactgagggcttcatcatgttcatgataatcccagcagcttgaaatgtcaaactggtagctgatccatagcacacagtagtgctaattgagataggttggtgtggataattgaatttaattgaatattaaacaccagtaagtgctatgctagatgttgggaccacagtgatgaagatgacattatcctgacccgggaggcgctccttatgtgcataaactgcatttggaaattttcatgatttgagagtcatctatggttgccagtagagattttcccagaaggccaaggatatatggggacatttgactgttctttgaccataattatataactttttatttgcccagaatgaacaactgcagggtaacatttatacaaaaggaatttagtgtgcttagagtgctgataatacttgagaaactaggagagctgttttaaagcacttctttttcttttttttttttttgtttttttctgggctgttagaatttgacattgttcaactttaactttgtcctcattgaactttatcctgctaaggagctaaaaggtccatatgatcaaaaaggcagctctcaacccagcacgaaattccaggctcattcatttctgtttacctactgccaaataagtcagacaactgcatacttgctttacagacgaatagaggacagcatgttgttcaataattgtagtttaaaaagtatatgtaagatacatccacaagaagaaagatagagggagcataccgtttgtcttctagtataggctccctgcccatggagatcacagagtagaattatgatgggtgccttagagaccagcctccctcaggatcatgagttcacctcggcaccacagctctgggcaacgtggaattagacaaattaaagtagttaagttctgacttcatagaacagaatctaaacttttgttcatactgcttttgtgttcttgggccatctgaaaaccttttctgtgtaaatattcctgcaatatgcggtcttacagaggtcttatcacgcatatttccctttgcttccttatgtatcgtattttttcaagaagaagacattcaactttagagacaatggaatcattgtgttgtggctttaattcaggtcattgtccttttgtgagttgcacgtgtgcgcgagcctgtgtgttttgcttggaggaatagtgaataagcaaggagcagagtccatttgctttttctaacagagggtggggcagattctctcacaaccattaaagaaaaaaataagataccagcaataatgataatcagtcatgcatatgtaatcgtgtgtagttcatacttcagattcatatacagctgagcatgatcttgaatgttacaggaagcaagcttgaaagtcaagttacagtagaactttgctaattcatgcctgactaatttgcccacccagtagttcctactgaaatcttgccattcctctaccaactttcagaaaaatttgatagcaggctgtggagaaggctcatgttacttcttatgtcaaggtgtaaacaaaaaagagagcacaaaatacatccatcagaccacatgaagtgaagagagagaaaacatctgctgaaagccggattctctgtttttttcctgctttttaaatgtaatctgtctttgtttatgcatgccctagaaacatgcataagtaaccctgagtagtctcttagtttaagaaaacctactataaaatttcttgttgtaaaataaaattctaaaaggaataagttgtggacatataagtatcagacagtttatgtaagactttacataggatgcaaggtaggctgtaatatgatttggtaattgttttatgggggaattttgttttgtatagcgaaaaagaacagtgagtgatttaactgaattttatagtttaatattgttgttgttttaactaaaatctttggtttgctattgcaaaatgaaagagaaaggaaattttggttaatgttaactttatttccaaaaccatgtgatggatgctgaccaaatgtgtctcaatagtgccattgaggtctgttgcctttttttttctttgaggtgctaagtgaaatgtgttttgaaccttgaatgttcactatgcgacgttctttgcattacaggtagatactgcaaacttgcttcaaaaaaactaaaaagttcaaataactaatggttcatatttgttccagttagtaaatatcacgacaaggtatcatcgtcatcccatgttctcagtatagattcagcttcatttcttacaccacacacccagaggcataaatggaagtacacagacaaaaggaaaggcctgagtttaaatgtagttatcatgttcagtgttcgacattttattctgagaatttaagtgtttctactgcagtaccacaaagtcaatctgcatattactttaactagatcacttgtaaaaataaatgaataaatgaccagtgatggttcagtgacaagagtgccagatgagtcatgaatgttttcacaagtaaatttgatagtaaactgctaagtttactgtatacgctgtgtacaaattagctcagattcaagatttttgctctaacaactgaacgctcagttgcatctttaaactttttgttgcgtgagaggggctgaggggcaggtgggaggaagtcagcctgcaggtgggaggtttctgtctcaggattgctgatacccctgcatgctgctgggttgcagccttggagtatatggcctatgagacatggcatgtctgatttgatggaaaaagcagcggagaaccagtgaaccaagctattccgtgtattgactttttaatacgtttactacaagaatctgccttttaaagtacttttaaataaggttataaacataagtgtgttttggacacagcctgcagcaagcatgcctctcgaggtgtaagatgagtcagctacacatgctcaggggcccgttccaccagccacagtagctgcagagggtgagagcaactgaagcaagagaagctcttagtaattaggggaaggaagcctccacttgacaccgcatcaccaccaagtatttattgagtgtctttggtgtgcaaggcaggagaatatcttctatggattctacatatttcagggttaccagagttataaaatcccttgaaatctatatgcacaaattgtaaatacgtatgcagctttttataagtgttcaaattctgccttaattgtgctcaaggatcagggtctcaccccagcattgtataccattgatagtcatgatttccttagtgaaattaagtaaattgactttcagagactttatttcatattcatcatgtccccatgtagccatgaaaaaatgatatgtttaatattcatctatttgtatgattaaaacaaaatatccgcaactactgacgattcaatgatcagatattttactgtaaattaatatcatcataaactcctagacattagacttcagacattcagagcccactcgatgcttggcacaaagcaggcaccaaatacatatttatagaatgaatgaacaaatgaaggaagaaacaaagaaatgactaatgcaccaaccatttatcaggaagtttaacagggaaattcaacaaccagatttgttttgctaatcttattaaagtgcaacatgtttgttgtaaaaatagatccacattcgtcattgaactggacagtctaaaatagatccaaacccattgtttgattatacttcacaaatgtaaggtaaaatagatgatactatctgtcatttgcttgatgctattggcaaatgtgaagcagttaccagcataaaagcttggaggttactccgaatgtatataaacaacagtggctaggctcacaagtgggagagagtctaaaaataggtaggcgatcccttatctcgttgcattgaaaattgtgtttatatgaagtgatattattagaaatgatgtgtgagaaaagaatttctgcaatgtctcctacaaattagagtgagaaaatgtatctttatgcagctttgaacaaaggattattattgctggactgtggaccaaaattttagtcaagttttttttttttaatgaaaagaaactgttcatttatgcagacatacaactttgtgtcctatagagacttgtcatctgctcttaaagttagcaccctatttttcctctggatgtccactgagaaacccactggtgtgatggtcattgaaaaagagagttgtgtcagaatgccctaaaatcttagtggcttaacacattcccaagtttatttctcattcacactacccgtcaacataggttggcaggcattcggatccacagggtcacacagagaaccaggccgaccgacccacatggtcacacagagagagaaccaggccgaccgacccacatggtcacacagagaaccaggccgaccggcccacatggtcacacagagaaccaggccgaccgacccacgtggtcacacagagaaccaggccgaccagcccacatggtcacacagagaaccaggccgaccaacccacatggtcacacagagaaccaggccgaccgacccacatggtcacacagaaaaccgggctgactgaagtttgcactggagcttttcacagcccccactcagaggtgagataggtcaccttttctcattagccaaaactggtaagatggccttccctgaccacaaggatgctggaaagtgtagtcatcttttctctgtgcctggagaggagagagaagtgaaaattggtaagcaatatttctattttaaaagtggttagagtgtagtgcaatgaatctagcaccattggttcagttttaaatggactgattccatttgtctaattctgtgtcagttggctgttttctgacccctgagaataatttagtctggctgattcccccattgtaccaattgcctggcatatgacaaatgcatttttgcctgtaagacaatctttgcctaggaaagacagccctaatttttatgtcttgtattttccagtaagctaatctggagtatcagtttttaagactgatacacaattagatgaaactaattaaggacaaaacatttgccacttttaactgttgataagtgaaactgagatttccccccaccccatggatacagtgaacatttgtcagcagctggtaatggctagtataaagatgtattcagttttcccttcccttcctctccctccagccttccagccacccccttcccaaacatttatgctcatttagagaaaagcaaccccagttctcttacctgggatatcaccagtataaaaagcacattcgtataaattatctggcctttaattacctgtaaccctgtaggaaaccccctgggaaaagtaccacaaaagaacgcagctctgggggtctgtgagaggcacccagttcacacccctaaaggacagagcgagcactcaaacgcacagctttgggtgccctctgaggcgtgcactggctggtagcagtgggtatcaaccatggaagttcacggaagattaaaccgcaagttcccacgcaaggccaagtggctgccaggacttggaggcactgaccctgagtggtccttccacctcagcgtatactgtcactgctgcctctgtggcttcccctttccctccaagtagagatagatgtctcgaggtgctccccaccccagccaggttgtcctctcctgggtggcattttcctttctactctctggggctttcaccaccccactgggcataactctccacaggctcccctgggaggggtgcccccacctcacccgccacctcacttctcagcccctcttcccatccaagggctccctgggctgcccccaccctagtcatgatctcgctcctctactctctcgtagtactttatttttaccttgctcctggctcacattacatgcttatcttgtatttatagatggttctatatatgtctccttttgcatccttttctcaaagctcctgtgaggccagggatggttttatgccttttctcatccccttatgttctagtataatgctttacacatgattaaattctcatcagatgttgaatgaatgagcttattatgcattacttcttagtacaaagaaatatttggaacgtaagctctgaaatgttgatattctgtggatgcttggattacatacaatgtcctaaataaacacttgcctgttaagtagaagtcagtctggaaagtgatacctttagatccataaaatgtttataaggcacatgaatggacaaccacgttgttttttgctcttttatatgtttaggttactgacagcccaaaatacattagcttgtctttgggctaggaggtacctaaagttgtatttttctctcatgtcattttcctgggtttttatcatatccaacttcgtaatgtccaggaatttgagattaattcctcaaacttgtcgaataatacaagaggaaacttgtataatacagagcaaacttggttggtgagtagctgctagagcaaacttggttggtgagtagctgctacagcccatacatggatttgtttcttcaggtggggggataattgtatccatggactcttcttcattaactgacggatcaaattattttatgaagctatgatgagaaatggcttgtgctcttgggaaaatcaatgccaatgtaggtaatgcaccagtctagctggtttttaatttaaagaacaaattatcttctggaatagtaataaatccccctttggaacagcaagaagacatcagctgttggatatgggataattaccatatgtttcaatgtcgtaaaaaggcacagcaattttaataacccaggttgtgtacaagaaagctcttgcttctgaagaatccatcaaccatgcgctatgatcatgtaataataaactgctgtttacttaatgctgtttttatttaaagttttaattaacataacctagtctttgcaaaacatctgattacctttgactcatatgttttctggtatataataatgggttctcatgagttgtttattttataagatctcctgtttactcagagtaaggaaaattttttttgaggtaaggtcttgctcaggctggaatgagtggtgcagtctcaactcactgcagcctctacctcctgggctcaagcaatcctcccacctcagcttcccaagtagctgggaccacaggcacatgccaccatgcctgactaattattgtattttttgtagagatggattctcactctgttgcccaggctgatctcgaactcctgggctcaagtgatccttccaccttggcttcccaaagttctgggattacagtcatgaaccaccatgtccaaccaggaaattttggtattaggaagtttcccacataccatttgtctttggtgccatgaacacctattttgtctaatttttataccaacctttcactttggcacatgggaaatctgataaggaatcgatatcacggaaatacacatcacactttctgcttgccgctttcttccaaaataaacccaaggattccccttttccaccaccaccttaatttagataaccaagataaatgagaaggttttcgcacttgatggtgggatttcttatcaaggctattgaatttggtttggcactgactaattttggtatccatgtgtttttagagtaagttgtagctagggtggtggggtgatggggagactctcactgaatggctctaaattcagtattttattctttaaccaagcagctgttcacacacatttcttaggaagtggctaaataaaaatatggcagccctggaatgaacagaaactgttgctctttcaaaaaccagcagctacaaatagtgatttttcttccacaaatacttgtttttctgtgacattctcattggttttattcagttaaactcccagaccatgttgatttttttttgccttttattttttgagctcataggtaaaaggagttgaagtgattttattttctgtttttgtcttttttttttaagtttttgtagagacaggggtcttgctatgttgcccaggctggtcttgaactcccgggcctcaggcaatcctcctgcctcagcctcccaaagtgtacccagtctcaagtttttttcacattatatatttgtgttctttctgtttttaactaatggtctccattatttaggctatattaaaataacaataaaaacagagcagatacaacagaattcatttggttggccattggagctgtttttcctttttctttttaaactgactttatttttttggagcagttttaggttcagagcataattgagaggaaggcacagaaatttcccatgtatttcccccacacaggcacagcctccctcatcatcagcatcccccaccagagtggtatgtttgttacagttgatgagccgacattgacacatcatcacctaaagtccatagtttacactagggttctctcttggtgttgtacatgctgtgggtttggacaaatgtataatgacatgtattcactattatggtgtcatacagaataatttcactgccctaaaaatcctctgtgcttcatctgttcatccctaccatgcccctaaaccctggcaaccactcatccttttactgatttttacagttctgcctcttctgggatatcatgaagctggtggaataatgcagtgtgtagccttttcatagtggcttcttttacttagtaatatgcatttaaggttcctccgtgcctcttcatggcctgatagctcatttctttttagtgctgggataatattccactgtctggaaatgccaccgcttagttagtcattcatctactgaaggacagctgggttttggcaattatgaataaagctgctatgagctttttaaaaaatagtttaaatgacatatcaatactttaatatttaaaatatctcagtgatcatatagcctcagaaagcacagttttctgagctgggtgtcatgttgagtggtgttagagtgccgtgctgcgtgctcaggtgctatgctgtgaggaaggatgataggagcagattctgtataagcagatgcacaaccacccacagctgcactttggcacccagggcagacaaataaaaagggggcaagatttttttaggggagattcctggcagatagagattttcttcagaatgtacagatttatttttggggggtggttaggggcgacagttgttttaagcagagttttgaaggagtttggtttggtgagtgaaacagtatttcatttttgattgcctttgtttttccagcaagaaagctactcctggtctgtgggcacacaccaaaaggctttgggcaagacagagggagcttgtgtgtgcccccagaccggagtcataccacagttgtcagatcactttgcggcagaccttccgacagtctcctcatctctcttgtggaatttgagtttgacccacaggtagcattttttattttggtggtaccctgatgtttataaggaacctcaggacactattagttaggaaggagattgtcccatgcaattcagccttgcaagagcttcctggttgatctagggacaaggtgtctatcactcagccctccaggtcttttcttcctaaagcaggctttggagcaaagcctgaccggtctttgcctatgactgagtttcccagggctgctgtaccaaactactaccagttcaacttaaaacagcagacatttatcctctcacagttttggaggccgcttcaaagtaggtgtcactgaactgaagtcaggatgtccgcagggctgcgctccctccagagcctctaggaacacatctgccccttgcttcctccagcttctgggggctgccagcgggctccagcctctgccgctggggctgccttgcctcctctgctgtgtcagatctccttctgcatctctcttacaaggacacttgtgggccgggcgcggtggctcacgcctgtaatcccaacactttgggaggctgaggcaggtggatcacctgaggtcaggagtttgagaccagcctggccaacatggtgaaaccctgtctctactaaaaatacaaaaattagccgggcgtggtggtacgcacctataattccagctattcgggaggctgaggcaggagaactgcttgaacctgggaggtggaggttgcggtgagctgagatcgtgccactgcactccagcctgggcaatagggcaagactctgtctcaaaaaaagaaaaaaagttaaacgagtgtcttggcactcccctgtaatcccagctacttgggaggctgaggcacgagaattgcttgaacccaggaggtggaggttgcagtgagccgagatcacgccactgcactccaccctatgcaatagagtgagagtctgtctcaaaataaataaataaataaaaataaacaaggacacttgtgactgcatttagggcccagaacaatcccccatctgaggacctttcatttaatcacatctgcaaaggcattttcatgtaaggtaacattgaaaagtttcaggggtcaggacctaataaattttgtgggccagtattcagcctactgtcccctagttacaacaaggatggggcagcttatggacgagagtgtcaaaaaattcagattctgtcctacagggatcatcttaccctgcagctgagttgagtgattattgagaacatactacgtgttgatgctgttgcttagcactgtgggagatacagagatacataaaactctgcttgccctgaggttgcttgtggttttgttggaagagaagacgtgtgtgtaaaattagtcataagaaaaaggtcgtgtttgatcctgagagccagatagtggtacccagcagtgagcatccaagcccttatctcccaaataggagactttgtaggctgaaaactggcccacagatttattaggtcctgacccctggaacttgtcaatgttgccttacatgaaaatgcccctgcagatgtgattaaatgaagggtcccggtatggggggttgtcctggatgagctgagtgggccctaaacgcagtcacaagtgtccttttaagcccctgctgtgcctgttctcttggtaaatatctctgtgtgctggaacatttgaccagagagagatttcggtgatcatatccatatttgactgtttcctattccataatttgtcgctgtctccgagtcttttcccgggagccccctattacaagtgcacctttctgtgtttattcttccctgttgtgcttcgatgatcccttttttctattcttcagtggctttttctccagtaaaatagcagtttaaattcttgaagggaaacaattaaaaaataatgtctctgggttaacaagtatgattaccgtcatctaaatcagtgatactacatgagaataaaatcaaggagacttacatttacagtagatgaatctatgataatatgccctaccgttttgggtaatttaaatttatgctagttcactctgtctacatgcatgtcatatcttagtgtaaattatagaaatatccctataaaagaaaaaataatttttttctgtatatgttttaagggaacctgaatttctttgggttgtaatgcatgatacagatagtattctgggaatacctgatgttcagcttatccctggaaccctggttatcttagtaaaatatgcagcaacaatatagaagacaatcctgaattttccactgcacaattagggcttgattcaccgtatgacttgggcaaattacttaactttttgaaaccacacttttctgattttcaaagtatgactaataatggtttctgccttaggattattaagatgattaaatgaaataatgcatgtgcaacgtttagaacattgctttaaagtttgtcttttccttctctctccccttttttcctttaaaataaacaaacatgtttgagggctgggtgagttgatgggctccctttagtgcagcacttctaagtaatcactgttccctctggttcattccattgagcacatgatgacaaacatttctggggatatcatgtcaccttggatatagaacagtctcctaaattacattttatatgacaatgtctcactgtatttttgtcctcttgaattgcagcatagcatattatttcttccagcaaaaagcaaaattaaataaataagtgattaagttgctggctgtagctgatactgattcatgacatgactgaggattacttagccatcacattgaattgatgacagttgccttctaaatattatctttagtcacatccctcgaatgtttgcagtgactttcactcctcaactagaatatgcacgtttacatacacatgcgataaggctgaagaaggcttgtggctcagcacaatttggtcttgtatgcacagtaatcattctgaagtgtatgattctgttttattagaaattctcacttgaatttcaagagaataaaggaggattcctcctacacaaagctgctaattgtttgcacactgtgtgcatcccgcatgataagcgatttgagaaggtgccacatcagtgcctttatccaagtgtcacctcctgtctacagttcccttagcagggtgaagggagaaagatgcaaagactgagcttggctgaaacaaatgtatttttgtccccttgacttcttgaattgcagcagagcatatgaataacattgatatatttcttggctgctagacaacaacgtatttctttgacagattgacgcctgaaaagaaaaatacagtatgtactaatgaatcaaaacattttttagtacctttgtgtatactaaatgtattttagtttctatctggagctagttgccatttactgtgggtttgaaatgccctaagttatcttctatggatgggtagaatcaatttacccacacattgacagcttttacagataggtcctgtaacagatataattaagttaaatttcataaatagataggcagtctcctccccagtcctggtccctttgggagatgaattggggtgggggtaatggagagtttcaaaaaggctttccggtgtctttttttaaaaataaggttttaagagtttcatggtcagctgttctcagtttttctcaagatggtatccaaagtaaggctcaaatttatgatttatcttccaaatgcttaaatggtccatttatgatctgccagatgttacaatgactagctccccaaggaacgatcaagaatgtgccaatgtctgggcaagatttttatccagcaaaaagaaaaaaaccataagaattggaggttttactttgaaaagtaaaatcagccacatccatgacttaagagactgtacatattgtcatgggtaaggatttagatcttggctccactgcttactcacagtgtaccctggacgagttactaggcctttctgtgttttactatgctcttttgtaacacagggagagatagcatctatcttctaaggttgttgtgaggattaagtgaactaacttgtgcaaagctcttagaatagtgctgggcacagagtggtgagtgccttgtatatgctaatagttgttgatttatagcttaaaattaattgtgtgatgcaaataggagggttaccaccccaagcttaaatggaagttttgcagcactttgcactcttgaggatgtatctgggtttaatagtaccttccatctagtgcacaagtcttctcccaggctcatcctcccaaacacctctcagtgttatccccactttgcaaatgcagtagtagctgggctcacagaagttaaataactacaccaagtcaccatccaaaaaggttcagggccaggaatagagcgaaagacagaatacggagccatgctctttttgctgtctttctcagtgctcagttctcagaattactcaggaatgagagcagagaaactctgtataggccatgcctggagttttttgcacatggcagtcagagagtcccagctcagttcagtgcagtattaccgaattccagtatatgctgggctctgttaggtgcaaggggttccaggatgaatgagtctgtggcccagtggacaaggtttgcccctgtgtgcagctctgtctgctttactagatttgctcctcagattctaaattggaagtatgtgcatattgcttgatttacagattattagagaatttttttcagttaaactttgtccaaaatagacactaagggcaaaggaaactggtattattacagcagggtgtatctcataagctctgagaattgtacatgtataaagaatctttgaatcgccgagtcttagccccacgttttatacagcacagaaatacagcacagaaagtttaggtgatttcccttgggttccatagtgtgttagtcaccaggttcctttaactctctcagtactctttcctttaaactatggaagagctcaaatgattaaatcaataaaagaatgacaacttatagagctcatttacgtgtctgaatatatcagtttagcccagagtatctgaactcctgggccattgctattcactgaccccttctcctcctcgtgttctagtaaaattcagcccatgaatatagtcattagaagttgaattttaatgaaattgggcgctttgatcaatgggaaggttgaaagttatgtgggaatcatctatatagtttatagctgtgactatgtaggccagctcctaagtgccccctgcaatgtgtcactctctctggttttctttccagggaggtaccctgtagaataacagtctaatttacctctcagacatctgctgtctttcagaccttatgctagttttgtgcatatcttcatgattcctctaataatgcattggattataaactattatctccacttgagagacgctcagagaggctagggagcttactcagggtcagagggagtgcagctgaacagttctgccagggtccctgtgattgttggagcagcctgtgttttttcaagctgttgtctgtgaatcgtacggtagaaacatggtgcgtatttctgcagccttagttctagccattgaaatatcatggagttgaatgcagaatacccattaatgtttaggatgaccaagaaactgtgcccaggccccaagcccagctctgtcatcagaggtgagttaccactggtgccatgccctttgattccctacaggcgccctatggaggtgcccaccagtgtgcacttggaagtgtgatggaacgcatcacatccccttgttgcccctgccccggtgatagggggattcactaagaacttcagcatagtgagagaatgtaactgaagctcctgggttagtgctgcttggtatcccagttactttgtagatttcggaatcttttgtcgtctagcctgaggattactgttgatgacacaattttctttgggattataggcttcatgtttcatacaaccagcatatacgtaaatggcctcttcagtgtatcatgtatacacattggtgaatagcttcccactagataatgttttaaaggggaaaaaaagaagtcatttctaaaatcccaagagagtgtccccgttttgaggttagagcacgttttttagccttatttagtcttgcatcttgctccttatgctacctttcattgctttatgaaattattttttaagggatactttctaacattccatcccactttttttaaagctcgttcatatactttgtcctcacagaatagaacagggtttctcaaattgcacacactgaactctgcaacacaacagttccttcattggagaccagatgaattgaaccactggctttctgaaaataactgtatgctttccagttggccagccttggcagggacccactactactcctatttctcaacagtcaatttaaaatattgacagtagcttaataacattcaatagtaacttgcagcagcctttcatataccctgacatctgagatatgtaccagtttatgaaatagaacacgcagatggtcttagccccattttccagatgaggacccttgtccagggaaggattggtgcccatttagctagctctttcccagcaagcaacagtacccaaggctccatgccccaggcctgggaggacccctcccacggcgtacttcagatctccacctgtgactttgaacacatgcttcgaggtgatgtacttcttggagatagtgctttcctcatctcttctaccttgtagtcgtcagtagagggcatgcagtgcaacagaagtggatttcaggactgagactagggtgaggcaagagaggcatcagaatgcaaaagtgaagtagacacctgccgtcagcactgggcagccctgctcctggggccttacttgactcatcctggtgggttttccaaatggcagaggtgcacaaccacttcttgcaagcatgggcacttgaattgtagcccatgtacacagtgattcttggaaaaagtcatgagtaatgaatggaacttttctctcccaggttgatcttgtgttttgagacataaagagtcaaaggttggtgcctaggatgctcattcttattgtttttggtagtttgattgttgaaggcttttgacacgacattgaagtgaatatttggggcattttgctcctctgggcttttctctaaagcaccctcacatttcctctctcatgttcctgggctttcctggctttgatgctagccccactgtgtgttcccattaatagccctatgtagcctggctccttattctggaaactgtgtaacttttgctcttgatcttaaacacaactcagtcttgcaaggagctccgcctttggtctcagcttcttggggatttccctggcagccacatagtgaactatgtcacactctctgttttacccgttaataaggaaatactctggtacatggagctttgcttgctgatctttttctaagtactctgggggcaaaaggaaaagcagctagaggataaggatgtaactttcttcaaattaagccatcctgacccgtggtagagattagccactaagaaatagtggaaacaaataactgtttcactcttgagtgttagcatggaagagattctggttgaaatcctagtcctgccactttctggttacagaaacttacattacttttcttttgatgtttcaaggagataggagttaaagaaaaatgaacaccagattactagaacattcttatagagttgcccaaagatggaatggacaccttccagagtggaggggagggagtaggattggacagtagtcctcaactgggagcacttcttccccctgaccccacacctgcctcccagggacgtttgacagttttggattgcacaaaactgaggggtgagagttgctgctatatctagtgagcagaagccagagatgcttccaaataccttacgaagcataggacagccctcacggaaagaattatctagctccaaatgttaatgatgctgactttgagataccctagtcagaagtaacatttattggccaggggcagtggctcatacctgtaatctcagcactttgggaagccgaggtgggaggatcacttaagcccaggactttgagaccacctggacaagaccctgtctctacaaaaaaaaaaaaaaaaaattagcctgatgtggtagtacatgcctgtagtcttagctactcaggaggctgaagtgggaggattgcttggacccaggagtttgaggctacagtgagctatgtttgtgacactgcacttcagcctgggcaacataacaagactctgtctcaattaaaaaagaaagaaagaacatttgttgaatctaattttcccatgtaatatcaatgactgtgcaagataaagtggtttttatcctcactttggatgagattggcctttggtgattgagaaaccttcctttggttgttcagctacttctagatagacatgggattttaaactagccatctatatgtccaaaacccatccgctttccacaaacccattatgtagttagctccccatcactgatgatgttcaaagctaagcagggtgagcaaccacttgaaagaggggatggatgaggatacaagcctaagatgtatgttgcactaaatgacttttgaggtccctcctaaagatcacattctctggttctattttgaaatgggatttgtctttttagccccagtgttagagtggcagccagatatcccttggctatgaccagtgaaatccctgtgctttgtgcacctgtgaatcttactcctattaatatcccagccctatcaggccagagggctagggttccaaacaggggcagccagaaatgcaccatcttctgcatcccatctgcattccgggcccaggcagttatttttacctccatatgtaaatgggcccagcgatttctcatttaggagaacagcagaggcacaagtgaggagagctggagaaggaggggaacctatcatatactctgagattgcaatttagtatcagtttgctgatcagtgtcactccactagtttaataagtaattatagtttctcttttgtgaacaaggaaaacgggtagcttcacccagtggttgtcagccctggccaaaaattagaataagatagagggcttttaaatcacacctacaactgagcccctccaccagaaatttaattttctgaggtgaggcctgggtacagtgatttgagaactttgcagggattccagtgtctaagcagcctgggcacctctggttaatggcacacctcagtgctgcgcattctgctccagtacctgctggtgttactctgtcataaagagactagaaaaagagtgagttgggccctgtttctcagtgtgtcttcagtggattgtagggagaaggaggcccatactctctgcctaaacgagcacctgctagactccgaaatctagttaatggaagtttctcctcatccttggacatccttgttttatatggtatacgttcaaaatacatataatctttggtttaatttgttttacaaagttttgaagttttcctctccacacttttctcatcaagctggtgtgtggaaagaaggaatttttcttttccattgctgtcatctaaaattgttgtgtcgggtggggaggggagggagccgggagacttagctttaactacttagaagttttcagggaaatgtttttataacaacctagttaatagtttgactttatgatagattctgttccttcattattttgtcctccagtggcttttatacccagcaaagtggaccatggtgtatgattcaagaagggtgaggagtatgtctttctttggaaaggcagggatggagggttgtgatttagaaagggtaagcaggaaaggagagccacagaaggcaagcactgttctcatgccagatcggtttcaaggaagaggacatatggaaggatctagaaaatgatttctctagaattgtccatgtccaagtcccctggaatgtctttgtatatccccagagctgtgcatgctccagtttgaagagctctgctttaaaagatatcaggggtgggggagatgaggggggtgaagtaaaagaataaaaactattcaattccatttgttttctctttcaagctcatacgttactcatttcatttttatattaaaatatagatgaggaaggaagggcacatggcaagatttggcaagcataatccatgaggggatatggagttggggatggcagcatagcatactaggatttttgaggagggattcggggagcctgttcatgttttccttacaactctggtacatgaagtacaggttctgcatcatgatggaagactgcctgggttcatgtttgggccactacctactagctctatgactttgggcaagtttctttcttcttttttttttttgaaatggaattttgctcttgtcacccaggctggagtgcaatggtgcaatctcagctcactgtaacctctgccttttgggttcaagcaattctcctgcctcagcctcccaagtagctgagattacaggcaaccgccaccacgcccggctaatttttgtatttttagtactttagtacagaccgggtttcaccatgttggccaggctgttctcgaactcctgacctcaggtgattcacccacctcagcttcccaaagtgctgggattacaggcgtgagccaccatgcccaggcaagtttcttaacctccttatagcagtgtttggcacatgatagatgagctacaggttggcttgttattccttgcaatcctgagtttctccccagagtaaagctggagcttttcccccagccaactttggtggagtccactgggcagagatgtgatttcagccaaaatatggctaaaggaggaaaggatctgagacagccaggtggaaatggctccccgggagagcctctgaccgacccgcacactgggaggagtgcgcactggggtggagccttgggaagttggagccatttgcagcagggaggagcctggcccctcgtcttcttggatggtacctaggattcagtctgcgaggcaggaagcacactagcaggactccagcttggtggagagttcctgctttcctttttttcctttttgtccaataaatcccatttttctcaccctttaaattgtgagcctaatttttcgtagtcatgtgacaaggacccctcttaagctgaactaaggaaaagtcctgcagcagatctaactagaatgccaatgcctacattgaggctgtttaatggagagtttatgaaaagttagctagtgtccttgtgtaaacctgtatgactctagttcagagtcttcagtaattgcaattcaagaataaaaccacacggcacttccattcccgtgtaatttgttgttgctggcttgtgacattctacatatcccaactatgagacagccaggcagtgggatggactgtgaggttcagatgcccggagatatgtgaggaagagcttttagcaataaatatgaaaatgaaatcaaagtaaaaactggcattgaacccctggtgtacttaggcttacttttacccaaatccaaatcatttcttgacactgcatggttaccaagagtgtctgtcattcaatatttcagattaagatctgttctttggtagctaagttcagagaaaaaaatataggatctagaagtatcattgctattttttccttgatacatttagtctggtattaaaattgcttgcagaagatttgattttaaaaaagtagaaaagagacacttatcctggtaaaattatcctgaaatcttaagaaattaagacaaattgcaccataaaaccagaagcacaaaattaaacaatattatattaagagaacccagtgacacattttccttctaaattaactttaaaattaacttttaaattaagttcaatctcatatcagtttgctttgtaagaaatagaatatatgtacatgtttgccttatttttagcatgttatattcattaaaatgttttagtttattcagcagatacatttagcatttctttcacaagaaagacagtgaaggaacaattaataacaggaccccagtaatacctggggggtttctacatctgcattttttgcaaaaatagaatagccttctaagaagctgtcagtggcatttgtgcagctggacagctttgcagcagatgtaacagtaactgtgatgccaggctgtgccccagaacctgtaagcatgacaagctctggcttcttccctcctctgaaaaggtacaacattgaagaggcagtcgtttcccctagatctgtaaccaagcacatctgggtgaaaggggaagacatctcttcacagagaggagaataaaggcggtgaccatcagggtgacaggcagcatggactgttgccacctgtgctgcaggcagcttcagtgcctggatggtgggacagctggtcctgcactcagcacgagtctcaggcagtggtctggccgcgcctcccttgggctgcttcttcctccaccgtcctccacttttgctttgtgtctgcgtcaagtcagtaacgttggtctgcagctcccatccctcctgatgggcactgcactgaggccttagtgggcattacctgatgccctcatcacccagtgtacaaacacctgctgacaagaagcgtccctgagcggaacccttctgctgggacaccgcaccttccgtgtcctgagtgggctgcaccctcgtggtgctcaactgggtgacttcacgctgtcctcagcgctgtcctcggcgctctctctccagtcagctctcctgctcaggcacctttttgggacacagtccttgccagttattccctgtttaatgtcctcatgtgtcttcacttgccctgggagactgtcgtcttgagagagcaagccatatgggaccctgaggcctggcctcagtttccctcccccccactgccccacggggccacgcctcatcagtggcatggaccttttagtcagcgagccctcagccggatgctcccgtgctggccactcctgtcatccctgctctgtcctccctgcaaactcctccctcaggaccctgcttgaagttacgtcctgcacagtcatccctggccttccctcagcagaatctgtcactccctcaaggtgtccctgcagtattctgctcatgcccctgctacgtggcagaactctgttgtcctatcctgtccagagctccaaagcccccagaccctgtggctgctgagcacttgaaccatggacagtccaggtgaggatgtgcggggagagatgcctcctgcctgtggctgagccctgcctgaaggagctgatgaggaaaagctcctaagcacaacagtgctgctcacctgggcatctagttggcagagtcctatcccagtgttcgcacccccagtttcctgggtcttaagttcagattatcaagtgctcctcctgcaaaaaaaaaaaaaatggtgattcttgtggcccttagttgaccccgcacctgggatatgcttatatttggtgtggggcagagaactgagtgttcttgaaccacttccacccaaccagagggaggtggggacatcaggtacacctcatcccctgatgtcacagccaagtacctggagccaccaggactccctctgagcccacaaaggagtgtcttctcaccaccccgattatactggtctagttatgctttggagttaaagccaggctgctattgcagggctgctgcaatccttgcaagcacagttgttctttgcttgcgcttgctctcgctctcgctctcactctcactcttgctcgctctctttctctctctctgacttcagtttaactttttaaacttcagtaataagtgttcctcaaaatagatggtcttcctggttgtaggtacagccagcagggttgagttctgctgccttccagcatggttttcctggggcctgtaaaagtcctgcaaatttgctctgacactctgttgacatggaggtcctgtttgttgttataaataaggaccagtgtctctaggacacaccttactgtgtataactgaatggcagattttgtcccttacttcttaaaaattaaatggcagaggagctggccatgtaaaagccctgtgtgtgtttaccaaaaagtacttgaattttgtttgggttttgtgttctggtgcatatgaagtgaattttggtaggagtatgtgcattcagagaatatgtcatcacacttttttctttatttgagtgccacttggctcttatttgattaaggtaatttcagtgacatattttgaagcaattcaccttgaaaggcagaggcaccacccaggtgcagaaaccttccttgggttatgcaacgcccagcgtgggtggaaccgcactcacactttacctcttcctgaaccacagccctgctctgattgcatgatggaagctgaggtgcctgacaagtggaaggaggaaaaggaacattctgccttccttttctctgtaatgccaaagctggcgtcatgcattactgagggcctctgtcagcactggggccggccagtggcacagctgatggggtagctgcactcgctagtcctctgggaaagcccaggttgtttttctggcttagtgttagaggcagctgtgatgtttacctcgatctgtaacatacaaagatctgatcatatgctgtctttgcttacattctattattgtctgacttatgttctaaattctctacaattcccttccatttgtcttaagaaactctaaacctttttttttttggaaatcactacttaatgattttgaggatggaaccccagacagttggtaatagtggatggttttccttttctgtagttgagtggctttctaattcttttgatggcacacaaaaagaaattaaccttagatcacaacttagtacacacatttatgtatgcatgtaactgagatgagttcctcaaaatagcacatacctgtgttttatgtgaggcactgatattttctgttctatattatgcttaactttaaaaaatacttcctgtgtaccatttgtgggactgtaactcacaacttaaaaaatattaccttgatacatagctccagaaatacacatgggtcattttaccaagaatcaccagtgcttttgctctgttaccccggctggagtttggtggcacgatcatagctccttgcaccctcaaccccctgggctcccagctgggggtctttaggaccccagcgtgacctgtgggtagcccttacttcctttaatacttttcttctgcacagtcaggtgctctccctttgagcttccgtgtgaagttcactgtgcacccagctctgctaccaccgcctctgtcttgaaaggaatagggtggggtggtcattggtgtatagtaagattcgaatcacatccttcaagtacagttctaccctaaagataagagtccctgtggtttttgttgttgttgttgttgttgttgtttgaatggatgtgttctttgagaaattgagtcttgagtattttgtgaggacatctaagcctggcgtccacgtcagtgctgacagatttgacctagtgtgcactcccatctggggaaatgcccataggctataatctctttcactggagcgattataatagcccccgggcttcaggtcccagtggcatccacccttggtggcagcatacccctctgcatgaacagggcgcccacttgtcccctccttcttacttagtagtgatttttaaatgggagggtggcagtcctgaatgtagttcatcagtatttaccgcacaagctctaaaggacacagtgttttatttgtgtatttatttaacttttccaatatcggaatatgaatttttgtttcacctgataggacacgtttcaggggctccattctacattgtcatttcacaggaaaaatatttgatggctcattagaagggaacatctattattttgttactgaaaggcacattttcaaccttgagaattggatggcaggtaatggcatggaaattgacagcattttaccacttaaaaataaccacaagaaataccaatgttcaccgaatgagttgaagttaatttggttttgtaggctattgtagttaacttgatgcttgatggaaataattttgtattggaaatcattaaaaattgatttgattaatgcttttataatgttggtatgaggtgttgcactgtggtggtgatgacctaagggtgctgtgatggcctcaaacgttgtccctccggggcccacaggcaggatcccacacactagcacacctcccagttcctcttaccatcaaacagaggtgttccttcaacatgcctgctcctccctgtggcataaaggcaccaggaggttctctgatcccctgttagatctcctctgcagggttgaagacattttttgtttgtttgtttgtttgtttttgagatggagtcttgccctgtctcccagactggagtgcaagtgacatgatctcaactcactgcaacctccgcctcccgggttcaagcgattctcctgcctcaacctcccaagtagctgggactacaggcatgagccaccaagcccagctaattttgtgtttttagtagagatgggatttcgccatattggccggggtgatctcgaactcctgacctcaagtgatctgcccgcctcagccttccaaagtgcttagattacaggcgtgagccaccgtacctggccatttttgtttttaatcggtgtagtgtccctaacctaaatatttcacatggcctgaactttctgtagttttagcagcaatgggatgctttgaaacctagatctctcaccaactacatcttccattgactggtgaaacactagtttaagccaattcattttgaccatgtgcatttttgtgcttgatccctattttatttcaaaaataatttccatctctattcatgtaaactaataagagccttccgtttcctttaatggcaaattgtctcatcttttactgttttaaaacatttttttaacatcatgagaaaacgtgataaaaggtataagtgtagtttcctggcttttgcagtacctcagggaattcggtaaactgtattccatttgaggaaaggaacggttggagtaggaggtagtgtaaagataacatagcaaataagcattttaccagaaccctctgaagtctcatcagactgtgccatcatcagaatccctcccttctcatctacaccgtttaaagccagcatccagtcagaagcccagagctggtaccgccttgctttcctgccagttgctgacatatggcacacagtgtcagttaagggcacaggctgatgggcagcttggccacatacctctctggcttcctatctgtaaaatgggcacaatcattgtacctgcctctgaaggttgttgcgagaactagacgcagccttggcacagagcccacagagagtgagcactgtgtaaagactggctgccagccattagtactgggtgcctgtcttttggtgtctgggcaaagctttaacctgttttatcagtttagaactcagatgtctccctggcaaaacaacacgggcatatagatattttgtgaagttttgttgaagtgcacttaggttaatgattcatgggcagcctttcaaagctatcaggctgtgaaacagctttgaataagattgtcttgtccttctgctgattgtcttttccttcccacattagcagccatagcaggaggaggagaggtggcaagtggccacactactctgctcacattaagcagacaatttatggtcaatattcagtgaatttcttttttttatagtacagttaactgatatttatattagctttaaaattatagcaaaatcaggccaggcatggtgactcacacctgtaatcctagcactttgggaggtcgaggagggcagatcgttggaggtcagatgttcgagaccagcctggccaacgtggtgaaaccccatctctgctaaaaatacaaaaattagctgggcgtggtggtgtgtgcctgtagtcccaattactcagtaggctgaggcaggagaatcgctttaacccaggaggcggaggttgcagtgagctgagattgcaccactgtactccagcctgggcgacagagcaagagactctgtctcaaaaaaaaaaaaaaatagtgaaatcagccaaatagagaactaacaggcacactgcctaattccttgtgtaactgtcattggtgtgagtcactggggcagcgtgattaggtctgtgagctggatagcaaggctgtcattattctcaaggccttctgctgactgctgctcttggtaagacatacagaatctgtgggcacctcctcttaccgctctatgctagatgaggcgtctccacgttgagttgtagtagatacagctaagaaagtaaaagaaatgaaaatctcatcaaaaggattggggctagtctcattcttcatgcatacccaaaccgtggtaactttgatttttttattatccagaatggattgtttagaggagacagatggctttccagttcatcaaattttttcaattatctaaaaggaattcctacgcttggagcaagtcatttcaataaatctcattcatatttacctgctgcttccttttaaatggaagaagagaatgtttttcaagtacacttgaaaaatagcatatgtgaattagaaacttcctctgtaaactagcagagtagaaataagaggccaggattcagcaccaggtaggctggattccttcttaggtggctcaagctggctatggggctggtctcatcatatctaaagaactgcccagcttttacgcattttgaatgtggtggaaccagctgcatctttttatatgagagcggcaaatagtcattgtgttccagtttgcttctcgggtcatctaaacatcagaggccatgccacaagcaccgtaactgagggatatagtgtgactgtggtccaggccagtgacctctggagctgaatcatgacttcccagatgactcccagagcctgagaggggactggtgcgtggctccaaatgattttcacctgggcctctttgaagtcgggagagatacgtgcagtatggtagatgtggagagggagaggcatggtgtgtccaaaaattagcaggacctgatccatatacgtggactctgaagcagtgcacttactagattaaaaaaaaaacaatgtacttactggatttaaaaagtgtgtatttttttgtgagatgcagtttgtaagatgcattggtaactaggccatatactttttccattggctctcagctctcaagaagctctttagtttttagcattggatcagtaaacacttattaaaatgttcccagcatttgtttgccatcttctctttcagctgggcccagctgtgccctcaaaccctgcctgtctcttccctgactgatcatgttctcccagcttctacagaggcttccatagcattgtgcttggtagcagacaccagacagaatctcagccagctcagtccaggcgcacgggctcctggtctcccggggtgtggttactcgtgtctcctcggggccttccgccctccacattccagtgccaggccctggacctttgtctctattcatgataaaacatttttaggaaatgctgacgctcagtgaagaaatggaaacactaactctttgttctcttcctaacagacacgagacgacttcctgggccaggtggacgtgccccttagtcaccttccggtaaggacagtctcatgtttgatgcttcgtgctgggggcgggggtttctaattgtttgtagtcagtgtattttcagagtggcatttcttcaccacggtgaagaaggctgaaatgaagcacgtgtgctgtggccttagtcctttctggaaagtggtcctttcaaggggatggaggagaagctggctgtaagagtagtcaagggtgcctgagtcgtgcgcttgcgttcccatccaccagctccctctcttttctgcacttcagctgctccacctttgtgtatcacatcttacaaaacagacacctccttcactcaggcctcccttcttgtcacttactgtctctgcttcctaatgcatcctccgggtcccatcagatgtttgcactctttgtctggaaccgcacatgccatttctcttggattcctgtacacaaactataatagcatttcccagattttggtgtctggctttctcagtcagcatggtgacaaaagaagagcctgttcattctgagtgaacttgtcagctgggaacacccaccctcgctggaacacgcactgagttagcatgtgtggtgctgccatttctctctgctcaaagtagcggagcagtcgaggctgttgactagtgacgggcattagggctgacacccgaaacaggaggcagggcagacagaatgtgtaggtaggacctggaggccttgagaaaggtggatccccatctcctattccagcttcagttttccggcttgtcccagccttcctcctggccttcttccctgggcagcacaacgacgtgatagaagtagcagctgagagaggaaaggcgaatgtttctgccttacaagggcattgtgttatttttttaaatgctttgtgtgagcaaatagcataaatagtctataaagtaaagtgactttactttatttactttatttaaagctatttaaagctagcataagcttcctgctgtgtggaaattatggctgtttccatatgttaaataccaagtaagctttgaagatgtgttgtgaaggaaggtgatagcaagtaatttactcttactcactcaggggagctgttaaggaagaaagtcgcaaggttccaaaggactggaagtgaaagtgatattcttaaaatatcttgtttgtttctttttaaaactctgaagctccagggtgccacgggaggggcctgcccagggcttctgcgtgagaactactccatgagccatcagaaacctgactgctcttctcaggtcacgttgggaggatgtgactatttcaccttttgtgagcaaagacctcgcatccttctacgttgggaggtcttctgtgtatgttcttcagactgaagctgcgatcctctcacacttttagacagtgttggttgatgggccagctcttttatggacgtctccagccaccctttccctaatgtaaaaaccacatcttggccaggggaaattattttctgagaggcaaatattctaatatttggtaagaggcaaaagtgacatgtttaaaaaccttgctctgacaagctcttttttgagtgagtgagcagcacctggtcttgaaaggttgagtagggctcccagaaaatagaaaaaggttcctcctccgaggccaagtcagtataaagaatagtttagctttggattctgagtggaggcagggtcagtgagccttcaaagaaggaagcggtgcagaggcacagggcaggaatagaagccagccgattgcagagggtagagccgtgaacgcccagagaggaccgagtgcccctagttactcgtgtgcccagagggtaacttgcagtggcgtgcttcacctccatacttcaaactgactagctgttcacagccaactatagtcagagagatggaccacaaagaaaacaaaaggagaggcgtgaaggtatattctttattcatgtggcagtagaacccaagttgcgtgttctgaatgcacgtggcttttgaatccaggatttcaggtgctttcgtgtgtatgtttggtcgtgtgtataggatgctcatggggaaattacagtggcattctgtttgtgtgatagcacacaggtatgagtgtggagagggcgggagcatatgcgtgtattttgtggatcgaattatggatgctgtgttcttgattagtatatgaccattgtcaaggtggattattaacagtctgtagattcaaaatttgtcaaaaccaccaagctttagataaaaggaaatagaccaggcacagtggctcatgcctgtaaccccagcacttttggaggccgaggcaggaggatcgcttgagtccaggagttaaagaccagccttggcaacatggcaagaccctgtctctatagagaaacttaaagattaacccagcatggtggcacatgcctgttgcctcaactgtttagaaggctgaggtgggaggatcgcttgagcatgggaggtcattactacgctgagccgtggttgtaccactgcgctccagccttggagacagagcaagctctccttttgcttttacattcagagaccaagagcaaacttagctgtaactgtaccatcattgacttttcaactgccgttttcacatttgtctgttaaattcagtgcatcgttgtctaaaaattcatatgatatttgataacttgaatctattaattatttagcgataaagagaactctgagatctgtattaacagagtgagatttctggcaggtgtctgcctgttgcaccttcctcttgacttgtcagctctgtctccccttcccctggagccctcagtaacccacctttgcccagccacaaaatctcttcgtccctgggaaaggcagtggggcagagagagctattttaaaacattaagttttcctaaatcccagtcatgtgccacttaagacaaccatggctgactctggaatttaaattttcctagatgaggcattttcagggtggtggtattatttgatgccctgcctgtacttggaggtagctcagctgaccaacatccttttaccccttttgtgtttatggctgatggctggtagcaggtagcaggctgatggttccctctcatgagtgcagaattcaaaatcatggagtttggagggacttcagagacactgattcactcccagtattttccaggtgaaaaagcctgggcccagagagggaggggacttgcccagcaataagcaggtcattggtggtgctggatctgaccctggctctccagcatcattgtgagcctgtgatgtggtcaagggtgtgggcatggggtggattcgcccaaggcttaggtgcttgcagtggttgcatacaagtttcgagtctagggacccagcagggccctctccttccatttgcctgcagaatcctttatctcactctattccatagtgaatgcacctaggctgaaagcaactactctctttcaagatgaaagtactgagtatccagattttcttctgaatgcttttaccctggaacgggggcagcattgtggctattgtggctaatagcactgtttgcagcagtgtgtttaagatggctttccaccaggagcaccctcaaagccatcctgggaggctccactcagctctgctccagggaacaggatcagattggaacctggatgaatgccaagaagaatcttgtagttatctataagatcatcttctaattcaggctagagaatttcaatgaacgtgaactttgattttaatgccctacctgttactgcttggcattgagttggcagtactgacaaatgatatgaacgtgtagaattggccaatgaacatggctagtgtttgttgagtgtgccaggtgcccttgagaactttatagaaaccaactcagttgattggtttgatcctcacaacagccctgtaagttatggttactgccccattttatagatgaggacactgaggccaagagagataaggaacttgcccttagccacttggctctgtaagtaacaaagccaggatgcaaacctaggagatctgccttttgacctgtgtgatatcagtcatttaagctgcatagggtatggacagactcaggttcagagtccctctaagctccgtggttttccctcttcactctcttgcatgttctctgctgctcctagattgctcatgcccactggtgatcctgtaggctttgtcatactgtttgatttcctatgtttaaactgtcctttctccctgttctctacctctcaaagccttcccatcaccctgtattgtattgaactccacatccaaaaccattttgatttccaagtcagagtccgtctgttccctgtaccccaagtctcacagaatgtaacctctctgtgtcagtgaatttgttctgccttagcttctagtggattgttgacatgatggctcttcccttgtaattgtaaccataaggactgctataccatgttgtatccacatgtcgttgacataatattgctctcaaattatttgttggttggcagggcatggtggcttatacctgtaatcccagcactttgggaggccaaggcaggaggacgtcttgagctcaggagtttgagaccagcctgggcaacataggaagacccccatgtctataaaaaataaaaatattagccaggcatagtggcacacacctgtggtcccagctacttgggaggctgaggtgggaggatcacttgagcccaggaagttgaggctgcagtgagctatgattgtgcccctatactccagcctggacagcagaagaccctgtctctaaattaaataaataaatgttggtttaataaatgaaaaaaggaaggaaaaccagcaatagttttcttaataaattatccatttatttccttatatatatttacaaaccttttggtagaaaatattttcaaaatgtatgtttattactgcctcataagaacagtctagaaaatataatttacttcattcaatgatagtgaattttgagagcctccatagtttactacagatcagatgaattgagtgcttacgtgagtacctacttggtgccaggcaatgttcttggcaccggtgatccaatggtgagcaaattcaagtctctgttctcatgggcttacattctggaagtgatggataataaactagtatgtcaacaaatgaacaggtactttcagaaagtgatatgaggaagatacagcaggacgataggatggggggtgataagggtggctgatggtgggaactctaaaggatgagacctgggatctcacacttggatggcaaagtggaaacagccatgccatccagagtcagctgtccagcagagggacctgcctgtgcatgggccctactgcagtacatataatctgcatccatggcagatgaggacaggatggttgggagtacaaggaaggaagagagagactggttcccaatgaggttaaagttgattcaaggccagattatagttggtcttctaagtcataggaaagaattttcagtttattatgagaggagtaggaacccattgagagtttaaagcagagaatgacataaacagataacatttcaaatagcagtgcatacgtacatacatgtgtgtgcatgcacgcgcacacaaacctgatacagtaaatcactggactggtttatctcttgctataaaagtatttgaaattgtgtttaattgaagggtctaggtatttgaggttttactgaatatatagtatttaaagattaatgaaatagtcacacttatttatccaatttcctgctttggtaggaacttcacaatgaacttcacacaatcaaatgaacactgatttctttaaaaatgaacaaatactccacttgtactcatagcttcatgaactgaacctcagcagaaggttgatcggtgctgcttcctggggtgatctctgtgcaggagatagtctttcaattctcttaggctgatgttgtgagattttaatacaaaaaacaaagtttccctcaaagattaaatcttgtatattcttctgtttactccacccatatgtgtctcgagtcacaggcatatagcaaggcactggtgaccgctggttctccgaagtgaatcagctctgtgagactgaggccacaccctgcagttagaaattttacttggcaatgacagctgtaattttgtcatttgtctgtggctggggctggctcctaaaacccggtgtggatagtgacatctagtggatctctagtagatcagttccgtggactgtcaggtaccaagtgaagaaacacattcagcggtgccacattctaaaattcaaaatatattctctgtaatccagttgcctgtatctaaaacatgaaattattaggaatattaaaatttaatttactgttttttccccacagacagaagatccaaccatggagcgaccctatacatttaaggactttctcctcagaccaagaaggtgaggcttgtgggtatgggtgggtggggatgcctgccctgcatgctgtaggtataggtggggatgcctgccctgcgtgctgtggatatgggtgggtggggatgtctgccttgcttgctgtggtgtgggtgggtggggatgcctgccctgcatgctgtggggatgcctgccctgcgtgctgtgggtataggtggggatgcctgccttgcgtgctgtggatatgggtgggtggggatgcctgccttgcatgctgtgggtgtaggtggggatgcctgccttgcgtgctgtggatatgggtgggtggggaggcctgccttgcatgctgtgggtataggtggggatgcctgccttgcgtgctgtggatatgggtgggtggggatgcctgccctgcgtgccgtgggtgtgggtgggtggggatgcctgccctgcatgctgtgggtatgggtgggtggggatgcctgccctgcgtgccgtgggtgtgggtgggtggggatgcctgccctgcgtgctgtgggtataggtggggatgcctgccctgtgtgctgtgggtatgggtgggtggggatgcctgccctgtgtgctgtgggtatgggtgggtggggatgcctgccctgtgtgctgtgggtatgggtgggtggggatgcctgccctgcgtgctgtggtggttggcttttgctgaagacgattttaagtgtcctttgaagtcacaacccttctaaccaattttcttccattatgtgtgcagtcataagtctcgagttaagggatttttgcgattgaaaatggcctatatgccaaaaaatggaggtcaagatgaagaaaacagtgaccagagggatgacatggaggtacgtggagggcgtcaggcctctctccttgccttgagatcatattcatgttttgctttcaaactttataattgaaggaaataaaagtttagaaagcttaaatataaaaaaaagtacatatgtccgcaaattggtcattgatagtctaccagtgcagttatttgttttggttaaagatgaactttttatgttacaacaccaatcctcggagagatttctctttagacaatgccatgcctattccccaattttagccccacagctctgtgaaagtctcctcacacattgaatcctattattgctatggacttgcaactctttgtaaattctttttagccattgaggtcgcttcaaagtgggtggaggaatttagaaaatcacttttttttcaagtttcttactcatttggccacaggtgacagcctgcagtagaaaaaccctcctctagaaatgccattctgcaacgagctgaccagaggaatgtcccttttttccttcctgacagagccgcctgtatttaccttgtcacagactgatgctgtgggtcctatcgtaccttttcagcacacacctcggccagtgctgttttgttaggcaaattctcatattctcaaagtgtccattaaacgagacctctctagggcttattctcacatctgtttgcagctgttgcatatatgtgatatgtgaataatgtgtgtggagaagttacccgaacactcctccgcctgagagatcatatttccaggcattatttcatttacaagccttcatctctctatatacatgaagaggaataatgtgggtgatagaaatttatgaatgttaacatttcataagcatgtcaacagattttcatctcaaatccaaggaattttttacactcttcttgccttccaaccgcagtaaccagtgaattacttaattttccagtgattttagcagaggatgttaggaagggaatacgtaatgcctaaaatacgtgctgtaaaaatggaactcgaattttggtaccatgaaacccgttggtgtggacacagccagtgtagagggcctgagtagaaggcagcagcttccagactcctggctcctgcggttgtttgggatgcaaagaggaggcttctctctcaaagcccacctccctggggagcaacaggactctgggcctctggtcccctgtgccatgagttctgttagaacacaggtgcagcgcagctcatcttccctgctccctttacctcatagaggtgttgaaaagatggcagctgtactgtgacgcacatcattggcagggctttgtacagccttggaggccctccagtcaaaataacaaacatgacgtatggaaagagtatgatgtgacttaagtagtgtcaccgactgtgcagatccaaattgtgttgtcctgcaatgtagtcatcttagagggcagcacaattaattggccattactcagaagatttttgaggcctttctagaattgatatatatatatttttttggccttcatttgggaatttactcaaatgtggccccgaagccatggctagagccagagagccccagagcaaggagaagggcatgcagggcatgctgtgatgacctcttactcacagccgaagaaccaacctcataatcgtccctttaactttattccgcagcatggatgggaagttgttgactcaaatgactcggcttctcagcaccaagaggaacttcctcctcctcctctgcctcccgggtgggaagaaaaagtggacaatttaggccgaacttactatgtcaaccacaacaaccggaccactcagtggcacagaccaagcctgatgtgagtaccgtgtgatggtcaggaacacgtgcacgtgcactgcacagctagggacaaatatggcggccctttgggacaaggctgggaaataaatcatatgtctataagagcagatggtggtgtggtacgagattcctctccatttacgtaaagcatgcaagagcagtcagaacttgtatattgtaagcgattgcctttgagtcacatgctgctgttttcaatatgagctgatttattttctatgtcttcttttatgtcgattcctgaaatacaaagcagaggttgtttttcttagacttattttacatttgttgattatattgttttcttcttcacctttctctcccaactgacccagaacagaaccggcaagcaaattggctttgcaattttctgttttctctaagtttttggatgtttactctcttcaatgcattgatttggaaacctcaaaaatttttttttctttaaggaaatttgagccccttaatataatcagaaacacatgggagagttgcaaaatcagaattagtaattactgtgtattttaatccctcaccagcctcagggatgcagtaaaccaattcctgttttgttccctcagcaatttgtggtttgattgatagcaaataaacactggttaaaactcatggactttaaaaatggttttgtagcagcttgtttttaaatcattttatacagcaagatctaagtctattgataatacatcgaagggcaaaaagaaagtcttaaggaaaaggaattttatcctagaaattatgagctgcctagcagccaagacaaggaggaaattatcaatgaactatacaactttcagtatgtaataaaagcaagtctactgggtagtataattttcttgtctactcgaactctgaaagaaagtggctaatgatacattttagacaacaagcagtatgaggtatcatgttcttaaaaaccttttatctttagaaattgtaaagatactccacatatgactgtgggtggggagggtggccaagttttctggtctaggttttgtttaatttagagataaagcttgcagaatctggaacaacgaatagcctgtcttctctgagcccccaggtgggttctcgtgaatgtcagctgttcgtgatcagctttagactacccagcacgggcattagctcaggacagcaaaatggtctcaggacagcaaaaatatcagatcagctgggtaatgctgaactatcttttgttaaagttttttcccatggaaatagcttggttgattctttttgttttttatattattgcttactatttccttttgattaatgcccatagctattagaattattgtaatccattgtagctatttgtagtaaaaatgaatttggacccaccttgggcttggttacatgtagtgactagaagaatcttggtagcaatatcctaagcaaagcaccattacctacctttgctcaacagcatgagaaaggagtactgaaaaggtagatcctcatgcgacctctgcagaaaagtggccaggagcaactcacaaaggaaaaaatcctgatagctaatatgtatatggaaaaatattcaacttcataaataaggatcatgcagattagagtttgtattttggggacaaatagggataattgctactttctctgcctcacagagttgtgaaactaacgagggaattcttgagaaaacacttcatacattttaaaatatatactatttttttgatggctccacaggtgtagacatgtccccacactcatcaagaggtgtacgttaaacatgaacagctttttaatgtgttgattagacctcaataaagtgatttaaaagagaaaccatctttggtggcagtgtcccagaaactaaaacaaaaggtataacttgctggctcttcactagtctagagcaacaagggaaaaatgcagttctttttctgttgttgtttgagacagagtctcactctgtcacccacagtggcaccatctcggctcactgcaacctccgcctcccaggttcaagcgattctcctgccttggcctcctgagtagctgggattacaggcgcccgccgccatgcccagctaatgtttgtatttttgtgaagatggggtttcactggcttggtcaagctggtttcaaactcctgacctcaggtgatccgcccacctcagcctcccaaagtgctaggattacaggtatgacccaccacgcccggctgaaaaatgcagttcttaatccaagttcgggctcacatgtagttttgggagaaggcagaggcataactgccccatcaaggaggcagcaatgccaaagggagaggctgagccaggaaggacacagcagaacttggcagaacctgaggagcgcctccttccaatgggcataacttctagaaggcaagaggaaagttagttaaggaaaaagagtttccaccacaacctctgctagcaggccctttattgggatacagtataagttcatttcagaatgtgtgagaaaactttaaaatttgtgttttagaaagagtctataatgagtgttcttgataagtactatatttcagttagtctgaaatgacgatttcaacttttgagatactgacttgtgacataatttttgttaatgggatatgttatcttattgaaagtatctgtgagagttttccctgaaaaaatttttggcatttaaacttgtacactaaaagcctctgactagtatttcccccaaagtatgattgcctataatttactgcaaaaaaaaaagttttcttttttctttttttttttgttttgttttgttttgagatggagtctcactctgctgccctggctagagtacagtgacatgatctctcagctcactgcaacctctgcctcctgggctcaagtgattctcctgcctcagcctcctgagtagctgggactacaggcacgcatcaccacactcggctaatttttgtgtttttagtagaggcggggttttgccatgttggccaggtacgtcttgagctcctgacctcaagtgatccgcccgccttggcctcccaaagtgctgggattacaggcatgagccaccatgcccagcccaaaaaagtcttccaaattgaatcaaaacttttagatcctgaattgagaacatcacatgacaaaaaatagggtatgatgttttggtgttcttcagaccccggctgacttgagaggttatctcctgatgttattaggatttttaaagtagggtaaaggaggtaaatgcagtgtcacgattttgagattctgttaaaatgagctagaaagcagctgaaaaaaattcatgttggatcaggtgtactttcctccagatgacagctttgaatttgtcccttttgtagtctttggtcaaattgctggtgaccagaagtagctgccttgtcattgctggacttctagaaggattgggactgcccagctgctgtgtgaacttgcctgtcacctctgcttccagaggtctgacttgtcactgtggcaaatgggcagaggactttgatttctgttttttattaaacactgaggtatattttgaaatgtatgcctgaaagatgctcaaaatggtgtgactaatgcattttaaaactgcatttatttgattgaaatgaaccttaacctatactttagccgtaatatggtgggagaattctcacattggatgaccagctagttgtcagtgtttgacgctgacactttagtggccatctggccctccgtgagcattgaactgtcatgaagggcccgatctcaaccacttctcttcttctctttccccctttcctgcatgctcagggacgtgtcctcggagtcggacaataacatcagacagatcaaccaggaggcagcacaccggcgcttccgctcccgcaggcacatcagcgaagacttggagcccgagccctcggagggcggggatgtccccgaggtacgatgtccccagaatggtgcaaagcccggcagctccttcttcccatgttctccagcttgattttatatcataatttcttctgtcagtaaacattgttgagaatgtaaagattacagtgacgcagggaattaattaccatctgaatattaatttgaaagtgcctataaaagccgtatttgacaagtataggtggctctatattatagaaatgggaataacattatttttatttttattttttttgaagacagtgtcttgctctgtcgcccaggctagagtgcagtggtgcagtcttggctcactgcaacctccgcctcctgggttcgagcaattctcctgcctcagcctcctgagtagctgggattacaggcacgcatcaccacacccggccagtttttgtatttttagtagaaatggggtttcaccatgttggctaggatggtctcaatctcctgacctcgagatccgcctgctgcctcagcctcctaaagtgctggggttataggtgcatgccatcacaatggctaattttttttttttttttttttcctagtagagacgggtttcaccatgttggccaggctggtcttgaactcttgacctcatgatccacctgccttggcctcccaaagtgcttagattacaggcgtgagccactgtgtccagcccacattatttttcagtatgaaaatcttaagatatttttagtttgtaatttatttttcacaggggtctaaccatgtctcattaaatgacagcttgtttttatcatagttgagctgttgaatgagccctgtaacttgtttgggtatcatatgcatatttttattgagtcgctttgacacttggaagagatttattaccatgaaaatataaatttaggtgaacagaaatgtgtaattttccctttaaatagttatggtatgttacttaaaacgttatgaattaaacaacaaattagccataatcttccatgctatcttaccagctctgtttatgtactaaaaatccattcttcttagacattgtgttaggaagatcatttagaatgcggcgattcaacttggaaaagcaaaagtaatgattccataacacattcactctaagttattttataccattgtttaattacagcgtatagcttctatgctgctcccacggtgaatcctcagtggttaaaagtaaaagaaaatccatgacaattgtttataaactccagagaagtgtgtgtgtgtgtttgtttttttgcccacacatatagtaacaagtgctggaaatcagtcactgttcagagaggcattgttataaagtggttaagagcacagcctctgtctggaaccaggcctctttgattcacatcatggccctaccacttgctagatgttaccttgggcaggttattttctgtgcctcagtttcctcatctgttaattgggggagttatcttcctcgtgattattgtgaaggttgtgtgcctcatgagaggcacttagtaggtgttaattatagttatcaccggggctattgttgttacatggtttcattggggagctgggtggatccctacttctttctagtgtttaccccagtgtctccttctctgaaagccttgggagaccatttcagaggaagtgaatatcgctggagactctctcggtctggctctgcccccaccaccggcctccccaggatctcggaccagccctcaggagctgtcagaggaactaagcagaaggcttcagatcactccagactccaatggggaacagttcagctctttgattgtaagtagtggccttgtttgaaagaaaagctgagcaatgttttattgttttttgttgcttaaggagaatctcttacgtaaatagtgaccaagggtcttccagctcccagctaactctgacattttccaaagttcctccttccctaggagaagcaggactgtactaaaattagcccaagcaggtgagaatctttcttgatttggaaggcagctttgctcacccttataccactaacactttcttggtttataaagaactcaaagaagtaaaactccatgatgtctgtaattattagctttaaccttgtagaattcctttcccagccaaaaggctcatgaaaatagtacctttatcacaaaggtagtatttcacagtaacaattaaaagccatcaggcctaatcagtcctcttaagtcatattctgcaggatttatcattctcatttcgctgataagggcacaatgcttaagtggctcatccaagacaaggtttgagtgggagatagaagacgtctcctaagtcccagagtatgaacccttgagaaatgttgtgaaattgtgacactgtcatcaaggtagcattttaacttgggctctcaaccatcagaaacatactttctagaagcttcagatgggcccaatgcctgagcccaatggaatcagtcacaaagacttccatgtttgacaatacaaaactgtgcagaaataacccatagaaaatccctgcttgtgcatagaattaagagcaaatgaagtctcagtgtttctcaagaaactgaacttaaaaatgtacaatagtaaatgatgatagtcactccactgaaaatggcatcctaaaaaaaaatagtcattactatgaccataacaaacataaatgatagcactgcatacaatgtaaaagcaagtaagtactcacaaaattgttactttttggttatggtgtttttattttaaaagacagtatacgcctctattacatgagttgcatttatcattcagttaatgtgatttcactttgaaattctgtgactttttcaaaaagagatgtgtcgccaagatgaaaatgtagtactaaatggacaggataaaagaaattgcatatatatgggatatttgaactgataaaactgttgttatagaaacaacataaacaatgaagccttgtatttaaaacctataaaagcaaggaggtaccacagaatccatggcagtaacacacctttagtaaaccaagtaaacactgtaatttttttcagcaataatcataagttagcaattctaattatttaaatgaggagctcctgaatttaattattctagatctgtgaaatatcattaagacccaaatacaatgttgtattatttcacatcgtgttcactgttaaatgagagtcaaatcggatatttgctcattgggattaccctgtattcaaggggaagaacatgagctttggctgggcacggtggctaatgcttataatcccagcactttgagaggctgaagcaggcggatcacctgaggtcaggagttcaagaccagcctggccaacatggtgaaaccccgtctctactaaaaatgcaaaacttagccgggtgtggtggggtgcacctgtagttccagttactcaggaggccaaggcccaaaaatttcttgaacccaggaggcagaggttgcagtgagccacgattgcgccactgcactccagcctgagcaacagagtgacacttttattaaagactgattctttcacagtaaccaatgtgggaagatgtgaattgtcccccatccctaccacagagtcttcttgtaccatttacttatcacaaaatattaaaaatgagtaaatactagaaactgatactatggatgaacttgccgataaggagactctggcttctgtgtgtgacctgctgctaatcttcattcatatcaattaggcttcatttaaccacatagactaatacaaacaagttagaggaatattaagacactacacagtagatctttttttttagcttgatctcactatttttaatcattcctgtctttactacttgaagtccacttagaagctaaaattggctgagcatggaggctcacacctgtaatcccagtactttgggaggccgaggtgggtgaatcatctgaggtcaggaggtcgagaccagcctgaccaatatggtgaaaccccatctctactaaaaatacaaaaaattagccaagtgtggtggggggggcttgtagtcccagctactcaggaggctgagacaggagaatcactggaacctgggaggcagaggttgcagtgaactgagatcatgccactgcactccagcctgagcaatagaacaagactctatatttaaaaaaaaaaaaaaaaagcagctaaaattataaataccagatctttcagaagtaggccaagatgatgtctgagctcctctgaatataggatgcaactgactctttttcaattgtagtaatcaataaatgttgggtagccacatatcactatttcttccgtctattcacatcacattaaaatttaccctgagggtgcatcttagagcaaactacaagactgctagcttctttctgtttgtaaagcagcattagagtgttgcagagtcctgttgagtctcctttctgaaagttttggtctcctcttacttttgccactaattctaaggaccaatcaaaattccagtctgcttaactgaaaattaaagtgaaagataactttttcaaggatgactgtccttgctctgaaaagatgtttcatttaattaccttctaatatcgaagagcggtgaatatggttgagtgatatgtttgttaaaccaatgaaagttgcttttaagaatatatttcttgatgcttcctgtcttttcctctccttccagcaaagagaaccctcctcaaggttgaggtcatgcagtgtcaccgacgcagttgcagaacagggccatctaccaccggtaacccatgctaatttccagtcatcagttgactttttgggctttcatttacaatcatctgggctgctgcaaaaagagtttttcctgtgtaaatttatttacaatataaatgagatgtttttaaatttcctggccaattgccctaggaaagtggatttccaatacagagaattgttactgccacccatctctaaaatgctggaacctccattgctttagtttttcacccaaatttataccaattttgatttgctcacttaaacctcttggtacattagttagtaattccttttaccttattgagttactatagttatgctccagtgatctgtactttgaaaacacattgagtccctttaaccaggaagaactcttctgggcgaccgtccacatgttcctttcccttcctaatgacctgaagtctgaactctacagagcctctgtaccttctctttaaaggcagctctgctcaccaggaattggctataattctttccaactctctcatcattttaatagctatcagcaaatgtagaggtgtaggggattttgtaacatctgatgtatgtaaaaagaaatattcaagttggaaggcagactagaactgccctgagagatgtttgatgtacacattaaaaataagaaattttacataaatttgtttcttcttttggaggtgaaaatatgtggttttaatgtgttcaatttgatattttaccttgacagtttttgtctgttgctacaaaaccttgatcatttttaagactaataatgtattacgtatgaatttgaagggggaaaagtgcatttaaggtttttgaaatcacagtgtcttccctctcatgtatgttttttcttgacttcaaaggatattttggcctaggttttaattttttatgtttgagaaaaaattaatgagtatactagtcaaggaagcagtcaaaataatagagtcatttgtgacttacactggagagacttaataataagcttgataagagcgtcttttctgggatggtttcagtacagggctcccaaaaacaaaataatcaactgagatggactggtaggatccttctcaacctcatgatctgtgattttccttgaacgaatggcactttctctccttttcaaaatcaatgtcaattttatttcccaaagaactcactttcctggaaactggtgattcctccctctttctttgtactttctgatgctgtaaactcactgatcaccagtggcctcttgagttttgagtgtggggagatttcagaatctgctaattatttgacaatggcaggcaaaaccagaccagctttccatttttctctaaggcagctcactcttttgaggttgtcattgtttacccaggtcaaggatgagccaccttggggggcataggggtcacgcttcctttgtgctactggtcatcagcgactgctggctttgtctggatagggtgggtttcagggattctgatctcacgtcacctgccttacagcgctgccacagcagtgggccctgattcagacagcagggggtcatcccctaagtgcatttcactgatgtaaattatcattcacagcccagtgccccagctgggagagcgcgttcatcaactgtcacgggtggtgaggaaccaacggtaatgatccactttatcagacatcaatagcaagaggccgtgaggcagttttaatatttcgtgtagtggtgaatatacgctgtttttaaaaataagattagctcctttgtgctacagagctgcacacgtttcttattttaagcttctcatttggggattgtttaaaggtactgggtaaaatagaatgatttttttagtcccacataattttattaggaatactatcaggctttggttaagtgcatttaacttgaccatttagaagatatttttgacttttagtgtttgtactcctgataagtttttccatttcattagaatgcttggttaaagtaatttggttggaagatcatcaaagaagccacaggaattgcatgagactgtgtgtgtgattcctggatgtgcccagggcccttctcttttctgtatctcccctaccacatttttcacagggggttagacttttcttgtccccagaatgcaccatgaccctttctctgccaccaggggctctcctcacacaatgaacaagtttccgtaattccaagggaacataattaggatatataagtgatctagaaaaatttatgtttctctaagccaaccattcttattcattattttaaagaatgtatggtattcctgtctgtgggtgacttagatttgtattttaattgcctgttttctacttgatccctaaagttaggctagcttatagtttatgcttcgcactgcaatagctgtttaaagaatttcctggccgggcacggtggctcacgcctgtaatcccagcaccttgggaggctgaggcaggtggatcatgaggtcaggagatcgagaccatcctggctaacacagtgaaaccccgtctctactaaaagtacaaaaaattagccgggcgtggtggtgagcacctgtagtcccagctactcgggaggctgaggcaggagaatggcgtgaacccgggaggcagaggttgtggtgagctgagatcgcaccactgctctccaccctgggcgacagagcgagactccatctcaaaaaaaaaaaaagaatttccttattgtttcacctgtgttgtattttgctataactgctcattacttgtggataactttacgtatacaattgctgattttctaaagatgttgatgacttcaatttaatgctcagcattgtacagaggaaaatcaaactggcaacagtcagccccagaacactcagctcaggttaagatattgagctacagtggtttacatgagtcatgtgttgagtgaggcagcctccagtagaattcaagaaattctacatgaactattacccaccgtgcacttgtaatttctgtgggagtagtggagctttgagggggacaagatcgttttgtgagataattttagttgaattcagtgctgatgaacatcatctgtatatcacctatttttgtattttgttggccttgcaacctgcgtgtagctttggagtgttgtggtagctgatgtagtaaatgaagtaggaatggaatcattgcagtaccaggctccatggcaagggtcacctggcaggacaaggtgacccctctgaatgagatcccgggtggcacgttagactgccattttcttgccttcttgcctgcactctcccctccccgtcactgagtttcagcatgggttgggtgttttctttccacaggcttggcaatattcattcctaagtgtttcatctactttggtagatgtagatagatctccctacctacttaggtttgaaaggatcacatccatttctcttctgctgtatcctgcatgtttctcttccacatcctttgtcgtgaatgcccttgacttcctgtcttgcaattctgtctcttcaccccgtgtttccctctttggcatcccctctgttcctctgcacatcactcacactgaagtgtattgtcctgggctggagccatcatggtattatatcatctcactgcccctgtgctctcacagacatacggctgtgtacacataggtacacattgtgccactttattttattttttttaaatgggatgtcatgtatacattacttagcaacttggtttttttttaacttatgttcattcttctgggacatgttaataattacataatattcactgacgtaaaggcactacagtgttaatttcccgacattcaaggactttctgctccccctaccctgccctttcaactccatacgctgtgctgaagtaaccgtcctgatatagctttctttctatgatagtgctttcattcctgtagtctaataaacaggccctgattctcagccaagaaaccacagccctttgatttatggcaaataaacgcacagtggtgtcactttctggcagactaagccagggccctccccatgagataaaaggagagggatagcacagtcctttcagtctttgttgtatatattctaaaaatacacgagccaccattactgggttggtgcaagtcttggcaaatctgtgatggtcagtgtcaaagtggttatttttaaaagcatattgaaacttctgcagtttacaatcgtgttctttattttaatgaaagaaacagagccactaggaagttctagctaatggcttttgggcatcacaaagcagtagtgtattcagtctatgatgaaaagctgtgaaatgttaaactaagtcgccatttctaactggtttgattacttttttgttaagctagggtggaacatgctcacaagcacagaacagcagaaggctggttttggcttcctggcgggcccttccatggcctgtctgtagaagctgagtcctgccccctcaactagccgtgcagggtgggaggcagtgtgagttacaaatggaatcatcagcacaagttgttctatgtggtcatttggagagaacactgtaaagaaacatttccaaattgccctctcacataaatgtaactaaattacaggttgccagttcagttctcaatagaagagagaatgagcattttaatcaaattcagcgttctgtactacactcctaattttccacaaactgattagtgctattcactgtggctgtatgaaagtaacctgtatggccaggtgcagtggctcacactggtaatcccagcactttgggaggctgaagcgggtggatcaattgaagtcagcagttcgagaccagcctgaccaacgtggtgaaaccctgcctctactaaaaatacaaaaattagctgggcatggtggcgcttgcgtataatcccagctactcaggaggctaaggcaggagaatcacttgaacatgggaggcggaggttgcagtgagccaagattgtgccactgtactccagcctgggcgacagagcaatactctgtctcaaaaaggaaaaaacaaagtaacctggttgctagaattcatacagctttaggattcagttctgacatgatctatgacacatccatgtgctttcagttgatcagttgcctcccaagtgtcctttccagagattgagtaactgcaaaaatatccttaaggtttccagagctaaggtttccggagctgagttttccaggggcggggccagggggagtggggagttatgggagggaaggggcctgggagagggggaagtggatcaccagaacggctgaaggggagggctctgggcggagggagctgagaatgtaacacattccatttagtatttcattgattgtataaacaatagtaggtcaaaacttgatagcacatactttgccagagatactaattgaccaggaacttaggttacaacttagctcagcaggggagtccattgaagtgcccggatccacgtagctctttgtgttggcatcgctgctagaggaggaggggaggaaggagcttcactcaggctgcatgctaattcatcgatgtttaatattcatgaaaggattaagtcagtgttgatgtttcttctgctcctgctgagtctccacacctggatccagaatgctccatgatccgagtctttgtgtctttataaactatctttagggagctttaggactttatctcgggaaatattaaggaaatggttttccttaatatcagcagaaagttttcttacacataatctaaaatcagctgcttcatgatcttacccaggtgatctttctctgaattgtgcttttaagcctgggaggttaacatactgcttctctgtggatggggttttcaaattacccggcagcatccttgttggtgctttctctaatttgagatcctggagtccaccagggaactccaggtgaccaccttcaccaagacacattgctggtagtgcagggaaaaggtggcataagcacaggaagaagttaggttcagaggaaatttgtatcctcagcctaatagcaagaaaacgacaactgctaaaatatctggaagtaaaagaagcagcttccttttgtaacctcacgtgagaggttattcctaaggcatgggctcctcctatacctttagattcccctaggagccgtggtatagctgtggtcggcttctggtttctgagcttttccccacttagagctctttcacaggcacagatattacatgcatcgcctatgcattcaagccctcctgggacagccctgatctccagcatctgtcccagtgcctccatacatcatcaacacatccttgtttttcagtgtttctccatccacactgcatttcttagactgcttctcagggatcttcttgtgatcaaatgtggactgtctaaatacagtcactctatgcggggcaggtctctaaacccaaaaactgccaagctgtgttcaccttcaaagaaacacactcctatcagcagacttgggtgcacatagcctggggtgtgaggctgggtgctgggagacttcctgagctggggcacacagatgtcctgggtggtcctccagattatatgctactgtgtgaccatcagtatcctagagaaggggctctgtgttgggattttaaaattttgccccagaagctacagtgttagggtcctaagctgatggaggaatgtaggcctaagctagaagagcaccccatgggagctacatcgaggagaaactcagagcatccctctcatacacagtgacactggacagtttgaaatacctttaagctctacctggtttggcagtggaatttagtagctagaacagatgataatgtttttccctttccctgtgatcaccttggcagcaaccctttacgtttgagactacggggtcttagaaccaagttctgtaagaatttggactctgcaactgtatggggttcatttcacagtagatttgaagctgttggaaatctattgctgttttccagacacttgtaagtgttttctatataaatagatctaattaactttgtctagagaaaataattatctgggtgtaccttactttattaaactgatcagaaaacaaatgcaaggtattaaataataatgatttcttgcacaaacagccatcagtggcctatgtacataccacgccgggtctgccttcaggctgggaagaaagaaaagatgctaaggggcgcacatactatgtcaatcataacaatcgaaccacaacttggactcgacctatcatgcaggtacgaagattgccatccaacttaaaaccgcaggccatagaagccgaaatgtacatgaccgaactcctttcctggtgtttatgtattgttctgaaagacccgtatttgtaaaagctttctcacaaagaaaatgcattactttaaatacaataatagcctaaggaagaatttgcttttcaaatcagtttatcactgaatatattttaaaaatgtgacgtgaaagatattttcaaagtaagagcctattgcagtgtgtagcttcttccctgcccagcccccactttaatccgaggctagtttttatgctgggctagtgattcatttttatttcccttgaatgtgtttccccatcctttcccccatcattatgtttaattatttcctccacgctttaaataggccagacctcttattattgctgtttgcgttgttgtttgggttcgcgctcctaatcacacacaccgggagatcctcctatgaagctaacttgtttttgcctccaaaatagcttgcagaagatggtgcgtccggatcagccacaaacagtaacaaccatctaatcgagcctcagatccgccggcctcgtagcctcagctcgccaacagtaactttatctgccccgctggaggtgagacggctacctcatctaactggactcactctgtcctgtgactcccattctttcttctctcttaactctgccttcagtttcgcagccacctcctctctctgatcagtcgttgtgttggtagtgaagggtgttcttgtgcagcctttctacctgcttctctgtctcgcccagttaacattcctggactctctcacctgattctcattctcatttggctaaggccgtggtgacttgtgctggacgtgggcactctcttttcaggacttccaccgttcttgttgtgtttcgcttctttttgcctgttacctcattagaattgcgtaatccctctttcaaataccaagtgctgatattgagtttttaaacatagctattgctttgatcatttgtttttctttcgactgtagggtctttcattctatgggcatacatgtttctgatgcatatttgcatctctgcatcatggctgggcatctgcttgtgctctctgtcgtgtttgtgttgttttggtgccatcctttaacatcacaaatgtcagagttagagaagccaaagagcaaatgtttgaggtcctaagcttgactgtgtcttagagacagctgtgggcttctccacgccctgggtccagatgctgataagtgggaatggatgctgtctcttccacactctgatatgaatgtcatgggtaacaactgtgagattccagatcgttgtatttattgatgtagcttttttcctttttgtgctctaaaacttgccaatctgttcttcattagactgtgagctcattaagagcaagggcacatttttctccactctgtaaaatctccatccataatgcttagtacagaacagtatttttggtacatactgagtagctaccaaaggatggtggttataagtacttaatattgttgtgtgtttatccaacagagaaaatgtaaagttagattgatttaaaagtaaatgaatgacagaaaacaggttttggggatcttccctcttgtccatctccaaagagaagccttctgcaatacccaggtacattttggcacattggaatcgcacatgctaaagagttctaatcctcattgttattctttagggtgccaaggactcacccgtacgtcgggctgtgaaagacaccctttccaacccacagtccccacagccatcaccttacaactcccccaaaccacaacacaaagtcacacagagcttcttgccacccggctgggaaatgaggatagcgccaaacggccggcccttcttcattgatcataacacaaagactacaacctgggtaaggctgctgcttttatttggctccattttcatcatgaagtctggcattaattccttgatttccttagtgtttgtagttcttgcagaggaattggattgactgtaaagggtgtctccagagggtctcctcagcctgcatctggcccctgcataaatgggcgggtgggagtgggtgggcacaggctggtagctgtctttggtattggtgctgggactgccttttctcctgggaagctctagtttagacagttcaccgtgctggatggaaaggtattgctctgtgctgttaagattttgttaattgatcccgtctcacaaagtaatctcactaggagttataatcattttcaaataattttttcttttgtcagtttcttcttgcactttcattggcattacccaccttcttttgatttgtcgctttagtttttaccgttcacatcagatcagtattcacacatctgaggtacattttcatgcccttgatcatggggtaggggatgtactgagtgactttggttgtagatctgatagctcctttttgtgatcattttgtcaaaattgatttttcttaccatgcaactctttcatgtactcctgaattgtacccaagaaagaatctgtacattgtattatcttgagcaaaatgagattaatcaaaggcaaatatgcatatctttgtatttctgtgtcagttctttatttctttagccgaatcggtggctttttcagtgtagtatatgattcttttaaaagtcagttggtattttcctgctatataatctctatacctgtaattacactgaaaccggttcccgtatttctggctatttttgatgctgcagatggtttttcttccggttatgtccccatcgaattgtctagctagagttaactcagagtttaacttggtcctactattatctgtgctacttgctcaaaactgatgttatgggaatgctggttgagttttggtgattgttattggccctagctcttcggtcttggaccaacaataaacatacaccattaattcccatttctagtgatggacattaagtgtgtccatttgatagaccagcagccttatattcaagaacaagccctgctcaaggggatttgggctgtcattttatgccttgcccattgtgtggtatcagttcagtccagcaggtctagagggcgtgctcctagaatcctttgaaccgtgggacattgtgtcttcaagggcattcttggcatttggggcagggacatttgtgccttcagttgcagactatttaacaaacttggcttctgctaccaggtgctaatggtcaccattacccccaccccaacatagtgatgaccagaaatgccctacacatttcaaaacagccctaagtgagaaccactctaagagctctttctattttgaagtaagggaatggcctgccaagagaatttctcatttagatctggtaacattcatttggtaaactgataactgcttctaaggcatataataacatgtaggtttgactcccctactagtctgaagataatgttacagatttgcaagcaagccaagagtaagagacgggcagctcgttggaaaatatagtaatggagttctttttttttatgtctttttacttattaccatggaacccctggctgtcctgccagtgttctcatttactatagcactgctgtaatttcaagtccttagccagaaacaggctccagaaataagggctaacgaatataaaagtagatggattagtgtaaggagccactgtggcttgccaacataagctatgattttagtaattttaactagcttggtaatcaaatcccctaaccttttcacagcctttcaagccacaacaacagtgtaattgcagctgggcagattgtattttaaattaaacagcactcgctttatttattgcttgcaacattgctgaatgaaacccatttttactttccagttgcgcctgtttacccagatacttgttattgactaatttactgatttaaaatcataatctgttagaacaacgttttgttgctgctgctagtgtgggaaatcctcaaggtaacaactggaaattccacaagctactccccttcttaagcgaattcagatgtgctgacacagctgcgctatcgcttctaaacaaaggcctaggcaggattttccctgcggaagacacactctaaattgcctgttcattttgacaaaagatgaagagccggagggaagcatgaagataatttgcaacttaaaaatctgttttgagttggttttagggtttgctttgttttttatttttgaaagaagaagagaacaaatgagagaacagcatagctattcttagatttgagcattagaatagaaaaaggaaaaaaactggtaggacaggttgaaaatgatgaaaataacactccttcccccatcggcctgggcactgttgattcttacaccaaccagaagcctgaaaagtatcaggacatttcccctctatacattgagaaattaaaaaatttattgaaatatgtcatgaaagatgaccttttacacacacacagatactgaaggcagtatgccatcagtatttggataaagtttggcctcattctcttttttttaattattattttttttgtttttgagacggagtctcactcttgcccaggctggagtgtaatggcacaatctcagctcagtgcaacctctgtctcccgggttcatgcgattctcttgcctcagcctcctgagtagctgggattacaggcacatgccaccacaccagctaatttttgttgttttttgttttttgttttttttagcacagacagggtttcaccatgttggctaggctggtctcgaactcctgacctcaagtgatcctgccgcttcggcctcccaaagtgctgggattatgggcatgagacaccctgccaggccaagtttagcttcattcaaagaaagaaagaaagattggctttgttccccgcctgggtcaggcctttcagggaatgcatgctggagaccaggggcttgggagggatgtaccaaggagggatgttccatcctcagcagctcagagcacgtgtatacgggttgagtatccctagtttaaagattcaaaatccaaaatgatccaaagtctgaaaccttgtaagcactgacatgacactcaagcaataaatgcttattggagcatttcagattctcagattagggatgctgaagtggtaagtataactgcaaatattttgaaattcaaagcccctctggtccccaagcattatgggtgagggatgttcaacgcatattagtatatttgtgcctttcacaggatgaagcatgggcttgcttttgtagcaagaaagattacaccctagttaagttgcaggtttgttttccatccaagttcaaactaatgaaacttattactctaggtgtggttgctggtctcttccaggatggaaaagataaagaaaaaaggcacttttttttaatccctgtgttttatatattttgaattaggaaagccctttttaaaaagatactgctctttgcatcctgtttaaaaacactttgaacttgatggagggaagcaattttatattacacatgaaagagttcccgttatgaaactgaagaaaggaagaaacaaccaggcacactttatgcgttggatcatttattttcattgcatcagagccctcgttagtattccactttctcatcagctctgaagttgtccataactaatagagagccttgaccgccacttcatgtgccctggcaactaaggagagatgcctgcctccttgagtggctcggtgggagtcagggcttgagggtgaccactagccttagccctcagagctgattcatggcagctgctgccattatttttattatttttgataaaataatattataagcctcaaggcctctggccctcacagtctatgaagtctaggtttccatgcaaggccactttagcagatctttgaaattcggttgactttatacttcatgctctgcccctcactgcctccctgacacttttctctaatttcagcttcttttcacgctacggccccccccgccccccccccccctttaaatcaccagccttttaccaatagggctgattgtctttcacggtagcctacatgtgattccaaggtcaggctggccttgtgtgtagcattcagaagccctgccctctttcatgtaatagcagtcctcagctttctctaaatctggcatggtcataggctaggtggaagcccaagggtcccccgctggttgtggcgttacctggtccggatcagagttagcattgagtgggtagcttttgagaaattcagtgctttcagtttttcctctgtctgtagttaaccagtcatgaatgtttaccagattatcagcttcttggaccttctcaatcctaaatcagcttagcatatttctttatgttctgtgtatgtcagtgtactgcagaatactggattattttgtgcctctgcttagccttttaaaaaaatatattgggttcagggtcaatatgcatcacaaactgctaacaggatttctttcttcatttaaaagttcacctagctagcaagaagcaagggttgatttttgttgttcgtggtcttttttgattcttgccagttcccaagatctatgattatgattcagtgatactatgacttacacggttgacttgggaagcagaaaaatctagtaatttggcagcagcaaaggccctattataaaattgaatgaagctgatatcaaatgtcttcacagtttactttttttaatcttaagcttatttggttgatagtggttttttttttgagtataaagatatggattctcctttttatgtttttggaggcaagactcactgcatcacccaggctggagtacaatggcacaatcacagtttacggctcactgcagccttgacctcctaggctcaggtgatcctcccacctcagcctttcaggtagctaaggcaggcatgcaccaccacactcagctaactttttgtgttttttgcagagatatggttttgctttgttgcccaggatggtctcgaactcctgggctcaagcagtcctcccgccttggcctcccaaagtgctgagattacaagtgtgagccactgcatctggccttacactgcatttctttttcttttttttctttttttttttttttttttttttgagacggagtctcactctgttgcccagcctggagttcagtggcacaatctcggctcactgcaacctctactttccgggttcaagcaattctcctaactcagcctcccgagtagctgggactacaggcacacaccacacccgggaaatttttgtatttttagtaggaacggagtttcaccatgttggccaggctggtctcaaactcctgacctcctcagcctcccaaagtgctgggattacaggcatgagccatcgtgcccggcctacactgcattttaactgggtctacataagtgagagtcagctcctggactctgggtcataatctttgggcaacttcctgttctctctgaaactccatttcctcatctaaagaaacagaccatgtgcccaacctcctaccaagggtctgttgcaggattttacatctgaccatgcctcataaatcatgcagcctgacccaggttgtcagagtacatatttctcttttgttgattctctgtggtatcttatgaagcttatgctttaagaaaaaaattttgtaaacgtttaaatattaagacataaatgagaacttaatctgcagaacttggtcaagaatctcagtaaagttgtatcataactttgtgagtttgcctgatgaaagcgactctccctggagtagccacgtgacttcacagaccagattgacattctctgctgagttcagaaggagtggaggggagcacaagtgctggaggagggtgtggcagggaggcctattccctaacgtgttaggctggctcccctcaccgggagctcgggacccatggagagatttcgaaaccgttgtccccactccctctttgtgccacattcactggcaccctccattctggtttccctagtaacatcactgctgggactctcttccccttccccttctcaaggtctcagggaaatggttaacctttcatgtaaatattcttactctcctctctccaccaagcacaagaaggaagagtacagtctgtctcgagagacagtcagccaggcttcctgtacaaaacagagatgggacccatctcacgctccaggcatggacagcctggttgccttgaaacaaacagctcaagaagaaaagcacccagtaactgcacacagatacttccacttagcatctactgtcttttacatttttcttgcaggaagatccacgtttgaaatttccagtacatatgcggtcaaagacatctttaaaccccaatgaccttggcccccttcctgtgagtacactggagacacatggaatggtctgaatatgtgtgttcctttatccgctcaatgttgatggagaggccctgtggaccttctctatctccaggctttgtggatctcattggtttgtgtttcttaacagaattgggtgtttagctgaattgtagtcatacattatagttcatgtgatatccagtacttatgaaagaggtttctgaattgctagcttctagcagaagatagaccttgtacacaggatgttcaagagacgttctctgcaggtgacaatttaagtggcactcattcattttgtaacttagcaaccactgagtttcagtcatattgctgattaagtcatcagaacaaaaataatgaaaatagtatgggagaagaaggcctaattaatcatagaaagtttctataagtcatttaacctgcagatttttaaagtttttttctcccttgttggtgacggctcagtaggagttgagctatatacttaaaattggattttgaatgaaaccttcacatacatcctcctcaacaactcactctcagtttgaaaaagccgtagggggtgacagggcagtggttggactccaaggctatttttaaatgggaatttttgttgttgttttccaagtgtaagaacctttttgttgcctggtatattagggcaacattggaggctgcgaaggttaaggttcaatcattattcattaggttatacaggtatcccacaccaaatctgtttggttcctgggttcaaatagaaagaaccagagagttagtttagaaaacaaaagaaagcatttttttctgaatctgttggattcctgaggttcagatagcaaatatggatagttcagataatgagggcataccagctttatcttgaaaaaattctccaaatctgtttagttcctgagcttgactagcaaaagttcatggtggataataccaatattagatcatcaactgcctggacaacacaaatacagttaaccatgtctaacatttttatattaaccccctcttcctttcctttagtactcagtatttatttaattaaatggtactcaacttcaaactccactgttccatggaatgctgcggtttccctttgaagcttttgagctagcagcccatttccggttcttcatacagtcagcgcatctgagacctgagcatgtgataaagcgtgttgctagacatggtcaagagttaacttgaaatgttcatatttagttcacgctcaatgcataaatgtaccctagcagaaaagagtacagaggtgttctatagtttttaaatgttgcctttgatttcagaactcctagctaatgtttatattttctctctcccttccttccccggatactagcctggctgggaagaaagaattcacttggatggccgaacgttttatattgatcatagtaagtaggcgctgttatggacacacaggtgttgtgggttagagggaaggagtaattcaaacatcatagtgaaagctttgtcattttactctttatctaggcagccaggtgttatgtggagaaaatgataccagagaatcagtgccttcatacggtactgtgcattcaccccaagtttgcttaaagtagcccatcaaactttcacccaatctgatcttgtgacctattaacgtgtttttttttgttgttgaatttttaaaccacattttgattgttgatcccttgacttttgcacatttaataaatacactctggtaatagaaaataagattagaaatgatgatttagtcaaaaatctgtgaacagtgcttgaagcagcatgtaagttttttagacactgccttcaagggtcctatggcaggatgcccgctctgaccttattttctattcacggcatgtttccttgcacccacaacactaatatatatgtattttctggaaattgtagtatatttgctatagacatttgctccagcacctatgaaaaaatgtgtggtttctcattccaactaaaagttcaactaataaaagtttgctttttagccagtgggattttttttttctcattctttttggaggtgccatgttcttcatggaatcatatttctatgtcccttaaattttctgaaaaagtatattaaaaagaagccttcaaatagatgtaaagtttcaaccatgagtgcaatttggtagtatcttggtctttgctttcatttggttcatgaacagaaagttagggtttccctggcttcacaatttcataactaaacaaaagcacgttgatgagccacctgctgagaagtctggccacaagtaatcctcacacgtataggactggtcactatctcataggcatagtacgtttttcagatgttactaggaggcagagacattgtgaacagaatttcactttcaggccctgggggttgagggcttattataaatggaattaagcaaaagtaccagcagtttacaattcaactgaaagtagaagtcctaggtgtatttagaagagtgagctaccctttgtttaaaccagatatttcaaggtgcagagacttagtttttgtcttttatcaaaaaatgggcagatttgtcaactgtccagaatttcatagtaagcataaagtatttttcctgctttcatgtatgtgtatgccctacttttttccttaatatactatttatttattgttttaagagaatttactaaaatgagagagaggccacacctctttttcccatgaaaaacaaaataatagtttccggcttggtgcagtggctcacacctgtaatcccagcactttgggaggccgaggtgggaggatcagttgaggtcaggagttcgagattagcctggccaacgtgatgaaaccccgtctctactaaaaatacaagtaaaaactagctgggtgtggtggcgtgcacctgcaatcccagctacccggatggctgaggcaggagaatctcttgaacctgggaggtggaggttgcggtgagacaagatcataccactgcactccagcctgggcaacagagggaggctgtctcaaaaaaaaagaaaaaagtttcctttatagtattttttatacatcacaatcacagttttaagacaggtgtgaataatactgatcattttactaaaacaggtctttactggtaacacatcctggtctgtgacgcatggagagcattgcacacaatattgtgacagttttctggctggagatgtgatgcttaggtccccctaaaaagaatgttgtgaatgtgtttcgtataccgcaaggagccaaaaacagaaaaacacaattacaaagggctgtcgtagcatgcgttaaaatagtgaaaatcactgactatttcacttgtggtgtcatagacctagtatgatacatagcagatgcttgatacttggtgacttgaaatcaggttcatggaggatcagtggtgaagctcttaggaagttgttgtgcttgatcagaaagtgaagtgaactcacttgaggagcagtaggtgcccccactccggctttccacccccaccggcctgaggctagcgcaactccggcttactggaaggtggaagaaggtaactacctgctagatgcctgggcttttccttactcctgatcagttctgcagttactccagcactctgcccaaacatttcctcatttcacttgactagagcagcacccccgaggctccattatactctgtacagagcttgatgcaactaagctgtgccaatatatttgtggccattgacttggagattaaaatttattttgcccttgcacaaccatattgaaagattctgttaaagagatatagcataaattaagtgaccaaaaaccatttaagaaaaggatttgtttacgagtgcctccttagctgttcatgctacgtttctaccatcgctccataattcatcaaggtttactcaatggaaagctgtagagcagtacacgtcagtgaaacagttcaagtcatttgcctttccacaaaattcagtctgtgaaaactgcagaatacctatcttttgaagaggctttatcaggctgacacatacattccaaatgggttgaattacctggaagataacatttaggaatgtcctttctgtcagaagaaagcctctttttctaaacaatcttatagcaaaactcagcatctgattttgctgtcataatgcctacaggacaggaaccaggttatgcccacgtatgccacaatgccgtgagtgccgtcatcttgtaaattgcttagagtcatcttgtcttccagcatacctggcacgtgggtccacctggaattacagatgagatgatgagatgcacttgtcttttcaataattaattatttctgctttgtaagtttttcctgagaagttagacattttcaagatgaacaatactcagccatcataaagatttaatttcaagagcaacgaatgatcgagactaacctctttagactcctcgattcctttgtttgctgtctatggaatggctcctggctcttgggcctcaggtgggaggttaaaggaaggtcttaaactgaatctctacatcttgtaggaatgatgtcattcttcttaaagaccagacaggcccagcagctgagtaattggccacaggtatcctatctacaacattagaagagaaaattgaattccagtgattttgtaaagtcctattttagtctttcctgtcaacagtcttactagacctgttcatcgtgactaaactgagtttctcatccttccacttccttcttgtccttttattggaaatatatctcaaagaggaaaagcaagtttaaaagccaaagttctttaaaaaaaaaaaaaaaggataactggctaccccatactttcatacattgaccatacttcactgaagaattctttatcataaccatgtagaaacttgtgttgttccaaaagcttaggctctttttaaagggactttgttttcaccatcagcttcattcagtcattaaaaaaataatgcactaagttcctgttacctgctgggactggtcttaagtggtagagaggggattgcaaagatgaataacacacagtccctgtccttggggaggttaggtccagtgggaagtagcaggggatatttcaggtgttagaggagtgaatcagttgttacacagaaacagaagaggcaaggactgcatctgcttgggaggtggttgggcacagggatggggccctgagagaatgggtcactttttagatggatgacaaacactgagtaggattgaggcagtcaaagccccaggaagagtgatcctaggatgcgtggaggtgtgtgaatatgtgcagatgctgccacgttccgagaaacgcagcattgctccaaacagctagtgtgccgcaggggcgcacaggccaagccaaagggtatctgcccggtgtggggactcgggctcaagccacaggcagtggggagctcccaggggatttcccagaggggagggatggggtcgaaatcgttatttagagagatccttttggcagagctgtagaagatgtcttgaactggggttggggggtgagacaattcccagtgacgcccagagaacagttcagggaaaaaaaatgagccctctagcaagaagcttatcaggaatagagagggttggtccgggaccaccagagtgagtgacacggccaggttcctgattgggacagtgagtggattgtgatactgcacattggaatgtaaggtcacgttaccaattttggtgttgggtgatcagaggtttggttttggtagagttaagctgaagtacttacgggaaacccagatgcagatgtccaggatggagcttgaagttcaggtctggtctgaggacttgcgaatcccaatgagtcaggagttattcatttattttctgctttgatgacaatatccattgatacggttataatccaagttggtgttttaaggcgcaatttttactcagctgtactccgtttcctttatttggttttcttttctcttgttttccatcacaatagcaacttttactttccaaagtcttctgtgaaaggtaagggacccaaaaatgccttttgcttccatcaagattctctcaaacagttgagatttttcatgtaaattttctgccagcatgaaaacaaaagattctagaatcatcacttgctttggtagcttttttttttttttttagcttttcctctgcttctattaaaataataataagactttttaaaattcctaatatggtcattaaaacagaattcactaattattcttatcagctcacttacagtgtatacagaaaataaacagaatcaatattcttcccctgcactcccccgccccggtccccaagacaggtgcagatcgggctggagcatagtggcacagtcatagctcactgcagccttcccctgggctcaagcgatcttcccacctcagcctcccaagtagctaggactacaggcgtacaccaccacacctggctaatttttttttttaaccttttgtagagatgggtcctcactatgtttcccaggttgggcccgaactcctggcttcaagtgatcctcctgcctcagccccccaaagtattgggattacaggcatgagccactgctcctggccaccctttacttttcaaataattttcttcttctttttttttttttttgttttttactaacctagatatccaaaaactctggagaacctactctccctagtgtgccccaccccccgtacctttcatgtgagtccattgcactctctctccctccactccaccctagtacacacacaggaatccgtaaggtctttttaattatgcacagttacaaacaccaagtgatctaaggcagctgttgtgtattatcacctacacaagtaatggtatagatagcattgaacagtcttgtgcacattaactcacttggaagaaagcaaaccaccttttgccagtgtgaccaaacagaaaccatgctctgtaatcttcctctgctgtatctaattctcttttttggactgcctaagctgctttgatttttgtgtgcatatgagtgacgcatgtaatagattattcatttgttcaatgcaggattcttaattgaaagcagtttttcaacaccataagtaaagagaaaagtatttgaaatgagaaaaaaaatcgtgtgtgtgtttgttagccttttgggaaactaagactttttaaatgctttttttcaactaaatgaaaatcaagatcaagttataaatccttaaaagaacaggggtttataattcccattttagcaagttatttgcccaaaacagtatgaatagatggtttatctttagttgtgcatttttgattgagtgtttttaactaaacagtatgtgaggggggttgccatatagactgtagttacctgctaactctgaaatactaatttgtctttagaacacagggtgggggactggacagcttttgaagaatccagaaatacttccttccaaaactttctttacatagaatagatttgaactaatgttctgattttttttttttttttttaacattttcagatagcaaaattactcagtgggaagacccaagactgcagaacccagctattactggtccggtcagtattttcaaattctgcctcttcagtataagattttggttacgtgtttacgtgtttcttgtgtattactgataacggtgatgtcaagggacaacggtgattgagtagttgactagaaacagagcactttgctgccatctccttactgaagtttccaggtgaggtacagctgcatgtgccttttcagatggatttcattataaaggaaaacagcttgataacgacagcagaattaaacatttttcttctcctttataaaagggtggactataagtatagtcaaaattccctcccttcctttttatatgaagcaaaaccaagccctatcttcataaagtgttatcatttctttaggccaggagtagtaaatgtatgccaaaagtttaaatcttttacaactttcaaaaatctgtagaagtttgggtgagattatagctaagttcaggagctggcagagttaagagtttggaactctgccgacccacagtgttctcatggtcccctcatatatgccgggtggaaaaagaatcaattctgatgcaggcgtgatgacctcttaaaacaccgtagcacactgtgttcataaggcagtgtgagaaccccactccctgaagcatcaggagacatttggtatctcacacttgttaacaagtctgtagaatgggaccacactcatcagcagagagcacaccaccagcttttgtcagtggctatacgagtgcagggaggtaatttggaattacaggagttgtactgcgatcagcagaagattgcaaatttgggattcttagaccagaggagcaaaaggaactgaagtttgttatatcacatgctgagctaagaggccagtaggtagatttaaaattccaatttcatggctttaatctgattccattcaaattatgttttgaattagtaagatacatccatttgaaaacttaaaagatactacattgcaaatgtgccccggtaactgactcctgttagttacttgttggatttgtttagtcatttgggtactatttcctaggcaaagtgcccagtagtacctgggtaaaaacagtcaacttttttctctatgcggcttaaacactgccttactctgatgcttccttttgatatatatatattcgcagtcacagttgtttattggaatattattttctcttctacatcattagaacaaggtaaattcaagaaactattctttttaagtgacagaagacttttgacataactttgaagccttttcaaaatatttttatcacttatcaattaccggccgtcactcaaacactgctagtccttattaaatcttactgaaaattgctcagcatcataaagccaagtagatttgcccccaagaaagagctctctgctttctgttaataaaagacccttgtttattccttcatttttattattattattcattatattgctttcaatagaggagaatctgtatttaggtagttatcaacttagtgtagacatttggcctttgttgtcattcagttctaaatatttggcaattttcatttgatttttcttcttgacttatacattatttaaaatatgctttttagtttctaagagtatgggagggttgtgcctattcatttttttttattgatttctaattttattgcattatggtcagataatattgtctagagaatatttattattggatgtttatttaaaacttcattggaagcttgatcactttttgtaaatgttctttttctttttaaaaagaatgtgtattgtgtctttggttgaatatagagttctttttgtgtccattaggtcaagcctgtggtgttcaaattatctacattctcattgctattttgctattggatctaatcaagatagttctgtcagtctctgtggtgactgttgccctgtcgatgttgtctgaggtgtatataactacattctctttctctgttcgtatttgctgtttagcatatcttttctctctcgcgatattttatcttctttcttgccttttgttcaattgatagagtactctctattttattttctctatgtgcttgcaggctgtactttctatttgtattcttatagctctcacattaaactgtgtaacccacatacttgacttagggttaaaatgaatcactgtctactctccttaacatcaggacctcagggaacttgaatgccattcttcccactcccatttgccacgtcattgttgggtggaattttaaaactaccttgctttaaactttcctaatagtcaaatagtcattaatatgttttatcttttttctccctactgtccatactgatttaattttaccaaatgtagacaaatttctttgcccaccattggtttgcccaccattggttcttccatccattttttttctggggtgagttttgatcttagtgaagcctagtccagtttatggttcttactgtgtggtctgctgaccagagtatcagtatcgcctgagagcttgttggaaatgcaagttttcaggtcctaccccagacctactgaatcagcacctctgggggtgggacaccagtctttgttttaactgctctcccagggattccagtgccccctcaggtttgagcacttctgcccagcagcactgccagtgacagtctgagagtggtaatatctcttagtctttgactcaaaaggtctcatttgacctctctgaagttcagctgatgatagaaatcttggttaaattattttccctcagtgctttggagattctcctgcatgtcttctggcctccataaatgatgataacaggtttgctgtcaatctcattgtcgtttctgtgtaggtaaatggctctgttctctagtgattttgaatttttatttgtgtcttagatgttttacaatttcgctatcatcatgtacctatgtgtggagttctcttcatttatcttgctttggactcaggcttcttcagtatggggattgtgtctttcctctgttctggaaaattctcagctattatttcttaacatactgcatttttccgattctctctaagtatctgtttctgtaactcctattggacatttacttctctttcacattgtctgctttatctcttaacttttgtgttttctgtctctcactgctgtattgtgagttattacttagctcttccagttaattctttaagctttttttgtaatctctttatcagttcattgtgtttattatttcagtgactaaatttaattgctcaaagttttatttggtcgtttaaaatttgcttttgtcttcatagttattttgtcctgttctctttatctctttatttatttttgatgctttcatctgcttattatttttaagatatttatttcttagcctctttgagattattctattatctctggtcctaggatcattaaatctcccactacgtctgtagactctccttaagagtgtagattattgcctagttcagtttataatttgtgtgtgtgtgtgtgtgtgtgtgtgtgtgtacatgcatgcaagagggagagagagagcatgagcaagctcatttttttttcctatgaggcttttgtaagtcctgacctgtatttactgttaacttcttagcttgggttcatgcacccccagtcagtataactgtggacctcatacccactttggcacaggcttggagtatggatttattacaggtctgtttctttttgtttttctcccatttatggtcctggacagaaggtaagcttccttgcaacttccctggtccggtgggtagagttttcttgtcccctttccagatgttaggttttaaacaatgactgttctttctccatcatgtagaccaaaggccaagttctgtgtccccatgggagattaaaacccaagcccctatgtctaggtccagtgcccactgatttctctaattgtgagtctttctgcttacctagtacctagagtttctcttcccaagttttaaaaatatcagttctaagtaggcctagcgtttctacatatttttagggagaggggaccctttctgtggcagctcagtgttcagcattcctgtaagttagcatgctctgtgtatagcagatatcactagtaatagcatttagtaagtgatgttcacacatgctgctgtcatgaacactatctcatgttgtgtaacactttcatttttccaagaactttataatcagccgacttgaaactcacagtcgtcccctcagaaaggcagggcaaatgttgttatttccaatttgtcagaagctcagaaagcttattctgttgctgacagtccttgcaagggtcagaatcaggaccggagccccagatgcgctggtgtcactgatgtccccgtgccgggcatgagcccttctgtgcaaggagctccaatgtctcccggccagtgatgatgtgaaaacatttagaaccgacctacacaataaggcagattttcattctgtacccaaaacaggaacacagatttaatgcagagcaaaagggctttaatcaacagatatgttcatttttcacgtagacctattttacaagctaacttgtaagccagaaaatgacattcgagattttcaagtgagaacaaatgatttggtccaataattaaaaaaaaaaaaatgtacgtgtaatctcttcagaagctgcactggaaggatgtttgtcctggtacgttgttggaaagttttcaggaagagaatgtaaaaacttgctcttcttattctatcatgagaactacctctggagagaaaagataatgaatgcaagaggaagacagtgatttttcagctttcacgcatcattccccagaaggagaaaggcttgaaatatctcaacatttccgcccacacctcctcagcccctgccaggagacagagcaggcaagggaacgggcatcataggctgggggccacatgttgaaatctgctccttggggaatttgtcatttaagacagtcgaacttgcatacacagtgatgactgtttaagctttttttccaacattttcaggagtagggggaactgtgatgtaacagtgatgtttggagaaccctcacgaatacaggaacaaacaaaaaatagttgctgggaatcacagactttcagaaatagaagagctgagtcacgtttgttcatccagtcaaattcttccacttaacagtgaagaaactccttagtagagaggatgtgatgcagagccagctgatgagagtctacccgagagtgcaggccttctaacgctggcaggagagagtggaaggaagtcacttttttagttcctatggggtcatttttttcctcatggcactaccacggtttattcattgatttcctattgcctgttgctctcaacagcttgtgagctccaggagggaactgggaaagctacctttggtttatgtactgttatttttctggcacctaaaatgccttgcacagagtaggtgctcaagaagtatcggttgaatggacgagaatgaacaccagaaagtgagaaataaactagagaggaaatcttagtttgtgacgggatgtactgttggtagagcagaaaacatgatctctttattggcttatgtcagaacattgtattctttttcttattttggtggttgtccaggtattaacaaatttataccttgcctagactcagaattgctatgtggtttcatcagactaaacactgcctaaaataaataggatgtgaggtcaaatctgttgttcagtggaaaatcaaagaagactggcttaaaaactaagaaaagaccataggcagtgtaaattgtctatagattgctcctaagctatataaagatgatgtattttttgctctggaattacagagcaaaacactgacgtgctcattttctggaagagtggttgtttgttttgtttcgggttttttatataaacatgtcttaaaactataaaagagggaagttcatgttcttcatttcttctgtttctggtcaagataagtatggtgaaagtgtaaggtttggagtctggagatactagactaaggatcagtatattttattaacttaggccgaaatgataacagcagaagtattctctgctgaaattcatactagtggctaaaaagcaatgagttgttttcgaggctgtcatagttaatgtctgtgtatatgcaaaacccaatcctttttgctcataaaaatatcgtaagctttttcagtagccaaaactcacggccctgactctaagatattgtaagctactttacaaggtagcaaataaagattatttaaatgactacattaacatgttactcctttgcctgaagagatatcacaacttttgaatgactatagttaactcaattcctgagccctcaactggggtactatcactctatttcatagataaagcatttgagatttaaagaaatccttgcccaagaccactaaatattaagggacaaaccttctgacttctaaattgaggattttttgagaatgccatctgcctgattttatattccttgataggagtgtcagttcacttccctttctgctcgttgtatttccccacaaaaattcgttaaaccgtaattagacttttcaaaatgccaacgtaggtcattctgggttgtatgttagaagtatttagccaataactcttacctaaaccacagcaaaaaagaaaaacagaaacaccctgactcatattctgacaaaagtcacttggaaagcatgtttagtttgtgtagcgtaccccaaatggtttctcaaatagcagtatagctgttttcaggggtgaaagctgcattcaaagctgattagccctcatcagttctaggactttcccctgtgctgtgtagacattatctaatttttccatggataatctgagaagtgagaatttacggtttatgactcatgaaattctcttgaatgttgcctcagtatacataaaatttcaggtgtattgtttgcattatctatatttataaatttatcttccaggctgtcccttactccagagaatttaagcagaaatatgactacttcaggaagaaattaaagaaacctgtgagtaatcatgccttccaaaaatgctttgtgttagtcatttgtaagttaccacagtcacttcagtgagaacaacttggttgttacttttatatgaatgctaaaaatattaccttccttttctctctgcactttgatcctcctggttctaaaatctgaattttctttttaacagaaatggtaagtgaaaattaactcagtgttacatatcaaatcacctgaagggtaatttcctatgtaatacataaaaagacaggaatgatttttatgggatataaaataattcagaaccctagtcacaaaatctgtggaagcctattcaattatgcgcagttatcatatttaattaacctggatcccggtaagaaaaatgttcaagtccttccttgtaaatgcaaaagcttagtttcaactacagtatttataatatagtgttatatttaattataataattggcagtattacgtccaaatgtaattttctacttataattatccctggcagtttaaaacctagaaactctaaaaatttttatgggcaacattttaaattataacattgcattttctaatgacacaccatccccaaattgttcaacattgcatcctctgttttactttccgattcctccttagcagttttctcttcaattttctccatcactatggttacacctctagggaggggagagaagcggctgcagctcagaccccctctggtggcctgggctccattgccatctctccctgcctcctcccctcagctggttcctcctgcccgggaacatctctggatggggcacaatgtctgctctcatttaggggttttggtctctgttccaaagtcctgattcaagagcttgcgggtaactgctattgaaatgattctttgccttcaaaactcaaatgatcactgaaaattccacagttttctttgtgagtcatgtcccctggtaatgatgatgactgtggtcatcacccagtctcactctatggctctcacatagcagtgtctgctacccggaaaccatctctgcacattcattcttacagccagaccaagcctggaccgcctctttgcaggaggcagttgccacaaccttggtcaagtgttttgttattttcatgtcagcgaaccatgctttgggctgctttccccacacttggcataatcaggatcccactccccatggcaacaaaatggacttgaggcagcgtggattatatctaccacctggcggccctgccacagttgagcatggataggcccaacctggccaggtggggattattacaggttttgactacctgggctaaagtctcttgagtgaagcaacagatacagtcgactgcctttcggttgccctatgctggagaagtgcccacagttgtttattaaagggggcaaggaggatgttctccttcgcagcagagttctaactttcctgagcatcgctagtggatgccgtgtgtcccatcgtgacacagcaaggctttctgtctgcaagggaaaacccctaaaggagagaatctcagttggaaccatttgtcactgcctgtttctttgaggactgccaacttttctaccatttgctgttgtttttattagaaaacaaagtgtgtatttactgtatgattatgtgttttcttttgtcttttgtgtaggctgatatccccaataggtttgaaatgaaacttcacagaaataacatatttgaagagtcctatcggagaattatgtccgtgaaaagaccagatgtcctaaaagctagactgtggattgagtttgaatcagagaaaggtcttgactatgggggtgtggccagagaatggttcttcttactgtccaaagagatgttcaacccctactacggcctctttgagtactctgccacgtaagtatatggccacacccagtgtgtgtcccccactgagacagttgtatgaatttaaacagaatgaaaggataagcagctcatgagttcgagatgcattaactctgctgagtttgttctctcctcaccccacagccccttgcaagtctagaacaggttctgactctacgtggtgaaatagtgtactctgcgaacatctaacattgattttttttcttgtctattgggttcatggagttgaaattgaaaacgtggataattatgataaggaacaggaggcgattttcatttgcagtgttcaagaggaggacttgtcagtgttagaattcaaaaacaaaggaggtgttttttgaacaagagtcgtttctgaggtctcctgtgtaaaggcaaattgtaaggactttgaggacctaggaccatgccctgctcctgtaaggaaagaaccaggtttccccttgcattaggatttcatcattgccaggcttggaaactgaggcagactaaattgctttctgagcaattaaacatcagctacttccaggccagccattcctccttcagactctgaatcctccaagggttgggcagtacccaagcccccagtagaatagtcattgaccttgctgaagggcatttgtcatcactccagccctgggctctaaggggacgtgggttcccccacatctcccacctggtaccagtctcctgggggctcatttggaaggccgcctcagtacattcttcctggttgctctagccaagaattgcccaattgatttgttgttactgagtcccatgagaaagcccactatgtacaatgtatccaactattgaaggtggagggcagggtggagagagacaagatctttacctcttctccacattttcaaagatacccccaccccggaggaatcagtctgtgatcccagtttgaaaactactgatccacatgattgtgaaccaagcaagatcatttggacaaatctaaaaatttgcaggtttgcatcattgagagagccatatcctgttcctaatcccctcgaggccttttcagagcagagtagtggtcagaagacagaccaagggttgggcccatagcaaacatcttatggccaagccaaaagcctctggaaggaattaaacttccttcatcacagagacgacctaaagtactcacatctttgggaatccctgcacagcccctttattatgtggcgtttctcatctccccaagatatttggctgaaccatatgaaatagacacttcgtaggtcaaaaacagtcaaacatcagcgtctcttatggtttaattgactttagagggcacatgcgtcagcctccatggtgggtcacggttgagcatgtggtaagtcaggtcctctagcccacacattttcccactaggtacagaatgctcgcagggacactgtaaaagttgagtgacaggtggcaaacaaatatgcaaaatcttgcatttgaaagtgtgattgggcttttcttctctttctcctcaaaagggacaactacacccttcagatcaaccctaattcaggcctctgtaatgaggatcatttgtcctacttcacttttattggaagagttgctggtctggccgtatttcatgggaagctcttagatggtaagtcttgaagtaataaaaataggtcagtgctgcttgcggtttgctagtaggtgtcttatctttcgcatcatgggtttttaagcaaaagcttcactggtttactcataaagtatttttatgttttgcccataatggatgtccttttctctggtagcttattttgggcactgaagacatagtgtctacacacagttaaaaacaaaagtttttttttaacttcagtgtaaaacacagaacattatgtatttatacatttgtatgttttctggaataactttagtgaaagcaagatttgataacagatggaaaaactaattgaaaagttaattaaaatgatctcatctatctaatatcctgtgattattgcgtttgtccccaaattattttttaatttgaagggactaaataatttcaaaataatgttactgcttagctaagacattaaccctgaaacaaataacacaaaataatttcattcttatttaaagcatatagatcatggaagaatttcaaggtaccttgaaagttagaagtcaaaccctctacctggcggtatctataggcttagagacttctaaaagatttggccaattcaaaatagtgtccttaagaaaacactacagaaatcatcagtgagaaaaaagcatcagaaatactttttaagagcctggaggtagagtggttgaggatgggaagagggagagtaggatttgagattgacattgcagtaacttataagaaagatatttccaagggaactgtgttcattgcatttatagagccttagctattctaataaataatttgtataccctctgtacttttcccatgaatatgtttttactgttaattggtagctgatattgatgctctgattttgttgctttatttggtagcagggcgacagtaaacactttttttcctctagaaggaaactaaaccacacactctttccatgtatgtatagtgtgaatatattttaatttccagctttggagtcatgccatagattgtttcagcctgctccaattcactccaactttctcagaaggtcagtttagtcaccgtatgcaagtgagaagatgctgttagttgctacagtgtctttaataccctctctaacagggggtaatagagaagcataagatatgatcctgaccttagtcagcttatattttagcggggggaaaagagatgagaacaaaaccagaagaatcacagtgatagtgtctgagcagaagggagtgcattgagtcctcagaggagaaagtgacttggctggaggctcagggaatctttcccaggatgagctgcacctcggaggtggggtagcatttgagcgttcaaaggctggggtcatttcagatgagtgaggaccagcccagagtcaaggccttgtggaagaagatgggcggaagcaggaaccactcagggtctcaaggagctggctaaagtgaccccgacaagagtgatcacgatataaacctggaattgcacatttaagagtccaagtgcacatagatgggcctagtcagcagtgtcttcaaatttcccacagatgggaatgtccctgtcggcagggctcattctgcacatctgtccgatgggaatgtccctgtcggcagggctcattctgcacatctgtccgctgctccccctggtcggcttcatgcttttacttccccagacactggagtctattggagcctgcatagggccacgctgagccggggagaattggcctgtactgcagagggtgggtgcctggtggggggatgaaggagcagaagcaggagcctggggtgccaggtctggtggggtcaggaccccctgtgaggaggtgcgtgatgcctttggatcaggtgaaatggaggcacctgcaggacgcctgaatggtgggaggccgacctcgctgctgttgcctccctgaggcctctgccgtccctccgcggggggttgcacaggccctctccggggccttccccatttccagcctgtccccttcctgtgctttctccccatcgctgcccaagcaatgataacagaagacagatggaatttcacctggcctttcactgactccccactgccctcagagagcaccccaactctccagcaccccatgtgggctctgcactgccggccccttctctggcctgtctacccgccctggcaaacggctggcaagtccccagccttgttcctctgcttagtgtgcccttttctcccccaattcctacgcctgatttgcactgcggactctgcttgaccttgaagctcatctgtcacctcccagaggcctttctggccccactctgctgcgccatctctcttagcacagctgccctcctcatgccactctccccctgatctcgcctcctcgcttgtgcaatactgtagaaggcccttggttactccttcatggtttctcatttacattgaaagcaggttaatcttttctttcatgctctgatacatagcagtgtcaaagacctgaaactaaacccagtgtttaccgtgttttaggtttcttcattagaccattttacaagatgatgttgggaaagcagataaccctgaatgacatggaatctgtggtaagtaaatgcacgtcacacactggccatcaccgggcactcgtgtcttatgagaaggtattggagagccatatttgtagtctcagccacttttatgggtgttgcattccatgtgaacaacaggagacatttaattgcttgaaaagttcattgatctaattcttgtaataaatcattgttcacatttcctggaaccatggtacctagggtggatacatccaaatcccagttgcctctgcttacccggcataggacttgtgtgaacttactaaatccaagagacagctgaagatctatggtagcctgtgttttctataaaaactgctgctgctgaatgtttagagcttcatccgctctccctctgtttcctgacatcataaaaatggcagaggcaaaggtcaaaacaataggaagagtatcaggcagacgtcctagacatggatgagtgacgccacagctcaggcaagtgaacacttgagacgttctccaagtagtgatttgggttttcatgttgcatttaacattaattttacctagacagaccattttagagttggaaggattttattttttttttattttttttattttttgagatgatgtcttgctctttcacccaggctagagtgcagtggcgcgatcttggctcacttccgccttgcggattctagcaattcccctgcctcagcctctcagatagctgggattacaggcacacgccaccatgcctggctaattttttttttttttttttttttttgtattttagtagaaacgaggtttcgctatgttggccaggatggtctcgatctcctgacctcatgatcctcttgcctcatcctcccaaagtgctgggattacaggtgtgagccaccgcacccagcacggatttgctataaaacaaaaattgatgttctttttataatatacttctgcttctgtttttcttttaatgtacctataccccacatctacctccagagtgtatgggtgtttgcccacacgccagcacacacacagggccactgggaagcgcgtttgtccatttggggtatttgcagctcattcgtgtttgctcacttgagttaaaaagcccctgcatgatgtcacctgcctgtgataccaactgtattttgggcacggttgggtagatgagctgtgtcctcggccctgaccagcgctgactcagtgtttctgttgctcctcattgtatgaaaggagaggaagaggccagcagtgcccttgaacccactgctggtttgccagtcatggtgggttgggatgcacacctgtgattccggtctccactttgaccctgtgtttgtgctttctgctttcatcactgtatgatgaagcagctaggagcacaggaatttctcttaacgtctaactttataccacatgctgacagttagtgcctaaagtacagtgcgtgtattatttttaccctcttcacagcccgtcgtgtccccagcaggagagaccgtggagggaccagggacaggcgcttaggcctgtgactgatcctctggattctgaaaccagagcagccaccctttttgctgacattaacctggagagtgatcaaagcacaagaaaggggataacttaaaactattggtatttacttagttggaacattattttacttatttatttttttggcgatagaatcttattctgtttgccaggctggagtacagtggcacaaccatagttcactgcagcctctatcccctggcacaagtgatcctcctgtctcagcctcccaagtagctaggaccacaggcacacaccaccatgcctagctaatttctttttttttttttgtagtcatggcgtcttgctatgctgcttaggctggtcttgaacagcctcaagccctcctcctgcctcagcctcccaaagccgaggattacaggattataggcatgagccagcaagcccagtctagaacattctttatccttcctgttttcctcagatactttcactctttttttaaactttatttattttttatagagacagggtctcactatgttgcccaggctggtctctaactcctgggctcaagtgatcctcccaccttggcctcccaaagtgctggaattacagcgatgatattttcactctaaaaagatagaaagtatattgaccagcctggccaacatggcgaaaccccgtctctactaaaaatacaaaagtcagccaggtgtgatgtcacacgcccgtaatcctagctactcaggaggctgaggcgggagagtcactagaacccgggaggcaaagattgcagtgagccaaggtcatgccattgcactccagcctgggtgacaagagcgaaactccatctcaaaaacaaaaaaaaaaaaaaaaagagagagagaaaagaaagtatacttatgtctgtatgttaaattttgtagaccagtatggcagctccatccaccatccagagtaggtgccttccactgtgcatcactaaggacaggatttaactgcaagctcattacaactaaagcagtttgtttgtttatagtttaaagaggaaggtttggtttaggtggagcaggaaacattgcattagtaacatatttcttgagcattctgcacagaattacattagaatgtaattaaagaagtcaaatgagtttgtattttggggaaaaaatgctgaattttcactcctgtgtcattctgtaggatagtgaatattacaactctttgaaatggatcctggagaatgaccctactgagctggacctcatgttctgcatagacgaagaaaactttggacaggtacatgtgggtaaccctgggaactcttctttagctttcaaggggcatttttcttcttgacgggctgtaacacaactttgctggaccatcagaaacaaccagcaggagctgcaggtgttaattttcatctcattgtagcagcacctttttgtcatgccaagacgccacactccaattacaaccatttctctcttccagcaaagttacagaaattccaagaggccttggggcatgaaccagcacctcttctaatccaaagcaaatgtgaatgtttcatttgtgcctcggttttagaatttaggtacttgaaaaaatagtgagattgttgacttagcgatgtaaatacatgaccaggagtgggtgatgttggaagggccattggtttttctctctgttttatggttctgttgtcatggcgacatttgtcttgtgaggctcagcatggcaggctccggtttttctaccattccctctgctttgcccccacgctgttattcaggctggactaatcctcaaagtcagtttcagactggtcagcagggatttggatgggccactgaaagtggatttcaaaggtaaagttgcctgcttggaataattctcatcatgctaaggatctatgcgatgtatttgtctcaattctgaagcctttgcttcatctgccactcagtaataatgatgcagcttgggaggtgttctcaatgtattctctgaccctggtacctgtccttccgcaaaagcccagaggtatttcccatccttcagactaaatctccacggctatgaaattaattagaccatagaactcattgtaatggttgccctctgaaaaatgaaatagacgtgttctttattgctagatgtcaaagattgctagagaatctttgagaaaagaagctgatgccactagaggatttaatgacaactgagggtaaaaattgttggataagaaaataatcacattaatatcagaatcacttgttattcccatgtcctgtgtttgagccaggagagttcagtctctagtgtgagtcctggtgtgggtggaacctggggagtccatagggcccttcagtggctaggcaaggctcagagaaggacttcaggcaccagaggcaagagaccttgtggcttaatgtaaatgatcaagtcctttaaaaatctccttttgtgccccctccccactgcccccctttcccggcctcctccccaccccactgtgttgtgctttatgcctgagaatccttacagacaggcggacactgttctcctgcacggggaccttgtgatggggcagggaggggtcttttcagctgctgcccctctggtctccagcagcctccccaggaccgagagtactggtgtctccagccctgtctacctccttcctctgctgcctttgacacaaatagctcactccccccagagacacctgcaaggcacagtgcctttcactccgggctctcacccctccccactggtctccagtcccctggaagtgcatgctcctctgctggccctgtggatgcaggtgtcaccctgccagctgtcctgcacccgctgcttttttgtctcacccttgctatctggatttcctcatcctacctgtggctccggctgcacccatctccgctcaccaccagcctcttatctcaggccggcgtctgccttccagcctccagaattcccaggtctaacggcctcctcaactgcttctcctgagaggctcacgggtcccagtgctaaagccactttttcctccccagcccccacatcggttatggtctcatcagtgccaccactgtcccctcccacctgacacttgggcatcccctcagaatctccctctctcctcatgccatctcccctcctcatgccatctccccgtgcccaggcttgctgtgccccgtgactccccgtccttggcacgtccctgtctgtgcactcccctagccctgctccgatcacttcttgactgctgttctcacagcctcctgtcggccgccccctttcctgctttgctgttctccagtgccctgttctctagtgcctaccctgttctccagtgccctgttctccagtgcccgcctagctgtgagccccttatggactatttctgaaatgcagccctgaaaatgtccttcttctacttggccatcttgtgaccttcagcataaatgaaaactgttagcatggcatatgacccctcataatccagacctacccccctctggcattaccctctgacacctccttcctgtcaacctgtcaacaaacagtgtgccttcaagggtttccccagagatgcttcagtgccacattgctggctcgacactgcccactctgtaccgatgcattctcattctctctcccatcacctctttccctgccatcctcgaggtattgactgacgtgctgtgtgctgtatgccccctgaggtcttctgggtctctccagggctcagcatgtagttgatgcctgccagtgctcattgagcaaacgaatgaggagtgctaacctggcttattaaaaatatgaataaggtggtaagtaatagaaatcctaagtgtgagaaaacaaaatcagtcaagtcttggtggctttttttaaaaagccggacctattgaagggtcttaaactgccaattttcaaacgattagacatggttagtcaccctggaagtatcttcctttcatttttaacatatgaaggaaggagtggaagtaaagaaccaaggaagactgaaagtcagtcttgtgtgtcacatgcattaaaaaagtcttttcgtagattcattcatagaaaaccatatgaccaaattaacccaattcagaaaactattaagccacaatcagaagcaaatgatctgggaaaccttcctaattacatttaaatgtaattgtttccacctcataaatgaaagtcaaacacagggtgttggagtttttaagcaggcctctaataaatcttctgatgatcgttcaggccagattttcattaaaaacagttctcagacctcctcgtttaatgttgtgaattcttctgacttttgggtaggatcaagtagagtaatgcattaatcaaaacagacccatgagatgagtaagataagaattaggtgcccagtttgttgaattactgccttgcctttttgagagagctatcctgattaacagggaactcacgtatttattttgcactctgggaaggaatttagagcaagttaaatagctgcatatggatctcatctcccatatccagtccatcagcgagttgttcacacacctcccaaacctttctcatttctgtgcattctgccgatctcttctctcactcacacccaagtccaagctcccatcttccccactagacccccgacccgtctctacatccaatatggcttcttataatggcagagtggtctttttggaatataaaaatgagcatgtcattcctctgccagaaaccttcaggggtctcccctgcccttgagataaagaccccaaccttactttgtcccacaaggtcctgcgtggcctggctctccctgctcctcctccagactcactgtgaatcacaggccccactgggcttgtccaacacaagccccttcctgcctcaggccctctgctttctcttccatctgttgggagcatactccctcccagtctcagttcaggtgtcccttcatcagggaagccagcccttgacccagaccctatgcatcttccatgcctgccctgtggcatgtaccacagacgactttgcatttgtctgagtatgtttgtgtttagtgcctgtctctcctgctcagcttcctcccgatgatggcagccgcatgcctgccctgtgctcactcactgtcgtgtacttcccacaagcactttgcctggtgcatggtgggtacttgtagttgttgatgtggaaatctaggtgttagcatgatgcccggacaagcctctcacctctttggccctctgcaaaactgttgactctgacccagaagaaagcccattcctccccaatgccaaacagtcaagtcacttccacagtggggcaaagcaagtgcagttgtcatggggtgaaacagacatgcagtcagccttccacggtgtttcaaccttctttttttttaatttcacagttagaaatatcagaccatgaagtttggtagctgttccttcatgtaatgaagctgcagctgttgccattattttgcaatttgttttctttctgattggtaagaatctggggctgctggtttctagggcctaatatgaaagtttccactgaagaaatgtcagtgtttgaactatgatcctgtgccaagcaggaagaataagccgtacccccattcactgctgtgcacacatacctgcccccaccgggaggaggggcccttttagggctgtaacaagtgaaaattctttattgcaagttcagcagagcaacgtctaatttggttatgggtttgtttgtttgtttgttttttgagacagagtctcgctctgtcacccaggctggagtgcagtggcagaatatcggctcactgcaacctctgcctcctactttcaagcaattctcaatgcctcagcctgctgagtagctgagactacaggtgcaagccaccatgcccagctaatttttgtatttttagtggagacaggacttcatcatattgcccaggctggtctcgaactcctggcctcaagtgatctgcccacctcagcctcccgaagtgctgggcttacaggtgtgagccaccgtgcttggcctgatttgattgttttgaagagctgccagaagtttcaagaggctgtgcagtagttggagggagaccatgggcagcagccatataggaaggttctttaggatcgggtcgagccagtctccataggaatgattacccaaagggaacaaggaggacatcatctcagacattgaagtggttagtggccctcccagaagccacagcacattccacaggtgtactgtggatctctctgttaagatttcatggagagaggtgggccactggcagaaagaatctaaaaaggctctttagggggtgataatgaattaaaaggtagagaaacacttgggggaaggcagtgagtgaaaaggcagaaatggtcaatgagggagagggcagagcatgtcctggcggaagccaggagccagacgaagagcccggagctggaggtggctcccaggagcgctgaggccccggccccttcaggccagtcagggacacagaggggtggcacctggggagacgggaagtgggaaggctggcatggacttgctgcctccctgctgtcggtagttgcgctgctggagaggctggggaggatgaggaaggcctggttggtggagtgatgggggtgcagggtgctgactgcccccgaggccgtgccctgcaggatttgtgagcacccatcagtgggcgtttgcccagcagtgctccgtttccaagaatggagtctgacaagcagataagccttgctccacccaagtccagcatattccatatgagccaagctgtttctcagcagcttcccaggcagcgcaaagcatttatggagggtcagggagatgtgtgggaatcgggttgttaactggccaaggcagggagtcccccagaagttcctctgatctctgtgaggaagagagccaagtttatgctggggccagtagacttaaagaggaatttttctactgcagtgttctcccacgagctcttgctgagcgcctgctgtggctgggcattgtgttccttgtgtggggtcctccaggagcccaggcacaggagggcgatggcccagaaagccctgggagggcggggtgtgcgtttcgtggctgaaggtggcaagaatccaccccacagagcaggctctgcagactgctcaccagggagcagggcccctgggtgccagcaccagctccatctgcagttcgctgtttctccttggtcactttgctggatttctgcctccgggatgctgtccaccctcatgacgggggccagggcgctgccgcagcacctataggagatgcgcagggcagagagcagcccctgtgtgacgctgccccgatttctcccacttagggttgacactgtcacggtaccacccggtgttcagtgctgaggacatacagtccctcccctcctgtggtggcaacagctgatgttaagaagggacaaatttgggcgaaaggagaacacaggctgtagttagagtgatggtgagacaggaatgaaggcccgcagggaatctgtgtgcctggaggcgagcattagagtcagatagccgcctctccaacccccatggagcctcgtgcccaaccagcaaggactctggggcatcggccagtggcagtaagccagtgtggtgggctggacaatatgcctgcactgcaggagacggtgtcacgatcagcccccgacagccggtctcaaaagtggaatttgaagagtggtcattgcttctcatgaaagtgtcgccgtaactcatgaaagtgtcacctgtaacgaatcctagagggatgcatttctgtaccacggagggctcgagccgagacaccgagatctgggggcgtgacccctaacctagtagcttagggagcagaattacaaacccctcatcctgtgcccatccttgggccctctcctcactcccccacagagaaacccagggtcagaatcaaccatgagacttgacggctgcccacaggatgatttactgctgtgacctcatttagcatgggttagtgtgggcccattttttcttttctttcaaaaattatttatttatctaattataaaatattaacctccataataaaaataaagccagtataataaaaatatgtaaaataaataaatgtcacttattcccagtatctcaagaaaactcaggattaaaatttttatttacattttccagaattattctctgtaagcacaaaacagatttttttttttacagaagtggaattgtactctgcatactgttttcttttttattttatttatttatttatttatttatttatttatttattttgagatggagtctcgctctgttgcccaggctggagtgcaatggcatgatctcggctcagtgcaacctcagccccctgggttcaagcgattctcctgcccaagcctcctgagtagctgggattacaggcgtgagccaccactcccagctaatttttgtatttttagtagagatgggttttaccatgttggccaggctggtctcgaactcctgacctcgtgatctgcccacctcggcctcccaaattttttttattatactttaagttctgggatacatgtgcagaatgtgcaggtttgttacataggtatacacatgccatcgtggtttgctgcacccatcaacccatcatctacattaggtatttttcttaatgctatccctcccctagccctccaccccatgacaggccccggtgtgtgatgttcccctccctgtgtccatgagttctcatcgtttaactcccacttatgagtgaagctggaaaccatcattttcagcaaactaacacagaaacagaaaacagttttcaaattaatatatcacacataccttttcatgtcactgaatatcagtctataacattctaatgactgtgctgaattttactttgtagacgtgccatatatttttaaccatgccctgttggtagacgtttaggctattttagtattttctatataaacatataattctgtataaccctggaatactcacatatatacataatatatatagcatacaaatgtataatctggaatatacattttgtgtacttgactaatttttttccattgctataaactccaaaagagaaattactgtgagaagggatatataattttaaaattgtgatgcctattgccaaattataatatcttcagaaaaagattgaaccaattagactcccacccacagtgaaggggagaaccagttctctgcactcagcaacactggcttattttctctctcatccctgggcgctgcttttggaggaagcagagtgttttcctccttagccctcccctccccactttgtctgtggccgacccgctcattcagtagctctctggaaattacaactttcaggcaacaccaaagaaggctctgtgatcaaagagagagggctggatgaatgctggaaggagtgtattacagggattgtggatgcttatctacttgacctccttccccttccctgtgcgaggggaaagggtgggaggaaagattcggcttgagtgtagccgagctgtaccgaaagccttctcgataccaatgcctgggctgggatttattaacttgtcattgacgtggatctgataagaaaactcttaccgaaggaacaacaaggcagtctggggaggaataaatggggaaaagaagaaaagccaacctgggtttattaacacatagaacaaaaggtatggatgagcactgtccacgcacctctgagaaccagccacgaactggcagagtttcactgtagaaacatccccaccccacccccaagtggaagctgtttggcatcctccatccccaacacggcctgtacggggcaggagcagatgacccctgggagaaaatgggatgcactgggaagatggcagctagaaagggaaatggagaaatgaaggatgtcagcaaaaccggaaacgcagcaaagggattaaaattcacattgggcacagtgaagagttcagttgactttgcagaaatggaaagcatagtggaaaaatgagattccttcctgaataaagagaaaaagagaatgtcgagggaccggatggatgatgaatgtgttttacgttgaaaagccatctcagtgtgaatgggaacaagagccagtgcgtggagaagccgcatgagagacccaggtgtgagtgctcgggtcagaggggctcaggatctcctgggtgcaggtggcaggaccaaggaacccctggaggtggcctctgccagggcatagagttcatcacaacatggaacctccatccctcctgggtaccaccctaacacttactttggaaaaccctctcccctggcttggtttactctataatgcaaccagcaggcagaggaaaaaagatttagagggaaccccaccaaaatagtggcatggctttctttcagtaggagaggtgtaggtgctatatttttccaccttttttccccaaaatttctacaatgagaaaaaaacattttattttaaaatagtaggcctctctcccttccctcacgctggttactgtgctatgtggccttatggtaagctaggtctgggtcagggcataggagaaagggctgccctgattgcagctgcttttttcatgatcatgggtggtgctaagggaggaagcttcagggcagatgagtgaggagaaggcgtccaatgcaaataaatgccttcaaaaaccagataaatctgtctcttcagcctggatccttaagcttctttcttgtctttaagtttctgtttgcatttttgaaagaaataccatgcatcctttttttatgactagaaaatataattttcagaaacagaatgcattagaatttggatttctggagtcttgatgggtgtaccctgttcttttctctgttaaacataattagtttcctgataaatgaatagcagaggaaaaaatgttgctcttcattattgctaatatatgaagaataattaaaagtcataaataaccataaaacaatttgcctttaatgatagcatctttaactgtgtaacatcctagcaaaaaagcctcattggacattctcttgtgcacagagcccatttgccgggaaatatttctgaatacatgttgtcttccctttatagtaagacattgtcactcaataataatatgcaagataacttcgtgatagtaattgttgttttgtctttgtaattacagacatatcaagtggatttgaagcccaatgggtcagaaataatggtcacaaatgaaaacaaaagggaatatatcgagtatgtatacacatatttactgccttttctttgaataattgaaatgcatgtttggtcactgtcccttgctgaaacagctcatgcatttattatgggcatgagtttattggtcagttttcaacaaggtaagttcttttctggcttgggctaatgggaagttgaatatgggatggaaagtctgtcttgtatcatgactccattgagctgccctataaaggagcagaggagggagaaaaggtctatattattgagtaatacggcaaatactcttttggaatatgtggatatcaactaagatttagaattgcaacggagaaccacggtgtcagtgaccagcagggcaaaattaggaaccaacaaagaaaaaatattttgtctctctcccaacttcttttccataatagaaatgtatagaaatagttaaaatggataggaagaattcagcatgtgcaaccctaaggaattctttctggtatttgtaatattcttaactcaacttcagcctcagtggaacaaaatgttgagtctttttggaagtctagctgttaagtgattctaagacatttgtaccaggcagaagtttttctctgttgggcacgttacgttttcttttttagtgtatatgtgtgcttcaaatgcataactctgggatcttccaaggagatcccctggtgcaggggtgaggtgagcactgcagtgtgtggttcctggcacctggtttctgctctcttgtgggtcgccacagtggccctgagttcctcgtttgcattcagtgcttcgtttcaacaggctaggctccctcctttcttctcatttggaattggtcagaggtcttgaaatcagacagctcttgcattgactgtgggtcttagcacctttcagtgtgatctgcaaagaaaaacctactgtccttcctaattaggaagaaacggagcgtgttagagtctctactcagagatcctggcaaggagtggaactattacatggcggactcttttcactctcaagttgaaagcttgttatgctgaatacatagactagaaataaggtacctcggttcttacctggccacattaattggcactctcgttctgaatatgaacaatcttagctgatgacatcctggcagacaccattgtcttccttcagaaagtacagactgtgagtggggtttaaaaaatattctagctcagggtgacccaggtctcaagtctgaggactctgacatgcgtggtatgtgtcttgcatcattctttgcagttaattcttttagggttcaaacgtggtgggagtcagggccaggcagggttccagctagctttacttttaaaagtataattgaaatcaccaactgctccctgatacctctgctcccctggtgccagaagaatgctgttgagctgttcattgtagcccaggaggtgccacctgagaggccgcacagtggttgtgctgcaggctggtcctcagggccattaccatggttacagtgtaccaccccgaaggtgagaacccttcagaatgatggaatgcctgagatgacatccagagtacatttgccttgcgatcagttttgctgtgcattaaacactgtcgcagggaacttggttttggtgaacttcagttgcataaggaggtcttaccattcatcctctaaattttggcattaaattatgagtgcaaatcattttgctgataaagcttatatgttattgttgaatattagcacattggatactagaatgaaatattagataactaaatgcattgtcctgagtacactttacaaatatgtatacatatatgtgggtgtgtatacgggtgtgtgcatcttatacatgtatacctgtgtgttcataccccatgaacttttcccttttctccatgttgtcacattttaaagcagttaaagcatttaaagcattttaaagcagttaagcatttaaagcagtttaggtcagccaaaccttgatgtgggggaagttaattactcttttgaaatctccagtgagattttaggtttttcacgggtgttccagggagtcttgaaagaagccatgaataaactaaacagtgggggcacagaggagaccctcccctctgctctgctgtcgtggatggaggagaagcactccctgttgcggagaaagcagtgagcactagtgatgatggaggtggttcaatattgtcctcttttctcctgcagcttagtcatccagtggagatttgtgaacagggtccagaagcagatgaacgccttcttggaggtaagccatgctggccagggttctctgccatgtgcctctggtcccgggtcgatgggggatcgcgcttctcctttagctagtgtggtggagctgatcagagacagaggcgaggctggggaccctgcaggaagaccgggatcgcacagctcacaccgctggccagtctccagcacaagagtgttcagccaccgtgccgccacctccttttccttttcacgggttctcctgcttgacttctcttatttttacatttgtcctgtttttaaagaggacgttttacagacttgatctagaaccattgtcttggagtttcaggcggtacccaagagaaggctgccttttgctgcagtgacaggttccaagaagcccgagggctcagagctgaatgatgaagcgcagtccccaaagtgcctggccacccctccctccctggatcactgctgcctgggcttgattgattgattgattgattgattgattgattttgagagagattctcactgtcacccaggctggagtacagtggtgcgatctcggctcactgcagcctctgcctcccgggttcaagcaattctcctgcctcagcctcccaagtagctgggactacaggcacgcgccaccacacccagctaatttttgtatttttagtagagacggggtttcaccatgttggccaggatggtcttgatctcctgacctcatgatccacccgccccggcctcccaaagtgctgggattacaggcatgagccgccgcgcccagccatggacatttttttttaatcccctgccctttttctttgtggcataattcattgcaggttctcttctatacagatacatggaaaacacattttcttaagctgagtttttatttattttatacccagccacctcatgacagcttttaccctgttacagagcaaagtgggcactgcccagatcgaacttttaatatcagggatgctcccaggcccctagcagtgggtgagggattcatcattttaaacagtattccacttggaccaaaagcaaaattctttcttaaatatgatatagtattagttacctcaaagatcacacaggaaacagcctcgtgtccacgtgactgattttctctgcactgaggcagagctctcgtggggtgatgctttcccttcactcaggtacctacacaggatgcgtgaaagcccgggcagcacactcagaaacagctcggggccttagggacttaaaatgggaggacagaatggcaggtttcactctttatttagataagaaatcccaggaagcagattcctgggccccaccgcaggcggtccacaccttcagaaacgcggcgttcgcagcgcgcagggcccagcagagctgagctcatcctagatcacgccacagttagtggtacctgggaactggagcatggttttctgtacgcacagtgtctgcacccatcacctgcctccctctgtgtttcttctccctgcctccagcacgttatttttaagcgtgtctcttacacatctgtagcctgtgcatcttaggacgcactgactcacagcagtgttataaatggcttttggaatccaccctgcctacagtatcccatattttcatcaggtttcagaaattactccactacttgaatcttctagattctatgctttttcgaaactgttatattgtgactgtgctgtttttactggaactatagttacttgatactgtcactgacataggaatcatcaggagagattatatttttttctggctaaccagaaaagtttgtttttcctgtgaaattttttttttttgaaggcaataggtgtttaagatgttttttttttttctttcagggattcacagaactacttcctattgatttgattaaaatttttgatgaaaatgagctggaggtttgtattataaacattattttatgtaaagtggattttttaaagtatctctcattactttacaagtaatattttaatattcttggatccataatgtcctagagagtaactttagatgaattatattacatgtctcttatagggcttatttgccaatgtggttctattacatgtctcttatggggcttgtttgccaatgtaggagtaaggaacagcaaaaataatcagctgtagttgccttgtccatcagagggcagttctggaacatgcctagtaagtagaggccactgagcagagctgggatcatggccctatgcaccaggcgaggcaaattgccacaacaagtagaaacaaggtttgcagtagccctctggacagcagaaacctgcttacactaccagactggccaagtatcctctgctgcatccccatccacccccaccgtggcagccaaatgggggtcttggccacaaggtggccgtaagcatctacttgggcctgtagaacgacgtctcattgaacttgaagtggtttatgttgagtgaggaaaaatgtcagaaggcaacagggttgtagcaaaaggtagtttagtgattgtctagttcagcttcttggtgttgacatagttgagtaacagccattttaaaaacaaaggaatatctcgccctttgttgtgtcgagagaaacaggggaaagactgtctgttgagaagccgttggtgggactcggccatttgccccgtccatagccagtgagtgtttcccatacactggccttctatacttttatctcaaaacagaaagttcaagatcgatgatgtctatagaaatcatatacctcaagcctttcctctgataggtgggaaactgaggcagagagcagctgggtttacccagcaaggttttggcacggtcaggcctaggaactttatttccaggcttctggcttagttctgtttccatttcattctggtacctttgcataaatatcttccatttgtccacaggaaacctcccctgatggagagttgcataataggaacggcaaaccttagactaaatgctaagtcgaagacccagttgtgccttagcgtatgtctgccattcttaggcctctgggcagatgaggtgatttgtcatcactggaattgatcaacctggaggagagtcataagcactaattcttttgtgggtagggagatgcttttagatattcagaggaataacctctcaggaggagaagcagccagggtaatgcacagatgctgctggagcgtgagagaatccacaggtcccatgcgtaagactagaggggtagggaggacgactgtggcatttttatatccgatacgacatgccgtggcttgcgcaaggttcgaattgagctgccctcgtgactgctgcctctgtgatctgctatggcaggtggagcctggaacaggtgtctgccttcctctgttgttatgatttgctagcttaccttcgcggcacagtgaccacatgctggcactgagggtggtcatttctcagtgtgtgatctcgcacctttcacatcctgcttttacatctggtaaattttcttcctagttgctcatgtgcggcctcggtgatgtggatgtgaatgactggagacagcattctatttacaagaacggctactgcccaaaccaccccgtcattcagtggttctggaaggtaactccggggcccagccccagccggtgtcctccacctgaggcaggattgagggctgtgtggcgccctccattgtggtctgacttcaggactgatgctggctttggggtctgttagagcttggactgctgggggagggaagaggcaaactgagccagcagccccgtggtggctcctctgtaactgtagcagacagctagacttgaatgaagttggtccctacaaaagcacactggccttccttgaccacctcgtgaaagtgacttttatttgagggactggtcctccaatgcgtaaatagaaatggggggcttctcagggcagaaacaggcttcagggatggctttgcaagatgccactttctgttaagaagtcgttttctcaatttttaaaatatattccaacaaatattttgatctgtgtatctttcaaccaaagataacacaacatttgatttattatcttagggccactgtttgtatcctgttcagcttaggagggaagtaaaataggaatgggttagtccaaaggagatatagtaaacaaacttaaaaaaaaaaaaacagttatcccccaaaaaggctgattatttacttcaccccaaaaaggaatcatttaactttttcaaatttatttttatttatttatttatttattttaaagatggggtctcactgtgttgcccaggctggattcaaattcttgggcttaagcaatcctcctacctcggcccctcaaagtgctgggattacaggcatgagccaccatgcccggcctttttcacatttctaaatgccttttattactatttcaaatgccagcaggaatacagagataaaaaagcaaaatcttcaaagcctagtccaggtctcacttggcttgttttagatgtttgcctacagcagtccaagtggcattaccagtaaagccacctggattcccataataatgcagatatgtaagatacacagattattttagaaccccatctttgcctttgttgttttgtttttgttttgttttgttttgtttcattttataaaatgatgtcttctagggaacgtgtctacaatctgaaatcccatctcataacctggcttccccttgtgatgacaaatcttaaatactgtatatttataattggcttagggggaactggtaagcctcgaacacagaaacatgagcttggtgccatcagagagtttgctttttatatcatttattttggcctattggcagaagaagaaagagacggacattgtgatcactcagtctcttagattagagaggccagctagtattgtggccataaaaaacctactcagttttcagagtcaactgtctaggtcttacattgcaatataaataagattaagttctgcctgcctgcatgacagcagcatgtgccatgggtcacgtggggggtataatgaccttctgcctctgttcataggctgtgctactcatggacgccgaaaagcgtatccggttactgcagtttgtcacagggacatcgcgagtacctatgaatggatttgccgaactttatggtgagcaggataccattggattcagttgtcctcctgggaatttccagccaggcatgaactctggcccaagaaccctgccgccaggcctctgcagaaggctaagtttcaggacagtgtgccatgcataggttccatgaaagttcaatgaaagtactgttatctatactttatatagataacatggtgcttctacttcgagggattggggggcagtttgtgaagaggtccataaggctgctcttttttttttttcctagtttagttttttagtaaatcgttaaaaactaggttttgtagggtcatttatatggtcgtaaactgaggtataaagtcacctccagtaggcagaatttttcagtgtttaccatagatttaaaaatcactctgtactttgcatactgaaagtcacatttcattcaccctcccacccacaaaactagtttgaagtttaaatttccagggcccagctgagaggctgtagctgcctgcctttccacgtaactgttgtgtttgttaatcttggtgcagttccattctggagactaagcagagtctttctgtgaggttgtgcagacctctggcttccctcaacattaaatatcaatgttgcagcagaagagagtgtcttgggcctcacccctgggggcaaaccctgccctgacagtagctggactgcagaccacaccatagcttcattcttctgccccaagcaatcttaacatttctttttcttttcttgtctaggttccaatggtcctcagctgtttacaatagagcaatggggcagtcctgagaaactgcccagagctcacacatggtgagtgacaaaaacacatgcatgtcaatgcaatatctgaactgcttagctgggtatggtgctgggctcaaggctattgaatgctctgtttcctgtctgtaagtagcttagagaattaaaggacagtgatgtggatgaaaatagaaattgtacagtagtgctaataagacataatgcactcagtatgtttggcacataaagggctcaggcctccctgctgtggggaatttctcctctgagcccagtccttccctcattattctaggtagtggagctttcactgttcagcatacatagataaggcagctctcaacctgtataataaacacgttgggtttttactccaaccttaaattggttgagaagttaggacaaaataccctgtagaaacatcctttttcaaaggccttctatgcccatgaataacctgtaattccctggaattgagcagtaacatgactgtggtcggaggagggtaagagggctgacacgtggccagggatgcccaagcgtggagcgtggctgccctcagaaggccctctcaggaggcacagtgacgcagaagggtcccagttgttttctgaacagttgcatgaaacccagcacaaatgcagactggatgggatcagtttcttgaagccgggttcagggagctcttgctaactcaaactcccatgtccctcgtgttggtttttctgcaaaggcctttatttcttgctcctgaggaagcagcagaagtgggccttctggaaaacggtgagcagcgtagccctgtgtttctcatgcagcgggggctgcaaagcctgctctggccatagtgagctaacataagcaaccaaacactccctgcaggaaacgccctcccttacactagaagtgctggccaggagagaattctcatgaacatgtgtttgcgaaaaattggctgtgaaaggtttttcacttctgtcggattcccttgcctcaccagaaaggtgttttttttttctattcgtaccattcacgtgactctccagatggaaacaatgtggtcattgcctgtcagagccttgaaagcaagctgactccagcctaaaattcatgaatattcagagcagtcattgtccgtggttctctggctttattctaagggaagaatgtttgagtagttcagagcttttatccaaatggtgtccaagtcatatgtggttttctgggttctactggcctccatatgaaggcaccagcgttgagccaagccccaggactgtgggtggtgatgcgaaactcaagctcataatactaaccaggatgaagattaggaaaagcgaaattattgggcacagtcatcatctgtggtcaggcactgcttaatctttatggcagccttatgagatatgttattcccttgggctgtcagaaggctggcccagggctcaccagagtcacagattcccagatcacaggatttgaactcagagctaccagaattagagcctgcaccctttaccactacaccagatacactgcctctgttgatatacccactttctttttagacttttccaaggaaaccaaattagtgaaccaatttcatgttcattcagcccatgtttctctgtgacttcagggacacatatcttactattgaactgtcttttttatttcggagcccacatgattctgccacaagtagaacttcccagataagacctctgaactcagtggttctcaacctcagctgcatgttggaaccatctagagagccttaaagaaatcactgatgcctggaatttggacttcattggtctggtgtgtgacccaggcagtgggattttcaaagctccccagatgatttttataggctggcagggttgaaaattcacagctcttccctaggaagggcaaagatccacctacaggaagggaacaacccagctggctcttaccagaacttattttcctctttatgtgtcacggaaataaagcaactgtgtagttttcctaatgatgttctccccagactaacttgacccggatggagaggactggcagttgcaagcaacactggctagcatgagtgggactgttctgctgtttcttctaaatggctttcctccctacctgaccctgactgtattttgacataggaaacagaaacttcactggctgtttcgtggcaacagttctgccataaaattttgccatacataggtttaatttcttccacgttttatgatacacaattaaagttcagaataaaaatctgatttcctagaagagcagaagctgaaggatctggttctctgtgatgagggtacctttcattaagctttccaatggtgattattgagtgtctgacattcaaaggacttcatttcattgttctataaaaggtcactactcagacatttaaaattactcttcattaagaatcacaggcccacctgcccttttaggtagactctaaagcaaacaaaaatcatctcgttcagcccatgcatcttccacgtgaggacgctgaagccctgtgaggacaatgagctccttaaagtcacccagctcattagtgcagagcaaagccaggtccgtgtgtcctgacctctgaaatgataggaactcacactcaccaagcactctgttcattccggggatggtgctcagcacttgatgcgattgactcataccatcatcacagtggccctaagaggtgggtgatgttatgacccacttttttacagataacactgggatgcaaagcggtgaagcattaagcagcatgattcagaacctcagatcttgacatcccgtctttgcctctctcttcatcatgccagtgtttctcaaacctgaataatctgtgcaccttttttaaagggaaaaaatggtcacagattctcaagaatgggcctgagacccccatagggattgcaggcccgggactgtgaaaccccagctgaaaagcctgaagccactttcggtgaaaggctcttttaaatgccatctgtagatgtgaagtcctgtctttattaatatgataatagaaagttaaaagcctgtattagtacttgctcttttaggattcctgggttcctgagaaccccagtttgagaagcacagtgttattctctgtcttttagtgtttagtggctgttagagaatccaagtggaactcagtgggacttattcaatatttagtggttgttaaacggccctctacggtatgtgtttcttttctgttgctgtgacaacggttagcttttagtatatgtgcaagtgctgccaaagcgagcacgtgaatggttagcttttaaaacccaagaagttactttgctcattcttggaatcacacatcaatacctggagggggcggttttaaacacagtttgagcactcgcggcagaggcagcacaagtgcacttcaagagctgggctttggagcaccccagggctgtacctggccccgtgtgaccttgggcaagttacctaaccttgctgtgtctcaagctcctcctctgtgaaataggggtgaagcattagctgccttacaaagtgattgccagggttcataacattgagacaaggctgatggggcatggtgagcactccatgaacatgagctcttacgtcataatgagctgtggcaagtgtgcatgccattttcatgacagatacacatcagcaatcaccccccaacacatacacacacacacagaggtgcaggttctgtggctaaaggctctggtcttgagccccatgtagacatacagtaaatgttgaaaggtgttaacactgataccatctcttgagtaattgagcccttgctgtatgccgggcccactgatccgatccacttggcactcatatgtgcagtttccccatgtcacagaagcacagaggccatccatttgtctgaaaaccctcactattgccagggcgatttgcagcccccgcccccacctgaagcctccagatatgtagggactttttctaaatgcaactttacatagcaaatgtcaattttgcctgactttgatcagaggaggtagcttagcactggtgttcccgagccccggacagcctgggttctgtttgtgggtctgccgtttgacaaagactgtgacctcaggaaccttgccctatgtctctgctccaggagctcctgtgcagaatggagataacatgacctgcttcatagggttgtgatgaaaatgaagtgagttaatagggagaaaagcacttggcttgaggcctagtgtggaataagtaatagtattagagatagacacagtcttaattcgtgggtaactccaaaagcatcagctctgtgttccaagggtttggaaatcttgccggttactcccttcccaccaggattcctccgagatctgcatctgactatagcaaaggtttcatggaccatttgaaaatgttctttctctgtaaattacaagagcttatttagtgtggatgtttcatagctagaggtttttggggtttttttctccaggtaatcaaaattgttggttaaggcttttttattctcttactcaaacctcatgccctattaaccagatcgaggaagtgctgttgtggcttttcacctacactttttgttccttttgcagctttaatcgccttgacttacctccatatgaaacctttgaagatttacgagagaaacttctcatggccgtggaaaatgctcaaggatttgaaggggtggattaagcaccctgtgcctcgggggtggttgttcttcaagcaagttctgcttgcacttttgcatttgcctaacagacttttgcagaggcgatggcagagagcagctgcaggcatggtccctggagccgagccttcaccacgcactcgtccaagttcggatgcgggaacctggtcccagcttgagttcctgcctttcccaccacaaattatcaactggttgatgtgtacactaattacatttcaggaggacttaatgctatttatgttgtgcctctgcaggcaaagcccttaataaatattttacatcctttctaatgacaatgaatggaattaatcactcaacaggtatagtattacgactcatgtttactttttaaaatgatttagaccgattttcagattttatttcgttatgattaaagatgtctcatgtacttggaaaagtgagcattttttttttttttgtatttcactttcataccaggcttaatgtcaatgacatttttatttttgaagtactctgacacctccaccctctactttattagaattggaaggcaaatttttgtccaaaaacctacagacaagtactttgagagaatttccaatataatattagacataatgataattttttccatactcagaatgaaaaactggatattacgtttttgttttggggtttttttgtacaaatttagctaatagctacaggctgagagaattgtaacatagcatgacaaattttgtgttgacttgaaaggaatcacaccattattccttagaagtaattacatgtgttctaacacatttgagacagggttggactcccatttctcatccgagaaattacttaacccttcctggcgctgtacagtcatcttttattctatttcctctttgctgtttgtagtagagacattttgaatgaaacttggcactgcttgattcaaaactgtggaaaccagatctgtttagtctcctgtttgtatgcgtttgctaatggtagctaaataaccagtttttgttgtaaatgcaccaattctgaaggcactttatgtactacatggaggtcatatctggttttgtttttatttttttatcatgaacattaaatgtgatgatgatttcttttccctgcacacatctttccggtgcaatatctatcaattgtgaatctggctgctggtgtataaaaacctggatgtaaagctgagcctacagacctgtcctcaccaactgttttgtgatttctactcaactacaaagatttatttaatgtactcttaatctaactgagttttgttaccaatgacctgttgcatgcttcaataccgtgtactgcctgagttgtgcctcttgtgtgctagattaaaagtgagacagagacttgacttgatcctctgagctcaagctattgagctggtagtggcagaggactgagggtacctgcacagtttgattcttttccacgtgtaagtctccattgcagaattgtcgtgctttgagaaaacacctgaggcagtgtgggagttgaacgaccctgctgtcctttttaacctgtgttgtcctagaccctgtcggggcagtcaggggacactagagatttgatctcatgcgagtcatcaataggacaaaaaagttgtggtttggggaggtctgtttgttacataaaaaggacctttcggtgtaagaaattgccgtttttaccctgccctggctggcatgtgagaagccatggaaggttgtggttgtaaatgagttgtctaaaggggtgcagaggcctgaggtttctaaaagaaggtagatttctacagagctgagtgttggttcctttttcttattggttgaaaattacctggtagtgatcagaaaacttagatgctatgtaact

SEQ ID NO: 37710 - DNA, 55640 bp, Homo sapiens; identical to SEQ ID NO: 36307

SEQ ID NO: 37711 - DNA, 205998 bp, Homo sapiens; identical to SEQ ID NO: 37565

SEQ ID NO: 37712 - DNA, 14750 bp, Homo sapiens; identical to SEQ ID NO: 36877
